United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 41

SEQ ID NO: 184061 - protein, 545 aa, Glycine max
  Coding DNA Sequence Number=SeqID_67283
  Gene Ontology: Mol. function=transporter activity; Cellular component= membrane; Biological process=oligopeptide transport
  Homolog annotation: Hit_ID=Q1SIG4; Match level="QueryCoverage=99%, HitCoverage=99%, E-value=0.0, Identity=83%"; Hit description=TGF -beta receptor, type I/II extracellular region
  Pfam annotation: Domain name=MFS_1; Domain location=1-474; Score =13.1; E_value=8e-05; Accession=PF07690.6; Description=Major Facilitator Superfamily
  Pfam annotation: Domain name=PTR2; Domain location=60-458; Score =306.9; E_value=3.7e-89; Accession=PF00854.12; Description=POT family
  Pfam module annotation: Pfam domain module=MFS_1::PTR2; Domain location=1-474::60-458
IETSERLSYFGIATSLVLYLTKVMHQELKTAARNVNYWAGVTTLMPLFGGFIADAYLGRYSTVLASCFVYLIGLVLLTLSWFLPSLKPCGDTNMCTEPRRIHEVVFFLAIYLISIGTGGHKPSLESFGADQFDEDHDEERKQKMSFFNWWNCALCSGLIVGVTLIVYIQDNINWGAADIIFTVVMAFSLLIFIIGRPFYRYRVPTGSPLTPMLQVLFAAISKRKLPYPSNPDQLYEVPKYNSNNRRFLCHTNKLKFLDKAAIIVDDGSSAEKQSPWNLATVTKVEEMKLIINIIPIWVSTIPFGMCVAQTATFFVKQGTQLNRKIGNGFEIPPASIFTVAALGMVVSVAIYDKILVPVLRRLTQNERGINILQRIGFGMLFSIATMIVAALVEKKRLEAVERDPFKGSLTMSVFWLAPQFLIIGFGDGFTLVGLQEYFYDQVPDSMRSLGIAFYLSVIGAASFLSSMLITVVDHMTKKSGKSWFGKDLNSSRLDKFYWLLAAIATVNLFLFVFVARRYSYKNVQKLAVADCYEGKSDCEGAETKV

SEQ ID NO: 184062 - protein, 152 aa, Glycine max
  Coding DNA Sequence Number=SeqID_67284
MEDILSSMLRQQRLLSNQLEMLFEHPEIMQLGASHPQAINCDFYGGEHSMIVVIFTPWKILGGEQELHFYKQYEEETLSNLENVLMEENFVEVKAHEDSLVEEHDSREKEEEKKKRKALDILHQWSPLLLEEQWQRNGHERNIIGDATSRIR

SEQ ID NO: 184063 - protein, 63 aa, Glycine max
  Coding DNA Sequence Number=SeqID_67285
MTLGQITYCGHKTYEPKSLISLKCLIAKEITWLIRKPSILSSKIASTIGTVVLTISSSNIIML

SEQ ID NO: 184064 - protein, 58 aa, Glycine max
  Coding DNA Sequence Number=SeqID_67286
EACHAIAERLERHLNLGIVTPGTEIHEVIEQCLRIARGVTEDRIVYVRSRCRRRTDQP

SEQ ID NO: 184065 - protein, 41 aa, Glycine max
  Coding DNA Sequence Number=SeqID_67287
MDGVTGECTQSRDLFAKRRQFSELSMCSWINPSEILENTLG

SEQ ID NO: 184066 - protein, 263 aa, Glycine max
  Coding DNA Sequence Number=SeqID_67288
MCVEKGPVAFNHEQYNGSLPTLILRPQSWTKCIMVDEDAQKKVLSKLIVIMNVGAERKVKKVKSCFSLLLRIKAHRKKVSIWRKACEKSRHLEMVLTDGREVKFQLPNGNAARVDFNLKDLKKYVCFNFCHARVKPPQGMLSCLWYVTPIHGLTISNSLYGSKLLINYEVLNFSIYKERLSFACLGEPSNGSDFSELDRFLYKSKVLNLSRICDAADGVAEITKPSCYKTQASQLELSQIKDLRRFDQSLPHIKPEFTYIYQL

SEQ ID NO: 184067 - protein, 164 aa, Glycine max
  Coding DNA Sequence Number=SeqID_67289
MQGLERTTCQYRKTRPETCSGEDDEAARIGPVNFRRLEGDAWPSHAEVGTRLWRRVTARGRDFGHATSKAIAHGNANGGDKHGVNDGNANGEDDPARTATATYTEILVNAGNGQKCKYVLETMKSQKMGQNGALPSRCNSSVRMAAIWAADCNVTHMILKCSTN

SEQ ID NO: 184068 - protein, 122 aa, Glycine max
  Coding DNA Sequence Number=SeqID_67290
  Homolog annotation: Hit_ID=Q1SXC2; Match level="QueryCoverage=48%, HitCoverage=3%, E-value=2e-12, Identity=63%"; Hit description=IQ calmodulin-binding region; Myosin head, motor region; Dilute; AAA ATPase; Myosin, N-terminal, SH3-like
MKKLQSALQVMQLQFKETKLLVQKEREAAKREAERAPVIQEVPVVDHALLEKFTSENEKLKGDQSGSRCFARMLQPYGINIGLKEHSNPVTPKAYTPKSSSGPLPPDSGPTPKIILAHKHCS

SEQ ID NO: 184069 - protein, 127 aa, Glycine max
  Coding DNA Sequence Number=SeqID_67291
MGNRKVLCRKISGNLKAVAGKHAEKDGGRMGDWKVLRSNAKHIKKWTVGCPKSQTKQYLEEGATSAVEAQPKTVHRALEKSVDDNADGGVTGQKGHQSSSGRQQRMAVAAGKGGKSPKRGAASRKVN

SEQ ID NO: 184070 - protein, 280 aa, Glycine max
  Coding DNA Sequence Number=SeqID_67292
  Gene Ontology: Mol. function=sequence-specific DNA binding; Cellular component=nucleus; Biological process=regulation of transcription, DNA-dependent
  Homolog annotation: Hit_ID=Q1SIG3; Match level="QueryCoverage=92%, HitCoverage=40%, E-value=2e-32, Identity=41%"; Hit description=POX; Homeodomain-related
  Pfam annotation: Domain name=POX; Domain location=181-270; Score= -16.4; E_value=1.5e-05; Accession=PF07526.2; Description=Associated with HOX
MAEEGFEHYHVPQQSRRNKLRVFPEHQPYCFVESSSTCPTLASLYDPSLIIPSDLLACATQQGGGGAAAKEQEGSNLMMGFVKGAVVNGDAIQVIINNNNPLYQLQNLREYGDTYNDGSEMMVFKPEPLSLSLSSHSNSTHHYPLELNLQRYGAVNPGLVGGNSEVSRNSVPLGPFTGYASILKGSRFLKPAQQLLEELCDVGVRGIYTTEKIIAPDASLMEPPREGFSASEVVGGDDPLGEYQNYGRMKKCRLLTMLDEINFVQEWILDFSLSGFSFWP

SEQ ID NO: 184071 - protein, 98 aa, Glycine max
  Coding DNA Sequence Number=SeqID_67293
MPKMLLPISSSLKSWVQSELSVKVKGTVFIVAVVCSTSATNEMDEDQWMYDSIMSEEVYMDYQTEEECGVNEPHVDCSYAFNTSQVFMIVFDSRDDVL

SEQ ID NO: 184072 - protein, 275 aa, Glycine max
  Coding DNA Sequence Number=SeqID_67294
  Gene Ontology: Mol. function=sequence-specific DNA binding; Cellular component=nucleus; Biological process=regulation of transcription, DNA-dependent
  Homolog annotation: Hit_ID=Q1SIG3; Match level="QueryCoverage=98%, HitCoverage=51%, E-value=2e-92, Identity=65%"; Hit description=POX; Homeodomain-related
  Pfam annotation: Domain name=Homeobox; Domain location=59-117; Score =4.9; E_value=0.0015; Accession=PF00046.19; Description=Homeobox domain
MSKPFRCLKNAITDQLQFINKAPFQISNRKDESPRFHSSDRGTHSQRPGFLEHQQPVWRPQRGLPERAVSVLRAWLFEHFLHPYPTDTDKLMLAKQTGLSRNQVSNWFINARVRLWKPMVEEIHMLESQQGQKRSHWEERSKKNLSDHLPSDHNSVVTENPSTSMEKFHDAPYKHPRNELANKQVRSQEQLNQTNTGNQQVMGVGVSNNGVSLTLGLHQNHHGIGLFEPFGMSAAQRFGVALQPEGYVLSSFESQNRHFGRDVIGGGQLLHDFAC

SEQ ID NO: 184073 - protein, 457 aa, Glycine max
  Coding DNA Sequence Number=SeqID_67295
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=31%, E-value=1e-110, Identity=43%"; Hit description =Chromo
  Pfam annotation: Domain name=Chromo; Domain location=327-381; Score =34.9; E_value=2.8e-07; Accession=PF00385.14; Description='chromo' (CHRromatin Organisation MOdifier
  Pfam annotation: Domain name=rve; Domain location=75-231; Score=98.6; E_value=1.9e-26; Accession=PF00665.16; Description=Integrase core domain
  Pfam module annotation: Pfam domain module=Chromo::rve; Domain location=327-381::75-231
ALRELCLQNKAPDPHYSVQDQLLYWKGRTLSRIASQFYWKGMHKDVKEFVQQCLTCQQAKSGTMLPSRLLQPLPIPMQIWEDLAMDFIIGLPPSNGFTVILVVIDRLSKYAHFFTLKSDYNSKQVAEVFVKNIVKLHGFPKSIVSDRDKAFTSQFWQQMFKLSGTTINLTIAYHPQSDDQSKALNKCLEMYLRCFTHDSPKEWAKLLPWVEFWYNTAYHNSSGMTPFKVVDLTLSKLKQNLIKAQAHMKKYADMKRRQVEFNMGDLVLVKLQPYRQHSVALRKNQMLPPTTKIHPVFHASQLKPCKGDHPQSYIPLPITNDEVDLVIQPARFLKERVVIKGQQQVQQKLVQWQGFEENQATWEDNAALQQAFSDLNLEDKVHFKGGGIVTMKGRAERTLDKEEGEEHVMEEARELRRGARPKIPNSKLKDFYWHKERMMAVGGDAAAEGNGVVVGNK

SEQ ID NO: 184074 - protein, 89 aa, Glycine max
  Coding DNA Sequence Number=SeqID_67296
MSITCQKPQPSLASTRGMRHNHESHNTTMASIDNQLLWYRRNNKIGLGESTRLTEEGSNDDSRNGEDNDRVAKVVNKESKAEKEACEEP

SEQ ID NO: 184075 - protein, 45 aa, Glycine max
  Coding DNA Sequence Number=SeqID_67297
MPMNKINLSHRVCDVSMGYQEDVLAAQVWNCGSDRDILTTITSQG

SEQ ID NO: 184076 - protein, 573 aa, Glycine max
  Coding DNA Sequence Number=SeqID_67298
  Gene Ontology: Mol. function=oxidoreductase activity; Cellular component=intracellular; Biological process=lignin catabolic process
  Homolog annotation: Hit_ID=Q2LD62; Match level="QueryCoverage=92%, HitCoverage=92%, E-value=0.0, Identity=60%"; Hit description =Putative copper ion-binding laccase
  Pfam annotation: Domain name=Cu-oxidase; Domain location=157-309; Score=151.9; E_value=1.6e-42; Accession=PF00394.12; Description =Multicopper oxidase
  Pfam annotation: Domain name=Cu-oxidase_2; Domain location=420-557; Score=178.7; E_value=1.5e-50; Accession=PF07731.4; Description =Multicopper oxidase
  Pfam annotation: Domain name=Cu-oxidase_3; Domain location=32-148; Score=200.9; E_value=2.9e-57; Accession=PF07732.5; Description =Multicopper oxidase
  Pfam module annotation: Pfam domain module=Cu-oxidase::Cu-oxidase _2::Cu-oxidase_3; Domain location=157-309::420-557::32-148
MKLFSFSLACVFVFALLASSLASAAIVEHIFKVQNTTIKRFCKEQVIVTVNGLFPGPTINVHEGGTVIVHVLNEGPYDITLHWHGVLQLFSPWADGPEYITQCTIRPRSKYTYKFNVTQQEGTVWWHAHASYLRATVHGAFIIKPRSGRFPFPKPYKQIPLILGDLYNSRVEDITTEAQASGGGPNISYAFTINGLTSGHLMNCTENETFKMKVKQGKIYMLRMINAALNYDLFFKIANHNFTVVAVDASYTDHYVSDLIVIAPGQSVDVLFTANQPTGSYYMVASPYVVGLEDFDANVARGTVIYENAPPSSKPIMPVLPPFNDTDTAYTKFYNVITSKVRAPHWVPVPRKVDEHMFITIGFNLELCDSKNPNNATCKGPNGHRFSASMNNESFSVPAGVKLSLLEAFYKNKSSVYTRDFPDKPPVMFDFTNLNDANNTNLLFAPKSTRAKKLRFNSTVEVVFQNTALLGGQNHPMHIHGYSFHVLAQGFGNFNRKDRAKFNLVNPQLRNTVGVPMGGWTVIRFQANNPGVWLVHCHMEDHVPWGLAMIFEVENGPTPLTSVPPPPADLPKC

SEQ ID NO: 184077 - protein, 189 aa, Glycine max
  Coding DNA Sequence Number=SeqID_67299
  Gene Ontology: Mol. function=phosphatidylserine decarboxylase activity; Biological process=regulation of GTPase activity
  Homolog annotation: Hit_ID=Q1RU67; Match level="QueryCoverage=82%, HitCoverage=96%, E-value=2e-71, Identity=87%"; Hit description=C2
  Pfam annotation: Domain name=C2; Domain location=8-87; Score=107.9; E_ value=2.9e-29; Accession=PF00168.20; Description=C2 domain
MVEFVGLIKVNVVKGTHLAIRDVMTSDPYVILSLGHQSVKTRVIKSNLNPVWNESLMLSIPENIPPLKVLVYDKDTFSTDDFMGEAEIDIQPLVIAAKAYEKLNINESMQLGKFVASKDNTLVRDGIISLDEGKIKQEISLRLQNIERGELELELEYDNGKEYTSTQFPMLCEEAGIEQLTAPYTINKI

SEQ ID NO: 184078 - protein, 82 aa, Glycine max
  Coding DNA Sequence Number=SeqID_67300
MHMMIDGCRDNFFFLVETDGLGPSHERKDPRERHRRLTVSARGHQHPPIEPKLEPKPQTVTRAYDRIIVPPFGRGPVDVSLI

SEQ ID NO: 184079 - protein, 162 aa, Glycine max
  Coding DNA Sequence Number=SeqID_67301
MKNGCYTSEGNGFCPLKLQFVKAVHVKLCVSRATWAWKEGVYRKWVGVMMMFLQRLDCIPYVCLSRKGRLKSVMSFLVNELGFEASHVARCSVVLSLSFGKQIVPRGSVVLVLKSKGMVKVSLGGIFKCDEKLFLDKFIYGHDEKQTEELLKLYKDKMTLAG

SEQ ID NO: 184080 - protein, 99 aa, Glycine max
  Coding DNA Sequence Number=SeqID_67302
MSSCTFTIHPNVATAWAATGRVCTKWRLHLLDSARRNAELVEPQSYTRGHKSSSDHITSSPIAAGGLRSWVQLRKAKEDGCQGQQEGWQRQIFIVLTFF

SEQ ID NO: 184081 - protein, 308 aa, Glycine max
  Coding DNA Sequence Number=SeqID_67303
  Gene Ontology: Mol. function=DNA binding; Cellular component=nucleus; Biological process=regulation of transcription, DNA-dependent
  Homolog annotation: Hit_ID=Q84XV2; Match level="QueryCoverage=98%, HitCoverage=83%, E-value=3e-61, Identity=40%"; Hit description=IMB1
  Pfam annotation: Domain name=Bromodomain; Domain location=49-141; Score=97.5; E_value=4e-26; Accession=PF00439.15; Description =Bromodomain
MSCMQLEEQVAEVQKYYSTINDQVNNAKDKSQEKHVIGTKRSRQGGSSKEANSSNTMKEITQHRWAWPFMDPVDVEGLGLSDYYQIIEKPMDFGTIKRKMDAKDGSGYKNVRQIYSDVTLVFKNAMKYNDEKTDIHIMAKTLREKFEKKWLQLLPKVAQAESEKEEARALLKAKLAEEAAYANMTKDIRHALCDVDEQLKNLKEMVIKKCRKLSTHEKLALKKNLNRLNGDNLLKAMAIIHEIDPTFQHDAPQVDLDLDCQSDFILWKLNMFVKEALEDQDKAVAEDMAVNHNVNTQDQKNTNKRRKL

SEQ ID NO: 184082 - protein, 411 aa, Glycine max
  Coding DNA Sequence Number=SeqID_67304
  Gene Ontology: Mol. function=nucleic acid binding; Cellular component= intracellular; Biological process=DNA integration
  Homolog annotation: Hit_ID=Q1SLU0; Match level="QueryCoverage=99%, HitCoverage=45%, E-value=1e-124, Identity=51%"; Hit description =Peptidase S8 and S53, subtilisin, kexin, sedolisin; Integrase, catalytic region
  Pfam annotation: Domain name=zf-CCHC; Domain location=124-141; Score =13.0; E_value=0.0072; Accession=PF00098.13; Description=Zinc knuckle
MKESETINEYTNMLLSIANQIRLLGSEFFDSRIVQKILVTFPERFDATIFVMENSKDLSKITLTELHNALQAQEQRKLMRSEDSMEGALQANLQTGEKNRDFPPCKHCNKKGHPPFKCWRRPDVKCGKCNKLGHHERICKSNSQQKNDAQAVSKQEEEQQLFVASCFTSSSSSSSDCWLVDSGCTNHMTNNEELFRYLDNSQVSKVRIGNGDYITVKGKGTVIIESSTVGQLLEKGFKVFFENKQCTIKDPYDNEVIRIKMRGKSFSLDLMKEEQAAYTAAMTNTETWHKRLGHFHHTTILNMQKKELVRGLPHIELNLPSCKACHFGKQAKLPFQKKAWRANMKLQLIHTDVVGPHKAPSLNRSKYYIVFIDNYTRMCWIYFLMFKSKVVGVFFKFKNWIENQSGLRIKF

SEQ ID NO: 184083 - protein, 365 aa, Glycine max
  Coding DNA Sequence Number=SeqID_67305
  Gene Ontology: Mol. function=nucleic acid binding; Cellular component= endoplasmic reticulum membrane; Biological process=DNA integration
  Homolog annotation: Hit_ID=Q1SIY6; Match level="QueryCoverage=99%, HitCoverage=40%, E-value=1e-86, Identity=53%"; Hit description =Integrase, catalytic region; Zinc finger, CCHC-type
MEMVRCMLPEKELPKEYWAEATIVVFLLNRLPTKVVDGNTPFEACGVGTMKKNQQTDDLNQEGLVDHSPVRNTRLIADIYQRCNVAMLEPAGYQEAEKDPKWKDAICKARYNQNVTSHCSTNQWKIYQLDVKSAFLNGFLKEEIYVEQPEGFDAKGDEDKVYLLKKALESTLYVKGDSDNFFVVSLYVDDLLVTGNNIELIQQFKEDMMQVFEMIDLREMSYFLVIEIKQIENEIFIYQQKYVKEILKKFRMGNCKSKNTPMCQKEKLCKDDGTTKVDEFEYRSLVGCLMYLTTTRSDIMNVVNFLSRFMNCANESHLRAAKRVFKYVKGSVSFGVKFCLTPSFELQGYFNSDWVGSLDDMKNTP

SEQ ID NO: 184084 - protein, 866 aa, Glycine max
  Coding DNA Sequence Number=SeqID_67306
  Gene Ontology: Mol. function=DNA-dependent ATPase activity; Cellular component=nucleus; Biological process=DNA replication initiation
  Homolog annotation: Hit_ID=Q8H1A3; Match level="QueryCoverage=99%, HitCoverage=100%, E-value=0.0, Identity=77%"; Hit description=Mini -chromosome maintenance protein MCM6
  Pfam annotation: Domain name=AAA_3; Domain location=393-534; Score= -13.8; E_value=0.01; Accession=PF07726.2; Description=ATPase family associated with various
  Pfam annotation: Domain name=AAA_5; Domain location=393-540; Score= -10.6; E_value=0.011; Accession=PF07728.4; Description=ATPase family associated with various
  Pfam annotation: Domain name=MCM; Domain location=335-659; Score =688.6; E_value=4.5e-204; Accession=PF00493.13; Description=MCM235 family
  Pfam annotation: Domain name=Mg_chelatase; Domain location=360-548; Score=-147.5; E_value=0.015; Accession=PF01078.11; Description =Magnesium chelatase, subunit ChlI
  Pfam module annotation: Pfam domain module=AAA_3::AAA_5::MCM::Mg _chelatase; Domain location=393-534::393-540::335-659::360-548
MEAYGGFMIDEKAVRVENAFLDFLKSGISSFKSSSHRNELYYEAEIELMKSNDSNTMFVDFDHVIRFSDLLQQTISDEYLRFEPYLKNACKRLVMDLKPSIVSDDSPDKDINIAFYNMPIVKRLRELGTSEIGRLVSVTGVVTRTSEVRPELLQGTFKCLECGGVIKNVEQQFKYTEPTICTNATCSNRTRWVLLRQESKFADWQRVRMQETSKEIPAGSLPRSLDVILRHEIVEQARAGDTVIFTGTVVAIPDIMALASPGERSECRRDASQRRGSTAGNEGVSGLKALGVRDLNYRLAFIANSVQICDGRREIDIRNRKKDADDDNQQFTDQELEEIKRMRSTPDFFTKLVESIAPTVFGHPDIKRAILLMLLGGVHKFTHEGINLRGDINVCVVGDPSCAKSQFLKYTSGIVPRSVYTSGKSSSAAGLTATVAKEPETGEFCIEAGALMLADNGICCIDEFDKMDIRDQVAIHEAMEQQTISITKAGIQATLNARTSILAAANPAGGRYDKSKPLKYNVALPPAILSRFDLVYVMIDDPDDQTDYHIAHHIVRVHQKREGALAPAFTTAELKRYIAYAKILKPKLSPDARKLLVDSYVALRRGDTNPGSRVAYRMTVRQLEALIRLSEAIARCHLDNEVQPRHVRLAVKLLKTSIISVESSEIDLSEFQEENHDDGAGGGDGNDKNRDANDQVGNDAAAQQAAGNANDQVGNDATQQTANDQVGNDAAQQPAGNNGNSADGSKPQVRKLVMSDEYYQRVTSALIMRLRQHEEAVVQGNGLSGMRQKDLIQWYVDQQNERNNYSSMEEVQAEISKIKAIIESLIRREGHLIVVDDGQAAAAAAEPPGAPRNYRILAVAPNYVID

SEQ ID NO: 184085 - protein, 38 aa, Glycine max
  Coding DNA Sequence Number=SeqID_67307
MDPTFGVSAPNPNVIEEDLNQLWQSVYENSNRVQKDYD

SEQ ID NO: 184086 - protein, 401 aa, Glycine max
  Coding DNA Sequence Number=SeqID_67308
  Gene Ontology: Cellular component=membrane
  Homolog annotation: Hit_ID=Q5QLF2; Match level="QueryCoverage=77%, HitCoverage=79%, E-value=3e-65, Identity=43%"; Hit description =Purine permease-like protein
  Pfam annotation: Domain name=DUF6; Domain location=68-200; Score=9.7; E_value=0.018; Accession=PF00892.11; Description=Integral membrane protein DUF6
  Pfam annotation: Domain name=TPT; Domain location=218-365; Score =124.7; E_value=2.7e-34; Accession=PF03151.7; Description=Triose -phosphate Transporter family
  Pfam module annotation: Pfam domain module=DUF6::TPT; Domain location= 68-200::218-365
MALSIKNSEIEFVDHEGGEALAHADLVSTMDNTTMQERADQKGIISTSKRYININMPLLVINYACLFVGSLSSSLLSKYYFTHKGSSRWVSTWVQTAGFPLLMIPICVPYLFKFTKRVPFTDFTPRMLIISISIGVMLGFNNLFFSWGNSYLPVSTSALLLSSQLLFNLLFSVIIVKQKITFSNVNCVILLTLSSILLGLDSSHERPKGLNQKNYFIGFFCTIGAGLMFALYLPLMEKIYKKVNCYQMVMEMQVIMEAAATALAIIGMTWDGGFSEMKVESQTVFDKGSRVYWVTVMGNVVTWQLCFMGTAGMVFLTSSLTGGISMTFLLSMNVLGGVVVFRDAFGGVKAVSTFLCIWGFCSYVYGIYKYNQMGEHKFAQTRNKNISSNDSSTEMIHILKH

SEQ ID NO: 184087 - protein, 155 aa, Glycine max
  Coding DNA Sequence Number=SeqID_67309
MIGNRYGTLAAYDLSTWNSLFLTQLSAPRILSSHLTDVVASFDHDLRFLVTQGVILWSIPLLSYPNFVWGQLFVNMRTFADQIEVLKTHRRVTRKVRDVSEGNKPKTQKWGSELINLGGVPSPGPIWNILKGGYFRWKLSSPGRAGRQPPLSFLL

SEQ ID NO: 184088 - protein, 198 aa, Glycine max
  Coding DNA Sequence Number=SeqID_67310
MRSISSSAFNDLDAVSEPYDEAFKGVMKLHRGKVVKGEEGAVAEPLSEEALTGGSGGGWCDYSILEILEEKSKRKREKIEKCTGAAEEVPSSTDVEVQKADLMEKDQTSAEEVHPSTTIKVRECDSVELQKLVEDSLVNSLEVNEEASIESRDADVPCPHVTNNNEADLIEKDQTFVPHNDDHRPSLMERNSTAHIYE

SEQ ID NO: 184089 - protein, 95 aa, Glycine max
  Coding DNA Sequence Number=SeqID_67311
  Gene Ontology: Mol. function=protein serine/threonine kinase activity; Cellular component=beta-catenin destruction complex; Biological process=protein amino acid phosphorylation
  Homolog annotation: Hit_ID=Q1SPP5; Match level="QueryCoverage=75%, HitCoverage=27%, E-value=9e-25, Identity=51%"; Hit description =Protein kinase
MVDPLTHQVKLCDFGSAKVLPLFPSKNAVDQLVHIIKVLGTPTQEEVCCMNPNYNDFRFPQIKAHPWHKLRHGIIEELAHRYSNALAPKGIRKLL

SEQ ID NO: 184090 - protein, 205 aa, Glycine max
  Coding DNA Sequence Number=SeqID_67312
  Gene Ontology: Cellular component=membrane
  Homolog annotation: Hit_ID=Q5QLF2; Match level="QueryCoverage=98%, HitCoverage=53%, E-value=4e-40, Identity=43%"; Hit description =Purine permease-like protein
  Pfam annotation: Domain name=TPT; Domain location=26-173; Score =136.0; E_value=1e-37; Accession=PF03151.7; Description=Triose -phosphate Transporter family
MSSIILALNSSHEKPQGLTQKDYFIGFSCTIGAGLLFSLYLPLMEKIYERVYCYGMVMEMQLVMEIAATVLATGGMVYKGGFSEMKEEADRVFDKGNTFYWVTVVLSVVTWQCCFMGTAGMVFLTSSLTGGVSATALLSMNVLAGWLVYHDAFKGFKIVATVLCIWGFCSYVYGMYIKREQEEEAKRRNSSGGTTTELIPNGNRM

SEQ ID NO: 184091 - protein, 54 aa, Glycine max
  Coding DNA Sequence Number=SeqID_67313
  Homolog annotation: Hit_ID=Q1T1Y0; Match level="QueryCoverage=75%, HitCoverage=10%, E-value=5e-08, Identity=65%"; Hit description =Ankyrin
MQSLEAVECAYNRKMKQRGHIIQGDGLLSNMKMEIASFLMPPLYKSGYKSPIAS

SEQ ID NO: 184092 - protein, 104 aa, Glycine max
  Coding DNA Sequence Number=SeqID_67314
  Gene Ontology: Mol. function=4 iron, 4 sulfur cluster binding; Biological process=metabolic process
  Homolog annotation: Hit_ID=O81396; Match level="QueryCoverage=57%, HitCoverage=6%, E-value=1e-19, Identity=81%"; Hit description =Aconitase-iron regulated protein 1
MYSYIHKKAQGKVAKFDFHGQLAELKHGSVVIVAITSCTNTSNPSVMVGAGLVAKKAHELGLQVCDPSGRWYLADSGSVPGDLLLITGKALTHIFLSYEIYTLI

SEQ ID NO: 184093 - protein, 81 aa, Glycine max
  Coding DNA Sequence Number=SeqID_67315
MSTMNGGEEARMKQRRRSSNGTAKANETATQGRRGKKMLSFSSTLSIDRKISKIPFRKAHTDSQSGLAIRNLYEHTNYLFV

SEQ ID NO: 184094 - protein, 60 aa, Glycine max
  Coding DNA Sequence Number=SeqID_67316
MVIDSILTSPRLKSPSFRRQFKKDELGASGTCSGLSGAQKASCHMELVKDSVAKGKLKIL

SEQ ID NO: 184095 - protein, 120 aa, Glycine max
  Coding DNA Sequence Number=SeqID_67317
  Gene Ontology: Mol. function=cysteine protease inhibitor activity; Biological process=defense response
  Homolog annotation: Hit_ID=Q8VX72; Match level="QueryCoverage=77%, HitCoverage=94%, E-value=5e-28, Identity=61%"; Hit description =Putative cysteine proteinase inhibitor
  Pfam annotation: Domain name=Cystatin; Domain location=5-93; Score =89.1; E_value=1.3e-23; Accession=PF00031.11; Description=Cystatin domain
MAMIGGISQVEGSQNSATIDRLAHFAVDEHNKKENAVLEFVKVVNVKQQVVSGMLYYITLEAKDGEKNKVYETKVWVKPWLDFKEIQEFKLIGDAPYAAPSEYDCILTPKVLALSMHKIN

SEQ ID NO: 184096 - protein, 914 aa, Glycine max
  Coding DNA Sequence Number=SeqID_67318
  Gene Ontology: Mol. function=RNA-directed DNA polymerase activity; Cellular component=chromatin; Biological process=chromatin assembly or disassembly
  Pfam annotation: Domain name=RnaseH; Domain location=790-910; Score= -28.3; E_value=0.025; Accession=PF00075.14; Description=RNase H
  Pfam module annotation: Pfam domain module=RVT_1::RnaseH; Domain location=550-736::790-910
FPGPRNPGTLYLVYHFGALVAMPDPSNVPASLEDAILKLAAQQLSMGETLQKVTFQLNEILHRLPPTLPNTGPGSSTPALSPSPAQHHRIKIDVPRFDGSDPSGWIFKITQYFEYHATPRGREAYHCCVLYGRPCFGLVPMDERKWPIHVLAGLSSSGPDPVRSFSVRGPYRRPIQAYPTWYGGTIPCRIRGISEPHHMPSSTLPAKLLRVGVVAEHSPRGPGPLATDTRTGGGSRSTSGGEAPRWPQHLPQSPPSTHKNSPSAHTNPPLPFFPHTEPHFPHSPAFDTNPTLATTTHASQPFSCETPHPGRNCLSPGARALLCDEKYHRGHRCASRAFLLVAPETLRFMGFTGDRQVILLVDELGLSTRDTNPLRVMVGNGQQLECTRVCEDVKVVIQNTQFTVDLHVLPIVGANVVLGVQWLKSLVPVLTDYNTLCMKFFHADTFVELKGDTETTLNFISSTQFHQPPSIQDDPTPSPHIQTILDRYHPLFQTPNTLPPQRETDHRIHLLPQATPVNVRPYRYPHFQKQEIEKQVEIMLQKGLIQPSNSPFSSPVLPVKKQDGSWRFCVDYRALNALTIKDRFPIPTVDELLDELGGAHYFSKLDLLQGYHQIRMYPEDISKIAFRTHHRHYEFRVMPFGLCNAPSSFQATMNAIFRPYPRRFIIVFFDDRLVYNASMAEHLNHLEITFQNQVEYLGHIVSSEGVKPVASKVEAILQWPIPHSIKAVRSFLGLAGFYRRFIRGYATIAAPLVHITIKAHFLWTDAAQDAFEKLKQAVSLAPVLSLPDFEQPFTVETDASGVGMRAVLSQQGHPLAFFSKPFPPKLLSASTYVRELFSVTTAVKKWRQYLLGHRFIIVTDHRSLKELLTQVIQTPEQHTYLARLMGYDYQIIHRSGALNQAADALSRIPDHTPS

SEQ ID NO: 184097 - protein, 184 aa, Glycine max
  Coding DNA Sequence Number=SeqID_67319
  Homolog annotation: Hit_ID=Q1SAV4; Match level="QueryCoverage=41%, HitCoverage=19%, E-value=6e-08, Identity=44%"; Hit description =Integrase, catalytic region
MWRYAHFLKKLPQSQLYGVSVQSQEEIYSFLKINYLNFNYVEHRLNLMWRYTLPLKKLSQSHTDTQDKEFLDFEDQGNLHTRDEEEGLIPSTILQHHPQEPQALKHSLSGSIIWSQPFPLHQHLPWVCWGGPPIILDRQWRDERLIVKELVQQLDRNFRLRCSPELLQHRTMKNRVNTSVSRQL

SEQ ID NO: 184098 - protein, 434 aa, Glycine max
  Coding DNA Sequence Number=SeqID_67320
  Gene Ontology: Mol. function=transferase activity; Cellular component= nucleus; Biological process=flavonoid biosynthetic process
  Homolog annotation: Hit_ID=Q1T1I0; Match level="QueryCoverage=98%, HitCoverage=96%, E-value=5e-63, Identity=34%"; Hit description =Transferase
  Pfam annotation: Domain name=Transferase; Domain location=1-428; Score=268.9; E_value=9.9e-78; Accession=PF02458.6; Description =Transferase family
MVTTVASYNVTPYQPTPNDPLWLSDSDQLGVLGHVATIYIYKAKPNSDTIERLRNSLSKLLVYYYPVADRLSLTESGRMEVNCNTKGVTLIEAETTKTFGDYGDFSASGGDSPTAIELTRFLGGEGLAIGVLISHPLTDATGLIHFMNRWAKLTRGEELNPDEMPFLDRTLLKLLPNQASTPSVKLQELKPAPQTLGKEQKKRSVALLKLTSSQIERLKKKANDHPSKEGSRPYSRFEVVVAHIWRCASMARAESGENSNQPILVRFSVNFRNRLKPPLPQNYFGNALAKVATPECYEGDIISNPLGFTAQKIRETSHAITEDFLRSQLNVGLGKWQLDNIRAFVVGQQHLINTPSVGDHNIFLTSLMTMAVYESNFGWGKPVHYGLASLFQVNRAGILPSPDGDGVIVNIFFQEALMKLFRKFFYEDLYVSSL

SEQ ID NO: 184099 - protein, 185 aa, Glycine max
  Coding DNA Sequence Number=SeqID_67321
MLSTFTINNIIVIVVIIKGLKRCVKSNMGFMVSNDLSYNGSNHFFNNGHGNGGLNFSRGGCNGGRCYGNGDGHGDFNEGSVMRLTSSLDMTVVSHLERLTGGGCDNVGGGCGSGVNDDSSDDGIDGGDGGSKVNGGGDFDGNSDNSGGHNNDNGGSSNAFDDGHDNDNGGGGSGCSGHDGGSQLL

SEQ ID NO: 184100 - protein, 113 aa, Glycine max
  Coding DNA Sequence Number=SeqID_67322
MVVTNNGGCNTVGKGRRGVDDEDEQNLAVIKLVDLVAQHPCLPIVVCHSTCDDLDSLCSFLSALPFLSSSTLVSLKLIFFLATNGGAPNEDERSHMIFVTDACLPLFASGEFL

SEQ ID NO: 184101 - protein, 50 aa, Glycine max
  Coding DNA Sequence Number=SeqID_67323
MYKDKYKDNLTDYARRSDTYAKSHANYKFEEKAQGAQADLKGQSVDALPI

SEQ ID NO: 184102 - protein, 74 aa, Glycine max
  Coding DNA Sequence Number=SeqID_67324
MFTHDRPITFIIRLPLQCHNHHMHRASIAIMLQPSTQLNYYTAPPPLLSCHSFTASTNMLPTSLASYHIAETTK

SEQ ID NO: 184103 - protein, 149 aa, Glycine max
  Coding DNA Sequence Number=SeqID_67325
EPSITILRKLLRKIDYKALYYTKVYIFLKNQIENVKNKTFKLVILEEVLLKNAIEHLGQGFVGFKQRAIGYVLVEPFTSFLVESGWAANRSVDCEAQNAIPKSKHTSFVQDQNQRHHHHFDGEVVMHASLGFVWEILVAMVVPMVVQWQ

SEQ ID NO: 184104 - protein, 117 aa, Glycine max
  Coding DNA Sequence Number=SeqID_67326
MQKRWCLDGGGSANLVVLRWLEVFGKRTQEAIDRGHEKHNGRSIDACSTSPLQISIHCEHTYTVMVVCFSPVQLDLLCRRLQHYPHMEDLHEDLSSSRSTKQNLLDLSSSRSTKPKT

SEQ ID NO: 184105 - protein, 462 aa, Glycine max
  Coding DNA Sequence Number=SeqID_67327
  Gene Ontology: Mol. function=transferase activity; Cellular component= nucleus; Biological process=flavonoid biosynthetic process
  Homolog annotation: Hit_ID=Q2HVN0; Match level="QueryCoverage=97%, HitCoverage=98%, E-value=2e-72, Identity=37%"; Hit description =Transferase
  Pfam annotation: Domain name=Transferase; Domain location=1-447; Score=351.4; E_value=1.5e-102; Accession=PF02458.6; Description =Transferase family
MVTIVGSYNVTPNQPTPKDPSWLSDSDQIGVLGHVAIVYIYEANPNSNTIERLRNSLSKLLVYYYPFAGRFSLTKSGRIEVDCNAKGVTLIEAKTSHTLDDYGDFSPSKLTEELVPDIDYTPPIEEIPLLLLQFTRFHCGKGLAIGVVISHPMTDATGLTQFMNRWAKLARGEELNPNEIPFLDRTLLKFPHQPSSQRVDQPELKPVLQLEQKKNARWSGALLKLKSSQVERLKKKANDEPSREGARPYSRFESIAAHIWRCASKARAESGENSNSNHPTIVRFSVNFRNRLLTPPIPENYLGNALARTMTPKCYEGDIISKPLGYAAQKIREAVNAVTGEYVKSQLSVGLGQEQVDHIRAFFMGQGHGTKPAYARDHNILLTSWMNMPVYEADFGWGKPMQFTLAHVFQQVDRVGIFPSPDGDGVVVYLNFETAQLQLLKKLFYADMKKVLLRGVASGSVL

SEQ ID NO: 184106 - protein, 352 aa, Glycine max
  Coding DNA Sequence Number=SeqID_67328
  Homolog annotation: Hit_ID=Q9LU00; Match level="QueryCoverage=60%, HitCoverage=52%, E-value=2e-15, Identity=31%"; Hit description =Arabidopsis thaliana genomic DNA, chromosome 5, TAC clone:K15C23
MASVQVDKTTIEVDDFLVREIEKHRISTMESLQNEKQIMVDPLSLKGSIKYLETTTTMLPTIITTSSSIILHPPPLQPPKPRFLSTSLPNSANSSPRFASPLSKKKPKGESPEPQSQGSNFTHKLQHLLPEVQLRKSKSCGEARAFATSDEFDHWLSKLSALEHDKWHHDNLSKIEVVKESPKSVNKLKHMKTTHAGFKCSALCLYLPGIGGKVKPVKARKEESEKGGAMSRTISLEKFECGSWSSAAICNEIGADSTNSYFDLPMELIKCSANEVYSPVASAFVFERDLKGILKNGSSRNSVRKSDASPRHVRFSTSSSASHPASPASCISPRLRKAREDFNAFLAAAQSA

SEQ ID NO: 184107 - protein, 146 aa, Glycine max
  Coding DNA Sequence Number=SeqID_67329
MMGKSNMDIEKNEHLQWMNMSLPSSQHAVEREHENRHQGSFSKSGTLIKDSGKRMQDEGSKCNALCMCFPCFGFGKAKPVNARKGGIKMDHSVNHVMPSTFSLENFKLNSTQGEGIVIQENNREDDSFSSYFDLPSIVLKCTGDDA

SEQ ID NO: 184108 - protein, 154 aa, Glycine max
  Coding DNA Sequence Number=SeqID_67330
  Gene Ontology: Cellular component=cytoplasm
  Homolog annotation: Hit_ID=Q9LTZ9; Match level="QueryCoverage=74%, HitCoverage=21%, E-value=3e-38, Identity=64%"; Hit description =Arabidopsis thaliana genomic DNA, chromosome 5, TAC clone:K15C23
MSRILSGCVMFLSLVWKVGFDLVLYEFGVAHSCGQVKMWKWGFEKLVYKDSKKGIRRDRKYAVQPRSLYATGVHMSQNLAGKTTHKTEGKIMYYHYHGTIAEKRESCKMLINSTEITYDKTPYVLDTTMRDIAGVIKKFELKMIGDRLQHKTRQ

SEQ ID NO: 184109 - protein, 304 aa, Glycine max
  Coding DNA Sequence Number=SeqID_67331
  Gene Ontology: Cellular component=cytoplasm
  Homolog annotation: Hit_ID=Q9LTZ9; Match level="QueryCoverage=99%, HitCoverage=57%, E-value=4e-65, Identity=45%"; Hit description =Arabidopsis thaliana genomic DNA, chromosome 5, TAC clone:K15C23
MAKEREKKLYVALLGNYAAELKLLLTTLLLLCAVATLLQFLPSRFTISASDLRVCISRVTQTTQTIPNSTNATSPPVTATASASASASPLVASLSSTTSPSPPPPSPPPPSPPSSEQILPDGTIKRVFNPYGSAAYNFVTMGAYRGGLDTFAIIGIASKPLHVYAKPTYECAWFSLAGDKKKLSTTVGYKILPDWGYGRVYTVVIVNCTFPIPVNADNSGGKLVLFASTSGGGDASFNTTDRIEALTEQPRTLDTTLFSSKPKYDYLYCGSSLYGNLNPQRVREWIAYHVKFFGPRSHFVIHDA

SEQ ID NO: 184110 - protein, 89 aa, Glycine max
  Coding DNA Sequence Number=SeqID_67332
MVGSTQRFEMGEKTSLGYKYVYSKWGYKVYKERRLVLREQKNKGNIYYLDVQALKKNPDSKVKKKVKFPIVVEVLGETFVGGGTCSLSN

SEQ ID NO: 184111 - protein, 215 aa, Glycine max
  Coding DNA Sequence Number=SeqID_67333
  Gene Ontology: Mol. function=zinc ion binding
MKENTDIEEGEACYYNVDDEANIDPDSFSYIDEKIQHFLGHFQKDFEGGVSAENLGAKFGGYGSFLPTQERSPCLCSHPRTPQRNHSSPELSINLHMEAVSHNTKASSNGLPARPENASHSSYSFRDLKEASVNDSVKKEQGISSSDIAERCTSKDDSTKKTGNSTDQRPLKFRIKMKSNILAPNNAEIYSGLGLDNSPSSSMGNSPVESEGMPP

SEQ ID NO: 184112 - protein, 59 aa, Glycine max
  Coding DNA Sequence Number=SeqID_67334
MTEGITDAQKQLEVENVRKKEVQLTVDVMCWINNGDRGETENVGETSSTTHKSRLKMNN

SEQ ID NO: 184113 - protein, 92 aa, Glycine max
  Coding DNA Sequence Number=SeqID_67335
MGDTWETAKMMPPDVRGESLDWRMERDRLKSQKGIELYKIEKSDTEKEASLTTNLALIALTSLFDLAFIDRSDLLDHYSVEKYERPQNHLIL

SEQ ID NO: 184114 - protein, 144 aa, Glycine max
  Coding DNA Sequence Number=SeqID_67336
  Gene Ontology: Mol. function=GPI anchor binding; Cellular component =membrane; Biological process=cell adhesion
  Homolog annotation: Hit_ID=Q9SNC3; Match level="QueryCoverage=83%, HitCoverage=28%, E-value=4e-17, Identity=43%"; Hit description =Fasciclin-like arabinogalactan protein 4 precursor
RCGGADRDDARLRVAGEVHRAEVVGGAAGGLEERGDELAGGGEGAEVGPGEELEEDVVAKDVGEGGRGEVVAGEVVVGGEVGVGDGENGEGGAVREIRSEGRGGGEEGGELGELRHGGEEGGEDWMVVEFERLNTDIKSQVSCE

SEQ ID NO: 184115 - protein, 50 aa, Glycine max
  Coding DNA Sequence Number=SeqID_67337
MPYAKRHEGEDGGCGTPPLTSRSFQKSLSSSETSRCPLFSVEAEDGNEEY

SEQ ID NO: 184116 - protein, 168 aa, Glycine max
  Coding DNA Sequence Number=SeqID_67338
  Gene Ontology: Mol. function=translation initiation factor activity; Biological process=translational initiation
  Homolog annotation: Hit_ID=Q6YU95; Match level="QueryCoverage=55%, HitCoverage=18%, E-value=5e-21, Identity=55%"; Hit description =Translation initiation factor 3 (IF-3)-like protein
  Pfam annotation: Domain name=IF3_N; Domain location=74-149; Score =81.8; E_value=2.1e-21; Accession=PF05198.6; Description=Translation initiation factor IF-3, N-terminal domain
MAFWHRIRNPNLKTLCIQFQRCYIHLPHASTPKPFPVDIPHQNSVFHGRPTSVFNTVRFFAAPLQVKHKNEEDSGDLRLNEKIKAPYVRLVVDDGHHSIVPRFEALERAKTLKLDLVEVDKNAKPPVCKIMDFHKQMYKRQEREKERAKSKVQYAMEVACEISLIAFG

SEQ ID NO: 184117 - protein, 70 aa, Glycine max
  Coding DNA Sequence Number=SeqID_67339
MALKCENKIPGNGAKNLLALWQVYQIARSNNLSVQNWAWAFVVSLSAKPRAQRHCELSALSACALGVSRT

SEQ ID NO: 184118 - protein, 174 aa, Glycine max
  Coding DNA Sequence Number=SeqID_67340
MGGAKSKGNRGAVSKAGGVESKQKGGAVSKEGVQKGEGYWALRPSHALDTPVHVVAGTRLVRSLRLMSALSATAPAKRVLRVHYTAAACEVALSAFAGRLSSPLRPLLGLSALIPVQNSTENPDLKLTKMQSRGGGIAEMKEGRKKNSGGILDFKSNYGTRAQREVAAKRSKAY

SEQ ID NO: 184119 - protein, 128 aa, Glycine max
  Coding DNA Sequence Number=SeqID_67341
  Gene Ontology: Mol. function=protein binding; Biological process =protein amino acid phosphorylation
  Homolog annotation: Hit_ID=Q1S6S4; Match level="QueryCoverage=66%, HitCoverage=9%, E-value=3e-27, Identity=67%"; Hit description =Protein kinase; Adipokinetic hormone
  Pfam annotation: Domain name=LRRNT_2; Domain location=65-105; Score =35.6; E_value=1.7e-07; Accession=PF08263.3; Description=Leucine rich repeat N-terminal domain
MNVSNWFCCYQGKESKTLFSSGQKIKRFGELWVPGMHLSKGCRCEVVFCLWFCCYFLLAAGQVTDPTEVEALKVIKGKLIDINGNLSNWDRGDPCTSDWTGVMCSNTTVDNGYLHVLRLYLEVKAKSV

SEQ ID NO: 184120 - protein, 782 aa, Glycine max
  Coding DNA Sequence Number=SeqID_67342
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=93%, HitCoverage=76%, E-value=0.0, Identity=63%"; Hit description=Protein kinase; Adipokinetic hormone
  Pfam annotation: Domain name=APH; Domain location=453-629; Score= -10.3; E_value=0.031; Accession=PF01636.13; Description =Phosphotransferase enzyme family
  Pfam annotation: Domain name=LRR_1; Domain location=109-129; Score =10.4; E_value=3.3; Accession=PF00560.23; Description=Leucine Rich Repeat
  Pfam annotation: Domain name=LRR_1; Domain location=132-154; Score =19.7; E_value=0.011; Accession=PF00560.23; Description=Leucine Rich Repeat
  Pfam annotation: Domain name=LRR_1; Domain location=156-178; Score =7.7; E_value=10; Accession=PF00560.23; Description=Leucine Rich Repeat
  Pfam annotation: Domain name=LRR_1; Domain location=86-107; Score =11.6; E_value=1.9; Accession=PF00560.23; Description=Leucine Rich Repeat
  Pfam annotation: Domain name=Pkinase; Domain location=451-723; Score =163.5; E_value=5.6e-46; Accession=PF00069.15; Description=Protein kinase domain
  Pfam annotation: Domain name=Pkinase_Tyr; Domain location=451-720; Score=149.8; E_value=7.4e-42; Accession=PF07714.7; Description =Protein tyrosine kinase
  Pfam module annotation: Pfam domain module=APH::LRR_1::LRR_1::LRR _1::LRR_1::Pkinase::Pkinase_Tyr; Domain location=453-629::109 -129::132-154::156-178::86-107::451-723::451-720
MVKENWKSVKEVPMFSLLGEKRRVNKNVHRWGVEFLLRSPCHHFDLPFPSGIPIPVFRPPSAELSQLDNNNFSGNSIPESYGNMPKLLKLSLRNCNLQGPIPDFSRISHLTYLDLSFNQLNESIPTNKLSDNITTIDLSNNKLTGTIPSYFSGLPRLQKLSIAKNSLSGNVPSTIWQNRTLNGTEQIILDMQNNQFASISGTTNLPANVTLLLEGNPVCLNNNSLVQFCGPEGDNNKNGGSIVVCPSQGCPPPYEYNVDCFCAAPLVVHYRLKSPGFSDFHAYVREFESFLTNGLTIHTNQLFIEHFAWEEGRLRMNLKVFPEYIGNGSFHMFSTSEVSRIGDLFRQWDIPDNELFGPYELLDFILLDLYRDVIIPSSSSGISKGALVGIILGAIVCAVTLSAIVSILILRVRLRDYRALSRRRNESRIMIKVDGVRSFDYKEMALATNNFSESAQIGEGGYGKVYKGHLPDGTVVAIKRAQDGSLQGEREFLTEIELLSRLHHRNLVSLIGYCDEEGEQMLVYEYMPNGTLRDHLSAYSKEPLSFSLRLKIALGSAKGLLYLHTEANPPIFHRDVKASNILLDSRYTAKVADFGLSRLAPVPDTEGNVPGHVSTVVKGTPGYLDPEYFLTRNLTDKSDVYSLGVVLLELLTGRPPIFHGENIIRQVNMAYNSGGISLVVDKRIESYPTECAEKFLALALKCCKDTPDERPKMSEVARELEYICSMLPESDTKGHDYVITSDSSGTIFSSEPSSSVIKTPFISGDVSGSDLVSGSIPTIKPR

SEQ ID NO: 184121 - protein, 214 aa, Glycine max
  Coding DNA Sequence Number=SeqID_67343
  Gene Ontology: Mol. function=carboxypeptidase activity; Cellular component=membrane; Biological process=electron transport
  Homolog annotation: Hit_ID=Q9C9F2; Match level="QueryCoverage=56%, HitCoverage=37%, E-value=3e-25, Identity=50%"; Hit description=MtN21- like protein; 91922-89607
MSKEYPRPHSCTTLMTSMGAIQATIFALCIEKDWSQWKLGWNIRLLTSAFSGIVVSGLVLIVTAWCVRLRGPLYALVFSPLSLVIVAIFASMMLDENLYVGRGANCVWLVHGAVGGKINTASGMSPASATFLFTRLSRSTDSEKARFMIFERGPRAFIDETVKLLCGLTVQGSSTQNLSQSASDYIGERVGFLSSLRYSLATLLAQKRKFGMTK

SEQ ID NO: 184122 - protein, 517 aa, Glycine max
  Coding DNA Sequence Number=SeqID_67344
  Gene Ontology: Mol. function=metal ion binding
  Homolog annotation: Hit_ID=O65430; Match level="QueryCoverage=91%, HitCoverage=34%, E-value=4e-30, Identity=25%"; Hit description=Glu -rich protein
  Pfam annotation: Domain name=zf-C3HC4; Domain location=465-503; Score= 4.5; E_value=0.055; Accession=PF00097.15; Description=Zinc finger, C3HC4 type (RING finger)
MTTVFIKSKERFSSGAELRTPVQTELANPRSPQRETVNKTTQLDNSVTTDQLSKDTSNKKGHGNANHATESTQKSASQTRIDHSTEEAHPSSDIKAPQNDSRETTEATTSTIDSNLNEMTADREETSNQQNAMAKSSNDETVNEEEESNQQHAETSYEETIEEASNQNYAESSYDDEMEEEVEEIDQNCYETNYDWISEISRPRSYWEECRQAWYREMLETGTQNEDIRRLLERRTVSSFLSSDFRGRMDRLMESHRGTQTHLVNSQDREEDSQGLMAFLQERLHSTRASQDGSNAREEEDESRNQDEEEEDNTDEQEQEHEEEHEKESLISGSYHEVGDYSNQSSSWSYRDNEAGDDFDRVVSSSPQPYQSQSFYSECRHSSSTNHHSIEMELIYDLRGHMEQLYSEISELRKSIKGCLEMQMELQQSIKQEVQTASVMQCKHTITVKKEEKKSNDTTLKKGNCCICYEMKVDSVLYRCGHMCTCLKCANELQWNSGKCPICRAKIVDVVHVYVDS

SEQ ID NO: 184123 - protein, 1245 aa, Glycine max
  Coding DNA Sequence Number=SeqID_67345
  Gene Ontology: Mol. function=protein serine/threonine kinase activity; Cellular component=integral to membrane; Biological process=protein amino acid phosphorylation
  Homolog annotation: Hit_ID=Q9SN91; Match level="QueryCoverage=98%, HitCoverage=99%, E-value=0.0, Identity=58%"; Hit description=Leucine rich repeat-like protein
  Pfam annotation: Domain name=LRRNT_2; Domain location=23-64; Score =46.3; E_value=1e-10; Accession=PF08263.3; Description=Leucine rich repeat N-terminal domain
  Pfam annotation: Domain name=LRR_1; Domain location=123-145; Score =14.8; E_value=0.32; Accession=PF00560.23; Description=Leucine Rich Repeat
  Pfam annotation: Domain name=LRR_1; Domain location=147-169; Score =16.9; E_value=0.074; Accession=PF00560.23; Description=Leucine Rich Repeat
  Pfam annotation: Domain name=LRR_1; Domain location=171-193; Score =10.7; E_value=2.9; Accession=PF00560.23; Description=Leucine Rich Repeat
  Pfam annotation: Domain name=LRR_1; Domain location=195-217; Score =11.0; E_value=2.5; Accession=PF00560.23; Description=Leucine Rich Repeat
  Pfam annotation: Domain name=LRR_1; Domain location=219-241; Score =9.7; E_value=4.3; Accession=PF00560.23; Description=Leucine Rich Repeat
  Pfam annotation: Domain name=LRR_1; Domain location=243-265; Score =19.1; E_value=0.016; Accession=PF00560.23; Description=Leucine Rich Repeat
  Pfam annotation: Domain name=LRR_1; Domain location=267-289; Score =13.8; E_value=0.61; Accession=PF00560.23; Description=Leucine Rich Repeat
  Pfam annotation: Domain name=LRR_1; Domain location=291-313; Score =18.5; E_value=0.024; Accession=PF00560.23; Description=Leucine Rich Repeat
  Pfam annotation: Domain name=LRR_1; Domain location=315-338; Score =12.0; E_value=1.6; Accession=PF00560.23; Description=Leucine Rich Repeat
  Pfam annotation: Domain name=LRR_1; Domain location=340-362; Score =9.8; E_value=4.2; Accession=PF00560.23; Description=Leucine Rich Repeat
  Pfam annotation: Domain name=LRR_1; Domain location=364-386; Score =15.8; E_value=0.16; Accession=PF00560.23; Description=Leucine Rich Repeat
  Pfam annotation: Domain name=LRR_1; Domain location=388-410; Score =9.1; E_value=5.8; Accession=PF00560.23; Description=Leucine Rich Repeat
  Pfam annotation: Domain name=LRR_1; Domain location=412-434; Score =9.5; E_value=4.7; Accession=PF00560.23; Description=Leucine Rich Repeat
  Pfam annotation: Domain name=LRR_1; Domain location=436-458; Score =10.8; E_value=2.7; Accession=PF00560.23; Description=Leucine Rich Repeat
  Pfam annotation: Domain name=LRR_1; Domain location=460-482; Score =11.0; E_value=2.5; Accession=PF00560.23; Description=Leucine Rich Repeat
  Pfam annotation: Domain name=LRR_1; Domain location=484-506; Score =10.9; E_value=2.6; Accession=PF00560.23; Description=Leucine Rich Repeat
  Pfam annotation: Domain name=LRR_1; Domain location=508-530; Score =12.2; E_value=1.5; Accession=PF00560.23; Description=Leucine Rich Repeat
  Pfam annotation: Domain name=LRR_1; Domain location=532-554; Score =8.3; E_value=7.9; Accession=PF00560.23; Description=Leucine Rich Repeat
  Pfam annotation: Domain name=LRR_1; Domain location=556-577; Score =6.7; E_value=16; Accession=PF00560.23; Description=Leucine Rich Repeat
  Pfam annotation: Domain name=LRR_1; Domain location=603-625; Score =11.6; E_value=2; Accession=PF00560.23; Description=Leucine Rich Repeat
  Pfam annotation: Domain name=LRR_1; Domain location=627-649; Score =15.6; E_value=0.18; Accession=PF00560.23; Description=Leucine Rich Repeat
  Pfam annotation: Domain name=LRR_1; Domain location=651-673; Score =19.2; E_value=0.015; Accession=PF00560.23; Description=Leucine Rich Repeat
  Pfam annotation: Domain name=LRR_1; Domain location=675-698; Score =6.7; E_value=16; Accession=PF00560.23; Description=Leucine Rich Repeat
  Pfam annotation: Domain name=LRR_1; Domain location=699-721; Score =12.5; E_value=1.3; Accession=PF00560.23; Description=Leucine Rich Repeat
  Pfam annotation: Domain name=LRR_1; Domain location=723-745; Score =11.0; E_value=2.5; Accession=PF00560.23; Description=Leucine Rich Repeat
  Pfam annotation: Domain name=LRR_1; Domain location=747-769; Score =14.9; E_value=0.29; Accession=PF00560.23; Description=Leucine Rich Repeat
  Pfam annotation: Domain name=LRR_1; Domain location=75-97; Score=6.8; E_value=15; Accession=PF00560.23; Description=Leucine Rich Repeat
  Pfam annotation: Domain name=LRR_1; Domain location=771-794; Score =2.9; E_value=81; Accession=PF00560.23; Description=Leucine Rich Repeat
  Pfam annotation: Domain name=LRR_1; Domain location=796-818; Score =14.3; E_value=0.43; Accession=PF00560.23; Description=Leucine Rich Repeat
  Pfam annotation: Domain name=LRR_1; Domain location=820-842; Score =8.0; E_value=9.1; Accession=PF00560.23; Description=Leucine Rich Repeat
  Pfam annotation: Domain name=LRR_1; Domain location=99-121; Score =20.3; E_value=0.0069; Accession=PF00560.23; Description=Leucine Rich Repeat
  Pfam annotation: Domain name=Pkinase; Domain location=950-1233; Score= 131.6; E_value=2.1e-36; Accession=PF00069.15; Description=Protein kinase domain
  Pfam annotation: Domain name=Pkinase_Tyr; Domain location=950-1233; Score=81.6; E_value=2.4e-21; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::Pkinase::Pkinase_Tyr; Domain location=23 -64::123-145::147-169::171-193::195-217::219-241::243-265::267 -289::291-313::315-338::...
  Pfam module annotation: Domain location=340-362::364-386::388 -410::412-434::436-458::460-482::484-506::508-530::532-554::556 -577::603-625::627-649::651-673::675-698::699-721::723-745::747 -769::75-97::771-794::796-818::...
  Pfam module annotation: Domain location=820-842::99-121::950 -1233::950-1233
MRISTLEIVILLFFSFALFCDGNESTMRVLLEVKSSFTQDPENVLSDWSENNTDYCSWRGVSCGSKSKPLDRDDSVVGLNLSESSLSGSISTSLGRLQNLIHLDLSSNRLSGPIPPTLSNLTSLESLLLHSNQLTGQIPTELHSLTSLRVLRIGDNELTGPIPASFGFMFRLEYVGLASCRLTGPIPAELGRLSLLQYLILQENELTGPIPPELGYCWSLQVFSAAGNRLNDSIPSKLSRLNKLQTLNLANNSLTGSIPSQLGELSQLRYLNFMGNKLEGRIPSSLAQLGNLQNLDLSWNLLSGEIPEVLGNMGELQYLVLSENKLSGTIPGTMCSNATSLENLMISGSGIHGEIPAELGQCQSLKQLDLSNNFLNGSIPIEVYGLLGLTDLMLHNNTLVGSISPFIGNLTNMQTLALFHNNLQGDLPREIGRLGKLEIMFLYDNMLSGKIPLEIGNCSSLQMVDLFGNHFSGRIPFTIGRLKELNFLHLRQNGLVGEIPATLGNCHKLGVLDLADNKLSGAIPSTFGFLRELKQFMLYNNSLQGSLPHQLVNVANMTRVNLSNNTLNGSLDALCSSRSFLSFDVTDNEFDGEIPFLLGNSPSLDRLRLGNNKFSGEIPRTLGKITMLSLLDLSGNSLTGPIPDELSLCNNLTHIDLNNNFLSGHIPSWLGSLSQLGEVKLSFNQFSGSIPLGLLKQPKLLVLSLDNNLINGSLPADIGDLASLGILRLDHNNFSGPIPRAIGKLTNLYELQLSRNRFSGEIPFEIGSLQNLQISLDLSYNNLSGHIPSTLSMLSKLEVLDLSHNQLTGVVPSMVGEMRSLGKLNISYNNLQGALDKQFSRWPHDAFEGNLLLCGASLGSCDSGGNKRVVLSNTSVVIVSALSTLAAIALLVLAVIIFLRNKQEFFRRGSELSLVFSSSSRAQKRTLIPLTVPGKRDFRWEDIMDATDNLSEEFIIGCGGSATVYRVEFPTGETVAVKKISWKDDYLLHKSFIRELKTLGRIKHRHLVKVLGCCSNRFNGGGWNLLIYEYMENGSVWDWLHGEPLKLKGRLDWDTRFRIAVGLAHGMEYLHHDCVPKILHRDIKSSNILLDSNMEAHLGDFGLAKTLVENHESITESNSCFAGSYGYIAPEYAYSMKATEKSDMYSMGIVLMELVSGKMPTDAAFRAEMDMVRWVEMNLNMQGTAGEEVIDPKLKPLLRGEEVAAFQVLEIAIQCTKAAPQERPTARQVCDLLLRVSNNKKIEDK

SEQ ID NO: 184124 - protein, 133 aa, Glycine max
  Coding DNA Sequence Number=SeqID_67346
  Gene Ontology: Mol. function=transferase activity, transferring glycosyl groups; Biological process=metabolic process
  Homolog annotation: Hit_ID=Q8S9A4; Match level="QueryCoverage=74%, HitCoverage=21%, E-value=1e-22, Identity=51%"; Hit description =Glucosyltransferase-5
MFRATALLLQRRSRESGGARSVVEVNGDVVVEIFGEGFGVIEVHEVHDEGFEVRGFGEGLECNGDVLRAVAGEFEGEDVKGEGGGVKVEGDVVERDGGGGGGDSGDVSSIRVACDGSGGRGDGRSEDEYSDGK

SEQ ID NO: 184125 - protein, 167 aa, Glycine max
  Coding DNA Sequence Number=SeqID_67347
  Gene Ontology: Mol. function=transferase activity, transferring glycosyl groups; Biological process=metabolic process
  Homolog annotation: Hit_ID=Q8S9A4; Match level="QueryCoverage=54%, HitCoverage=21%, E-value=3e-16, Identity=60%"; Hit description =Glucosyltransferase-5
MEDGVGIITNTFEGIEEKPIRTLSKDTHDFCTVWRIRQRVFELVKLATELERRIALLWKHGKVLEGSVEGDCSWVGEERAKVLVGREDRVGRGANGGVASLRRVEDEYSDSSEGNKGGFGGEREQRRVRECDRVGGLSDAILPPQGHWIEDSKKIGPEMQEKALRFS

SEQ ID NO: 184126 - protein, 57 aa, Glycine max
  Coding DNA Sequence Number=SeqID_67348
MVARPCLLFLTLAAVLPMLLAKHPPRQLDLARSLGAAIIYNQDKPWDDHKIHSKTIL

SEQ ID NO: 184127 - protein, 432 aa, Glycine max
  Coding DNA Sequence Number=SeqID_67349
  Gene Ontology: Mol. function=metal ion binding
  Homolog annotation: Hit_ID=O65430; Match level="QueryCoverage=55%, HitCoverage=18%, E-value=4e-18, Identity=33%"; Hit description=Glu -rich protein
MASSQIEIASSSPFGCALRDRNHREACSRESGNVKSTHHHHHANFQRNMKNFVMDLNMCMAVSSDSKANENENNSSSSSSINNHRKAPKNKQLERLLITRANPFINNSNVASNETSLASLISPRHSGLLDRWATRQACQMVSNLENEAELLSMDGNDMLPRTSSSSEEESSFSSETRNGGGASSLVQIWEKRLNQSSVSKPNTPRERIGSTSSSINENANAFSPENVNAFSGEEQCFDGPSGNEESFTSSSFPDWESSDQSLSPSRRSESDRVRVADIIKKLTSTSQNQCPTPSFADDNEHEGYGSSVTGSPCRERECDQQHSEQNRRVNCSLRIRGRRAYIDLLAQMENDRLGELNNLVERGAVSKFPQRGRIQAMLRLRLLQRGVAANDQPRQKSTASEVNNSQPHGYAIMQLRFDNFKSSVNFLVHFVI

SEQ ID NO: 184128 - protein, 446 aa, Glycine max
  Coding DNA Sequence Number=SeqID_67350
  Homolog annotation: Hit_ID=Q8H3W6; Match level="QueryCoverage=92%, HitCoverage=77%, E-value=4e-62, Identity=35%"; Hit description=WD-40 repeat protein-like
  Pfam annotation: Domain name=WD40; Domain location=303-341; Score =14.3; E_value=0.45; Accession=PF00400.22; Description=WD domain, G -beta repeat
  Pfam annotation: Domain name=WD40; Domain location=347-387; Score =14.4; E_value=0.42; Accession=PF00400.22; Description=WD domain, G -beta repeat
  Pfam module annotation: Pfam domain module=WD40::WD40; Domain location=303-341::347-387
MQASRPVVQITFYFLFYVVLSFESNRKLNLQIWKYRGTDGMRITALEHLRVDVQTSAGKTETDVLLTGSTNGSMSFSQVGGVGRNHDGGTKWRADCVKNYVKGRTDENNEVLKPVFKPNRAALLMSSRISSIRLGPKFSSHAVNDGHIVGRALFTTLGSETSGGTVYTLDLVEPLNLGPGILNTWSGLEEIASFRGTIWTSEYDYNRHRAVIGTNLGAASVDLETGTMSWFLHCKSDVFAQQIVNSGNVILCGLRNGAIVTVDSRERRESLSGRLITHRIPYASSDKKVVGSNKEWFKLKGDIYPSHTIRMSSSISCLASLQFDDQYFLASSMDGSMKLYDLRLLQRGAVQCYEGHVNSHTRIQMGVDPSERFVMSGGNDCKLRLWSIKSGELLFEDKFSDSIISTVCYKTYGHSFKAEEENQYKCDSSQGAWLGSYEGLFYMCWL

SEQ ID NO: 184129 - protein, 138 aa, Glycine max
  Coding DNA Sequence Number=SeqID_67351
  Subcellular localization annotation: CTP_CleavageSite=55; ConfidenceScore=5.38e-01
MAGDAAFPSYTSTCMMTFFFSLLLALHFAMAVPERSFSSLASIKEGAKKRNTMVAASTAREEGSTQNLKTEEATPKDNHVSDHLLKGTNKEGSSRSPRPPLERQNKIFNASEHEVPSGPNPISNRLAELANKCTIYAN

SEQ ID NO: 184130 - protein, 501 aa, Glycine max
  Coding DNA Sequence Number=SeqID_67352
  Gene Ontology: Mol. function=oxidoreductase activity; Cellular component=membrane; Biological process=electron transport
  Homolog annotation: Hit_ID=Q2LAK9; Match level="QueryCoverage=89%, HitCoverage=90%, E-value=0.0, Identity=73%"; Hit description =Cytochrome P450 monooxygenase CYP82E13
  Pfam annotation: Domain name=p450; Domain location=35-491; Score =319.1; E_value=8.1e-93; Accession=PF00067.12; Description=Cytochrome P450
MEMFPLLPYFLLSSLVFLLTFKLLFSQRRKHKNLPPGPPPLPIIGNLNLLERPLHRFLTRTSKTYGDIFSLWFGSRLAVVVSSPSAFQECFTRNDVALANRPRSLSGKHIFYNYTTVGSCSYGEHWRNLRRITSLDVLSTQRIHSFSGIRKDETERFIRMLAKDSCMDYAHVELSSMFHDMTYNNMMRMLSGKRYYGDESQIKDVEEAKEFRETVEELLQVAGVSNKADYLPFLRWFDFHNLEKRLKSINKRFDTFLDKLIHEQRSKKERENTMIDHLLHLQESQPEYYTDQIIKGLVLAMLFAGTDSSAVTLEWSLSNLLNHPEVLKKARDELDTYVGQDRLVNESDLPNLFYLKKIILETLRLHPPAPLAIPHVSSEDITIGEFNVPRDTIVMINIWAMQRDPLVWNEATCFKPERFDEEGLEKKVIAFGMGRRACPGEGLALQNVGLTLGLLIQCFDWKRVNEEEIDMREANWFTLSRLTPLNAMCKARPLVNKINLK

SEQ ID NO: 184131 - protein, 498 aa, Glycine max
  Coding DNA Sequence Number=SeqID_67353
  Gene Ontology: Mol. function=oxidoreductase activity; Cellular component=membrane; Biological process=electron transport
  Homolog annotation: Hit_ID=Q2LAK9; Match level="QueryCoverage=98%, HitCoverage=99%, E-value=0.0, Identity=69%"; Hit description =Cytochrome P450 monooxygenase CYP82E13
  Pfam annotation: Domain name=p450; Domain location=31-488; Score =316.2; E_value=6e-92; Accession=PF00067.12; Description=Cytochrome P450
MFPLLPCFLYSLAFILTFKLLFQRRKYKNLPPGPPPLPIIGNLNLLENPLHRFFQRMSKTHGNIFSLWFGSRLAVVVSSPSAFQECFTKNDVVLANRPRSLSGKHIFYNYTTVGSSSYGEHWRNLRRIIALDVLSTQRIHSFTGIRKDETERLIRILAKDSCMDYAHVELGSMFHDLTYNNMMRMISGKRYYGDESQIKDVEEAKEFRETVAEMLQLTGVSNKSDYLPFLRWFDFQNLEKKLKSIHKRFDTFLDKLIHEQRSKKKQRENTMIDHLLNLQESQPEYYTDKIIKGLILAMLFAGTDSSAVTLEWSLSNLLNHPKVLMKVRDELDTQVGQERLVNESDLPNLPYLRKIILETLRLYPHAPLAIPHVSLDDITIKEFNIPRDTIVMVNIWAMQRDPLLWNEPTCFKPERFDEEGLEKKLVSFGMGRRACPGETLAMQNVGLTLGLLIQCYDWKRVSEEEVDMTEANWFTLSRLIPLKAMCKARPLINKINLK

SEQ ID NO: 184132 - protein, 999 aa, Glycine max
  Coding DNA Sequence Number=SeqID_67354
  Gene Ontology: Mol. function=zinc ion binding
  Homolog annotation: Hit_ID=Q10LI9; Match level="QueryCoverage=52%, HitCoverage=57%, E-value=4e-34, Identity=26%"; Hit description=CW -type Zinc Finger family protein, expressed
  Pfam annotation: Domain name=zf-CW; Domain location=405-453; Score =70.7; E_value=4.7e-18; Accession=PF07496.5; Description=CW-type Zinc Finger
SQENAEDSPNGIIQVMTSFPISGGVLISPLHDSLLYMIKNEKVIRDSKYLSSLKGHQDTCSMSTDESDSFVGDEHLKKKTVRIMRESEKQLELKHTNGTFSEKDLTLHTKKRLGNRTPDCKDFLSNDLKRTPLSSSICDAGETAEVTAKAFEASKDFNESGVQGRMVPVEALKEESLESISGQDFEKTEKQNAGNGFMKNALEHKLENSRKDNFTDPMNNNMRNTFMNKFESDAVKHKVDHKYENHQKVKAVSERKTKSKGDLSPGKAEAVGRKDSFGGTNNAMVIDKGIAGFDNTCKSKMNKSMSLKGKKFSNSNGDSLKEKKSEQKVASVASIGAIKNGNIGNGKKSAFGTKVKERLSGHKVANQLLAGPCIKDTSAALPIAENNLAPEMISSAVGVPQVIAEDWVCCDSCQKWRLLPNGMKPEHLPEKWLCSMLNWLPGMNSCDFSEDETTKALYASYQIPISDGQNNMQSHGTETAIGVSCTLQYGLNHKMSTFDMLSDREKKKHVIKEKTMSGSNNDVLQFPNSAKINVQVSGKNRSLNAMNHHPADLNPMKKTSSSKHLSRLDNMIEEKNVPKEKEKQVNEGDRKHAKLKRKMDADQYKLGTPKKPKVENVFYTDKQLNPGMDLEKVSLYSRNGLPTKASGKEMRKYDEYCLSDDIQDRLPVTVKNEGDHAQVSSGGGSLDVKNRSKSGLMKKRKLKEHMDDEKHNNSYSSHGEKQYGEEGNASEIRKQKKYRILSKEAKLVTEGDDKLSKDGMRQVCLSGNRDQMAVGTEVRFVDKGNQPRKHRKNVASLHASDSIDQLGKGLGSRPLSLAATSSSSKISGSHKAKTNFEDVRGSPVESVTSSPLRAFNLDKNILAIGDTSVKDDATKGYLSSVGSRRSVDNREGKLSVKLKAGRISHDLHPASHKLSSIEARFEDAKDTARVQAKKSSELKNNHLLEAGVHVEQPGYCANGIRYEEKVNKDNQESELSWQKSGKVSSLHRKEMGRKSGSHV

SEQ ID NO: 184133 - protein, 177 aa, Glycine max
  Coding DNA Sequence Number=SeqID_67355
  Gene Ontology: Mol. function=transposase activity; Biological process= transposition, DNA-mediated
  Homolog annotation: Hit_ID=Q1BSE7; Match level="QueryCoverage=30%, HitCoverage=62%, E-value=7e-21, Identity=88%"; Hit description =Transposase IS3/IS911
  Pfam annotation: Domain name=Transposase_8; Domain location=112-177; Score=70.5; E_value=5.3e-18; Accession=PF01527.10; Description =Transposase
VFGGQFCIKDSKVYTFDPETGALEYLADDIENWVKILLSDYEVLTGYPLAHQWQKQNGQLPAGKRLLPKVPFVLGGEFVLDNLYLADAVEGMRFRADIASQIKELPDGTAMKKRFTEEQIIGVLKKAEAGAKVAELCRKHGISEATYYNWKAKFGGMTVSDAQRLKELEQENNKLKK

SEQ ID NO: 184134 - protein, 62 aa, Glycine max
  Coding DNA Sequence Number=SeqID_67356
MDSAHAIVENKGSGTNMSFNLGEDLNYLVLPYSDEENLKGAASVKLYFDLKHFDGNWDEAEM

SEQ ID NO: 184135 - protein, 444 aa, Glycine max
  Coding DNA Sequence Number=SeqID_67357
  Gene Ontology: Mol. function=transferase activity; Cellular component= nucleus; Biological process=flavonoid biosynthetic process
  Homolog annotation: Hit_ID=O64470; Match level="QueryCoverage=99%, HitCoverage=99%, E-value=2e-72, Identity=36%"; Hit description =Putative anthranilate N-hydroxycinnamoyl/benzoyltransferase
  Pfam annotation: Domain name=Transferase; Domain location=1-444; Score=340.6; E_value=2.6e-99; Accession=PF02458.6; Description =Transferase family
MVTTVASYNVTPYQPTPNDPLWLSDSDQLGALGHVATIYIYKAKPNSDTIERLRNSLRKLLVYYYPVAGRLSLTKSGRMEVNCNAKGVTLIEAETTKTFGDYGDFSASKSTDELIPKVDDTQPTEEIPLLLLQITRFHGGEGLSIGVLFSHPLTDATGQIHFMNKWAKLTRGEELNPDEMPFLDRTLLKLLPNQASVPSVKLPELKPAPQTPGKEQKKRSAALLKLTSSQIQRLKKKANDHPSKEGSKPYSRFEVVAAHIWRCATMARAESGENSNQPILVRFSVNFRNRLKPPLPQNYFGNALAKVATPECYEGDIISNPLGFAAQKIREASHAITEDFLRSQLNVGLGKWQLDNIRAFFMSQRHLINTPSAGDHNIFLTSLMTMPVYESDFGWGKPVHYGLASLFQVNRAGILPSPDGDGVIVNIFFQEALMQLFKKLFYED

SEQ ID NO: 184136 - protein, 220 aa, Glycine max
  Coding DNA Sequence Number=SeqID_67358
FDTAQSLVSRFLQLSSFFEDEGESPVESDETKSGEKPLLLPIRSLKSRLSEEDIDVQSLNISMSSKKRFSSYSNRKAEVEAIDADDVDAEVQSQKRSTSSKRFSSNSNRNTKVEGSRAENKKKESVVLPSPIPWHSRSGRLEHKQEEFDEASNMMFPSSKEESRPVKSQPSCASSRDNSMSFSPSFSLESPAKNAEDSVRKKGFYKSCPPPPLPPPPTMF

SEQ ID NO: 184137 - protein, 216 aa, Glycine max
  Coding DNA Sequence Number=SeqID_67359
MLFDHVEIMQLRAYHPQLVNCDFCGGEHFNDNCHSYSIKNSWWEQEFHPYNQYEKERLSNLENVLMEFMETSQASFKANQNSIQNLKIQVGKLVKEVAEIPFLVIREENFVEVKAHEESLVEIQEKKMKKKKKGEESTQQQWDKFSQSLTKKRKCKEDVFYVTFNKKSFSVIFSLITNTSLAMIWKTFQEYMTFMESLAKKRKCKEDVFYVTFMPT

SEQ ID NO: 184138 - protein, 122 aa, Glycine max
  Coding DNA Sequence Number=SeqID_67360
MERSKIHRSYEDVEKHMYRACYHLQGMDPACDERGKGKQLVGILGKHSDKVTVDPSVGNVQVVEDRWSVKLHVNLPKYHRSGDFYTQTQEQKHFQPYGNKLYGGSSKYKRHQALSIAYLGEE

SEQ ID NO: 184139 - protein, 84 aa, Glycine max
  Coding DNA Sequence Number=SeqID_67361
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=65%, HitCoverage=29%, E-value=2e-17, Identity=78%"; Hit description =Anaphase-promoting complex subunit 10
  Pfam annotation: Domain name=APC10; Domain location=1-84; Score= -79.7; E_value=0.017; Accession=PF03256.7; Description=Anaphase -promoting complex, subunit 10 (APC10)
MKQQLKPYTALGIVVGAQSSKLSTLPVNKLIVLYVVFKLDESYTPSKVSILACGGFHNLKEIKTVELVRPTGWVYLSLSGAYPR

SEQ ID NO: 184140 - protein, 59 aa, Glycine max
  Coding DNA Sequence Number=SeqID_67362
MQGRQSDRISNEARERVEERNNRMSYKGNAGIYNIKMIQLFAAFQEPEVEICATMRSTY

SEQ ID NO: 184141 - protein, 73 aa, Glycine max
  Coding DNA Sequence Number=SeqID_67363
MQGHHGDGSGSAEEVWRPKRKNEELEEIGQGAHHRDRTERSSRSRKDRKKKERMWKRRRGEEGRRGKRERMRE

SEQ ID NO: 184142 - protein, 247 aa, Glycine max
  Coding DNA Sequence Number=SeqID_67364
  Homolog annotation: Hit_ID=Q8W4I4; Match level="QueryCoverage=39%, HitCoverage=13%, E-value=1e-12, Identity=41%"; Hit description =Potassium transporter 6
MAIVGTCSTHSLLMTKNKVDNVDFPGPSELKEIKSPNVIQQQKKRVRFLVPESPKIDTCVMEELEEVMEAWETGVAYIIGQTHMRAKSGSNMLKKIGINSSGFSLPRLLGHEGIEKKAKFNLCSWKQRMELSLFEDDNLYIKLFSDFRNPLGFHSIPNFPVTPPRRQQIHVHNEDMGRLREIFLQPPQRATFQTNTQAPPLVEISKSTAFSKLKKVVHDPPPKRYARRVSLYYRNNAAKPWKEKEKE

SEQ ID NO: 184143 - protein, 119 aa, Glycine max
  Coding DNA Sequence Number=SeqID_67365
  Gene Ontology: Mol. function=microtubule motor activity; Cellular component=microtubule associated complex; Biological process =microtubule-based movement
  Homolog annotation: Hit_ID=Q2HU33; Match level="QueryCoverage=56%, HitCoverage=6%, E-value=1e-26, Identity=85%"; Hit description =Kinesin, motor region
MSRLAFVESSSPVLASHWMFAKKKNDSDTDEDDNHDLDSAVANTVNDASSSVFGPNTEQKELYDQAVSPIVYEVLEGYNCTIFAYGQIETGKTYTMEGGARKKNVEFSSDVSVIPRAVK

SEQ ID NO: 184144 - protein, 83 aa, Glycine max
  Coding DNA Sequence Number=SeqID_67366
  Homolog annotation: Hit_ID=Q10MT0; Match level="QueryCoverage=83%, HitCoverage=48%, E-value=2e-13, Identity=49%"; Hit description=ECA1 protein, putative, expressed
  Pfam annotation: Domain name=DUF1278; Domain location=1-83; Score =33.7; E_value=1.4e-08; Accession=PF06915.2; Description=Protein of unknown function (DUF1278)
MASSYDPVILVTLLQACSGEIVTFVLNGETYLGQGCRQAIRVIGHDCWHNIVASLGFTTEETDILEGYCDEIVHSPPPPLVEP

SEQ ID NO: 184145 - protein, 134 aa, Glycine max
  Coding DNA Sequence Number=SeqID_67367
MVVIFICVRIAEFNNRTQRGHQNNAISWPPLDDNQMCEARLTSTIVWWGSSEMLTIDVSSNRTTTTLSSLSWHALFFLEIDRQKGIPGWCESDEYMGNVTTHSGRKSERFLISKMPQPSLLRRSLQVTVVVEFI

SEQ ID NO: 184146 - protein, 253 aa, Glycine max
  Coding DNA Sequence Number=SeqID_67368
  Gene Ontology: Mol. function=structural molecule activity; Biological process=lipid transport
  Homolog annotation: Hit_ID=Q1T607; Match level="QueryCoverage=46%, HitCoverage=54%, E-value=2e-11, Identity=36%"; Hit description=Major sperm protein; Prefoldin
MQPQREAPEDMVCKDKFLIQSTKVPAETISEDVTSRLFVKDGSKYIEENKLKVILICPPNSPDLSPINGDFKNGLDHEKVQIYREPKEEARLKVSKNKELNMVKDLEELKPQKKLEVEVPKDLDFNKIKNAEELKPEKAVELKVSKLLVLNKVKNVEELKPEKAAELNVSKVLDLNLVNNVKELKPETETELKMSKDLELKTVKNAEELKPEKETELKISKDMELETFKNVEELKPENEIELKITKDRELKIF

SEQ ID NO: 184147 - protein, 131 aa, Glycine max
  Coding DNA Sequence Number=SeqID_67369
MWLQSRKRRPVCDKDELSSVDVVKKEITKLLQAGIIYPISDSQWVSPVQEHAFHPVQCPRKLHRGVYGCVATYPSAGGRRETRGMRVPRKEYARSRHQRLFEENVGKTGKDAIYELFSERFGSCIYARGRY

SEQ ID NO: 184148 - protein, 902 aa, Glycine max
  Coding DNA Sequence Number=SeqID_67370
  Gene Ontology: Mol. function=RNA-directed DNA polymerase activity; Cellular component=chromatin; Biological process=RNA-dependent DNA replication
  Pfam annotation: Domain name=Chromo; Domain location=852-902; Score =31.8; E_value=2.5e-06; Accession=PF00385.14; Description='chromo' (CHRromatin Organisation MOdifier
  Pfam annotation: Domain name=rve; Domain location=560-707; Score =76.3; E_value=9.4e-20; Accession=PF00665.16; Description=Integrase core domain
  Pfam module annotation: Pfam domain module=Chromo::RVT_1::Retrotrans _gag::rve; Domain location=852-902::314-510::24-126::560-707
MAENTRCQASLHEMEERLSSRMKSRFVELGASMQQTIHGMFQQRQQDSPAASNPPRGLENLPSWNEYQILLLDCFGHVYEDPMADLMKLRQTGSIIEYHEEFDSIVLRVDLSDERQLSCFLGGLKQEVQMIVRMFQPNSVRKAYSLAKMYESSFSNTQAKPFVKNQKSFFVPKSPLLPNPPRSTNPLTINPSTKPQTPKHLTPTYMAERRSKGLCYFCDEPFTPEHGLTHKRLQIHVLEIEDEEEGPRPQQPDANVEPSGLPPCRVDHDHKIPLMQGANPTNKRPYRYAKQQQKVIDGLIQDYLKSGIIQKSDSPYASPMVLVGKKNGAWRLCVDYRDLNKATIKNKFPIPLVEDLLDELHGSTIFSKIDLRAGYNQVRMDAADIHKTAFRTHAGHFEYLVMPFGLTNAPTTFQGLINSIFQHYLRRFLLVLFDDILIYSRSYYRRFVSQYGAIAKPLTDMLKKENFSWSSTAKEAFQELKQRLVASSVLALPDFSKEFVVEVDASGLGLVQKWRHYLLPKKFIIRTDHRSLTYILEQILSTAFQQKWLVKLMEFDFNIEYKEGRENVATDALSRLDSPKIMALQAAHFMALSHPYTAANVAQCFLDNVFKLHGFPDTITSDRDSIFVSHFWKEFMSLQGIQIQLSTAYHPQTDGQSEVVNKCLETYLRCMCSDSPAQWFKWLPLAEWWYNSTYHSIIKASPYEIVYGQAPPVHLPYLLRESKIALVDRSLQKREEMLKLLKFHMKRAQDRMKQLADRGRSDRSFQIGDLVYVKLHAYRQVSVQARPNAKLAPKYYDPFPVEDKIGAVAYKLKLPLGSMVHNVFHVSQLKKFNGTATAGNFSPSPLLDTSQKEPAAIIDRMTVKRGNRAITKVLVQWKHQLPEDATWEFFYDLKQKFPHFNP

SEQ ID NO: 184149 - protein, 232 aa, Glycine max
  Coding DNA Sequence Number=SeqID_67371
  Homolog annotation: Hit_ID=Q10LI9; Match level="QueryCoverage=37%, HitCoverage=9%, E-value=1e-08, Identity=39%"; Hit description=CW -type Zinc Finger family protein, expressed
MNAQCSTDNKTISRQNLTQDFKGENKANLTESRVGESKVLPSAVDEVKREALNVSSRTVPQYQKGGMSNERPVHVSGNDDLAKSMRNYADVSNNAGVNYSSGNFAPDQQLTLSSPLRTNSSQTATGTLEEAAKLKDRADNYKNSGFDFESNETYFQAGLKFLHGASLLENCHNESSKHGEMSQMKIFATAAKLFNYWSNAILVVKNKTEVSVSSWHLGSLNIGINTSPTLAR

SEQ ID NO: 184150 - protein, 168 aa, Glycine max
  Coding DNA Sequence Number=SeqID_67372
  Gene Ontology: Mol. function=zinc ion binding
  Homolog annotation: Hit_ID=Q10LI9; Match level="QueryCoverage=93%, HitCoverage=17%, E-value=5e-27, Identity=44%"; Hit description=CW -type Zinc Finger family protein, expressed
MAAAALAYKCMEVAYMRVVYCKNSSTNRDRHELQSTLQLVFQGESPSSSASDVDNLNNQTAADKATLPRGTNTHVAINQVISARTRPNLVRLLDFTQDIHFAMEASRKCQSTFVLANVIMQEAWKKDCIASIRSAIDFSFQDVDELVRLVWTATKAISHAGLGGTRLS

SEQ ID NO: 184151 - protein, 322 aa, Glycine max
  Coding DNA Sequence Number=SeqID_67373
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHVLTFRGKHVLAFRGLHALAFRGLDVLAIRGLHVLSFRGLHVLTFGGLHVLSFRELHVLAFRGLHVLASKGLHVLAFIGLHALTFRGIHDLTFRGLHVLALRGLNFLTFGGLHVVDFRGLHTLAFRGLHVFAIRGLHILSFRGLHALTFRGLHILSFRGLHVLAIIGLHVLAFRGLHVLAFSGLHVLSFRGLHALSFSGLHVLAFRWLHVLAFKGLHVVAMTGLHVLAVIGLRVLTFRGLHVPPFRGLHTVAIRGRHVLPFKALHVLTYKSSPSKDYTSSPSEDLLHVITFKGLHVLAFRGQHALSFRGLHVLAIRWLH

SEQ ID NO: 184152 - protein, 244 aa, Glycine max
  Coding DNA Sequence Number=SeqID_67374
  Gene Ontology: Mol. function=methyltransferase activity; Biological process=methylation
  Homolog annotation: Hit_ID=Q7N7J1; Match level="QueryCoverage=73%, HitCoverage=26%, E-value=7e-28, Identity=40%"; Hit description =Complete genome; segment 4/17
LAQQEVREQRYLQVIAQYERAELDLLVQAFAHLVMSYELRVEAADFGDVLGSTFMMLDMGNAGAGQFFTPYEVSRLMGNMMMGDGQALVDKANEQGFLRVLEPACGAGGMLIAAAHAMHEAGLKYQQCMHATAIDIDQRCVHMTFIQLALLHVPAVVIHGNGLTGECRGQWFTPAHILGGWSARLRRREAEESARALLQEPVAKVVAHVDLGADDADVPKAEQPLQVIPKAIRQAAAAGQMSLF

SEQ ID NO: 184153 - protein, 367 aa, Glycine max
  Coding DNA Sequence Number=SeqID_67375
  Gene Ontology: Mol. function=catalytic activity
  Homolog annotation: Hit_ID=UPI0000383C72; Match level="QueryCoverage =94%, HitCoverage=88%, E-value=2e-61, Identity=39%"; Hit description =COG0189: Glutathione synthase/Ribosomal protein S6 modification enzyme (glutaminyl transferase)
MHHLLQSLEHNNAGHTFQGLAPFLRMNLNGSDLRAHGQSLLVQANQDQENAILWMNLATVFLCLKMRDMGLAIQEQALSLQRLYIRPANCRPAKFRLLMIMTPGDLSENTPIDCLLENSPVELLYYYATTEQPLPSPLPAHDAVMVGLSDSQANRALLLAVQASLEGHTKPVINPPHLLPNVNRDQLSTLLQGVAGLDMPRTHRLSRSQVVTRLSMGNHNSHNNPDALPGFPFIIRPVGSQAGNDLAKVTSTSELAEYLRAVPSTDFFVSRFVDYSSQDGQFHKYRIAMLHGQPFICHMAISSHWMVHYVNAGMYDSAEKRAEEGQFMQDFSSFATRHQAALAAIYQRLQLDYLCIDCAETADGDLL

SEQ ID NO: 184154 - protein, 186 aa, Glycine max
  Coding DNA Sequence Number=SeqID_67376
  Gene Ontology: Mol. function=DNA binding; Biological process=DNA integration
  Homolog annotation: Hit_ID=Q1YMQ7; Match level="QueryCoverage=47%, HitCoverage=25%, E-value=5e-39, Identity=86%"; Hit description =Putative transposase
DQRSLAAIGINIGARLLLPIEPEELLVVHEEAFASEQHMKASISKAAAFMRQRLHPLAKVMVIAAPAFRLAAGVTTNGMVRLVLLPHHEAANPKEVAMSQRNMPRPAAVYGIDIGKNIFHVVGLGSDGVPVQKVRFRRDTLLQFFERAAPAIVGMESCAGSQWIARKMQAFGHKVRLIPAQFVKPY

SEQ ID NO: 184155 - protein, 405 aa, Glycine max
  Coding DNA Sequence Number=SeqID_67377
  Gene Ontology: Mol. function=gluconate transporter activity; Cellular component=membrane; Biological process=gluconate transport
  Homolog annotation: Hit_ID=Q7N951; Match level="QueryCoverage=99%, HitCoverage=94%, E-value=1e-163, Identity=71%"; Hit description=Low -affinity gluconate transporter
MPIAPPTLPRIVSITVQPKTGVVDVAQHDGAAGDADSQRGQLPAVQPELAGDRQHQADGGQTGDGGRALNHPHHGGERKGGHGDRQAGADHRVTQRRPYAGIHQDLFEHPAGAGHQQDDPGRLHRGGADGQRLFVAHAARLRQAVNHDQAGQQNGGERVADKLQPLLQLRAGGDQPRADGLHADQHQRAQHQRQAEAERRQIALGQRRLVLFRWHRPVDEAADKAAVQRAGDQHADHRRHQADGDHPAEVGLHLRSQQHRHRPRQQEGGGGGHAGEQRNGQLDDIAVGAARHGEHDADQQHHRHVEEQRQRADQAGDAERVVRLALSESFQQLRRNLIERADLMQDLAEHCPERHHDRQEAQRVAHAFLHGVGNMVQRHAGEDAGGDGHQHQRDEGVHARLHHQE

SEQ ID NO: 184156 - protein, 72 aa, Glycine max
  Coding DNA Sequence Number=SeqID_67378
MVVNRSREEKNRRKKFDEGTIMDGTNGDVAVDHYHRYQIFACIICLKPQALKYTIYLNVNFFQPSSHDIRIN

SEQ ID NO: 184157 - protein, 59 aa, Glycine max
  Coding DNA Sequence Number=SeqID_67379
SLCVNGLACLWLRKGADNHKVRITIRYLRMSSNSPSLDDKGCVRVTVECLRMPPDSWVT

SEQ ID NO: 184158 - protein, 225 aa, Glycine max
  Coding DNA Sequence Number=SeqID_67380
  Gene Ontology: Mol. function=chitin binding; Cellular component =extracellular region; Biological process=chitin metabolic process
  Homolog annotation: Hit_ID=Q86AI8; Match level="QueryCoverage=88%, HitCoverage=50%, E-value=7e-30, Identity=36%"; Hit description =Similar to Homo sapiens (Human). Mucin 2
GGPLGTSTLAFGGLHALAIRGLHVLAFRGLHALAFRGLHVLAFRGLHAMAFRGLHILTFRGLHALAFRGFHLLAFRGLHALAFRGLHALAFRGLHVLAFKGLHALAFRGLYALPFRGLYILPFRGLHVLSFRGLHVLTFRGLHVLAFRGLHVLTFRGLHALTFRGLHVLAFGGLHVLAFRGLHIYAFRELKFLGHPPDLMQSYPPRALDRRLQEDWAKDAREGPR

SEQ ID NO: 184159 - protein, 212 aa, Glycine max
  Coding DNA Sequence Number=SeqID_67381
  Gene Ontology: Mol. function=transcription factor activity; Biological process=regulation of transcription, DNA-dependent
  Homolog annotation: Hit_ID=Q5PEQ8; Match level="QueryCoverage=99%, HitCoverage=73%, E-value=2e-75, Identity=66%"; Hit description =Possible regulatory protein
  Pfam annotation: Domain name=CbiX; Domain location=52-140; Score= -7.3; E_value=0.041; Accession=PF01903.8; Description=CbiX
  Pfam annotation: Domain name=HTH_1; Domain location=5-64; Score=71.9; E_value=2e-18; Accession=PF00126.17; Description=Bacterial regulatory helix-turn-helix protein, lysR family
  Pfam module annotation: Pfam domain module=CbiX::HTH_1; Domain location=52-140::5-64
  Subcellular localization annotation: CTP_CleavageSite=25; ConfidenceScore=5.31e-01
MHYSPEALTAFVEAAASGSFSAAARRMRKSQSTISTAISNLETDLGLTLFDRSTRQPTLTAQGEQVLGYVKAILAASSRLDELASSLSGNTEPRLTFVLSDTLHPDVLEDLLEQFDRRFPHTEFECLIGEDEDVVDLLQKERAQVGLIEARDSYPMEIGSMRLPLQTAMGIYVAPGHPLAGQGRVFWDDLHGWRELRLSTYLESAPDPSRGQ

SEQ ID NO: 184160 - protein, 68 aa, Glycine max
  Coding DNA Sequence Number=SeqID_67382
  Gene Ontology: Mol. function=transferase activity
  Homolog annotation: Hit_ID=Q2HT39; Match level="QueryCoverage=96%, HitCoverage=17%, E-value=4e-09, Identity=48%"; Hit description =Membrane bound O-acyl transferase, MBOAT
MEMEGEIKNLIMVWTIAPATMCYCHRIGKLIPEGTSRLIALFPAIVILLLLPLRLISIHLGGPSSFFL

SEQ ID NO: 184161 - protein, 70 aa, Glycine max
  Coding DNA Sequence Number=SeqID_67383
MVAVGDGESAWDVRNGFGRKKEEEMVFFLSYTKAKAENAQVRNGLGHENLPHTPEIFSKIPKVRSWTSVL

SEQ ID NO: 184162 - protein, 111 aa, Glycine max
  Coding DNA Sequence Number=SeqID_67384
  Subcellular localization annotation: CTP_CleavageSite=86; ConfidenceScore=5.02e-01
MGMKGKLPPFGHFYKLFPQIGLFLKFFMHGSVLDVKGMHAKANRQFHWRFSLSVLDSPAPLAISPCMGSCQSNWRVPRRRAQARVLGFHLASLAGGGLQGLQSGRGTRHSH

SEQ ID NO: 184163 - protein, 118 aa, Glycine max
  Coding DNA Sequence Number=SeqID_67385
MPYLGYAAEGQAFCGIPLPNTLGGPQYRPQPQPLHFAVGRVPPAMMEREKFDHIEEWLRVIERGRDYAFADMAELCLVLDVIIPLRFKVPDFDKYKETTCPKNHLKMYKQENGGILKK

SEQ ID NO: 184164 - protein, 170 aa, Glycine max
  Coding DNA Sequence Number=SeqID_67386
MTTLTQIWMTLLHSNVLPSDHNFDLPLPKCQLVYAILTQMSIHMAQVIADVIYLFAGMAPTRHPLDQEKSNRALGFPALITGLCQSYGVPITPSKVIRPLITRAFIEKYCTPRQAQGNAHQDAGAPPPPRQADSVGPLCVERLSQQGQGSAPFVCRTPEQFGAEVAWPGD

SEQ ID NO: 184165 - protein, 235 aa, Glycine max
  Coding DNA Sequence Number=SeqID_67387
  Gene Ontology: Cellular component=mitochondrion
  Homolog annotation: Hit_ID=P92535; Match level="QueryCoverage=44%, HitCoverage=89%, E-value=2e-25, Identity=55%"; Hit description =Hypothetical mitochondrial protein AtMg01010
  Subcellular localization annotation: CTP_CleavageSite=33; ConfidenceScore=5.01e-01
MASVDTFESLVRRLAFYLGNQALSRLLLQRGCSVGLTVAIAVLFGDTPSVGNNMMDPSGSSGSSGGGGSESSWTGALLSSETLSGTGSVNQPAEGMPVPPANPVVEQAGPANPEDTTEIIGGDSIDSIRNRLLQSYGNPSAEQISRASYDADDLFQVKVEIIRGMTPLDPEGDWPGRGARALDNPRTSTGEDSLENLYRLKDDLNENGRDSETFKRLKDKVFRRPRPLEDANSTT

SEQ ID NO: 184166 - protein, 90 aa, Glycine max
  Coding DNA Sequence Number=SeqID_67388
MYVFIQEKEKLSVERQPSLITSLVKVLRIQVWVFLTVCVREALVDDPSLISVIPTNLSQLCFIIIMFLSLKNCMSCEKLLMETLNAIQVM

SEQ ID NO: 184167 - protein, 82 aa, Glycine max
  Coding DNA Sequence Number=SeqID_67389
MVLNANYSAKQGTIQCFDQEYERYQKGGAKGLASSSPGRAFRRLQPEGTTLSRHGREMWKRFQGSESEGIERREKEQEERRV

SEQ ID NO: 184168 - protein, 82 aa, Glycine max
  Coding DNA Sequence Number=SeqID_67390
  Subcellular localization annotation: CTP_CleavageSite=43; ConfidenceScore=5.26e-01
MFKTPWLCISAILGKKTRFREEKSSRSDSVTPSVSDSVEILHRSSSFFTVLRSFFILQRFSFLPFLTCFSHLLKSFSHLIKR

SEQ ID NO: 184169 - protein, 122 aa, Glycine max
  Coding DNA Sequence Number=SeqID_67391
MKLAKYRLKAQVEKDEGPSGEGQSPRVEKDEGPSNPCGVYPDLSSFTGSGVNPDLSSFTGSGVYPDLSSFTGSGVYPDLSSFTGSGVVQKLYSLYQTIRPVLSYMSRLHNDRCRLLYFLFNS

SEQ ID NO: 184170 - protein, 544 aa, Glycine max
  Coding DNA Sequence Number=SeqID_67392
  Gene Ontology: Mol. function=hydrolase activity, acting on ester bonds; Cellular component=periplasmic space; Biological process =nucleotide catabolic process
  Homolog annotation: Hit_ID=Q6D7Z1; Match level="QueryCoverage=88%, HitCoverage=87%, E-value=1e-178, Identity=60%"; Hit description =Protein UshA [includes: UDP-sugar hydrolase and 5'-nucleotidase]
  Pfam annotation: Domain name=5_nucleotid_C; Domain location=400-544; Score=134.5; E_value=2.9e-37; Accession=PF02872.8; Description=5' -nucleotidase, C-terminal domain
  Pfam annotation: Domain name=Metallophos; Domain location=71-293; Score=79.5; E_value=1.1e-20; Accession=PF00149.18; Description =Calcineurin-like phosphoesterase
  Pfam module annotation: Pfam domain module=5_nucleotid_C::Metallophos; Domain location=400-544::71-293
MTVFAFGLELKGELCDTEGRKSTSGAPPGKKRRIRRSALLLSPHRGRWLALIMLLLPLLAQAWQPERSYRFSILHTNDHHGHFWANAQGEYGLAAQKTLMDQQRYDVQAKGGGALILSAGDVNTGVPESDVLNAEPDIRGMNLIGYDAMALGNHEFDKPLSVLQKQQKWAKFPFLAANIYAKGSDKRLFKPWAIFNRMGLKIAVIGLTTTDTLRIANPQNVAQIEIRDPVKETEKAVAELRASDKPDVIIALTHMGHYDDGQHGSNAPGDVELARSLPPGTINVIVGGHSHDAVCMAKENVSVADYQPGQPCQPDRQNGVWIVQAKEWGKFVGRGDFTFRNGELTLDNYQLIPVNLKHKVKNLDGSETWLPYQEAIAQNGAMMKLLTPYQLRAGKQLAVNVGRSDSVFDGDRSKVRFEQMPLAQLILRAQMAATQADFAVISGGGIRTSLAQGEISWRDLLQIQPFGNQVVSVTLTGKELLNYLATVANIKADSGGFAQFSNISLVADGKSVSAVKINGEPLQLDKTYRMATNSFNASGGDGYP

SEQ ID NO: 184171 - protein, 307 aa, Glycine max
  Coding DNA Sequence Number=SeqID_67393
  Gene Ontology: Mol. function=[isocitrate dehydrogenase (NADP+)] kinase activity; Cellular component=cytoplasm; Biological process =glucose metabolic process
  Homolog annotation: Hit_ID=Q8PFZ0; Match level="QueryCoverage=94%, HitCoverage=50%, E-value=1e-127, Identity=78%"; Hit description =Isocitrate dehydrogenase kinase/phosphatase
  Pfam annotation: Domain name=AceK; Domain location=1-304; Score =236.6; E_value=5.2e-68; Accession=PF06315.2; Description=Isocitrate dehydrogenase kinasephosphatase (AceK)
LRCAAPIAVRLQDDLAHWADTPVRSIELLDTVFYRERRAYLVGRVFGEHRFSPCVIALVNDERGLRADAVLTRRRDVAHLFGVSRSYFQANLTTVGDAVVFLRSLLPGKPIDEIYTVLGRAKQGKTERYRTFFRHFNEHPQERLVHAEGTPGMVMAVFTLPSYPLVFKLIRDRFVWPKAMSRQQVEEKYALVFNLDRVGRLLDAQPYRHLRFPRERFAPALLEELLQQCAQSVRVDGDEVEIALCYVQRRFRPLNLYLREQGGEAVRAAVLDYAQAITDMARNNIFPGDMLPKTSAYRGTSRRVLRL

SEQ ID NO: 184172 - protein, 394 aa, Glycine max
  Coding DNA Sequence Number=SeqID_67394
MERKDGLWHSTLRPKDLWKEGVLRIDPFSYSPSETLQEEYVHLFSNYFGRAGYIREFPLRNPSSPNLNNIIFEHSPSNGKVYPPRAIVWRSKESRESLSIEDIYLEDPELSPTFSDWEFSYYGMHLYLCLNQYKEEIRARKASFRCLQRLNVHLPFISGSQFLCFAHSETKFQLGMDKPMLIPKADCYKGKKKLIEDDKDAPPTRYVKAKPNRLFKREVAVLHQNELTSRNWQALQRYYKPGAHCSGLEPEEKPPLKGVHHKTGRCYQTINRNPLVVDSPSNCVCQWKKDFVVVSERNFSFTVELPNSTFTFIHQVQPIIEEVNSNYKAPTTIKDTAMEVYDGPPPSQKYVHFLEKTLLRTTESLVEALYDRAHAKIKAKRWKMLGEFLFYKLF

SEQ ID NO: 184173 - protein, 256 aa, Glycine max
  Coding DNA Sequence Number=SeqID_67395
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=6e-39, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LYTLAFRGLHAFAFRGLNALAHRGFHAFPFRGIHVLAFRGKLNVLAFRGLHVLAFRGLHALVFRGLHVLAFRGLHTLAFKGLQILTFRGLHVLAFRGLHVLAFRGLHVLASRGLHVLAFRRLHALAFTGLDVLAFIGLHVLTFRGLHVLAFRGLHVFAFRGLRVLAFRGLHALAFRGWDILAFKGLHTLTFRGLHVLAFKGPRLKRATRPRLQRIARPRLQRTARPRLHRTAHPRPQRATLPRLQRTARPRLLIEA

SEQ ID NO: 184174 - protein, 202 aa, Glycine max
  Coding DNA Sequence Number=SeqID_67396
  Gene Ontology: Mol. function=oxidoreductase activity; Cellular component=integral to membrane; Biological process=electron transport
  Homolog annotation: Hit_ID=Q2LAK5; Match level="QueryCoverage=99%, HitCoverage=75%, E-value=2e-82, Identity=72%"; Hit description =Cytochrome P450 monooxygenase CYP71D54
  Pfam annotation: Domain name=p450; Domain location=1-197; Score= -153.8; E_value=0.00057; Accession=PF00067.12; Description=Cytochrome P450
DIFAAGTDTSASTLEWAMAEMMRNPRVWEKAQAELRQAFREKEIIHESDLEQLTYLKLVIKETFRVHPPTPLLLPRECSQPTIIDGYEIPAKTKVMVNAYAICKDSQYWIDADRFVPERFEGSSIDFKGNNFNYLPFGGGRRICPGMTLGLASIMLPLALLLYHFNWELPNKMKPEEMNMDEHFGLAIGRKNELHLIPNVNL

SEQ ID NO: 184175 - protein, 174 aa, Glycine max
  Coding DNA Sequence Number=SeqID_67397
  Gene Ontology: Mol. function=protein dimerization activity
  Homolog annotation: Hit_ID=Q2R1C3; Match level="QueryCoverage=50%, HitCoverage=12%, E-value=4e-12, Identity=44%"; Hit description=HAT family dimerisation domain containing protein
  Pfam annotation: Domain name=zf-C2HC_plant; Domain location=16-78; Score=24.3; E_value=5.3e-05; Accession=PF07567.3; Description =Protein of unknown function, DUF1544
MSCITEMFASLEYQDDHATLWSFVTIKEKIGDGGGSRMWSCNFCEKVVKSSYFRVKAHLLRICGSGIATCPKVTDAYLVDLRRVFEEAENRLKSKNVPLPTDKRTPTPPIGVTQWYMTVLHTGTRCCSTRGAIVGRCTIARVEARAHTRVNDAEFHDGVRRKCRRFVISMTVII

SEQ ID NO: 184176 - protein, 123 aa, Glycine max
  Coding DNA Sequence Number=SeqID_67398
  Gene Ontology: Mol. function=transferase activity, transferring glycosyl groups; Cellular component=phagocytic vesicle; Biological process='de novo' pyrimidine base biosynthetic process
  Homolog annotation: Hit_ID=Q1RU71; Match level="QueryCoverage=72%, HitCoverage=19%, E-value=5e-31, Identity=76%"; Hit description =Phosphoribosyltransferase; Orotidine 5-phosphate decarboxylase (Uridine 5'-monophosphate ...
  Homolog annotation: Hit description=synthase (Ump synthase) [includes: orotatephosphoribosyltransferase (Ec 2.4.2.10) (Oprtase); orotidine 5'-phosphate decarboxylase (Ec 4.1.1.23) (Ompdecase)])
MGVGSNRRASPSQHGEPRSKSLLREHTGKCTSMESLVLQLHEISAIKFGNFKLKSGISSPIYIDLRLAISYPSVLRNISQTLISSVSSTSFDLACGVPYTALPIATCVSVTQNIPMVMRGKDA

SEQ ID NO: 184177 - protein, 365 aa, Glycine max
  Coding DNA Sequence Number=SeqID_67399
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=95%, HitCoverage=62%, E-value=5e-81, Identity=34%"; Hit description =Tyrosine protein kinase, active site
  Pfam annotation: Domain name=LRRNT_2; Domain location=15-54; Score =43.4; E_value=7.9e-10; Accession=PF08263.3; Description=Leucine rich repeat N-terminal domain
  Pfam annotation: Domain name=LRR_1; Domain location=107-129; Score =17.4; E_value=0.051; Accession=PF00560.23; Description=Leucine Rich Repeat
  Pfam annotation: Domain name=LRR_1; Domain location=131-153; Score =12.4; E_value=1.3; Accession=PF00560.23; Description=Leucine Rich Repeat
  Pfam annotation: Domain name=LRR_1; Domain location=155-177; Score =9.9; E_value=4; Accession=PF00560.23; Description=Leucine Rich Repeat
  Pfam annotation: Domain name=LRR_1; Domain location=179-201; Score =2.5; E_value=98; Accession=PF00560.23; Description=Leucine Rich Repeat
  Pfam annotation: Domain name=LRR_1; Domain location=203-225; Score =16.8; E_value=0.077; Accession=PF00560.23; Description=Leucine Rich Repeat
  Pfam annotation: Domain name=LRR_1; Domain location=226-248; Score =8.9; E_value=6.1; Accession=PF00560.23; Description=Leucine Rich Repeat
  Pfam annotation: Domain name=LRR_1; Domain location=250-272; Score =10.7; E_value=2.8; Accession=PF00560.23; Description=Leucine Rich Repeat
  Pfam annotation: Domain name=LRR_1; Domain location=274-296; Score =17.5; E_value=0.048; Accession=PF00560.23; Description=Leucine Rich Repeat
  Pfam annotation: Domain name=LRR_1; Domain location=298-320; Score =14.7; E_value=0.35; Accession=PF00560.23; Description=Leucine Rich Repeat
  Pfam annotation: Domain name=LRR_1; Domain location=322-344; Score =16.3; E_value=0.11; Accession=PF00560.23; Description=Leucine Rich Repeat
  Pfam annotation: Domain name=LRR_1; Domain location=346-365; Score =1.2; E_value=1.7e+02; Accession=PF00560.23; Description=Leucine Rich Repeat
  Pfam annotation: Domain name=LRR_1; Domain location=58-81; Score=1.2; E_value=1.7e+02; Accession=PF00560.23; Description=Leucine Rich Repeat
  Pfam annotation: Domain name=LRR_1; Domain location=83-105; Score =14.1; E_value=0.52; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1; Domain location=15-54::107-129::131-153::155-177::179-201::203 -225::226-248::...
  Pfam module annotation: Domain location=250-272::274-296::298 -320::322-344::346-365::58-81::83-105
MASPPSYDAFASSEIATEANALLKWKASLDNQSQASLSSWTGNNPCNWLGISCHDSNSVSNINLTNAGLRGTFQSLNFSLLPNILILNMSHNFLSGSIPPQIDALSNLNTLDLSTNKLSGSIPSSIGNLSKLSYLNLRTNDLSGTIPSEITQLIDLHELWLGENIISGPLPQEIGRLRNLRILDTPFSNLTGTIPISIEKLNNLSYLDLGFNNLSGNIPRGIWHMDLKFLSFADNNFNGSMPEEIGMLENVIHLDMRQCNFNGSIPREIGKLVNLKILYLGGNHFSGSIPREIGFLKQLGELDLSNNFLSGKIPSTIGNLSSLNYLYLYRNSLSGSIPDEVGNLHSLFTIQLLDNSLSGPIPASI

SEQ ID NO: 184178 - protein, 106 aa, Glycine max
  Coding DNA Sequence Number=SeqID_67400
MDIKGWCNSGRRTIQLGKSYNEIEHINSLSATGTSNKLRWKLLWMKLKKEKKKIFESASSFQVPYDQYTYSQNFDQGTALDEPDNLSRSFSVRFADPSIVLVKRKG

SEQ ID NO: 184179 - protein, 306 aa, Glycine max
  Coding DNA Sequence Number=SeqID_67401
  Homolog annotation: Hit_ID=Q6F379; Match level="QueryCoverage=86%, HitCoverage=50%, E-value=2e-14, Identity=25%"; Hit description =Expressed protein
  Pfam annotation: Domain name=Frigida; Domain location=93-305; Score= -41.0; E_value=1.5e-06; Accession=PF07899.2; Description=Frigida-like protein
MATRVHQFFDELEAKKTILAKCTDLFTTLSTHFSSLQHSISEKSQSLDSNLQSLDSLSKETLESLHRRETSIPERESAAAARIEEQREAALADLRATHPPDPDLSATLKSLWRKMDAPALLRFVVSKRKESASLRAEIAAAMAEAVDPARLVVEAVEEFLKSKVAKSGVTDKRWACGLVIQALMVSESESREYSRRIAERAVSVVEMWKEHLDGESESGAAEVVMFLQMVVCFGLRSRFDDEYLRKLVMQFASRRDMAKLAASLQFGDKIIGGARCYSNIVHFFFTCTLSYYESATIEFFLHFASN

SEQ ID NO: 184180 - protein, 100 aa, Glycine max
  Coding DNA Sequence Number=SeqID_67402
  Gene Ontology: Mol. function=protein-tyrosine kinase activity; Biological process=protein amino acid phosphorylation
  Homolog annotation: Hit_ID=Q1SML3; Match level="QueryCoverage=98%, HitCoverage=8%, E-value=9e-28, Identity=65%"; Hit description =Tyrosine protein kinase, active site
MEVNEKCDVYSFGVLAWEILLGKHPGDVISSLLLSSSSNGVTSTLDNMALMENLDERLPHPTKPIVKEVASIAKIAIACLTESPRSRPTMEHVANELEMS

SEQ ID NO: 184181 - protein, 148 aa, Glycine max
  Coding DNA Sequence Number=SeqID_67403
MGLEESRQRKKQGSKNKEIANITKERNHTKRKKISKFENEPRVVLPLKHSSKVRNHNEAKVLAQVSACSKSCSNSRRKCGSGPSGLRTSSNLPTKQKKLKLAKRFTYQARKVEGKQGVVVCPRIGTHETTYSLLARPSAKCQMRILRI

SEQ ID NO: 184182 - protein, 56 aa, Glycine max
  Coding DNA Sequence Number=SeqID_67404
MTKGRALRLKNNNPRLYKTGSLLVGLCKKTHLRGWISYLRLCLKRIKSFITWINKY

SEQ ID NO: 184183 - protein, 132 aa, Glycine max
  Coding DNA Sequence Number=SeqID_67405
  Gene Ontology: Mol. function=RNA-directed DNA polymerase activity; Cellular component=mitochondrion
MSDFASTFNNYHLNIFHGCGQNYQTGRMYKSLIQQFQEVKWRYLFKGNMARPRARFILWMACHERMATKDRLMRFGMLNDDTCCYCKEKETIQHIFFQCNVLSQFWKHTLKWLEVPHSPGVWNEELDWIIKK

SEQ ID NO: 184184 - protein, 159 aa, Glycine max
  Coding DNA Sequence Number=SeqID_67406
  Homolog annotation: Hit_ID=Q1T413; Match level="QueryCoverage=44%, HitCoverage=53%, E-value=2e-16, Identity=61%"; Hit description=SKP1 component
MGTTPNPCEKDHAEEFRWQGIRGGRGSGVGVLDDKACMIKDDCTDNAKVIQYCKKHIEAANPEDKPSEDDLKTWDTDFVKFCKVREKNISKKKEENFDTVIVVATMEFTATTTTLIKKLSNNGGYDVSNSSTYDGVFATPIMPRTLSFSSQFSDYHEIF

SEQ ID NO: 184185 - protein, 266 aa, Glycine max
  Coding DNA Sequence Number=SeqID_67407
  Homolog annotation: Hit_ID=Q9LHJ4; Match level="QueryCoverage=31%, HitCoverage=38%, E-value=5e-09, Identity=43%"; Hit description =Genomic DNA, chromosome 3, P1 clone: MMF24
MKGSSKVIMGATLVMVVTLAVVLVLIFVLLAELYCSLLLRRRHLRNRNSNNSTIPTARANASPSHTDTASLPQQQQSPPFRSIYAQGVLQAPRSILLPAVSCKEDKAGPRKQKHYSQLLQIQIQPQDSNSSPSPPPSLISIAPSRSNLCHDDDKQSCNGGEKHLVYISNPIYESQGSGADTPFETPDTSPSRLERSGSSEEDDAAAEACVTHSPCTPPLTPMKKLPAEASSVSLRDARSLATSCSDSRSNNGLSSSSASPCTSPSW

SEQ ID NO: 184186 - protein, 181 aa, Glycine max
  Coding DNA Sequence Number=SeqID_67408
  Gene Ontology: Mol. function=nucleotide binding; Cellular component =membrane; Biological process=small GTPase mediated signal transduction
  Homolog annotation: Hit_ID=Q9SBU1; Match level="QueryCoverage=99%, HitCoverage=91%, E-value=2e-66, Identity=69%"; Hit description=GTP binding protein
  Pfam annotation: Domain name=Arf; Domain location=1-153; Score=-74.0; E_value=0.00046; Accession=PF00025.11; Description=ADP-ribosylation factor family
  Pfam annotation: Domain name=Miro; Domain location=2-108; Score=46.1; E_value=1.2e-10; Accession=PF08477.3; Description=Miro-like protein
  Pfam annotation: Domain name=Ras; Domain location=1-155; Score=273.6; E_value=3.8e-79; Accession=PF00071.12; Description=Ras family
  Pfam module annotation: Pfam domain module=Arf::Miro::Ras; Domain location=1-153::2-108::1-155
MGAGKTSLVLRFVKGEFSEYQESTIGAAFFTHVLSLNEATVKFDIWDTAGQERYHSLAPMYYRGAAAAIVVYDITSMDSFVRAKKWVREVQRQANSSLTMFLVANKADLEDERKVRYEEGEEYAKENGLSFLETSAKTAQNVNELFYEIAKRLVKANPSRQSGMKLHTRPGETRRGFLCCT

SEQ ID NO: 184187 - protein, 101 aa, Glycine max
  Coding DNA Sequence Number=SeqID_67409
MALHALSDGATNLDFPIRLKVFGHSGGENTQRKQKCMAKGSHNVTKVRWGQGQGDVRVDLKLGAVRDTIRTMSDTRRYCDDIGITKFRSRRRWWCKALVWW

SEQ ID NO: 184188 - protein, 797 aa, Glycine max
  Coding DNA Sequence Number=SeqID_67410
  Homolog annotation: Hit_ID=Q3LHL2; Match level="QueryCoverage=20%, HitCoverage=33%, E-value=1e-17, Identity=31%"; Hit description =Hypothetical protein PPS5
  Pfam annotation: Domain name=DUF292; Domain location=51-172; Score =133.3; E_value=6.7e-37; Accession=PF03398.5; Description=Eukaryotic protein of unknown function, DUF292
MLDGILGRGFTAKWFALCALFDEESVVMLLTTINVFSSAAFFVFSKSLIKLTKSRIDVIRRKRRATEKFLKKDIADLLLNGLDINAYGRAEGLVVELTLSSCYGFVEQCCEFVLKHLPAMQKLSGCPEECRMAVSSLMFGAARFSDLPELRDLRQIFQERYGNCMECYVNQEFAANLNFKFSTLENKVSLMQEIASEFSINWDSKAFKLRMSRSSATAQGHNACVPNHDKPSHGKDFTQKEVRNDVLLEKNCDLANNECRFQNGKEAVVLNRLDHDLHSKSTLPGNGFKPLNGHEVLRKRDGHDNSGRQEITVEKSDKGCWKEGSMLKPIGHPSQQKTVEQFEGGSKLQYSRGNITPPRANQGSMLKLFGHPSQQKNVEQFEGGSEQQRSRGNATPPRENQVSMLKSFGHPSQQKIVEQFEGGPKLHYSRADITPSRANQGSMLKSIGHPSQQKTVEQFKGGSKLQDSMGNTTPLRENQGTTTSRKSSSHAGSRFKSNVNESFAVNHVGLPGTDKSERENQRDETPTLKPCYSNVIPPPYLKHPNSKQQSSTRGANMISSLTDSGGISTYHSAHEKPDAASVLERRIQIDLDSSDQDWQGNRHERRSKQSREKEISEEVPVVKPRSMRRRQSRSRLPGYYDATNEDSGLNRKSRSRSRRRDESRRGLKAMLDDERYQNAEEERIIDKLLIHYSKKPSVLVPEKLKRNSKVHHAHDSTTELLQNGSGYGSDETPEMVSHHASRSFSLPREQHREAEIKKKVFTRAATFEPVRSLEARHVHPKLPDCDDLAARIAALRA

SEQ ID NO: 184189 - protein, 411 aa, Glycine max
  Coding DNA Sequence Number=SeqID_67411
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=98%, HitCoverage=96%, E-value=1e-158, Identity=65%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=34-398; Score=- 408.9; E_value=6.5e-05; Accession=PF00743.9; Description=Flavin -binding monooxygenase-like
MEYLKEVEGKTVHDYLEVKMGKMTKPIGVEGPVIVGAGPSGLAAAACLKQKGIPSLILERDDCLASMWQLKTYDRLCLHLPKQFCQLPLMPFPQNFPSYPTKQQFLAYLKAYADHFDIKPALSKTVISANFDHRCGYWRVKTQGVKKEETEYVCQWLIVATGENAEEVVPQIEGMSEFEGPILHTSSYKSGSMFCGKNVLVVGCGNSGMEVCLDLCNHHARPSLVVRDTVHILPQQMFGKSTFGLSLSLLNWFPMRLVDKFLLLMSHLILGDTAQFGLNRPKIGPLELKNLCGKTPVLDFGTLAHIKSGKIKVCRGIKQLAQHKAEFVDGKIEDFDVIILATGYKSNVPTWLKGSDMFCEKDGLPRKPFPNGWRGENGLYAVGFTKRGLLGASFDAKRIAGDIEHCWKAAN

SEQ ID NO: 184190 - protein, 149 aa, Glycine max
  Coding DNA Sequence Number=SeqID_67412
  Gene Ontology: Mol. function=nucleic acid binding; Biological process= DNA integration
MELQQIDVKIAFLHGRLEEDILMQQLKGFEKLKPLLSSEFEMKDMGVAEKIMGMEIKKDQVQKKSNLAQAVNVVSRYMGNPGKKHWQDVKHIFRFGCKEIYDWARIHNWKLSFQLEENTLAHNDFVHYGGRVHGSGRSNKGRNLVEGPD

SEQ ID NO: 184191 - protein, 352 aa, Glycine max
  Coding DNA Sequence Number=SeqID_67413
  Gene Ontology: Mol. function=nucleic acid binding; Cellular component= intracellular; Biological process=DNA integration
EGTLLKEHLDELNSILMELRDIDFKMEDEDLEMILLASFPPFYENFMSSFSIGKDSITLKEVKMTSENDLVLVASEQLQQHYEKCVLDLGFSYCMCPHRLWFVTYEKKTGGNILMDNDAPCKSVGIGFAQIRMHDGVVRNLIEVHHVPELKKNLVFVDVRDLKGFSYWVEGGVMQGTNQENSYILRGHMSEKVLNILSKQGLLENHKIEPLKFCEHCFYGKQHWVKFPNVVHTTKAMLNYVHFDCWGPSRVPSLGRERARHRTICYTPQQNKVVERMNMTLLEKDRCTTCYLVNHSLSTAIDFKTFIEVWSNNLTEYSLLKVILSKDVFFDKLAMMGSKSDEDLGKAKDVTK

SEQ ID NO: 184192 - protein, 113 aa, Glycine max
  Coding DNA Sequence Number=SeqID_67414
MKFSRIKFQESRSRFKTQDSRIKKRINQDNSSGGYIHLVVQREQGRVHPLWIFACKGFYKVEKKSQGPKKNLLVDGGRDCRASDSSFTSDAKHVMRGRERAMESARACVVFRE

SEQ ID NO: 184193 - protein, 173 aa, Glycine max
  Coding DNA Sequence Number=SeqID_67415
  Gene Ontology: Mol. function=RNA-directed DNA polymerase activity; Biological process=RNA-dependent DNA replication
  Homolog annotation: Hit_ID=Q1S7B8; Match level="QueryCoverage=96%, HitCoverage=21%, E-value=5e-25, Identity=36%"; Hit description=RNA -directed DNA polymerase
MGFSPKWIKWMDGCIRTTSMSILVNGNPTAEFIPQKGIRQGDPLAPLLFNIVVEGLMGLMREALKENKYKGLLVGKDGIEISILHIHAKVKVLKAILRSFEMGDFDKVNPKLNSLVTLQRRFLWGGDMDSQKISWVSWETACLSKKKRGLGIRDLTKFNQALLGKWKWDIFHH

SEQ ID NO: 184194 - protein, 482 aa, Glycine max
  Coding DNA Sequence Number=SeqID_67416
  Gene Ontology: Mol. function=ammonium transporter activity; Cellular component=membrane; Biological process=transport
  Homolog annotation: Hit_ID=Q84KJ6; Match level="QueryCoverage=92%, HitCoverage=92%, E-value=1e-162, Identity=61%"; Hit description =Ammonium transporter
  Pfam annotation: Domain name=Ammonium_transp; Domain location=26-440; Score=257.9; E_value=2.1e-74; Accession=PF00909.11; Description =Ammonium Transporter Family
  Pfam annotation: Domain name=DUF1112; Domain location=236-426; Score=- 123.8; E_value=0.084; Accession=PF06539.2; Description=Protein of unknown function (DUF1112)
  Pfam module annotation: Pfam domain module=Ammonium_transp::DUF1112; Domain location=26-440::236-426
MSGVPLPSNLLPGDGSPEWFSRADNAWQLIAATLVGLQSVPGLIILYGGAVKKKWAVNSAFMSLYAFACVFFCWVVWGYRMSFGDELLPFWGKPAMSLEHTYLFKRAFLGAFPNATMVYFQCVFAAITLILIAGAVLGRMNFYAWMLFVPLWLTFSYTFTAFSIWSSSGFLTKMGIIDYSGGYVIHLSSGVAGFTAAYWVGPRLNKDRERFPPNNILLMLAGAGLLWMGWTGFNGGDPYTVNSDASLAVLNTHACTATSLLTWVILDVLFFRKPSVIGAVQGMITGLVCITPAAGVVEGWAALIMGVLSGSIPWFTMMVVHKRSKLLQKVDDTMAVFHTHAIAGTLGGLLTGLFADPRLNKLFYGTDGQYVGFFYGLGSKKVSTGFRQMGVQILGIIFVIFVNVISTSLICLFIRIFVPLRMSEEDMEIGDEAAHGEEAYAIWGQGDKLENSSSKYGSSLYDDVEAGGPKKKRGGTVEMMSN

SEQ ID NO: 184195 - protein, 103 aa, Glycine max
  Coding DNA Sequence Number=SeqID_67417
MVHGLPPIGMPKRLCVESCESKQPRNSFKLQIRSNEKLEVIFSNVCGPLEVKTLEEKCGFISEKKSEVFDIFIYKGVIGEIPTKPLIIYLDKGHFCLVMTSTE

SEQ ID NO: 184196 - protein, 54 aa, Glycine max
  Coding DNA Sequence Number=SeqID_67418
MKAREGDGQQQHRRVWDEAMQRLRVKVMRVMSVNREGHLLGLILIWDKGEHRFL

SEQ ID NO: 184197 - protein, 124 aa, Glycine max
  Coding DNA Sequence Number=SeqID_67419
MGKNVDEIQKNIDEMKRKEVLAIQEFLKHPQEHMDANSTDDGVEYTETLKPVVQRTELPNFDGSDPIGCSGRRVYQYSKRKIREGGASGLCNCSRYFPEVEQESLRPTSHYPSNNIGWRLCAAV

SEQ ID NO: 184198 - protein, 396 aa, Glycine max
  Coding DNA Sequence Number=SeqID_67420
  Homolog annotation: Hit_ID=Q0KIN0; Match level="QueryCoverage=33%, HitCoverage=7%, E-value=2e-14, Identity=31%"; Hit description =Integrase core domain containing protein
MATTVTLWLTTSNFGFAIFRAHDTCQAAWDEVKSLYTKDSQCLYGICQNLTSVIAARQFDGTMVDYLGKVNGLLFDFNELLPLTSTPDEELEQLQSFFMLLALYGPLTEYSLVPDHILGSPNIPTINSAWSTLLLVLAKPFVDVDVPPPYVDSSALWYEERQDSSFTASIADTTDIGSQTQSQGIGIDLSSGWTIGTGCELHGLYQLNTFAHAGFVVDSLLFIHAQWGHPSLAKLQKMEAKTLVANPVPERGSYRSVPAGATAVPPPRIGKREGENEDEQQVNAKKHKRHEVAEEQRIMDEIVSDDSFEDFEPDKNPEAKKDSLSKQEKKGKPDSANCSGSLESLADGSEEGKHQNPKRIDLMLDRRNFNQSQISLEYNNGLDSYRSFDEGITNTE

SEQ ID NO: 184199 - protein, 100 aa, Glycine max
  Coding DNA Sequence Number=SeqID_67421
MELAKFALSNKGDVAVYVEHTMSTIECIEQLDNGTVSGKKQENGEDGKNMDVGVFNEIGMMMMQFHPRALDRRLQEVWVRVTGGSSRVLMSRRVDFRFMD

SEQ ID NO: 184200 - protein, 466 aa, Glycine max
  Coding DNA Sequence Number=SeqID_67422
  Homolog annotation: Hit_ID=Q10KE4; Match level="QueryCoverage=40%, HitCoverage=24%, E-value=8e-11, Identity=28%"; Hit description =Expressed protein
  Subcellular localization annotation: CTP_CleavageSite=89; ConfidenceScore=5.20e-01
MSGCPTHPQPDFGQNNQLKARKKSQGKLEGKSLKEFYGSWSPSSTTSGQFQNQLVSSVIQSSPSSILGQWNELQGPETLYQDITNTYVTSSAYGNLTNTYSSMSMLPQAQSGVLMRQPLLSRYEASLGVMNPVSKSVDLVKPLTMTPQEKIEKLRRRQQMQAMLAIQKQQQEFGHQVPSTNKSMNEKCAIEIHSQLCDGADPEIEDLRTALDPPTEQDDSNTMSLAIDDHFVEDTILYMLQDAISKLDVKIRLCIRDSLFRLAQSAMQRNYANDTSSTNNTSREELKVAAREESNSQNSGQTQNVLSGGNSKNIFIFYGVDRKILQDMYDGVTTGMKTPRSETKDVPIRIRYARIADVETKTNPIDRTVAHLLFHRPLELTGNYPDKLESPISAKIQFESREANMEKFHMGCLPDEDLKSNQQFSHQGLEAQPEDQFKNSRCIDTSENASNNVLADAGDQVLEALQ

SEQ ID NO: 184201 - protein, 411 aa, Glycine max
  Coding DNA Sequence Number=SeqID_67423
  Gene Ontology: Mol. function=peptidase activity; Cellular component =endoplasmic reticulum; Biological process=proteolysis
  Homolog annotation: Hit_ID=Q1SAR7; Match level="QueryCoverage=100%, HitCoverage=94%, E-value=1e-109, Identity=51%"; Hit description =Eukaryotic aspartyl protease, putative
  Pfam annotation: Domain name=Asp; Domain location=87-408; Score= -150.2; E_value=9.8e-05; Accession=PF00026.14; Description=Eukaryotic aspartyl protease
MSHSSCLTLVLLCLYNICFSEALKSGFSVEIIHRDSSRSPFYRATETQFQRVTNAVRRSMNRANHFNQISVYSNAVESPVTLLDDGDYLMSYSLGTPPFPVYGIVDTASDIIWVQCQLCETCYNDTSPMFDPSYSKTYKNLPCSSTTCKSVQGTSCSSDERKICEHTVNYKDGSHSQGDLIVETVTLGSYNDPFVHFPRTVIGCIRNTNVSFDSIGIVGLGGGPVSLVPQLSSSISKKFSYCLAPISDRSSKLKFGDAAMVSGDGTVSTRIVFKDWKKFYYLTLEAFSVGNNRIEFRSSSSRSSGKGNIIIDSGTTFTVLPDDVYSKLESAVADVVKLERAEDPLKQFSLCYKSTYDKVDVPVITAHFSGADVKLNALNTFIVASHRVVCLAFLSSQSGAIFGNLAQQNFL

SEQ ID NO: 184202 - protein, 48 aa, Glycine max
  Coding DNA Sequence Number=SeqID_67424
MLKNTKNEDTLSKNGNRKEEKEGILKQAQPNSGAKLASGAKRATTCRC

SEQ ID NO: 184203 - protein, 68 aa, Glycine max
  Coding DNA Sequence Number=SeqID_67425
MDHVSRSVTPKKQQPSSTIGCLRELTEADDDEDGLVFRKLKVASPSDETHVPQVKKVKPTPLVLPSPT

SEQ ID NO: 184204 - protein, 70 aa, Glycine max
  Coding DNA Sequence Number=SeqID_67426
MSSNSKQNHLTEIAKVDDAYLSAVFLSSSWVFPAILNAAIEEFGLASTRGMRLVSGNLQVAGLLSFFRVA

SEQ ID NO: 184205 - protein, 57 aa, Glycine max
  Coding DNA Sequence Number=SeqID_67427
MEELVKGIGEEEIKKAKWARLVKCRIYELAKPHHALGEPSAKHTILWLTAQKNLEEG

SEQ ID NO: 184206 - protein, 1155 aa, Glycine max
  Coding DNA Sequence Number=SeqID_67428
  Gene Ontology: Mol. function=zinc ion binding
  Homolog annotation: Hit_ID=Q9FN44; Match level="QueryCoverage=97%, HitCoverage=23%, E-value=0.0, Identity=54%"; Hit description=Genomic DNA, chromosome 5, P1 clone:MYJ24
MAPWLSWEKLPSSGSQGGPSPEWIRIFWKSFRGSQEELSLFSDWPLIPAFLGRPVLCCVRERHLVFIPPPLLEHPTSTSGISERESAESYVSGVRVSRDNTSEAELAESYISAFARFKTSYPWLLPMLNQCNIPIFDEAFIDCAASNSCFSMPGQSLGHVIASKLVGAKQAGYFIEPTNLSTSNCDALFSLFSDEFFSNDFYYAQEEIEVLRSLPIYKTVVGSYTKLQGQDQCMIPSNSFLKPYDEHCLSYATDSNESSFLRALGVLELHDQQILVRFGLPGFEGKPQNEQEEILIYIFKNWHDLQSDQSVVEALKGTAFVRNSDEFSTDMLKPMDLFDPVDAILISIFFGERRKFPGERFSTDGWLRILRKLGLRTATEVDVIIECAKRVEFLGIECMKSGDLDDFEADTINTRSEVSPEVWALGGSVVEFVFSNFALFFSNNFCDLLGKIACVPAELGFPSVDCKRVLASYNEAILSKDWPLAWSCAPILSKQHTVPPEYSWGPLHLRSPPPFCTVLKHLQVIGRNGGEDTLAHWPIASGMNIEECTCEILKYLDKVWGSLSSSDVAELCKVAFLPVANGTRLVAADALFARLMINLSPFAFELPTVYLPFVKILKDLGLQDMLTLSAAKGLLLNLQNACGYQRLNPNELRAVMEILNFICDQIVEQNTLDGSNWKSEAIVPDNGCRLVHSASCVYVDSYGSRYVKCIDTSRIRFVHADLPERVCIVLGIKKLSDVVIEELDENHTLQTLGSLGSVLLVTIKQKLSSKSLQTAVWSVVNSMSSYIPAFNSFSLDTIEFLLNSTAEKLQFVKCLKTKFLLLPNLVVVTRAGKDFIIPEWKNDSAHQTLYFMNQSRSRILVAEPPTYISLFDLIAIIVSQVLGSPIILPIGSLFGCPEGSEIAVVNVLKLCSDKKEVEPVNGSSNMVGKEILPQDARLVQFHPLRPFYSGEIVAWRPQHGEKLKYGKVSEDVRPSAGQALYRLKIEVSPGDTQSFLSSHVFSFKSVSASSPLKESLVHESPVLGSNRPHVDFPESSGRGESYAKVQPVRDQSGKVSAAELVQAVNEILSAAGIKMDVEKQALLQRTVNLQENLKESQAALVLEQERVQKATKEADTAKAAWICRMFFCSVKVSLLSASGYKSYQNFSSIISPMLL

SEQ ID NO: 184207 - protein, 560 aa, Glycine max
  Coding DNA Sequence Number=SeqID_67429
  Gene Ontology: Mol. function=calcium ion binding; Cellular component =mitochondrion; Biological process=metabolic process
  Homolog annotation: Hit_ID=Q1SQX3; Match level="QueryCoverage=70%, HitCoverage=75%, E-value=2e-32, Identity=23%"; Hit description=IMP dehydrogenase/GMP reductase
  Pfam annotation: Domain name=PPR; Domain location=147-181; Score=2.3; E_value=4; Accession=PF01535.11; Description=PPR repeat
  Pfam annotation: Domain name=PPR; Domain location=221-255; Score=3.6; E_value=2.8; Accession=PF01535.11; Description=PPR repeat
  Pfam annotation: Domain name=PPR; Domain location=304-338; Score =17.4; E_value=0.051; Accession=PF01535.11; Description=PPR repeat
  Pfam annotation: Domain name=PPR; Domain location=339-373; Score =34.5; E_value=3.7e-07; Accession=PF01535.11; Description=PPR repeat
  Pfam annotation: Domain name=PPR; Domain location=374-408; Score =18.3; E_value=0.027; Accession=PF01535.11; Description=PPR repeat
  Pfam annotation: Domain name=PPR; Domain location=409-443; Score =17.9; E_value=0.037; Accession=PF01535.11; Description=PPR repeat
  Pfam annotation: Domain name=PPR; Domain location=444-478; Score =30.2; E_value=7.5e-06; Accession=PF01535.11; Description=PPR repeat
  Pfam annotation: Domain name=PPR; Domain location=479-513; Score =31.9; E_value=2.2e-06; Accession=PF01535.11; Description=PPR repeat
  Pfam annotation: Domain name=PPR; Domain location=514-547; Score=9.9; E_value=0.5; Accession=PF01535.11; Description=PPR repeat
  Pfam module annotation: Pfam domain module=PPR::PPR::PPR::PPR::PPR::PP R::PPR::PPR::PPR; Domain location=147-181::221-255::304-338::339 -373::374-408::409-443::444-478::479-513::514-547
MATKLFFFHTQTTSLWKPRRLDDSVVTALCKSFREGRSWESITQEFRSLHLNDSSVEHVLSQLTDAKAALRFFHWAAKRNNDNNTFHHTTRSYTITINLLLTSNSLTDSRALLESLATRNTDPGAARAVAASLLDTYHAVSTSVALLAVNLLIQTYAKAKLTDVAFDLCRYVEEERGFSSSVSVVSFNVLLHALQRSEKCGGSVWEVYEFMIRRRAYPNATSLRIMIDAICKEGELQKIVDTVDRIIVGNNDCSRSRFRSPAMIVNCGLMLRILGKGRVAKSESDDVVVLLKRLLQKNLLHEKVVYSLVVHAKVVFGDLDYAWGFYLEMVQRGFEGNAFVYTLFIGAFCREGRVGKAIGLLREMQGKGLRPYGETFEHIVVGCAAAEDSEQCVSFFEEMVRVGFVPACMVFNKVVERLCEKGKVEKANGMLTVLLEKGFLPNDVTYAHLMQGYARKEEVQEVLKLYYEMEYRCVSPGLSVFGTIVQCFCRCGKVEDAEKYLRIMKGRLVRPDVSVYQALIDGYMKKGESARALHLRDEMASLEALEAFGHVEFATAEQAV

SEQ ID NO: 184208 - protein, 168 aa, Glycine max
  Coding DNA Sequence Number=SeqID_67430
MRLGEEAGKLILFGGKRGDALEESVVGEGEVVILEEKKRDTTQEQDGSVRYIEVLADNTNMVIQRSFVGMREPKKVAEQVWEFGNDIRVIGNKQMVIPMWENMEGKNHIACGRGEGGGVSKVGLGDRLKKQEVQRMVVDHKPDLICLQETKLEEVDSRLCCLLWGSYD

SEQ ID NO: 184209 - protein, 361 aa, Glycine max
  Coding DNA Sequence Number=SeqID_67431
  Homolog annotation: Hit_ID=Q9FN44; Match level="QueryCoverage=91%, HitCoverage=6%, E-value=1e-102, Identity=56%"; Hit description =Genomic DNA, chromosome 5, P1 clone:MYJ24
MHVIDVNLYSEGTTVIDRWLVVLCLGSGQTRNMALDRRYLAYNLTPVAGIAALISSNGHHANVYSRSSIMAPLPLSGCINMPITILGCFLVCHNRGRYLFKYQDRGASAEGHFDAGNQLIESWNREVMSCVCDSYVEMVLEIQKLRRDIPSSIIDSSACSAISLSLKAYGDKIYSFWPRSCERHVLSDQLGNHDNNPPSTTAVVLKADWECLKDWVIHPFYSRIVDLPVWQLYSGNLVKAEEGMFLSQPGSGLIGNLLPATVCSFVKEHYPVFSVPWELVTEIQAVGFSVREIRPKMVRDLLKVPSKPIALRSVDLYIDVLEYCLSGFQQAESSSSARDSDPASTNVFQETVNNGITSSQL

SEQ ID NO: 184210 - protein, 218 aa, Glycine max
  Coding DNA Sequence Number=SeqID_67432
MLSPLMRSHSVATLLLKWFGFNVDGHDCDSRNTRVDEAQPVSAMVVVEVVASVVVVDVVAEQEVVTARTTGARRILTEIKQETVTANVPLAVTGEMKPACSSIRDFIMELPWEAAMRSDADFGAGLVGMGAGHGIEVNIGRGASIGVSVGGDCTKEENEERWLGTMPQGGPSWMRKGRLLPLEGSREGASGLSVVPYWSGNCYVSCGAAIAIRMGLYS

SEQ ID NO: 184211 - protein, 283 aa, Glycine max
  Coding DNA Sequence Number=SeqID_67433
MSEKYYSIILPFSFFFRRLPWSRMQGGASANPKLVNPHRRPPQPYHPPRCHPGATPCSITPTTPTPQPLPPSPFPNHPRPYIKLEVPRFDGQNAMGWIFKISSWFQWMLRNSLIMSWSSLLQALESRFAPTFYGDPKGTLFKLTQWGSVNQYLNEFERLSNLIIGLPPSFLLNCFISGFTLELRREEDKLEDRCRIYLPRPLNNPPQPPQTPPPTNILPALSPRPLPSPKTQVKRFIPNEMAHKREPELCYNCDNKWNPTHRCKARFFLLIADDEKATLDPPP

SEQ ID NO: 184212 - protein, 118 aa, Glycine max
  Coding DNA Sequence Number=SeqID_67434
MPENPLQALFHNIEQVSSFVQHHLSNFIGIHFQPSGPHSGSLLSISSSTKAPLAKTASSVQLGDTAVKFLQLGNNNSNSKGNSKIVFFRKTMNESGGGGGAADLQAQDYHFFGMAESS

SEQ ID NO: 184213 - protein, 54 aa, Glycine max
  Coding DNA Sequence Number=SeqID_67435
MRKLIKERMENKVVNFMGLNKVVLGIKWMNGMIKGEDERKERITLSSEGNTQRL

SEQ ID NO: 184214 - protein, 499 aa, Glycine max
  Coding DNA Sequence Number=SeqID_67436
MDPSHPFLSFEGIVINTPFYSSFTLPNATERERERNQKNKPTRDHVLPHHLTHHYTIAMVEPKSRTVGDTERSWCRAVRGGTGIAVLAFRTSIPPDISMLQTSLRTLQTSHPILRSRLQTNATTFSFLTSPTPSINILTLTLPTNVTDPLTHILELELNRNTWHDSTTEENVFFATLYAGPSTNTWVVALRLHVSACDRTTALLLLRELFTLVEENNNKSLINQYPQEATSLAIEDLLPRGKGKKPMWTRGLDMLKYSLNSFRLTNLKFVDAKNPRFSQVVRLELNQNDTKEVLAGCKLSGIKLCGALVAAGLMAVHCSKRSSRKYGVVTLTDCRSSLEPSLTDKFGFYHSAILNSHEMKGGETLWDLAKRTYEAFANSKKCNKHFSDMADLNFLMCKAIENPGLTPSSSLRTSIMSVFEDTVFDNGGKKQREIGVEDYMGCASVHGVGPSIAIFDTIRDESLDCLCVYPTPLHSREQMIEFVEKMKVILIEATKTCKK

SEQ ID NO: 184215 - protein, 53 aa, Glycine max
  Coding DNA Sequence Number=SeqID_67437
MGRYNKQKGAEIKEKKKKIRRSPVQQGAKREDTPNAQEGKALSARHALSVRWH

SEQ ID NO: 184216 - protein, 59 aa, Glycine max
  Coding DNA Sequence Number=SeqID_67438
MYIWECPTEAMLSRLHEVDVVLGLFPTHPLTPSTSWARGVNNKWWVFVTTKRGLAEAWS

SEQ ID NO: 184217 - protein, 124 aa, Glycine max
  Coding DNA Sequence Number=SeqID_67439
MTVGKQPLPGSQSAPSRASQGVYVPYHKERPRICIHFSICKICLVPMVDKIPGGARLGFITIGDGKTEVLVHIDCLVFPPTENSAPIFRAIRNGPLKDKAPPGEPRIMRSLLQALQKSVEIARL

SEQ ID NO: 184218 - protein, 79 aa, Glycine max
  Coding DNA Sequence Number=SeqID_67440
  Subcellular localization annotation: CTP_CleavageSite=50; ConfidenceScore=5.17e-01
MKAIERSKVTVTVGGSCGGGAARSIFTIHTCRNLPFGGRGTPGSRVRLPRKENARSRHQRLFEKNVGKIGKRRGLRTFK

SEQ ID NO: 184219 - protein, 230 aa, Glycine max
  Coding DNA Sequence Number=SeqID_67441
  Gene Ontology: Mol. function=DNA binding
  Homolog annotation: Hit_ID=Q1SWX1; Match level="QueryCoverage=82%, HitCoverage=36%, E-value=2e-21, Identity=32%"; Hit description=IMP dehydrogenase/GMP reductase
MGQLQRQAFRKAYGKIWDLARVEVSTESIASLAQYYDHPLRCFTFGDFQLSPMVEEFEEILGCPLGGRKPYLFSGFYSSLARISKIFQILAKELDHQKQVKNGVVGIPRKCLEAKARILAGRNEWAPFIDVLALLIFGGVLFSNVDGLVDLAAIDAFLAYHNHKESPVVAMLADLYDTFDRGCGKSSARIVCCALAFYVGPSIRYKVTARASKKERRIGTNSWLAWRGVC

SEQ ID NO: 184220 - protein, 42 aa, Glycine max
  Coding DNA Sequence Number=SeqID_67442
MADQQANKSKAKGKQSIRTHLVAHDPGNLNKTSASSEGSKIP

SEQ ID NO: 184221 - protein, 64 aa, Glycine max
  Coding DNA Sequence Number=SeqID_67443
MTKNVSQFVRLIVKECIDCISLLAKPICRLSEPSAECTTPTAEREEESGRRMSWTHALSEGSSR

SEQ ID NO: 184222 - protein, 86 aa, Glycine max
  Coding DNA Sequence Number=SeqID_67444
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8LD27; Match level="QueryCoverage=72%, HitCoverage=27%, E-value=3e-23, Identity=74%"; Hit description =Proteasome subunit beta type 6 precursor
MALLYIYFHWQNFLETGLIVGGWDKYEGGQIYGVPLGGTIVQQPFAIGGSGSSYLYGFFDQAWKEGMTKDEAEVCAWILTALLLLS

SEQ ID NO: 184223 - protein, 138 aa, Glycine max
  Coding DNA Sequence Number=SeqID_67445
MQNHIEKAFYSGHASYRVSHSTRYLDIWEPATLAITREGYSIKCSGQSGVVITEKFSPSTTSVFKHLYKRIHTEQIILRDVKGVCPYIEPCDSKTQKSNLGIALVGVGCEQNKVDVRVDNKLRKTSEIVLGLSGAYID

SEQ ID NO: 184224 - protein, 93 aa, Glycine max
  Coding DNA Sequence Number=SeqID_67446
MVSSNDSYVTKLCQYQFDSIRGALIYCQYFLNSLPIFPNENRYPQAQLVEVNAHCLFSKWFSESGKLIPHCISALLKSGIRQIICSFLEVNDH

SEQ ID NO: 184225 - protein, 181 aa, Glycine max
  Coding DNA Sequence Number=SeqID_67447
MGAKHLTRTKERSHVIKQRVAGDHDLSFPDFHKLPNDGCQAPHKDQRKVACHQAKVPGRKLVYDTNFAPLGLTRVAGDHDLSFPEFHKSPNDGCQAPHKDQRKVACHQAKVPGRKLVYDTNFAPLGLTRVAGDHDLSFPEFHKSPNDGRQAPHKDQRKVACHQAKVPGRKLVYDTNFAPLG

SEQ ID NO: 184226 - protein, 76 aa, Glycine max
  Coding DNA Sequence Number=SeqID_67448
GVSSLSSFSIPLPFIFQEAKESIDEEDPRPTSSNGAYINTLIPMLVLCPHKCRLMSSEKKKLTTFMLIIMITMKEN

SEQ ID NO: 184227 - protein, 226 aa, Glycine max
  Coding DNA Sequence Number=SeqID_67449
  Gene Ontology: Mol. function=kinase activity
  Homolog annotation: Hit_ID=Q26FX8; Match level="QueryCoverage=67%, HitCoverage=27%, E-value=2e-40, Identity=51%"; Hit description =Gliding motility lipoprotein GldJ
  Pfam annotation: Domain name=DUF323; Domain location=10-220; Score= -59.5; E_value=0.00051; Accession=PF03781.6; Description=Domain of unknown function (DUF323)
MSAGIIAKDLYINESNNQGGTAFNMDKFKANDPEMQGYINEQRMQQKTGLKTTNQRLLAANRAPNSAMVQKFRLPTEVEWEYAALGMAKNREYNQYLGKKPEIERLRGTKGRDRGMFLENFKMGRGDYSGIAGWKNDGSARTSDVRQYPSNDLGIYGMYGNVSEWTADVYRPIIDEDFSDFNYYRGNMPQAVVKNGDGTYKMVDEGSIKYDTLADGRLVYRNLPWT

SEQ ID NO: 184228 - protein, 258 aa, Glycine max
  Coding DNA Sequence Number=SeqID_67450
  Gene Ontology: Mol. function=transferase activity
  Homolog annotation: Hit_ID=Q8CWJ1; Match level="QueryCoverage=95%, HitCoverage=27%, E-value=5e-17, Identity=27%"; Hit description=FOG: Ankyrin repeat
MVLKRMREIEETESQKVGTNTIELGLILNAVTKERVVDAKSRVQFLLDESISSSSYDEWKAPLLRLSAKHKLFQNDIEGALKDFKQALKACDECAFGGLRGEIARDGFATELILKGFIQNNQEIYYRNMLAFMEWPEGHVSFENAAVECEEFFWDTLYQPYSGIAPIVCISKKQYQLIIEETTEIIFQADWNGLNEWFKKNAKQYRKLNIKDARRNSILLSWLKLYQNLNKNKYRLSLEIAHELASELEKYEAMLENW

SEQ ID NO: 184229 - protein, 101 aa, Glycine max
  Coding DNA Sequence Number=SeqID_67451
MSFRTCGKAWAEQMRKMSDQKNAYALLVMGKVVHIGFWTFLADPNGQHLGGVDGDPVLRGTRIRATWGYVSSVEGGQLGMVGSCLICECGRVDLHHRPIIT

SEQ ID NO: 184230 - protein, 66 aa, Glycine max
  Coding DNA Sequence Number=SeqID_67452
MDNHLGISACPLTSRPLGYIRMLPDFWVMIAKGGVVDKSKAFAPTYPQFMMWNSDQRSSCFCDVRD

SEQ ID NO: 184231 - protein, 117 aa, Glycine max
  Coding DNA Sequence Number=SeqID_67453
  Subcellular localization annotation: CTP_CleavageSite=40; ConfidenceScore=5.28e-01
MLRNFTDYAMMLVSRVPMGANKVQGLTATSNGSLWWPAVVVSGGGGFSRVVGIALSTLLGLIESSKVVILKIQTDASSIGACRPRIFFINGFLCFLEDKWQRNGEGRERGDATSRRR

SEQ ID NO: 184232 - protein, 112 aa, Glycine max
  Coding DNA Sequence Number=SeqID_67454
  Subcellular localization annotation: CTP_CleavageSite=13; ConfidenceScore=5.12e-01
MSVIRGIAFLFVCIYAISRFFSSRPPFLLSFFVGSQGYRLLVVRGGISGSAADPNYPSGDSVTHCFLSFQSLWVLCFKSLVYLSFNGLPSGEALTTGISGSSSPATGTSLAT

SEQ ID NO: 184233 - protein, 52 aa, Glycine max
  Coding DNA Sequence Number=SeqID_67455
MATIALLSRYRRWCLISDVQQAGFVADLGVAFVDDWAFLADRMWVMRKVDIG

SEQ ID NO: 184234 - protein, 121 aa, Glycine max
  Coding DNA Sequence Number=SeqID_67456
MANEYQQEPFTRLLKQENGPTLTNPLLITGRLKADLVLLKERALSIPSWPAPVLSYSIRKLMILEQVTSISNPPEVMLNRKVIKKCHSTIAIDRTFTIALPEWNGSSLLSPNPCAFKNKPI

SEQ ID NO: 184235 - protein, 97 aa, Glycine max
  Coding DNA Sequence Number=SeqID_67457
  Homolog annotation: Hit_ID=Q8PFZ6; Match level="QueryCoverage=47%, HitCoverage=19%, E-value=4e-16, Identity=78%"; Hit description =Uracil-DNA glycosylase
  Subcellular localization annotation: CTP_CleavageSite=47; ConfidenceScore=5.27e-01
MTVASALFGIHNPLEFKQLPAGNQPIPARKRCPAFSLGHPPAVRAPNAAAATSRSGPGRGAAGTRWPSRNAGSRGSHDGPTAATGAAHSARGGGGCR

SEQ ID NO: 184236 - protein, 70 aa, Glycine max
  Coding DNA Sequence Number=SeqID_67458
MAKHIFQVQALWTSDINIFFRRETKLGRKQTKRVNIETVRKMNHIHISDAVFDGAKDMTDICWSWPHGSG

SEQ ID NO: 184237 - protein, 106 aa, Glycine max
  Coding DNA Sequence Number=SeqID_67459
MVREDLKEICVLDDCKMRAKEKEKQKEKEKENNQKNEKEKEKVDEEKKKSKSEVSREKKKEITSAEGKEVPYPLVPSKKDKERHLARFLDIFKKLEITLPFGEVLQ

SEQ ID NO: 184238 - protein, 74 aa, Glycine max
  Coding DNA Sequence Number=SeqID_67460
MAPRKLLAKRSRKDKAAEGTSAAPEYDSHRFRSAEHQQHFEAIKGWSFHQERRVQLRDDEYTDFQRVCGICDLG

SEQ ID NO: 184239 - protein, 76 aa, Glycine max
  Coding DNA Sequence Number=SeqID_67461
SVTSSKGIRPPTNRDFIKKYCAPRQAQGETPQQPGDGQQRATDAPPSPLEFTSSHPQKAIKRPAQDVKEALLGGNL

SEQ ID NO: 184240 - protein, 207 aa, Glycine max
  Coding DNA Sequence Number=SeqID_67462
GCINYNLVLAIRQLGYPRRGVPLEEGLIPFITRGFDSTNAGVLQKVHKAWEMSQRKDKELKWSSNGPIGDYHRWLKAYAQDLDWLLSLRTTKGMEVETLEEDEEVQALKTELEKAQIVKEKFKSAAVRIRKENAKLRGVNIATTKALEQETKRARKEEHGRNKFRGALWGSNSELKLRREERDQSRVDSLILKDELRVCLRSKRSLS

SEQ ID NO: 184241 - protein, 80 aa, Glycine max
  Coding DNA Sequence Number=SeqID_67463
MERYLQLLVRQQVTNHRGQGFAPFACPTLEQFRAEVAWPGDWPEAQAGEAPVGSPGDAEEARMDEEMTDLLGFLGGSGAT

SEQ ID NO: 184242 - protein, 33 aa, Glycine max
  Coding DNA Sequence Number=SeqID_67464
MGARDESIKHKNPWHAHSGPVQECLLMNPVEVA

SEQ ID NO: 184243 - protein, 202 aa, Glycine max
  Coding DNA Sequence Number=SeqID_67465
  Gene Ontology: Mol. function=mismatched DNA binding; Cellular component=MutSalpha complex; Biological process=response to DNA damage stimulus
  Homolog annotation: Hit_ID=Q8PMX2; Match level="QueryCoverage=97%, HitCoverage=21%, E-value=1e-91, Identity=86%"; Hit description=DNA mismatch repair protein mutS
  Pfam annotation: Domain name=MutS_V; Domain location=1-144; Score =122.3; E_value=1.3e-33; Accession=PF00488.12; Description=MutS domain V
MTWPAGSPPSMVEMAETSYILHHATAHSLVLMDEIGRGTSTYDGLALADAVARHLAYQNRCYTLFATHYFELTALADEQHEGGRSGIANVHLDAVEHGEALVFMHAVKDGPANRSFGLQVAALAGLPRATVAQARRRLAELEQRGGESHAAELAPQALDAPQQFGLFAAPTSKAQEALATIDPDELTPKQALEALYRLKALL

SEQ ID NO: 184244 - protein, 174 aa, Glycine max
  Coding DNA Sequence Number=SeqID_67466
MDSRKSTLGYILLLADDAISWSSKKQTIVTSSTIEAEFIGCYKATSQAKWLKNFFSALEVVNSIERPLKIFCDNLVAVFFSKNNKNGSRSTISSPQSSRPRLNFSSPHGTRPFINPSMSHASAPPRKGVWLDKVDAILPRKGPVNRAMSKRLQEDWARAAEEGPKVLMNLRVDF

SEQ ID NO: 184245 - protein, 175 aa, Glycine max
  Coding DNA Sequence Number=SeqID_67467
MEGRSPLLMWRIPKHSADRNEGMQLPQEPLNKRPRGLARKSMAGINFEELCGVAIVNSSCEGKRGTSREHIAWSLSQRLCETETNMLAIIAKYQEELGLATTHEHRVADEYAQVYAEKEARGRVIDSLHQEATMWMDRFALTLNGSQELPRLLAKAKAMADTYSAPEEIHGLLGY

SEQ ID NO: 184246 - protein, 139 aa, Glycine max
  Coding DNA Sequence Number=SeqID_67468
MALRFPALITGLYQSFGVPGTSSKVIWPPITRAIIEKYCAPRQVQGDAPQATDAPPPPHQADPAGSLGMKRYLQHLGQSFAPFTCPTPDQFRVEVAWPGDWPEAQAGEAPAGAPGDAEEARMDEEMTDLLGFLGGSRAM

SEQ ID NO: 184247 - protein, 161 aa, Glycine max
  Coding DNA Sequence Number=SeqID_67469
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-17, Identity=31%"; Hit description= UPI00006A17C9 related cluster
GLHVLAFRGLHALAFRGLHALVSRGLHDLPFRRLHVLAFRGLHALAFRGLHVLTFRGPHVLAFRGLHALAFRGLHVIPFKGLHVGYMLLPSEDYTSSPLEGYTATHPRLQRATHLAFRGLHVLTFRGLRALAFRGLHVLAFRGLHALAIRGIHALAFRGLH

SEQ ID NO: 184248 - protein, 99 aa, Glycine max
  Coding DNA Sequence Number=SeqID_67470
  Subcellular localization annotation: CTP_CleavageSite=80; ConfidenceScore=5.67e-01
MSPKASGISLRGGRSTGKGARLALPEPTIKKSSTSSGSPTQAGSSTQKTNLEGSSTQIASIKPEPSTQESPKPATAKQTSADYAWPIETLQALQDMDGT

SEQ ID NO: 184249 - protein, 266 aa, Glycine max
  Coding DNA Sequence Number=SeqID_67471
MARTKKYGEMTSKVTPKIAYMIYFVDSRIPIKSSQHRATLSLMDVRLPFGDQSTPVVFMLLKLLTQKIRDELGQPITKKVTRQLMLSFSQMQSQGLVLPPEPEVGPSVAYVSTKGSCVKPLGRDPDMGESNKFGLYVDDNPPHLVVLGRVNEGSKTIHNVPLGNDQVKVSVEKVRDANAHVPVPTHEGAREPSKPIDRLEPDDDTLYQMTLTILQLFLKHMLVSWDSTMFWVYNDGVPLYIKNEELSKIAHGIQCLNISVIQMWIL

SEQ ID NO: 184250 - protein, 111 aa, Glycine max
  Coding DNA Sequence Number=SeqID_67472
  Subcellular localization annotation: CTP_CleavageSite=58; ConfidenceScore=5.18e-01
MVHDIFVKVKLEVTRISTILNVFGSRRSNDVTRSIFCPNFCKMVTSMLQLDSMNLFVKARAWFNPITQGMAILIANTSSTFHRDERLGNMHAMHGKCNYETEMSKGTSFLS

SEQ ID NO: 184251 - protein, 286 aa, Glycine max
  Coding DNA Sequence Number=SeqID_67473
  Gene Ontology: Mol. function=ligase activity, forming carbon-nitrogen bonds; Cellular component=cytoplasm; Biological process=tRNA processing
  Homolog annotation: Hit_ID=Q6D8C5; Match level="QueryCoverage=98%, HitCoverage=64%, E-value=7e-74, Identity=52%"; Hit description =tRNA(Ile)-lysidine synthase (EC 6.3.4.-) (tRNA(Ile)-lysidine synthetase) (tRNA(Ile)-2-lysyl-cytidine synthase)
  Pfam annotation: Domain name=ATP_bind_3; Domain location=19-198; Score=276.6; E_value=4.9e-80; Accession=PF01171.11; Description=PP -loop family
MNTDQLTTQVADQLGAQQRLLVAFSGGLDSSVLLHVLATLRRWRPGMQLRALHVHHGLSAFADRWVEHCRSRCADWQIPLTVTHVQVDARQGGIEAAARAARYAAFSAALTEGEALLTAQHLDDQSETFLLALKRGSGPAGLSAMAARTALGEHLLLRPLLGCSRQTLENYAQRHALTWIDDDSNQDTRFDRNFLRLQVLPQLNQRWPHFASAVARSAGLCAEQEQLLDELLAEPLQSLLAADRSLAIDGLTDCSPVRRFALLRRWIALFNVTMPAREQLQRLWEE

SEQ ID NO: 184252 - protein, 77 aa, Glycine max
  Coding DNA Sequence Number=SeqID_67474
KLERVHVGLQEEERIRNDLKDRYAAATGEHKHCYSLLKAFQVVPWCRVKLVYDPLWVIILCLSDKASVDLRIVLLNW

SEQ ID NO: 184253 - protein, 306 aa, Glycine max
  Coding DNA Sequence Number=SeqID_67475
  Gene Ontology: Mol. function=inorganic diphosphatase activity; Cellular component=cytoplasm; Biological process=phosphate metabolic process
  Homolog annotation: Hit_ID=Q5ZKI4; Match level="QueryCoverage=66%, HitCoverage=33%, E-value=4e-22, Identity=30%"; Hit description =Coiled-coil domain-containing protein 93
MEHTVSNSSSVEQILNLLYAAGYVDATNPDAPPSQKIAAGLSWCIAAITQDLDTDALFPVIQWLASHIRQNQEHCVNEVHHAENTIEVDECRTSIQALSGNLDELNQRKMNVVKQLYILQERINKEGADSAVQKLLSLLTSLKNLEKQEKYFQSNRDAKHSELQDDISELERKITNDSDNENLPDELHHSFGELVEKVNLMKKQLAARLRDIVVLRRQIDDLPCQSEVIQYERRLSELYAQIQGKHRQTRKYYATYNALLEIKELMLKETSLLNSIISQFQEAFSSTDGRIKLVHSMEGIVKGSQQ

SEQ ID NO: 184254 - protein, 106 aa, Glycine max
  Coding DNA Sequence Number=SeqID_67476
MECNNGNIVLLTTTLAKFTLNDIDELNFFNMNLVDGLVHIILVLSGDENNDDYDDNGDGGVDVDDDSCNGGSDDDKNDDGDNDNHKVGDISADGSGDSRLEMLVVA

SEQ ID NO: 184255 - protein, 98 aa, Glycine max
  Coding DNA Sequence Number=SeqID_67477
MAKGAEDDVSLCASTILFAPGWRKVRVIIRTTEGAGDDVSLCASTSSFSPWLTKGAGNHKVRTIEGAGDDVSLCASTGSFAPWLTKGAGNHKVTPHVT

SEQ ID NO: 184256 - protein, 358 aa, Glycine max
  Coding DNA Sequence Number=SeqID_67478
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q9FA47; Match level="QueryCoverage=96%, HitCoverage=71%, E-value=1e-129, Identity=69%"; Hit description=TctE
  Pfam annotation: Domain name=2CSK_N; Domain location=38-188; Score =238.3; E_value=1.7e-68; Accession=PF08521.1; Description=Two -component sensor kinase N-termina
  Pfam annotation: Domain name=HAMP; Domain location=191-260; Score =44.0; E_value=5e-10; Accession=PF00672.15; Description=HAMP domain
  Pfam annotation: Domain name=HisKA; Domain location=264-329; Score =44.1; E_value=4.6e-10; Accession=PF00512.15; Description=His Kinase A (phosphoacceptor) domain
  Pfam module annotation: Pfam domain module=2CSK_N::HAMP::HisKA; Domain location=38-188::191-260::264-329
MCVSLRYAGWVICWSVSRMKWGKPQSLYAQLLLFLGLPLALLWGLSAFNSYVSALQAATQAYDRTLLSSARTVAERLVVRGGHLEVNVPWVVLDSFELNMNDRLYYKVVDPQGKVISGFDDLPAMPPATSRTQLYPALAWFYHTEYRGQAIRVARLLQPVNEGGIVGMAEIYIAETLQSRRWLAGQLLFSSWVSQGLLVLLTLVLAGWLLRRVLRPMRQLSALMVRREPGLLTPLPELLPWSETRLLIVAFNRYIDRLRVMISRQERFSADASHQLKTPLAVLKTQASVALASDDPQLWRESLQAMRATLDDTILLTERLLQLATVKRREQGEQAFVAVDLQEVVHHSCFSRICPGAQ

SEQ ID NO: 184257 - protein, 239 aa, Glycine max
  Coding DNA Sequence Number=SeqID_67479
  Gene Ontology: Mol. function=DNA binding; Biological process =regulation of transcription, DNA-dependent
  Homolog annotation: Hit_ID=A0B3A6; Match level="QueryCoverage=98%, HitCoverage=100%, E-value=6e-70, Identity=56%"; Hit description =Transcriptional regulator, IclR family
  Pfam annotation: Domain name=GAF; Domain location=82-224; Score=9.2; E_value=0.093; Accession=PF01590.16; Description=GAF domain
  Pfam annotation: Domain name=HTH_11; Domain location=12-65; Score =2.8; E_value=0.045; Accession=PF08279.2; Description=HTH domain
  Pfam annotation: Domain name=HTH_IclR; Domain location=9-96; Score =108.4; E_value=2.1e-29; Accession=PF09339.1; Description=IclR helix -turn-helix domain
  Pfam annotation: Domain name=IclR; Domain location=125-223; Score= -15.6; E_value=0.0045; Accession=PF01614.9; Description=Bacterial transcriptional regulator
  Pfam module annotation: Pfam domain module=GAF::HTH_11::HTH _IclR::IclR; Domain location=82-224::12-65::9-96::125-223
MMGNEGVIAVEKALALLDCFRPGNDSLTLTELAQLSGYHKTTVYRLMNSLERMNYIIRHDDGTYTLGHRLLYLGKLYEQSFQLARIVQPELQALSQASSESASWYVIEGGQRLCLFRAEASEGLRHSNLPGSQFPLDGSAISKVLRHWGLGEALSEDEETLPFYTSGARDPHTAAFAMPVFGVHDNPIAALALTGPSSRLTADRKESGLGQLMRETANRLSIKLGASKSFCETFYDIKE

SEQ ID NO: 184258 - protein, 208 aa, Glycine max
  Coding DNA Sequence Number=SeqID_67480
  Gene Ontology: Mol. function=methyltransferase activity
  Homolog annotation: Hit_ID=A0B3A5; Match level="QueryCoverage=95%, HitCoverage=95%, E-value=1e-68, Identity=62%"; Hit description =Dimethylmenaquinone methyltransferase
  Pfam annotation: Domain name=Methyltransf_6; Domain location=25-154; Score=41.2; E_value=4.7e-11; Accession=PF03737.6; Description =Demethylmenaquinone methyltransferase
MPASQQKLINVDIERVSAEEVRQAAEYQAAILADVAGRRGTLHGRIKPLAPNMAVAGPAITVEVRPGDNLAIHAAMAVAKPGDVLVIDGKGDLSCALLGEIMATQAQASGIAAGLNPCGPTKFIPGRVNHAISVAGAAVQAGDLVVGDIDGVVVIPRDEVGTIIELAKGKLEGEVKRLSAIHDGDLRPHWLENALRQAGMLSEGEALP

SEQ ID NO: 184259 - protein, 186 aa, Glycine max
  Coding DNA Sequence Number=SeqID_67481
  Pfam annotation: Domain name=zf-CCHC; Domain location=62-79; Score =10.9; E_value=0.016; Accession=PF00098.13; Description=Zinc knuckle
MSIQRWTNQPSLEELQNFLTNQEAFMQQSSSSPAQETELVLIFKGKTRSQDNEEVELKRNSVKYFRFGRSGHIKRNCRTRLFKVNATYEENEDDSFESFRWDQCFTIEDRRIGQKEIPVNYLDYQREWILDSSCSHHGQPFPCVQESFTTRDPQSLNPFSEVKRKEEEISLERDRLYNEDQSQFLI

SEQ ID NO: 184260 - protein, 174 aa, Glycine max
  Coding DNA Sequence Number=SeqID_67482
MASGLKWDWKTEEACGNRLPACVIDYTEEQATGNRLPEMKSLEIPLLIACSGYETHCVATAIVMAAQLIHDRVEMECLEGAWETLEGNTRCRFRGTIRFTATSLVHPDEPARTLQRIVEWILPTPTPYRLVEPVQVIEVTSSEEDPEEDLEDLPPEPAVDALDFLEGDEDPLPE

SEQ ID NO: 184261 - protein, 166 aa, Glycine max
  Coding DNA Sequence Number=SeqID_67483
MTFMAEKGFFARSYLKTSTSGRALSPEPEVGAFVAHVNTNESCVNPSGQEPNMGESKKCGLVYEGSTIVHSVPLGNDQVKFYGEEVQDGNPHVPIPTEEGVEGPTKLDDDPLYQMTLTISQLFLKPLNMNETSMRAGNVSMYGFLEPQSIQRSRQLQFESEDYIKK

SEQ ID NO: 184262 - protein, 215 aa, Glycine max
  Coding DNA Sequence Number=SeqID_67484
MKATPTVGKKALAKENHETKKWVRRRTFTYPQGIVEDLLVKVGKFIFPMNFMILDIDEDEEIPIILGQFFLNIRGSLIDVREGKLTWQLGDEEEVFKVFGTAKCSFSSPFYNFVQAINNMEFIMAKFHSSVEIYSFLEEVTSFLIMWSTSSISYGDIFLPQRSYLNLNFAKHQFNLMWRYTPSLKKLPQSLVIWGIRSISYGDILLPRRSYLNLL

SEQ ID NO: 184263 - protein, 114 aa, Glycine max
  Coding DNA Sequence Number=SeqID_67485
MEKVPWPGTLPSLERKGGGPSAQVPQQVHDASSEATIPEPFIFEAGETQPADPPTLVHEMPVDPSTPLLDFPEDPSTLVLGLTTTPPTTPVLHLTDEEDNQDEDTQSQDLSQEF

SEQ ID NO: 184264 - protein, 54 aa, Glycine max
  Coding DNA Sequence Number=SeqID_67486
MKVFTSTLVTLTQPGGEDGALSELAFTQRLYTTHPSSRISMRLVDDALSQKMSG

SEQ ID NO: 184265 - protein, 125 aa, Glycine max
  Coding DNA Sequence Number=SeqID_67487
  Subcellular localization annotation: CTP_CleavageSite=73; ConfidenceScore=5.31e-01
MAKQAKLVFYVQDPCDERHMTTPPISLSPPKSTPLPSTSKKTSKATRLRSLATRPIRMERPVIHVDPTTGKADGAHKNELRTYLGIAAQDKTEFDIPKASDQRTKKKILKIVGERWRQFKSDLTS

SEQ ID NO: 184266 - protein, 268 aa, Glycine max
  Coding DNA Sequence Number=SeqID_67488
MEEKQKKRLEQAAQFGSTKTTVDPPSPIGRHVKWKMACTKKFGKMTSEAAREIANRIEIVRKLTQYFIDWKIPLKSSQHRATLSAMEVRMYLLLPLEYQSTLVVPVLLEPGLVLPPELEAGPSVARVSTKGSCAGPLGVYEGSATIHNIPLGNDQVKVGVEEVQDVDALFLVPIKSVHWQLVIICPKDDVVAWFCSMHNKSKNYLKGIINSALKGFNDIQGSKSKATAKCILVKYFTDPRPLEPKRLKTICIRCARCYLRVKNETLGV

SEQ ID NO: 184267 - protein, 150 aa, Glycine max
  Coding DNA Sequence Number=SeqID_67489
  Gene Ontology: Mol. function=N-acetyltransferase activity; Biological process=metabolic process
  Homolog annotation: Hit_ID=Q93ZR1; Match level="QueryCoverage=32%, HitCoverage=8%, E-value=1e-12, Identity=73%"; Hit description =Probable histone acetyltransferase ELO3
MRFTFVDFKLFKIVIVFKEVNLDVLGGCFWFVAMDGLAPLTTDVWVQSEDEPSPQLGKLQFLGAIDVDVADGSDVWASVQLRQVQDNDNSKGGANRLGMEIGEKGLALGNGEHHLRARHALCTSPCPPRRVASDHESETKILEWKHCESE

SEQ ID NO: 184268 - protein, 60 aa, Glycine max
  Coding DNA Sequence Number=SeqID_67490
MVKRACGNVSSWIFLLLDKYRCVSWESTGPMCDNKGFWNMAGWLPSEGIGGEGGIGTAHR

SEQ ID NO: 184269 - protein, 52 aa, Glycine max
  Coding DNA Sequence Number=SeqID_67491
MSVKNLVGRLGVYDKTNHTLASQVTLTRLKGALKPGDPQSLHCEESVRASPS

SEQ ID NO: 184270 - protein, 218 aa, Glycine max
  Coding DNA Sequence Number=SeqID_67492
  Gene Ontology: Mol. function=transferase activity, transferring glycosyl groups; Cellular component=cytoplasm; Biological process =lysine biosynthetic process via diaminopimelate
  Homolog annotation: Hit_ID=Q8PAU3; Match level="QueryCoverage=72%, HitCoverage=40%, E-value=5e-67, Identity=77%"; Hit description=2,3,4, 5-tetrahydropyridine-2-carboxylate N-succin
  Subcellular localization annotation: CTP_CleavageSite=62; ConfidenceScore=5.66e-01
MATKPAKKTAATPKSAAARKPAAAAPAAKKTTAPKKAAAVKAPAKKAAAAKKAPARSAEAVRAETIARKSLRKPSAPGVEELKFGIESAFERRATLTLHELEGSTKPLVNRVIDGLESGEFRVAEPDDQGGWKVNEWLKKAVLLYFRVNDMAVVDARPAPFWDKVESRFAGYDEAKFRRGGVRVVPGAIARRGTYFGKDVVLMPSFTNIGAYVGEGTM

SEQ ID NO: 184271 - protein, 173 aa, Glycine max
  Coding DNA Sequence Number=SeqID_67493
ALGFDGCLKDADWEVGYGPSCIVQTTDGLRCQEGIVRQRKGLKRMTGLECCYHRKKCHDALLWQLKWNFTSRGCDVWCGEPSSLLQERAAMRLAAEDSSFVVRAKYWHAAIGRLMKSQRLNWKKSDTFIRVWHELAGDSVTAHWLVRTLDENEVARMLFRKGRSKGRRTLQFA

SEQ ID NO: 184272 - protein, 169 aa, Glycine max
  Coding DNA Sequence Number=SeqID_67494
  Gene Ontology: Mol. function=protein binding; Biological process =defense response
  Homolog annotation: Hit_ID=Q1SW22; Match level="QueryCoverage=76%, HitCoverage=17%, E-value=6e-17, Identity=37%"; Hit description =Disease resistance protein; AAA ATPase
MVFTVRDGELYGLFWFGIYGNRGTLTGRALLCEAVAFIKTQILLLQSAYKIQDVKSLVRAERYGFQSHFPLEQRPTSSRGNQDITWQKLRRDPLFIEEDEVVGLDGPRGVGKTTLAKQVYDQVRNNFECHALIKVSQSFSAEGLLRHMLNELCKEKEEDPPKDVSTIES

SEQ ID NO: 184273 - protein, 146 aa, Glycine max
  Coding DNA Sequence Number=SeqID_67495
  Gene Ontology: Mol. function=long-chain-alcohol O-fatty -acyltransferase activity
  Homolog annotation: Hit_ID=Q84XY9; Match level="QueryCoverage=61%, HitCoverage=25%, E-value=4e-12, Identity=46%"; Hit description=Wax synthase isoform 1
MKKVMQPPPTAEHHLLRRHLRRGAHTVKHKKAHDFPRGSHTCENTGNHEIPPTTPKVLKGCGKCCLGLMGREAMEMKWRMFGGDSARGPWLKEKRMSLKVPSQTRKKVVGPPRWKEERLKGRVGKRLRIGRRKRSLMKPFGILEAM

SEQ ID NO: 184274 - protein, 217 aa, Glycine max
  Coding DNA Sequence Number=SeqID_67496
MRGAPTEESLSPFLVRDFGAQSLKVIQRVHKAWRSPLRKDKELRGVRNGVIGGYHGWLRVHTAREGKTRQRKVQVSATHIRKECTELREENAATARALEQETKRAHKEEHGRVKFRGALWGSNNELKLRRELAACARSKRSLAQHLEATEQSMLAIIGQYKEELNQSVTHEQKLVEDFAQVYAEKEARGRAIDALHQEATMWMDRFALTLNGSQDLP

SEQ ID NO: 184275 - protein, 87 aa, Glycine max
  Coding DNA Sequence Number=SeqID_67497
MTLEELKAKPSSSTLIGEKKYRRHIGALFYPPRLFMHHAVPFNNLDQVHHPTMGPIMITQKKDVLKDKFYDKTKASRRSPPKESYMV

SEQ ID NO: 184276 - protein, 319 aa, Glycine max
  Coding DNA Sequence Number=SeqID_67498
MARTKKTGEMTTEAAKEIVDKIDSFEEQASQGSFIPHGRQDVLTAAIRHPEHPGRVRAARAGVTIRQYFESAPRTSHSSSSLPLEELQQLTQQIRDQLEESTIEKVTRQLMASLSQMQSQFQWAAVSRKLAVVFRGVHLTLFHEWEVVSPTKPPQKPHSGIDDPLYLMTLTIPELFLRPYQVTWDATMFKVFNPDFPLYIKHKDLSEIAHGGQCLSISVLQLWILNLTETSMRAGNSDLYGFLEPQSIQRSGQPQFEAESYIKSWMQSSKRDVYLRAYLNGLNQRLLLGGLSSRPLEPERLKAIRIQWAQYYLRVRVES

SEQ ID NO: 184277 - protein, 119 aa, Glycine max
  Coding DNA Sequence Number=SeqID_67499
  Gene Ontology: Mol. function=peptidyl-prolyl cis-trans isomerase activity; Cellular component=outer membrane-bounded periplasmic space; Biological process=protein folding
  Homolog annotation: Hit_ID=Q1H4D7; Match level="QueryCoverage=99%, HitCoverage=78%, E-value=1e-50, Identity=78%"; Hit description =Peptidylprolyl isomerase
  Pfam annotation: Domain name=FKBP_C; Domain location=16-116; Score =180.7; E_value=3.6e-51; Accession=PF00254.18; Description=FKBP-type peptidyl-prolyl cis-trans i
MSANVTELQKIDTVVGKGREAEIGFNVTVHYTGWLYDANKEDHKGQKFDSSLDRNSPFNFFLGGGQVIQGWDEGVQGMKVGGKRTLIIPSDMGYGARGAGGVIPPNAALVFDVELLGVK

SEQ ID NO: 184278 - protein, 123 aa, Glycine max
  Coding DNA Sequence Number=SeqID_67500
  Gene Ontology: Mol. function=actin binding
  Homolog annotation: Hit_ID=Q2HV31; Match level="QueryCoverage=98%, HitCoverage=20%, E-value=2e-41, Identity=74%"; Hit description =Prefoldin
MNVLEKETQLLLAQTELNKINKQLQSVENTKSKTLSELDKAKVTLQELRKKLNSVRESKQSSIEVVEAVNNKAKQLEQALSQKAIGYEAWKQELEHERKEYTTTVKEESRCFQETTQQNKAIF

SEQ ID NO: 184279 - protein, 181 aa, Glycine max
  Coding DNA Sequence Number=SeqID_67501
SPFRQLEASKPVDTQRHFMVIHTLAIQRQSSPIACGDNSWSSTPLSSRDNKSNDTQANMLMHGNKYGHLHPLSKIQCLLTGTTLVPPFAIQRQSSPMAHKDYSGHMLLFFRDYQSPLYHPETSESDCIRDDNETNIVLFFPGQEIQCLLTKATGVSPTISRQASTKAFADAPDVFYALSFD

SEQ ID NO: 184280 - protein, 101 aa, Glycine max
  Coding DNA Sequence Number=SeqID_67502
MEVNVNTASDENREKSKLRSSGDVGEVKAHLGDDVEGEGEGIEDEGDKGGGVVESLDDDLAIAVGDVMAVMGLKSVSMRFDRDLELTRWREVTREGGSRGW

SEQ ID NO: 184281 - protein, 292 aa, Glycine max
  Coding DNA Sequence Number=SeqID_67503
  Gene Ontology: Mol. function=zinc ion binding
  Homolog annotation: Hit_ID=Q6AST6; Match level="QueryCoverage=31%, HitCoverage=52%, E-value=4e-26, Identity=66%"; Hit description =Cationic amino acid transporter, putative
MWHELEDEHLLNWVCERMRVRLRHQRNSNSHTNVSSTMSDSRGSENKGSLGEQGEQSLDLGKVEKERVRQIVQGWMENGISDHLSNVSQINNSRRAKCLGEMERERVRNISELVQMISQQRGSRGSRRDAQLHEGAQADQAHDVVANNDESQPEHVRWDMSRLRRRQALVDLLVKIERERQRELQGLFEHRAVSDFAHRNRIQDRILTRYNESAEVGEMRARSSHQMKKTLNWWDLMWLGIWAVIGAEIFVLTGIEAREVGPAVVLSYVVSGFSAMLSVFCYIEFAVEIPFA

SEQ ID NO: 184282 - protein, 431 aa, Glycine max
  Coding DNA Sequence Number=SeqID_67504
  Gene Ontology: Mol. function=nucleic acid binding; Cellular component= intracellular; Biological process=DNA integration
  Pfam annotation: Domain name=rve; Domain location=1-108; Score=4.2; E_ value=0.0027; Accession=PF00665.16; Description=Integrase core domain
  Pfam module annotation: Pfam domain module=RVT_2::rve; Domain location=206-426::1-108
EYHVMVEHETRRKLKCARVDNGGEYHGPFKAYCKTYGIKLEKTLPKTPQLNGVEKRMNQTINERVRCMLSHPKLPKSFWGEAVKTVVDVINFSLTSPLDGEIPEEIWSGKKASYNYLKKVVRSRDVVFFKDHTIEDLKQSKKPKRKVNTDHDSFPVPHDVLREQNLLSQKLLNNLNCNVPPEIDEGEPQSYEEAMASNDREEWVKAMQEEMQSLYENHTYDLVELPKERRALKNKWVHMLKTEENSSRPRYKARIVVKGCNQRKGINFEKIFSPVVKLSSIRVVLGIVASLDLEIEQLDVKTTFLHRDLEEEIYMEQLKGFEVSGKENLVCQLQKSLYGLKHAPRQWYKKFDSFMAQHDFKKTHTNHCVFIKTYASCDFFILLLYVDDMLIVGHNKKKIAALKLAVRKSFTMKDLGTNNENPWDEDHSRWI

SEQ ID NO: 184283 - protein, 88 aa, Glycine max
  Coding DNA Sequence Number=SeqID_67505
VDFDLLAKPISRLSEPSAACTTLAVEREEESGRRMSCTCALTSQSHTKRESTNETHILLPFFLFNEIDFVMDFTKIVEISSGLLEYWT

SEQ ID NO: 184284 - protein, 93 aa, Glycine max
  Coding DNA Sequence Number=SeqID_67506
  Gene Ontology: Mol. function=nucleic acid binding; Cellular component= mitochondrion
MEDSSQPIKVVIVEVRHVPGMCLHPILVEKLDDVVLISHFGDYKWKLTKGNMIVAREKKEGTLYVMQGRICKGEANVAHVTQAWSCGIDDLAI

SEQ ID NO: 184285 - protein, 418 aa, Glycine max
  Coding DNA Sequence Number=SeqID_67507
MASRKRKSIGARPTAQYDTRRFHSLDAWNRYTNNVLRMSILLERKVEIYHIEFDDFKTELERRNLHKRLTNLVDGTIDVALAKEFYANLYSSKDPSPKQARVRGHLVKIDADSLNTFLETPVVLEEGETLPTCSRYYRLPSDHREIEAALCIQGRGFILNAEGHPGRILRKDLTTLAQVWSVISYSNLAPTSHTSDLTVDRANLIFGLVSHMDMNIDALISGQMTSITQSNSCRLGFPALIIALCRARGVVSDSLTFERLSPAINLAYIRKNCWNVDDLTVSFRGARRVRARPADIPSTYAAPTLTPTSTFAAPLVPAHVDSQCFEAMLQCPTTQLPQQVHDASSETTIPEPFTLHHEADLSSPQPVADPSTPRLVIPEDLTTPVLALNTSPPATAVLHLIDEEDTQTQDTQDLSQEF

SEQ ID NO: 184286 - protein, 76 aa, Glycine max
  Coding DNA Sequence Number=SeqID_67508
MKNKNVKMQNNHETKPFPQKGDEHKNKNDNSEAQRVAMTNECRETFATCGGGVDDENEGDPDWKMEGIQRYVLGPQ

SEQ ID NO: 184287 - protein, 145 aa, Glycine max
  Coding DNA Sequence Number=SeqID_67509
MDAKITLILRHGGRFTPRANDGKVEYIGREFDVWEDISANYMNTFILCDLLQACKKYSRIGDCFWLIDKDLDFNHGLRSCTTNGDILYLMKDALENENEINVYFHHKVYPIPEEVPLMLDLKCHPIPKASNEDDLDDVPVAGHKE

SEQ ID NO: 184288 - protein, 211 aa, Glycine max
  Coding DNA Sequence Number=SeqID_67510
  Gene Ontology: Mol. function=nucleic acid binding; Biological process= DNA integration
  Homolog annotation: Hit_ID=Q0KIN0; Match level="QueryCoverage=88%, HitCoverage=11%, E-value=3e-30, Identity=35%"; Hit description =Integrase core domain containing protein
MASSGPVFSFSGTPTITTAKLNWKNYPSWSASVELWFLGQGHHDHLEKTSDSVSDDERPEWEKLDYQLCVMLWQSVEPDILEILRSFKSCRSFWKKAQEIFANNIQSLFDATMKVTALKQISHDMIAHVGKARAAVEELKKFLVADSLEEVNRKLDKFYMVLILRSFHSDFDHVRDQVLAGDQIPSMDSLITRLLRVPHLLKDENPTDGVE

SEQ ID NO: 184289 - protein, 370 aa, Glycine max
  Coding DNA Sequence Number=SeqID_67511
  Homolog annotation: Hit_ID=Q47522; Match level="QueryCoverage=14%, HitCoverage=64%, E-value=2e-23, Identity=100%"; Hit description=LacZ protein
MASNHSRAQKKATTSKRKQGECSQATLNRMDAWFTDESKKNDYKMIYAVKNEVPDLDMVVVCKFEQIVDGYNKMQTYRGMLLDPSRNLRNLLGVGGLTVKDRMLVYLITYIFTLRSSNHAQVTNSDLQMVYSLKLGIKMNLVLLIEDIMLKRRRLVDYKFPYVVLASRFIDYFNVDVSNEIVDFTKASSEITKRHLKKLGMRFADHKWIMAGEPIVGNSEHMDEEVEAKALQEPAHQWSHFESLMIQKMDAMLHLHQEHSAEVHSLLENITTRLENIENSPGDPLVLERPPPRWSSNSPYSESYYNSLAVVLQRRDWENPGVTQLNRLAAHPPFASWRNSEEARTDRPSQQLRSLNGEWDAPCSGALSAA

SEQ ID NO: 184290 - protein, 78 aa, Glycine max
  Coding DNA Sequence Number=SeqID_67512
MDIWEITKALCHKRHHYTGPIVLLFGELLRAPNNIAGAPSKQLSPEDPSYGNISEDPSSGKFRKNLLPEEEGVIPKEL

SEQ ID NO: 184291 - protein, 211 aa, Glycine max
  Coding DNA Sequence Number=SeqID_67513
  Homolog annotation: Hit_ID=Q8VZH5; Match level="QueryCoverage=40%, HitCoverage=12%, E-value=2e-18, Identity=54%"; Hit description =Receptor protein kinase-like protein
MVPYLGHQEPLFISDEYALEMLYQVSIASDVENAFGTWLDDSSYISGSQSGSVLSIKHRTVNQRVFKVYIYNQTAEKRMDVVALSGAPLTPLHRDYVVMVPRESGRRKDLWIALHPNFKSKAKYANAILNGIEIIKISDSDHSLAPIFQLRREQRKNKVPHNMEKTEVENFSYTPIKFHYKKPQKHSTSSDLRSLSSIHISRDQHSHQQLQ

SEQ ID NO: 184292 - protein, 140 aa, Glycine max
  Coding DNA Sequence Number=SeqID_67514
MATLGLEISVESASSVILKMILSFDLAFALIPLLKFSSSKVTSSTSIEEPYLPTTTGARATVVETSKNNDGVLTTDVDILPNNVGGEPATDVDRKQNKYGCYAYPTLIWTTTTTSLANPTLKWTKTTTGSLICASLNPFL

SEQ ID NO: 184293 - protein, 162 aa, Glycine max
  Coding DNA Sequence Number=SeqID_67515
  Gene Ontology: Mol. function=malate transporter activity; Biological process=response to aluminum ion
  Homolog annotation: Hit_ID=Q14UU8; Match level="QueryCoverage=97%, HitCoverage=31%, E-value=6e-13, Identity=30%"; Hit description =Putative aluminum activated malate transporter
GSQEIRITIQEQCSEMCLEASKAFKELGSSIRTMTMSSSSDTHVANAKAAVKSLKTLLQSSSWKETDLLSLIPAATVASLLIDIIEFTEKIADSVNNLATLTHFEVVDTDKSTTKAQQPSQSSPHCECAEPGPKTDHNSLQLVILIEDSALAVSDSEKSNRV

SEQ ID NO: 184294 - protein, 44 aa, Glycine max
  Coding DNA Sequence Number=SeqID_67516
MSKKLYGKWSFNGTLMHLHAISIQEWLQERRGDTPYVLTVKAHI

SEQ ID NO: 184295 - protein, 50 aa, Glycine max
  Coding DNA Sequence Number=SeqID_67517
MTLILRCCYRSLKRPTYLKNYRENGFASALESIKEMTIEMDIELKFNEKH

SEQ ID NO: 184296 - protein, 352 aa, Glycine max
  Coding DNA Sequence Number=SeqID_67518
  Gene Ontology: Mol. function=RNA-directed DNA polymerase activity; Cellular component=chromatin; Biological process=chromatin assembly or disassembly
DLLKVFGIIVVSELRPHTCEDYQWRITILDRKKFEDSIKETLKEMSENIRKIADCVYGQETHVSALNNQNTVLMERLNQEFFEIDGTLAKMKMKLASINLEGRTSSGHQNFVRFRPEAEVISWETYVADLKERFGEKHKDLMSKLLSLKQSGKVSDYYDQFDYWGHKCKKKESFVIEVTELNDVEGDQEGFVEEIEENKEDEGNPQISVYAIDGVAAKSYQTMKGSKEVGLQSGRDGSSVSGCGNWGKSKVCGYMQGPDMDFTGHQGTYLITPARTHDHRIPLKEGVSTINPSNYPFSSPIVLVKKKDGSWRMCIDYRKLNKSTAKDKYLILVIEELLDEQHGNGWLSKIDL

SEQ ID NO: 184297 - protein, 93 aa, Glycine max
  Coding DNA Sequence Number=SeqID_67519
MGCYNLHPSQSEGLVDVLVVEQIQHRLLPLCHQQREKEEVKRHHFEDKELLGYVNASFARGAILEAALARGGQGEAHKDSDREEEVHVHQAAT

SEQ ID NO: 184298 - protein, 70 aa, Glycine max
  Coding DNA Sequence Number=SeqID_67520
MWHHVSEKPHRAPKRRPVRVTLFCENAPIMWDRHRLKGALKPGVFNPKAYIPKSPSGPLPPDSSPTHKTF

SEQ ID NO: 184299 - protein, 101 aa, Glycine max
  Coding DNA Sequence Number=SeqID_67521
MAELVFMISAWCMPKSSPLQQVLVVLMHRLLGVTCKKVLQCDCILQNYEEPSMQIEMVHIAQDLITTAKKTFNDGYKKTVVRKSSFLRRFLAKNHLRMYAF

SEQ ID NO: 184300 - protein, 63 aa, Glycine max
  Coding DNA Sequence Number=SeqID_67522
MAQNGVNNQDEAEQGGWPTFAAMHADEGWGLKLKPFCFVLRQKTNRMQTCAPKVGDEANFFLA

SEQ ID NO: 184301 - protein, 281 aa, Glycine max
  Coding DNA Sequence Number=SeqID_67523
MVPREPALPTRSVGGGFMNQNMGKAGEDIKMGRKIVWDMGAQMDDNRAQINNDRVTIKDGELSPEIRTTVDDSDHAGMHPTQSSWGRKSGSWEMSLEVLALIARVGNQTVSVGKFRSTFQTSNVEKHSPRREKQKLRNQYLHAKLGVLFAEVWQKLWTERFSQEEENLIIELHAMLAREKRVTLRGRASLRGTWKALRLHLTHAPEQSSSLREGKVVDIDRGQPGKFERAQEVDCTSFLVACEGVVQGLGIGLLTCSENDDGLPPRHILRRFSITVLGCAS

SEQ ID NO: 184302 - protein, 126 aa, Glycine max
  Coding DNA Sequence Number=SeqID_67524
MAPPSITIMPLLSAGAANTSTWWPRLILLQLHQFQLQLSCNGCCLPPLLTQYLPRSRQIGVHNSINKRMSLSHPSLIVMQSTRCPKASHISLQMVVVSLQLFEFLLMASLHLRNMCLELLESVIVY

SEQ ID NO: 184303 - protein, 127 aa, Glycine max
  Coding DNA Sequence Number=SeqID_67525
  Homolog annotation: Hit_ID=Q1T4S3; Match level="QueryCoverage=47%, HitCoverage=3%, E-value=2e-10, Identity=47%"; Hit description=Zinc finger, CCHC-type
  Subcellular localization annotation: CTP_CleavageSite=98; ConfidenceScore=5.02e-01
MADDEHQNVNSLADLPATTKASKSGLTHSLTIKLDEKNFLLWNTHMKSRTRSTNTSTLALKSRARQLRSELKNTKKLSRSVNEYLMRIKSIVNSLVAVGDMVSEQEQVDSILEGLPEEFNSSPHDGV

SEQ ID NO: 184304 - protein, 300 aa, Glycine max
  Coding DNA Sequence Number=SeqID_67526
  Subcellular localization annotation: CTP_CleavageSite=19; ConfidenceScore=5.07e-01
MACTRMPFQAIGHKKKSVRQAAAASKRQTVERNKYGQPPPIVESSPPPPPPRPVQPPELAPVEPPMVKKFLHQSVEAHFKELLPRKFHLKSEVKLEPGELQQFQDTIEKRKTSMVHGTRVRYDVVTINKFLGTDFQDPKAQSCNYFKLKDKDDFDPNKLAMVLCIPGKYFVKEKESNKAYKFKRNALRTISQIWMSFAFSNIAPTLHTSNLNKQHEDSTDKPLGFLTLITALCAHQKAKMGGDGGPFSMKIVVVPEEGNQSHHDEEWAKVSNAREKGVKGANDDGPREEKYGCASVFGAN

SEQ ID NO: 184305 - protein, 161 aa, Glycine max
  Coding DNA Sequence Number=SeqID_67527
  Homolog annotation: Hit_ID=Q6Z1H3; Match level="QueryCoverage=48%, HitCoverage=18%, E-value=5e-31, Identity=75%"; Hit description =Putative DHHC-type zinc finger domain-containing protein
  Pfam annotation: Domain name=zf-DHHC; Domain location=105-156; Score =20.9; E_value=1.6e-06; Accession=PF01529.11; Description=DHHC zinc finger domain
GTSFVIQVEGTSTWVVVTENKRGYISCGSVLVEGTSTRLFKENKGGYIPCGSLLVLVLLLLTSGRDPGIIPRNAHPPEPEGLDSNLDVGAGQTPQLRLPHFKEVEVNGIPIKVKYCDTCMLYRPPRCSHCSICNNCVERMFWGKSSLIPLLSVTEMVLSQL

SEQ ID NO: 184306 - protein, 539 aa, Glycine max
  Coding DNA Sequence Number=SeqID_67528
  Gene Ontology: Mol. function=nucleic acid binding; Cellular component= nuclear pore; Biological process=DNA integration
  Homolog annotation: Hit_ID=Q1SRN1; Match level="QueryCoverage=93%, HitCoverage=35%, E-value=1e-146, Identity=50%"; Hit description =Integrase, catalytic region
  Pfam annotation: Domain name=rve; Domain location=298-460; Score =167.8; E_value=2.7e-47; Accession=PF00665.16; Description=Integrase core domain
MSMPIVEEVVVKAVAEVVAKVKLKIKAKSTMNQNSRGGYQAGPSNRPQNFNPYMRPTAHLAMPQPYAMPNMDQFSNGAWYPDSGASHHLTYNPNNLSYSSPYTGQDQVVMGNGQGVSIHSLGQSQFHSPNEPNVKLTLKDLLHVPNISKNLLSVSKFAQDNNVIFEFHPYHCFVKYQDSKQVLLEGTVGADGLYQFKPFKFLTNSGAASNSDSSSMSSSSQFSVFNTPVNCNNTVSVMQNGNVFQMWHLRLGHAHTSAVKNILNLCNIPFSNKTATLPCTFCCMGKSHRLHSPLSNTVYTKPFEVIHCDLWGPAPFVSYYGYSYYITFVDTYTKFTWIYFLKAKSDALKAFTQFKALIQNQFQASIKAIQSDWGGEFRAFTALLNELGIQHRLTCPHTSHQNGTVERKHRHIVEMGLTLLSHAALPLKFWDHSFTQAVYLINRLPSSAIPLFQSPYHALHQSQPDYSQIKVFGCLCFPHLRPYNNHKLQYRSSPCVYLGVSPQHKGHKCLDATGRIYISKDVIFHESQFPYLSLFPSSS

SEQ ID NO: 184307 - protein, 545 aa, Glycine max
  Coding DNA Sequence Number=SeqID_67529
  Gene Ontology: Mol. function=RNA-directed DNA polymerase activity; Cellular component=chromatin; Biological process=RNA-dependent DNA replication
  Homolog annotation: Hit_ID=Q1S3H4; Match level="QueryCoverage=35%, HitCoverage=43%, E-value=2e-60, Identity=48%"; Hit description =Integrase, catalytic region
  Pfam annotation: Domain name=rve; Domain location=326-477; Score =74.7; E_value=2.9e-19; Accession=PF00665.16; Description=Integrase core domain
  Pfam module annotation: Pfam domain module=Retrotrans_gag::rve; Domain location=1-93::326-477
LFPFSLADKAEHWYHAIPPNIPLTWDELCDKFLHKFFPQYKINQRKTTIATFTQGVDEPLCEDWEQFNSLLRQCPTHGLDDGGQINTFLVGNNNNHGRKQDVGSSSRPPPHGNQAQQGRQYQPLHQDHTSKLEDTLNQSMQISITNQKNTNASIKNLEVQMGQIAKEMEKLKSGSLSANTQTNPKDQCNPITTRRGTLVGDLSREKNEQEVAVEEIIEDEMSKSQIAKEKKNVVVNPPAKDLPYPHAFTRKDKESAFFLMDLPPKLQDPGSFTIPITIGDLKVGKTLLDLGARINLMPLSLLAKIGDLDLKPTWITLQLAGISIKRLYGVLKDALVNLLPSSYSNEYILVVVDYVSKWVEVFATPKSDAKAVIEFLKNIFSYFGVPKVFISDGRTKFCNSQLKKVLEHYNVRHKIASPYHSQTNGQAKVSNREIKKVLDKTVASSRKDWAIKLDDSLWAYRTAFKTPIDLSPFQIVNGKSCHLSVELENKAYWALKQKVKAYHDKKWLKLFPGKLKFKWSDPFVIKEAIPYGSQQFFISMTLEVF

SEQ ID NO: 184308 - protein, 200 aa, Glycine max
  Coding DNA Sequence Number=SeqID_67530
MASRRRRTGPSQTYREDSTWDSSRFAIETAWHRYQDNVHLWNILPKRNVELAPGMYDEFYGMLHRRYWHKRLTRLPEKQIDVALAKEFYSNVYDPEDGSPKTCMLRGRTIQFDTQMLNEFLGTPVILVEGEQLPTYSQYLHSYPDYKANRGQVLHTKRAILAECRGSVVEDSAEGPHHLGTDLECAFIHQPLTDLSYIRH

SEQ ID NO: 184309 - protein, 68 aa, Glycine max
  Coding DNA Sequence Number=SeqID_67531
MVTSISEYGWPEKSSLKYPDSCPISTVMASIRYGDVALCGACRPWIFFINGVLCFLKINGSGMENDEK

SEQ ID NO: 184310 - protein, 160 aa, Glycine max
  Coding DNA Sequence Number=SeqID_67532
  Gene Ontology: Mol. function=heat shock protein binding; Cellular component=integral to membrane; Biological process=protein folding
  Homolog annotation: Hit_ID=Q00XP4; Match level="QueryCoverage=62%, HitCoverage=12%, E-value=4e-08, Identity=35%"; Hit description=[T] KOG0192 Tyrosine kinase specific for activated
  Pfam annotation: Domain name=DnaJ; Domain location=104-158; Score= -12.7; E_value=0.075; Accession=PF00226.21; Description=DnaJ domain
MPQILSSLTRGYPYQQCPFRGHLEELLWSLFELMNMAEEAQRLRKRRKAEKRLLDMQRRQKERIEEVRETQKKDEEVMNLKEQLRVEIQKGLNQLEMRCHDMPSLLRGLGIQVHAAYKRALLKFHPDRASKTDVRAQVEAEEKFKLISRWKEKFAMTSCH

SEQ ID NO: 184311 - protein, 127 aa, Glycine max
  Coding DNA Sequence Number=SeqID_67533
MGFFAKPIQNDCSYRIQKWFNWFWSHCPRQCGVLCYFVGVSKSPDLTKALALHWGLQLLLQRYVEVVGVQSEPPLVVYCFKEKEGRPNLVINLDECPLTCKTGNFYHSTYLVDGIVLSGGYAVLKLK

SEQ ID NO: 184312 - protein, 467 aa, Glycine max
  Coding DNA Sequence Number=SeqID_67534
MGKHVSREHFQPRACSGKKENLKHTVFIDVDDQVDDVDVDVTIIDYEEFMSKLHGSSAPSTDRVCTPQSVISIDDDDSDDESDDAEIPGVVAGGVGELDSDACSSERSSPDPSGMRNSVHVDVDDDSGVCEKVTESDKLKSRKASSANGIGGCRHGIDWGDSESSESDCSDCELMDREQWEKISLKRKRSAFNDQPCYDEHGSSSGLHCNNNVYVDVDEENMTEENAGGPAYSGPTHGEYVKENQSSFSVRGDSQVDNQSSFPVKGDSQVENFFMDSDEKAEWETFKSSLFESTEEMKSLHQSSDIEHGRSTRSKDFSTYTQYNNNYNFCRAVTGVSRSQEACERQFSNTGSTLKSNLFDLNSECASDDEGQVNCDGLASSDQDCGLIASNDQDCGLTASNEKDIINEREKLKETDEYKQAMEEEWASRQRQLQIQVLIYDNPGGEPFQSNPSIYALRCIGPSNVSA

SEQ ID NO: 184313 - protein, 332 aa, Glycine max
  Coding DNA Sequence Number=SeqID_67535
MAPKRSEAVVIPGINTEDEAKNVFPFFLEKFSSWHYDQYALLWGIARQNDVNMRGTIKGKEVVILPTTIVATSSYVEEGLQGQVQPQANENMLKRLEEIYGAPESVSIKVMKEQLKAWKELMMSEKPIRFIELFHRLNYRLMKPAEQEATTWILPSRPPIQKQQDIKVHPNLHTIWYHGFKGYRVLEWQTCNKVWKESENEAGKARSHQDLEDRKVYPHGASIWKSREAKFAGMHFLTPMDLQQLMGLICALNVVLPWDCTKIGEMFQTTKIILEALEESLNFQDWELSDHGLALRMKLFTYKEEIKLRQASFHRIQKLNTHLPFMLGSQLM

SEQ ID NO: 184314 - protein, 73 aa, Glycine max
  Coding DNA Sequence Number=SeqID_67536
MTTAQDAYQTSLAAWTSGDPGITQLNWDALYKRNGQQAAGTYYGQTGRRALYYLVDDVSYSTSSREGLFSGIL

SEQ ID NO: 184315 - protein, 132 aa, Glycine max
  Coding DNA Sequence Number=SeqID_67537
  Gene Ontology: Cellular component=chloroplast
MNGAKRSAEAVGCKKESVGERSALEGRTRASSAGRSGSENVGLSNANVGENPMPRKPKGSSARVIRGRENASSQSSSTRRYSAEVIHAILPGKARTTFNKMGTCTRNRHRWVGREYLRRETTLSKELGKIAP

SEQ ID NO: 184316 - protein, 93 aa, Glycine max
  Coding DNA Sequence Number=SeqID_67538
VMPLTRHPLDPDMSNRALGFPALITDLCQSFEVPVTPSKVIRPPITRAFIEKYCTPRQAQGDAPQAADAPPPPHQADPAGSLGMERYLQHLAR

SEQ ID NO: 184317 - protein, 97 aa, Glycine max
  Coding DNA Sequence Number=SeqID_67539
  Gene Ontology: Mol. function=protein transporter activity; Cellular component=membrane; Biological process=intracellular protein transport
  Homolog annotation: Hit_ID=Q1SID8; Match level="QueryCoverage=72%, HitCoverage=29%, E-value=4e-22, Identity=77%"; Hit description=SNARE domain, putative
  Pfam annotation: Domain name=SNARE; Domain location=10-72; Score =46.5; E_value=9e-11; Accession=PF05739.9; Description=SNARE domain
MGESKDCGRRQDEELDELSLSVQRIGGVGLTIHEELLAQEKIIDELGNEMDSTSNRLDFVQKKVAMVMKKASAKGQIMMILGLLALFIFLFILVFFT

SEQ ID NO: 184318 - protein, 106 aa, Glycine max
  Coding DNA Sequence Number=SeqID_67540
MAEVSTEAIASLTQYYDQPLRCFTFGDFQLTLTVEEFEEILGCSLGGRKPYLLLGFYPSLARISKIVKISAQELDRGKQVENGAVGVPRKGLEAKARTLASQDEWA

SEQ ID NO: 184319 - protein, 118 aa, Glycine max
  Coding DNA Sequence Number=SeqID_67541
  Homolog annotation: Hit_ID=Q1T376; Match level="QueryCoverage=52%, HitCoverage=8%, E-value=1e-13, Identity=66%"; Hit description=IMP dehydrogenase/GMP reductase
MAIYEALGSFMLWSLDNIVADLASHQGVVKGYKKAVQQSSSKSQVLLPFVMISVAGILDDVPVHANIKGGIVNSWRRDNQAYNEEGVRPGIEKWQGNSSLIQMSIFLLNHMMLGMVLL

SEQ ID NO: 184320 - protein, 193 aa, Glycine max
  Coding DNA Sequence Number=SeqID_67542
  Subcellular localization annotation: CTP_CleavageSite=87; ConfidenceScore=5.29e-01
MKMHKTITRTPKGPYIMFKSLKTNTNWMTNEERCKSGLWSQFDSASASFFSSFFFFSLISLNFSQCWTLEPNTQPPSRLFIAKDGIRGELVTSPLSLLGAQASQGSEKCPKWPFCPSRWKQRTSSPTKHKDKDIESYKREKTLKSLKCCRNLPFGGRATRGLTGASSKKGKCAESPPTFIRGKRWKNQKRCGL

SEQ ID NO: 184321 - protein, 51 aa, Glycine max
  Coding DNA Sequence Number=SeqID_67543
MCKTIDRGATNPSCDSLHGIGGPMTRSKTKRMKRIISNWAWIQNWAEPAWT

SEQ ID NO: 184322 - protein, 190 aa, Glycine max
  Coding DNA Sequence Number=SeqID_67544
  Gene Ontology: Mol. function=nucleoside-triphosphatase activity; Cellular component=membrane; Biological process=ion transport
  Homolog annotation: Hit_ID=Q7WA26; Match level="QueryCoverage=96%, HitCoverage=71%, E-value=7e-82, Identity=83%"; Hit description =Glutamine transport ATP-binding protein
  Pfam annotation: Domain name=ABC_tran; Domain location=35-190; Score =119.9; E_value=7.2e-33; Accession=PF00005.17; Description=ABC transporter
MNAANPKEMIRIRGLQKSYGDHAVLRGIDFDVLPSQVVVVIGPSGSGKSTLLRCCNGLEVAQGGTVEICGQTLQNEGELLPEAELNRLRMQVGMVFQGFNLFPHLSVLDNVTVGPRKLRGMGRDEANALAEDLLRKVGLAQKMSAMPASLSGGQKQRVAIARALAMQPKVMLFDEPTSALDPELVGEVLQ

SEQ ID NO: 184323 - protein, 92 aa, Glycine max
  Coding DNA Sequence Number=SeqID_67545
MDIGEEGQDIVDMIGESMKECDGFDESTYDLGENEDVVGEKALEESTNDFGEDEHGDGKEVLEAEDNVEYVSELEDSIDKEENQILMVWWMY

SEQ ID NO: 184324 - protein, 128 aa, Glycine max
  Coding DNA Sequence Number=SeqID_67546
MEEIQSPSSNTLRSANNIRIDVLKNDLQRINQIRRKMTKEACMSLGRNMFSSHIGEETRSYEVEEGYFSRFEAEHFQWVVPNIEELGGLSFQYALGDSHRQQAEVKVAWENVRKKGEKELGKPHVTIS

SEQ ID NO: 184325 - protein, 210 aa, Glycine max
  Coding DNA Sequence Number=SeqID_67547
  Gene Ontology: Mol. function=DNA binding; Biological process =regulation of transcription, DNA-dependent
  Homolog annotation: Hit_ID=Q9LSF7; Match level="QueryCoverage=62%, HitCoverage=41%, E-value=5e-10, Identity=31%"; Hit description =Arabidopsis thaliana genomic DNA, chromosome 3, P1 clone: MJL12
  Pfam annotation: Domain name=DUF313; Domain location=80-183; Score =19.4; E_value=2.3e-06; Accession=PF03754.4; Description=Domain of unknown function (DUF313)
MAIEKKNSRGAAKKEFDSVDMRLRKAFRAWLAQEQQKNPQLFSFLEDDDTEILKSLLRRKDKRKREEEGTSMKCASSSSDELPSPFKEKIQEMKGCEVKLVMQKKLYESDLNPNQNHACFSIKIANNFLTQKEESFLEENKMLAGMHVIVLDPSLRDCNMCFMKGSRSCFYNLTNGWNQIVLQNDLKLHDILQLWSFRVSSYLWFALVKL

SEQ ID NO: 184326 - protein, 173 aa, Glycine max
  Coding DNA Sequence Number=SeqID_67548
MLRKRLGLNFLHGTNFPHLFREREREVPKGAEPFSTSLLPLFIENWGRSLPPSSPRRARLLPPEATAFWRNLLEGPSGPVTETYEFRNDTCFLSVMLRNLADYIIIPFLTYGMLRNLTVCATMLPFDFRCVTEFLRIVHQYFLLISGTSRNSTNCLMMGAKHLKMTKHKLHAT

SEQ ID NO: 184327 - protein, 257 aa, Glycine max
  Coding DNA Sequence Number=SeqID_67549
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=100%, HitCoverage=27%, E-value=6e-65, Identity=54%"; Hit description=WD-40 repeat protein-like
  Pfam annotation: Domain name=WD40; Domain location=125-163; Score =40.4; E_value=6e-09; Accession=PF00400.22; Description=WD domain, G -beta repeat
MTVGHSPIVQELMRRQNVEEGGNGEGVDGDGGGGGVGGGGGDEGDGGKVKRKGGWFKFMSLKSVVVGQKERRSGDERDTSSSEKAGGRRSSSATDDSQDGGGLVHGGERVRVRQYGKSFKEVTGLYSSPKIQAHEGSIWCIKFSLDGRYLASAGEDCMIHVWQVFESERKGELLVEKPEDGNLNIMFLVNGSPEPSSPGMDNNSEKKRRGRLSVSRKSLSLDQLVVPETVFALTEKPVCSFKGHLHDVLALSWTKSQ

SEQ ID NO: 184328 - protein, 339 aa, Glycine max
  Coding DNA Sequence Number=SeqID_67550
  Gene Ontology: Mol. function=DNA binding
  Homolog annotation: Hit_ID=Q1SDS1; Match level="QueryCoverage=59%, HitCoverage=37%, E-value=7e-20, Identity=32%"; Hit description=IMP dehydrogenase/GMP reductase
MGFDQAPLLKKMFYKVKIKSLEVTSLQELGQLMGGLVDIVAIDAFLAFHHSKESPVVAILADIYDTFDRRCEKSSIRTVCCTPALYVWLSSNLFCQEGRHACPLQCHRSCTERREANWDQLLANIEGASINWFPRWKEGRTGILFSCGEFPNVPLMGTRGCINYNPVLAIRQLGYPMRGASSEESLMPFIARGFSDPNARVLQEVRKAWEMVQRKDKELRGNSNGIISDYRKWLRARTRGLDWLPKLRTARKEEAKAPKESKEVQALKAKLEKAQAVKEKFKSTVVRVQKEYDELKDVNTATGRKNMAETRSGELYGAATASLNSKERKETSRESKAWF

SEQ ID NO: 184329 - protein, 647 aa, Glycine max
  Coding DNA Sequence Number=SeqID_67551
  Gene Ontology: Mol. function=acyltransferase activity; Cellular component=integral to membrane
  Homolog annotation: Hit_ID=Q1SWP9; Match level="QueryCoverage=76%, HitCoverage=98%, E-value=0.0, Identity=79%"; Hit description =Chalcone and stilbene synthases, N-terminal
  Pfam annotation: Domain name=ACP_syn_III; Domain location=235-326; Score=-20.5; E_value=0.083; Accession=PF08545.1; Description=3 -Oxoacyl-[acyl-carrier-protein (ACP)
  Pfam annotation: Domain name=ACP_syn_III_C; Domain location=401-485; Score=20.8; E_value=9.9e-08; Accession=PF08541.1; Description=3 -Oxoacyl-[acyl-carrier-protein (ACP)
  Pfam annotation: Domain name=Chal_sti_synt_C; Domain location=344 -487; Score=23.0; E_value=2.1e-05; Accession=PF02797.6; Description =Chalcone and stilbene synthases, C-te
  Pfam annotation: Domain name=FAE1_CUT1_RppA; Domain location=98-387; Score=755.2; E_value=4e-224; Accession=PF08392.2; Description =FAE1Type III polyketide synthase-lik
  Pfam module annotation: Pfam domain module=ACP_syn_III::ACP_syn_III _C::Chal_sti_synt_C::FAE1_CUT1_RppA; Domain location=235-326::401 -485::344-487::98-387
MTVTMSGEEEAAVGVQIQQKSRMVLPDFLQSVNLKYVKLGYHYLISNLVTLFLVPLILVTLIQVSQTTDLRHLWLHLQYNLLTILTCSAVLVFGLTLYAVTCPRPVYLLDSACFRPADHLKAPFRSFMDHSRLTGDFEESSLEFQRKILERSGLGEETYVPDAMHSIPPQPSMAAARAEAEQVMFGALDNLFQSTNIKPKDIGILIVNCSLFNPTPSLSSMIVNKYKLRGNIRSFNLGGMGCSAGVIAVDLAKDLLQVHRNTYAVVVSTENITQNWYFGNKKSMLIPNCLFRVGCSVLLLSNKPADRRRAKYRLVHVVRTHRGADDKAFRCVYQEQDDAGKTGVSLSKDLMAIAGGALKTNITTLGPLVLPISEQLLFFVTLLMKKLFKADVKPYIPDFKLAFDHFCIHAGGRAVIDELEKNLQLLPEHVEASRMTLHRFGNTSSSSIWYELAYIEAKGRIKKGNRIWQIAFGSGFKCNSAVWQALRNVRPSPNGPWEDCIDKYPVLMIPLKCGGGDGMLSILGLTSMTPTLVMWRLTSKRQSLKRILVEKGGQFVASRSKKKSETCCHCGTVMACDGLWCWLVVDFLESSDFDIGVLISGGSWRQQLEDGCGRKSGGGGGGDVVDCAFEGGEVLFAISKWERRGQG

SEQ ID NO: 184330 - protein, 247 aa, Glycine max
  Coding DNA Sequence Number=SeqID_67552
  Homolog annotation: Hit_ID=Q9FMY8; Match level="QueryCoverage=62%, HitCoverage=74%, E-value=1e-32, Identity=50%"; Hit description =Arabidopsis thaliana genomic DNA, chromosome 5, P1 clone:MJB21
  Pfam annotation: Domain name=Maf; Domain location=90-247; Score= -57.5; E_value=9.8e-05; Accession=PF02545.5; Description=Maf-like protein
MEPSTSSYKANAIISKLQTTTNQQRGDEPTVLIAADTKRRRQQDREAILAKSQGSPSKREGLSAPQIPLRIPKSMILNHIITESYMTECQNLILWRLFSCSHFFPYAEAILQRLLVDDYLKDAVPMLLITSDQVAVYEGVIREKPTSKEEARQFLKDYSGKLAATVGSVLVTNLKTGLRKGDLDRVDVLFSPTFAILVDEGITLNVAGGLIIEHPLIFPYVKEVVGTTDSMMGLPKALTEKLLKEAL

SEQ ID NO: 184331 - protein, 54 aa, Glycine max
  Coding DNA Sequence Number=SeqID_67553
MSRNFTDYLTMGVKYLKAVKRRLHATKQWSPDEIRVGYPRNVGFFSPCILGHLD

SEQ ID NO: 184332 - protein, 280 aa, Glycine max
  Coding DNA Sequence Number=SeqID_67554
  Gene Ontology: Mol. function=sugar porter activity; Cellular component=integral to membrane; Biological process=carbohydrate transport
  Homolog annotation: Hit_ID=Q39416; Match level="QueryCoverage=98%, HitCoverage=56%, E-value=1e-103, Identity=67%"; Hit description =Integral membrane protein
  Pfam annotation: Domain name=Sugar_tr; Domain location=1-279; Score= -40.3; E_value=1.3e-05; Accession=PF00083.14; Description=Sugar (and other) transporter
MTIITYLRFSPNLECWDLGRAKMGMTEEFETSLQVLRGFETDISVEVNEIKRAVASTNRRTTVRFADLKQRRYWLPLMIGIGLLILQQLSGINGVLFYSSTIFRSAGISSSDAATFGVGAVQVLATSLTLWLADKSGRRLLLIVSASGMAFSLLVVAISFYVKASISEISSLYGILSTLSLVGVVAMVITFSLGMGAMPWIIMSEILPINIKGLAGSVATLSNWLFSWLVTLTANMLLDWSSGGTFTIYAVVCALTVVFVTIWVPETKGKTIEEIQWSFR

SEQ ID NO: 184333 - protein, 75 aa, Glycine max
  Coding DNA Sequence Number=SeqID_67555
MASTIFDDESCEGTNTEDPAVDFEREANRLEVEEDEGMEFPAELEMMVAQEGREMKPHQEETEVVNLDVDNEKKE

SEQ ID NO: 184334 - protein, 129 aa, Glycine max
  Coding DNA Sequence Number=SeqID_67556
MIVKRLLVEAYGWFLTIIWRCDLGFHTLCSSDGGGYSDESGYEDGGCNTREVCDLNMPSKSAPRNPSTKSSNQGKDAIHVETNQYDWGWNIKGKYNGRDMRKENKFNVLGNHEKEQEAWKKVEELEQHA

SEQ ID NO: 184335 - protein, 145 aa, Glycine max
  Coding DNA Sequence Number=SeqID_67557
MAKISLALVFALVVTVPFHSVMGQDDAWKSIIDQAKDEASKAGLSEDTIFGAEKAITDGSAEKVAEDALGEGSLDDWVKQAKDMTNGESSPSGAPEDLPDDEEEDNLLETPELAPKIAPSKAPVGAPTDAPSAAPQAQTPSATTL

SEQ ID NO: 184336 - protein, 63 aa, Glycine max
  Coding DNA Sequence Number=SeqID_67558
MNEIRESNSPAFRHYFVDNRITVTMLSQKQVEGSNGHNFKVRKHEGCSTTEEEREHGGSFWNA

SEQ ID NO: 184337 - protein, 723 aa, Glycine max
  Coding DNA Sequence Number=SeqID_67559
  Gene Ontology: Mol. function=DNA binding; Cellular component=oxygen evolving complex; Biological process=DNA integration
  Homolog annotation: Hit_ID=Q1SH28; Match level="QueryCoverage=80%, HitCoverage=60%, E-value=1e-135, Identity=45%"; Hit description =Integrase, catalytic region
  Pfam annotation: Domain name=rve; Domain location=193-357; Score =53.3; E_value=7.8e-13; Accession=PF00665.16; Description=Integrase core domain
  Pfam module annotation: Pfam domain module=RVT_2::rve; Domain location=441-679::193-357
MFQPFTSSWILDSGATDHVTCSLNNLHSFERINPVTVKLPNGHHVHATHSGTVHLSRTITLFNVLYIPTFTFNLISISKLVSSTNCALIFSSTSCMLQDASNRMKIGIVEERHGLYHLIPDQTDKAICSTIIHPKCNIIPIDLWHFRMGHLSTERLQCMKPHYPILQNDKNFVCNTCHYAKHKKLPFFSSISHASHIFDLLHMDIWGPCSKPSMHDHKYFLTIVDDHSRFTWVHLMHTKAETRHIIVSFIASIETQYNRKIKMIRSDNGPEFLMPSFYASKGIMHQTTCVETPEQNDHFPQITETQHSHLESSTPLPGSFYNSQYDPTIETTQPQPTIQEPADHTSLQPTSTNELASSQRTKHEPRRSTRTKHAPTYLQDYHHDLSSHNTDASTSSRYPLSSVLSYSRLSPTHKHFVMSISSTVEPSSYAEASQHDCWIKAMNAELQALQSNDTWRLTPLPPHKTAIGCRWIYKIKHRVDGSIERYKARLVAKGYTQMEGLDYLDTFFPVAKLTTVRLLLALAALNQWHLRQLDVNNAFLHGELDEEVYMQRSLYGLKQASRQWFTKLSGLLTSHGFKQSHSDHSLFLRFTGSITTILLVYVEDIILTGNSDSEIQDVIILLDQAFKIKDLGNLKYFLGLEIARSSSGIHLCKRKYALDILSDSGMLGCRPNATPMDYSTKLQAATGTPLSAEASSSYRRLVGRLIYLTNTRPDIMYAVQQLS

SEQ ID NO: 184338 - protein, 594 aa, Glycine max
  Coding DNA Sequence Number=SeqID_67560
  Gene Ontology: Mol. function=nucleic acid binding; Biological process= DNA integration
  Homolog annotation: Hit_ID=Q1S7C5; Match level="QueryCoverage=88%, HitCoverage=77%, E-value=3e-75, Identity=50%"; Hit description =Integrase, catalytic region
  Pfam annotation: Domain name=GRP; Domain location=174-253; Score= -30.5; E_value=0.1; Accession=PF07172.2; Description=Glycine rich protein family
  Pfam module annotation: Pfam domain module=GRP::RVT_2; Domain location=174-253::376-594
MSSNNATDLEIPIPSCCKVKDQHLKWPSDNPKLFPGTVFWTKLRHSYIGETSRWKNNSKTPYDAYRVANKVNLEYEAWEVQDQTLLTWLQSTLSKSVLSQVIGSIHSYQVWDKIHEYFHMQMKARARQLRTNLRSTFLDGKTMREFLSHIKNIVDELTGVGYPDYAPVISIIESKFETPLVAEVEALLLAHESRANRFCKQSFAPSINYTQGYVLPNSNDTSTRNNSNGGYGRGGGGRGNNGRCRGGGDSNYHPHESLVLYDPKTLQAVQIITPSAMLTSVSSTGAAHSAWIPDSGASFHVIDEPQNIHQLGHFEGLNQIFVGNDQDLHINGSGVVGVDGLYSFPNLKLQEPSVLLSSAIKSPSSSADLSSSSRVAFNSSDTIGCKWVFRIKENADRSINKYKARLVAKGFHQVHGFDFHETFYPVVKPITIRLIITLALTNNWKLFQLDVNNAFLNGLLDETVYMLHPPGFEVEDKSLVCKLNKALYEPKQALRQWFDRLKITLIQFGFQASKCDPSLFMYKHQAHTIFLLVYVDDIIITDNSPSLIQQITTQLNYAFSLKQLGQLDYFLGIEIKHIPDRSLLMTQSKYIKDL

SEQ ID NO: 184339 - protein, 393 aa, Glycine max
  Coding DNA Sequence Number=SeqID_67561
  Homolog annotation: Hit_ID=Q1SKD7; Match level="QueryCoverage=56%, HitCoverage=57%, E-value=7e-09, Identity=24%"; Hit description =Ankyrin
MASQKRESIASSSSQLKYDRYKFSSPKAWDRYTNNMFGRKIIPERKVQLSFNDFEEFQGELNRRNWHKKIANLEEGSIDVALVKKFYTNVYDHEDKSPKQVKVRGQWIPFDSAAVNSFLETPVVIEEGESLPTYARFVLLRPNQQELAACLCIPGKGFELNSDGLPLKILRKNLTTFAQTWSVFSFSNLAPTSHTSDINLDRAKLVYALIQKMDMNLGSFISSQITLRAQHDSSRLGFPTLITALCKARGVRSDFLTLESLSPAINLAYIKKNYWNLDDPTVTFRGPRKAREIPVIPPAPTQIPLPAPLSKGPANFIFTPQMLHSMLQSIHKGQSIIMQSLQGLGLPSIMSKEEFNAQVAWPGDQPSSSGEGEASTAQEPVTEEPPAPAPSLV

SEQ ID NO: 184340 - protein, 265 aa, Glycine max
  Coding DNA Sequence Number=SeqID_67562
  Gene Ontology: Mol. function=receptor activity; Cellular component =integral to membrane; Biological process=amino acid transport
  Homolog annotation: Hit_ID=Q2KVK6; Match level="QueryCoverage=99%, HitCoverage=100%, E-value=1e-114, Identity=79%"; Hit description=D -methionine ABC transporter, substrate-binding protein precursor
  Pfam annotation: Domain name=Lipoprotein_9; Domain location=30-265; Score=469.8; E_value=3.4e-138; Accession=PF03180.4; Description=NLPA lipoprotein
  Pfam annotation: Domain name=NMT1; Domain location=51-263; Score= -74.7; E_value=0.026; Accession=PF09084.1; Description=NMT1THI5 like
  Pfam module annotation: Pfam domain module=Lipoprotein_9::NMT1; Domain location=30-265::51-263
MSIKVLKSLAAFALGAAVFAQPALAQDKPLKVGVTAGPHAQIFDVVKQEAAKQGLNIQVIEFTDYVQPNVALASGDLDLNSYQHQPYLDNANADRGYKLVSIAKTVIFPIGIYSKKIKSLSELKDGARIALPNDPTNGGRALLLLQANGLIKLRPEAGLKATPIDVVENPKKLRFIELDAAQLPRSLDDTDASAVNTNFALEAGLNPATDAIAQESPNSPYANVLVVREKDKDRPEFAKLVSIYHSPAVKQFIETKFKGAVVAAW

SEQ ID NO: 184341 - protein, 176 aa, Glycine max
  Coding DNA Sequence Number=SeqID_67563
  Gene Ontology: Mol. function=transporter activity; Cellular component= membrane; Biological process=transport
  Homolog annotation: Hit_ID=Q2KVK4; Match level="QueryCoverage=60%, HitCoverage=53%, E-value=1e-42, Identity=85%"; Hit description=D -methionine ABC transporter, permease protein
  Subcellular localization annotation: CTP_CleavageSite=43; ConfidenceScore=5.22e-01
MARAAVIRPGSTSRMAFSAMRAMNGIAATDSGTMAAVVPIEVCATRRVNGMMATIRITNGTERVALMTAPSAWLTAWFSSMLPRAVTVRITPSGMPTSTAMALATPTISRVSSSDVISRSISCGLMGNFFIGDVSGGQRGDGVPDRGGRALGQHEHRAYGHALDVFDARLLQAHVL

SEQ ID NO: 184342 - protein, 152 aa, Glycine max
  Coding DNA Sequence Number=SeqID_67564
  Gene Ontology: Mol. function=kinase activity
  Homolog annotation: Hit_ID=Q1SMI5; Match level="QueryCoverage=63%, HitCoverage=11%, E-value=3e-25, Identity=47%"; Hit description =Prefoldin; tRNA-binding arm; t-snare; Protein kinase PKN/PRK1, effector
VEPKNPAVGYTDDTNSNDVLPKFARRGLNFFETQEESNEQNSGSNNTLSESERVTKAETEILALKKAIAKLKDEKEAGLLQYQQSLEKMSNLELEVSTAQENSRKLDEQASKAEAEVQALKEAQIKLQAESEASLLQYQEKVKKQRTLIFKQ

SEQ ID NO: 184343 - protein, 78 aa, Glycine max
  Coding DNA Sequence Number=SeqID_67565
MTCACLPCNDNYQTSPLKEITWNPRPFFNSEGASMEEGVGLQCQRKRGFKRRSKQKGRVQTKEQGASSLGFKAISKAS

SEQ ID NO: 184344 - protein, 423 aa, Glycine max
  Coding DNA Sequence Number=SeqID_67566
  Gene Ontology: Mol. function=protein binding; Cellular component =cytoplasm; Biological process=regulation of transcription
  Homolog annotation: Hit_ID=Q9M3H9; Match level="QueryCoverage=99%, HitCoverage=100%, E-value=1e-144, Identity=62%"; Hit description =Tubby-like protein
  Pfam annotation: Domain name=F-box; Domain location=58-113; Score =37.9; E_value=3.5e-08; Accession=PF00646.23; Description=F-box domain
  Pfam annotation: Domain name=Tub; Domain location=124-423; Score =502.7; E_value=4.2e-148; Accession=PF01167.8; Description=Tub family
  Pfam module annotation: Pfam domain module=F-box::Tub; Domain location=58-113::124-423
MPFRSIVRELKEIGEGISNMYRRGGEAKHVHRHGKSHIAPECSLPPPPPPPPSSSSQSRWANLPPELLLDIIQRLEASETSWPARRALVACASVCRLWREITKDVIKTPEQCGLLTFPISLKQPGPRDSPIQCFIRRERMTSTYCLYLGLSPALSGDMSKLLLAAKKIRRATCTEFIISLVADDFSRACDTYVGKLRSNFLGTKFTILDGEPPHDSSLPLNCKLQQRVHLKQVLPNKVSAANYKVATVSYELNVLRTRGPRRMRCMMHLIPISAIQEGGNAPTPLKFTNYLNDYASTTIPDTKGKKPEVVEFDSTGTDNTPESIQRAREPLILKNKAPRWHEQLQCWCLNFKGRVTVASVKNFQLVAAAEPCQNVSAAEQEKVILQFGKIGKDIFTMDYRYPLSAFQAFAICLSSFDTKPACE

SEQ ID NO: 184345 - protein, 462 aa, Glycine max
  Coding DNA Sequence Number=SeqID_67567
  Gene Ontology: Mol. function=transferase activity, transferring hexosyl groups; Cellular component=Golgi stack; Biological process =multicellular organismal development
  Homolog annotation: Hit_ID=Q6K643; Match level="QueryCoverage=94%, HitCoverage=62%, E-value=1e-88, Identity=41%"; Hit description =Putative pentatricopeptide (PPR) repeat-containing protein
  Pfam annotation: Domain name=PPR; Domain location=128-162; Score =23.6; E_value=0.00071; Accession=PF01535.11; Description=PPR repeat
  Pfam annotation: Domain name=PPR; Domain location=163-197; Score =16.6; E_value=0.081; Accession=PF01535.11; Description=PPR repeat
  Pfam annotation: Domain name=PPR; Domain location=198-232; Score =24.7; E_value=0.00033; Accession=PF01535.11; Description=PPR repeat
  Pfam annotation: Domain name=PPR; Domain location=233-267; Score=6.0; E_value=1.5; Accession=PF01535.11; Description=PPR repeat
  Pfam annotation: Domain name=PPR; Domain location=307-341; Score =22.2; E_value=0.0019; Accession=PF01535.11; Description=PPR repeat
  Pfam annotation: Domain name=PPR; Domain location=342-376; Score =14.5; E_value=0.14; Accession=PF01535.11; Description=PPR repeat
  Pfam module annotation: Pfam domain module=PPR::PPR::PPR::PPR::PPR::PP R; Domain location=128-162::163-197::198-232::233-267::307-341::342 -376
EKVVVGLPKRRGKIRYKIYGLDLSDPKWAQVADRIHEAEQVFWPQEPKPITGKAKIVTTKILLSKEEEEEEEEEDGLQSLLAEWVELVQPSRVEWMDLLDKLKEHNPGLYFKVAEMVLTEDSFQTHVSDYSRLIDIYAKENRFDDVERMLKKLNENGLQVDASIASTLVLMYCKRGDLAHAKEAFEVLTSLGFQPDAHVYNSMITALVNNGQPKLGEKLMRDMDDRHIPITKDIYMALLRSFSQLGDAVGAERISNTMQFAGIQQGMDMETSTLLIEASALAVPCNPDQARSHFDYMIKLGHKPDDRCTASMISAYEKKNYLDNALNLLLELEKDGFEPGVATYSVLVDWLGKLQLVDEAEQLLGKIALLGEAPPFKLQVSLCDMYARAGNEKKALQSLGVLEARKDELGQAEFERILSGLIDGGFQKDAQRISQIMEAQGFDASRVKFKLSKPVSRAPSFR

SEQ ID NO: 184346 - protein, 74 aa, Glycine max
  Coding DNA Sequence Number=SeqID_67568
MKVCELASRLPLVDPECIKSRLECFEGSLHQVEEAKVASVKDIKKQTKVFKKLVMQLAVERECLNKQFVNNNNN

SEQ ID NO: 184347 - protein, 616 aa, Glycine max
  Coding DNA Sequence Number=SeqID_67569
  Homolog annotation: Hit_ID=Q1SHI0; Match level="QueryCoverage=16%, HitCoverage=29%, E-value=3e-07, Identity=32%"; Hit description =Probable extensin [imported]-Arabidopsis thaliana, putative
  Pfam annotation: Domain name=Extensin_2; Domain location=5-300; Score= -138.8; E_value=0.07; Accession=PF04554.4; Description=Extensin-like region
  Subcellular localization annotation: CTP_CleavageSite=18; ConfidenceScore=5.26e-01
MAQRSKSFRFRIPWLSVPSESFARRTRERPKSPPHSDTSVPIHRPSKPSVIAPSELSPLSPTKTEEAPRAEPQKESPPHPTPPPSTSESIESPVKVQPKPKPLSPQPPLRPSSHADSPSQVHVAPSSPKTHLASDNGAMKVPKLVAEETTPPASSSSEQEKEKMVLSEAKPQEDELKVESPLRTITKSPETSFQPERMLTHPAGIEQQVSSVRSSSPVSKTEPATHSSSPLASKDIKTEETTPQEEKEKMAVIVPQEEKTKIKSPLKTIPKSPKTSSQPENLSTQPTRIEQRSTTPKNKSLQPEEKEKVVQETTKARGKGKDTTIGQPSEQHTMASASGTTLSSTTTTQTKDSFAKAFRGDKKHHGARETVQRKIMFATTNPIGKDTRVVSSTDEGGTKNVSSSSISPEKTASSSGEKAPPLQKGIKDDITKFVHKLTASVHPTQHMDDKQFSVITLAGDNRGATMHLGSESAKKEGSVHIHRAYKSDPEDTNEVTTDGEENTNEEDEEVGMAYVNSNIQSINNSLMFHGSITERDPGVQVTLPQKPAEPIKPDDKPNPGLETQRTQFNINRAEKSTYQPTVGRSIRGPFLEPNDKPRRHGCNFSCDKDIEDIEIL

SEQ ID NO: 184348 - protein, 197 aa, Glycine max
  Coding DNA Sequence Number=SeqID_67570
MVDRGSLWGLVLKSKYGDVLDSPNVRQSQMESIWWRDIMDVCGDRRERSWFNDNITWKVGDGRRGGVLAEWCLEWCLAWFSWELPIVEAFMRDNEGGNFMHNEADKVLWKRVSIGDFSVKLAYDFVSFDLSLVEKMLTLWNIRNSIIFDGKTWDLDYALEMIKYKSWAWLEAKVEAFHFSFSEWYSNPRVCLQTSRI

SEQ ID NO: 184349 - protein, 373 aa, Glycine max
  Coding DNA Sequence Number=SeqID_67571
  Gene Ontology: Mol. function=kinase activity; Biological process=D -ribose metabolic process
  Homolog annotation: Hit_ID=Q657Z1; Match level="QueryCoverage=94%, HitCoverage=91%, E-value=1e-120, Identity=63%"; Hit description =Carbohydrate kinase-like
  Pfam annotation: Domain name=PfkB; Domain location=55-354; Score =115.4; E_value=1.7e-31; Accession=PF00294.14; Description=pfkB family carbohydrate kinase
MGAEPLSKNKVALAQAPFVLGLQPSALVDHVARVDWSLLDQILGEHGGSIPVELGELEYILREVKIHVISCHDNDNDNDDDYPSSHIKTLAGGSVANTIRGLSNGFGISSGIIGACGDDEKGKLFDHNMSSNGVDLSRLRKKKGHTAQCVCLVDDLGNRTMRPCLSNAVKVQAEELTKEDFKGSKWLVLRYAILNLEVIKAAILLAKQEGLLVSLDLASFEMVRNFKQPLLKLLESGNIDLCFANEDEATELLRGEQNADPVTAVEFLAKYCQWAVVTLGPNGCIAKHGNEIARVPAIGEAKATDATGAGDLFASGFLYGVIKGLSLEECCKVGACSGGSVVRSLGGEVTLKNCHWMYKQMQIKDLPTPEISK

SEQ ID NO: 184350 - protein, 107 aa, Glycine max
  Coding DNA Sequence Number=SeqID_67572
  Homolog annotation: Hit_ID=Q9LTY5; Match level="QueryCoverage=62%, HitCoverage=23%, E-value=3e-15, Identity=60%"; Hit description =Arabidopsis thaliana genomic DNA, chromosome 3, TAC clone:K1G2
MVFACYTNTIVVWGITCFTISTRGLCARFEVLDEEPGDDEESSGQRQYKLPMANIIPFPKSNDPSSAQDFPPGRHVLAVYPGTTALYKATVVQGHRRVIILSFSLVE

SEQ ID NO: 184351 - protein, 80 aa, Glycine max
  Coding DNA Sequence Number=SeqID_67573
MEVTVVVIHDANGTLENAISQNDEIKEYVDCRALCPDVLQHKVPLSTSPSHLLPRTQGSRSSQDPNTNSKPGVSYHIPNY

SEQ ID NO: 184352 - protein, 212 aa, Glycine max
  Coding DNA Sequence Number=SeqID_67574
KNCWNPDDLTITIRGARRARTRPVEAPSISIAPSPACTLVAPSASAPADFQRFEAMLQSIHQGQIILLQSLQMVAPPDFIPSVEQFNEWVVWPGTQSSLHREDEGPTTQVPQQMEDESSEITTLEPLVRRKKADQTQEAAATSEKSLEATFEPLEPVADTTSLQQAANPSIPENQTTPVLSPNTSPIATPVLHLTDEEDVHTQDTQDRSQDF

SEQ ID NO: 184353 - protein, 59 aa, Glycine max
  Coding DNA Sequence Number=SeqID_67575
MEKGQRSAYFENEGSGVIYAQQRVLNPSYLASFLFIAKLGEVLATHPGELSWLLSDEAF

SEQ ID NO: 184354 - protein, 285 aa, Glycine max
  Coding DNA Sequence Number=SeqID_67576
  Homolog annotation: Hit_ID=Q1RXW3; Match level="QueryCoverage=72%, HitCoverage=27%, E-value=5e-08, Identity=26%"; Hit description=Zinc finger, CCHC-type
  Pfam annotation: Domain name=zf-CCHC; Domain location=105-122; Score =20.6; E_value=0.00039; Accession=PF00098.13; Description=Zinc knuckle
MVVNKRPRTKLGYDMKDLRKIILWHSTIKRSRRFHCLERKRPKASLKSLKLKILLMKNEEEFDEDEVAFISQKIYKMLKNKGRSRWKNSSKKVLEKRKDKDKSFVLCYECKKPRHFKSECLELEKSSDKKKHYKNKEKKGLMSTWEDLDNTSFNEDEENANLYLMVYTTFEEFESDQEDELTKTCEKISKSCPKIIRNLKKAYKVHVSLDKSTHTCDAYEAFKEKESMLRLENETIAKEKYTLLENFQELEDKLKGLQKDLKELNELHNHQSEDRYGMFTSTQRL

SEQ ID NO: 184355 - protein, 102 aa, Glycine max
  Coding DNA Sequence Number=SeqID_67577
  Gene Ontology: Mol. function=oxidoreductase activity
  Homolog annotation: Hit_ID=Q1SFF5; Match level="QueryCoverage=93%, HitCoverage=32%, E-value=4e-22, Identity=56%"; Hit description=2OG -Fe(II) oxygenase
MSKRVREACESHGYFLLICDEIIPKDVRGDMFDGMKELFNLPEETKQQHICSKPYRGYNGKNSIIPLCQSFGMDVPLTASAEAFTNLMWPQGNTPFWPRTAH

SEQ ID NO: 184356 - protein, 143 aa, Glycine max
  Coding DNA Sequence Number=SeqID_67578
  Homolog annotation: Hit_ID=Q8S8K8; Match level="QueryCoverage=77%, HitCoverage=71%, E-value=3e-14, Identity=42%"; Hit description =Expressed protein
MHGETVTSVSSTGQREIAANTASNRVKNEACWKRQCVVMGVASIIGLEMCNSVAMAHEAIEIKTMPFSNQVVSNSNSYGGAKWSEKRMCPPWQGNSLETIVPENLPRPSARRRYEAVRSSSKTAPPLSAPIIVQSNKGSCFSM

SEQ ID NO: 184357 - protein, 622 aa, Glycine max
  Coding DNA Sequence Number=SeqID_67579
  Gene Ontology: Mol. function=nucleoside-triphosphatase activity; Cellular component=integral to membrane; Biological process=transport
  Homolog annotation: Hit_ID=Q1SFG1; Match level="QueryCoverage=98%, HitCoverage=78%, E-value=0.0, Identity=69%"; Hit description=AAA ATPase
  Pfam annotation: Domain name=ABC2_membrane; Domain location=350-564; Score=254.9; E_value=1.7e-73; Accession=PF01061.14; Description=ABC -2 type transporter
  Pfam annotation: Domain name=ABC_tran; Domain location=79-269; Score =107.3; E_value=4.3e-29; Accession=PF00005.17; Description=ABC transporter
  Pfam module annotation: Pfam domain module=ABC2_membrane::ABC_tran; Domain location=350-564::79-269
KGNESRRNVSSRTLSARVGGIGASEHNKKRGMVLPFTPLSITFDEIRYSVEMPQEMKSQGILEDRLELLKGVNGAFRPGVLTALMGVSGAGKTTLMDVLSGRKTAGYIQGQITISGYPKRQETFARIAGYCEQTDIHSPHVTVYESLVYSAWLRLPPEVDSSTRQMFIEEVMELVELTSLREALVGLPGVNGLSTEQRKRLTIAVELVANPSIIFMDEPTSGLDARAAAIVMRTVRNTVDTGRTVVCTIHQPSIDIFDAFDELLLLKRGGEEIYVGPLGQHCSHLINHFEFIHQVTSEAQEAALGVNFAEIYKNSDLYRRNKALIRELTTPPTGSKDLYFPTKYSQTFFTQCMACLWKQHLSYWRNPPYSAVRLLFTTIIALLFGTIFWDIGSKRQRKQDLFNAMGSMYAAVLFIGIQNATSVQPVVAIERTVFYRERAAGMYSALPYAFGQVAIEIPYIFIQTLVYGVIVYAMIGFDWTFSKFFWYLFFMFFTFLYFTFYGMMAVGLTPDHNVAAIVSFGFYMIWNLFSGFVIPRTRMPVWWRWYFWICPVSWTLYGLVTSQFGDIKEPIDTGETVEEFVRSYFGYRDDFVGVAAAVLVGFTLLFGFTFAFSIKAFNFQKR

SEQ ID NO: 184358 - protein, 785 aa, Glycine max
  Coding DNA Sequence Number=SeqID_67580
  Gene Ontology: Mol. function=nucleoside-triphosphatase activity; Cellular component=integral to membrane; Biological process=transport
  Homolog annotation: Hit_ID=Q76CU2; Match level="QueryCoverage=97%, HitCoverage=98%, E-value=0.0, Identity=49%"; Hit description =Pleiotropic drug resistance protein 1
  Pfam annotation: Domain name=ABC2_membrane; Domain location=501-714; Score=199.7; E_value=7e-57; Accession=PF01061.14; Description=ABC-2 type transporter
  Pfam annotation: Domain name=ABC_tran; Domain location=176-399; Score= 53.3; E_value=8.3e-13; Accession=PF00005.17; Description=ABC transporter
  Pfam annotation: Domain name=PDR_assoc; Domain location=719-780; Score=87.1; E_value=5.4e-23; Accession=PF08370.2; Description=Plant PDR ABC transporter associated
  Pfam module annotation: Pfam domain module=ABC2_membrane::ABC _tran::PDR_assoc; Domain location=501-714::176-399::719-780
MESGELRVASARIGSSGVWRSGSIDVFSGSSRRDDDEQELKWAAIEKLPTYLRMTRGILTETEGQPTEIDINKLCPLQRKNLVERLVKIAEQDNEKFLFKLRDRIDRVGLEIPTIEIRFEHLNVEAEAHVGSRALPTIFNFCINLFEGFLNSLHLIPSRKKPFTVLDDVSGIIKPKRMTLLLGPPSSGKTTLLLALAGRLSKDLKFSGRVSYNGHGMEEFVPQRTSAYISQTDLHIGEMTVRETLAFSARCQGIGTRYEMLAELSRREKAANIKPDPDLDIYMKAAALEGQETNVVTDYIMKILGLEVCADTMVGDDMIRGISGGQKKRVTTGEMLVGPARALFMDEISTGLDSSTTFQMVNSLRQSIHILNGTAVISLLQPAPETYELFDDIILLSDGQIVYQGPRENVLEFFEYMGFKCPERKGVADFLQEVTSRKDQEQYWANKDEPYSFVTVKEFAEAFQSFHAGRKLGDELATPFDMSKGHPAVLTKNKFGVCKKELLKACVSREFLLMKRNSFVYIFKMWQLILTGFITMTLFLRTEMHRDTETDGGIYMGALFFVLIVIMFNGYSELSMSIMKLPVFYKQRDLLFFPCWAYSLPTWILKIPITLVEVGIWVVMTYYVIGFDPSIERFIKQYFLLVCINQMASGLFRFMGAVGRNIIVANTVGSFALLAVMVMGGFILSRVDVKKWWLWGYWFSPMMYGQNALAVNEFLGKSWSHVTPNSTEPLGVKVLKSRGIFPKAYWYWIGVGASIGYMLLFNFLFPLALHYLDREYLTVHVPFNL

SEQ ID NO: 184359 - protein, 105 aa, Glycine max
  Coding DNA Sequence Number=SeqID_67581
  Homolog annotation: Hit_ID=Q1SNF1; Match level="QueryCoverage=94%, HitCoverage=72%, E-value=1e-14, Identity=43%"; Hit description =Expansin 45, endoglucanase-like
  Pfam annotation: Domain name=DPBB_1; Domain location=22-103; Score =44.9; E_value=2.7e-10; Accession=PF03330.8; Description=Rare lipoprotein A (RlpA)-like double
MSKTATTCFGRDASQFPSSNMFAAAGEGIWDNGAACGRQYQVRCISAAAPRTCVPGQTIQIKIVDRAQSSVSRPSLGGTSMVLSVTAFQAIANVSASFINIEFQQ

SEQ ID NO: 184360 - protein, 82 aa, Glycine max
  Coding DNA Sequence Number=SeqID_67582
MAATSVVPARIRSSHSVLRVIHASDITVTQIITSFNGLRVFGIMPSSPCLAAGLGLMDIDSGLFSLYLSQKLQRQRSRAPAR

SEQ ID NO: 184361 - protein, 151 aa, Glycine max
  Coding DNA Sequence Number=SeqID_67583
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=93%, HitCoverage=27%, E-value=5e-71, Identity=75%"; Hit description=DNA -directed RNA polymerase beta' chain
  Pfam annotation: Domain name=RNA_pol_Rpb1_2; Domain location=1-71; Score=46.1; E_value=2e-11; Accession=PF00623.11; Description=RNA polymerase Rpb1, domain 2
MQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRAYQQKRINFDSPLWLRWRLDQRIISSREVPIEVHYESLDHIDGWYLR

SEQ ID NO: 184362 - protein, 213 aa, Glycine max
  Coding DNA Sequence Number=SeqID_67584
  Gene Ontology: Mol. function=RNA-directed DNA polymerase activity; Cellular component=intracellular; Biological process=RNA-dependent DNA replication
MAPEIYPKAHENPKAFSCISSPIYLESSIQCPCRVGLHQPLVIHFTRDITTQRSQGFQPFTAKTPAPFPYKSDKVVPWKYVVQGPGKSGMTRSGRIFAAPKLLARSKDKGKVKADIGERDRAGPTVNDKAPVGKIVEEGDDFRKREISAKEATEFLRIIQHSEFEVIEQLNKTPAKISFLGLLMNSKPHRVLMVNILNEAHVAQDVGQVASIT

SEQ ID NO: 184363 - protein, 71 aa, Glycine max
  Coding DNA Sequence Number=SeqID_67585
MVIVATYPSTGGQREGSRVRLPKRKMHGVATNVYSRKMSEKPERRGIRTLSVKGSGVLFVHGEGNQTYAVL

SEQ ID NO: 184364 - protein, 259 aa, Glycine max
  Coding DNA Sequence Number=SeqID_67586
  Gene Ontology: Mol. function=inorganic anion exchanger activity; Cellular component=integral to membrane; Biological process=anion transport
  Homolog annotation: Hit_ID=Q1S420; Match level="QueryCoverage=93%, HitCoverage=39%, E-value=1e-112, Identity=81%"; Hit description=HCO3- transporter
  Pfam annotation: Domain name=HCO3_cotransp; Domain location=8-259; Score=-308.0; E_value=9.1e-05; Accession=PF00955.11; Description =HCO3- transporter family
MSREELNSINKTGFVQSVLALDGTLSTVETLASTAICGVVHSILGGQPLLILGVAEPTVIMYTYLYSFCQKTPELGGKLFLPWAGWVCVWTGIFLILLAIFNACTIITRFTRIAGELFGMLITVLFFQEAIKGLIGEFNTPKNENPSLVEFQFQWLYTNGLLAIIFCFGLLVTALKSRRARTWRYGTGWLRGFIADYGVPMMVVLWTALSYAVPGKVPDGVPRRLIAPLPWDAASLYHWTVVKGVGVQHCEQQAVIILV

SEQ ID NO: 184365 - protein, 520 aa, Glycine max
  Coding DNA Sequence Number=SeqID_67587
  Gene Ontology: Mol. function=1-deoxy-D-xylulose-5-phosphate synthase activity; Cellular component=type II protein secretion system complex; Biological process=terpenoid biosynthetic process
  Homolog annotation: Hit_ID=Q1S421; Match level="QueryCoverage=99%, HitCoverage=73%, E-value=0.0, Identity=83%"; Hit description =Deoxyxylulose-5-phosphate synthase
  Pfam annotation: Domain name=Transket_pyr; Domain location=197-363; Score=128.5; E_value=1.8e-35; Accession=PF02779.14; Description =Transketolase, pyrimidine binding dom
  Pfam annotation: Domain name=Transketolase_C; Domain location=377 -500; Score=151.2; E_value=2.7e-42; Accession=PF02780.10; Description= Transketolase, C-terminal domain
  Pfam module annotation: Pfam domain module=Transket_pyr::Transketolase _C; Domain location=197-363::377-500
MAVARDIKGRQERVVAVISNWTTMAGQAYEAMSNAGYLDSNMVVILNDSRHSLLPKIEEGPKTSVNALSSTLSKLQSSKSFRRFREAAKGVTKRIGRGMHELAAKVDEYARGMMGPLGSTLFEELGLYYIGPVDGHNIEDLICVLQEVASLDSMGPVLVHVITDENQGDDNSQKSDMSDEQKNEGFVKSDLLDNPVWPQTYGNCFVATLVAEAEKDKDIIVVHAGLTMEPSLELFQEKFPDRFFDVGMAEQHAVTFASGLACGGLKPFCVIPSSFLQRAYDQVVHDVDQQRIPVRFVITSAGLVGSDGPLRCGAFDINFMSCLPNMIVMAPSDELELMHMVATATRINNQPICFRYPRGALVGEGYTIGDGIPIKIGRGRVLVEGKDVAFLGYGSMVQNCLKAHSLLAKLGIEVTVADARFCKPLDIMLLRQLCKHHSFLVTVEEGSIGGFGSHVAQFIAVNGLLDGRIKWRPIVLPDRYIEHASPNEQLDQAGLSGHHIAATALSLLGRTREALLFMCS

SEQ ID NO: 184366 - protein, 157 aa, Glycine max
  Coding DNA Sequence Number=SeqID_67588
  Gene Ontology: Mol. function=nutrient reservoir activity; Cellular component=cellulose and pectin-containing cell wall
  Homolog annotation: Hit_ID=Q43557; Match level="QueryCoverage=100%, HitCoverage=42%, E-value=3e-57, Identity=67%"; Hit description =Unidentified precursor
  Pfam annotation: Domain name=DUF642; Domain location=39-156; Score= -47.1; E_value=9.3e-11; Accession=PF04862.3; Description=Protein of unknown function, DUF642
MERFSFLLVLFCCFHVAFSFTHGAVINGEFELGPKPQDMKGTVVTGGPHSIPGWEISGFIEYIKSGQKQDDMLLVVPNGAYAVRLGNEASIKQNLKVVKGMYYSITFVVARTCAQEEKLNVSAAPDWVVLPMQTVYGGNGWHAYAWSFRADYPSVDM

SEQ ID NO: 184367 - protein, 218 aa, Glycine max
  Coding DNA Sequence Number=SeqID_67589
  Gene Ontology: Mol. function=nutrient reservoir activity; Cellular component=cellulose and pectin-containing cell wall
  Homolog annotation: Hit_ID=Q43557; Match level="QueryCoverage=65%, HitCoverage=45%, E-value=1e-55, Identity=78%"; Hit description =Unidentified precursor
MVAFRKSEKRRFGVVGVGGGVERCFKEMRWGPTSVYCEGVVFFPLKVWPVGKVNGVEGVAGLGALREEDGKTDQGDIINHRPTQRSEIVTSHVVEGTFTLSLPTYASTLSDPSQELPASPTAKKRVYVLPGMVLATCAMALSFPPISSTALFPLGTEKWSESMYLTAFRDSTIHPGRGECSMWSTILGGISTPDDVLGNTYGPSSNPPFFNTFSVCVE

SEQ ID NO: 184368 - protein, 365 aa, Glycine max
  Coding DNA Sequence Number=SeqID_67590
  Gene Ontology: Mol. function=nutrient reservoir activity; Cellular component=cellulose and pectin-containing cell wall
  Homolog annotation: Hit_ID=Q43557; Match level="QueryCoverage=97%, HitCoverage=94%, E-value=1e-159, Identity=74%"; Hit description =Unidentified precursor
  Pfam annotation: Domain name=DUF642; Domain location=38-363; Score =766.6; E_value=1.5e-227; Accession=PF04862.3; Description=Protein of unknown function, DUF642
MGMLSFLLVFCCFHVTFSFTDGSIANAEFEFGPKPQDMKGTVVTGGPHAIPGWEISGFIEYLKSGQKQGDMLLVVPNGAYAVRLGNGASIKQKIKVVKGMYYSITFMVARTCAQEEKLNVSVAPDWVVLPMQTLYSGNGWDAYAWSFQADYSLVDMAFHHPGKEEDPACGPIIDSIALKALYPPRPTNKNVLKNGGFEEGPYVFPNTTSGVLIPPNIVDLSDHSPLPGWIVESLKAVKYIDSDHFSVPLGKGAVELIGGKESAIAQVARTIPGKTYTLSFAVGDAGNSCEGSLSVEAYVGKESVKVPYESKGKGGFKRATLKFVAVSTRTRILFLSTFYTMRSDDFASLCGPVIDDVTLISLRKP

SEQ ID NO: 184369 - protein, 271 aa, Glycine max
  Coding DNA Sequence Number=SeqID_67591
  Gene Ontology: Mol. function=nucleotide binding; Cellular component =nucleus; Biological process=small GTPase mediated signal transduction
  Homolog annotation: Hit_ID=P41916; Match level="QueryCoverage=80%, HitCoverage=99%, E-value=1e-116, Identity=90%"; Hit description=GTP -binding nuclear protein Ran-1
  Pfam annotation: Domain name=Arf; Domain location=51-221; Score= -99.6; E_value=0.045; Accession=PF00025.11; Description=ADP -ribosylation factor family
  Pfam annotation: Domain name=MMR_HSR1; Domain location=64-178; Score=- 8.8; E_value=0.0063; Accession=PF01926.13; Description=GTPase of unknown function
  Pfam annotation: Domain name=Miro; Domain location=65-178; Score =53.4; E_value=7.4e-13; Accession=PF08477.3; Description=Miro-like protein
  Pfam annotation: Domain name=Ras; Domain location=65-223; Score =229.1; E_value=9.6e-66; Accession=PF00071.12; Description=Ras family
  Pfam module annotation: Pfam domain module=Arf::MMR_HSR1::Miro::Ras; Domain location=51-221::64-178::65-178::65-223
MSLENEMQRGGGPWMNGDGPQSIGGGANDSATAVHNTLMTAEEQGGKKGEGALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQQHEAELLAAASQPLPDDDDESFE

SEQ ID NO: 184370 - protein, 96 aa, Glycine max
  Coding DNA Sequence Number=SeqID_67592
  Gene Ontology: Mol. function=peptidyl-prolyl cis-trans isomerase activity; Cellular component=nucleoplasm; Biological process=protein folding
  Homolog annotation: Hit_ID=Q1S411; Match level="QueryCoverage=84%, HitCoverage=9%, E-value=4e-38, Identity=91%"; Hit description =Peptidyl-prolyl cis-trans isomerase, cyclophilin type
  Pfam annotation: Domain name=Pro_isomerase; Domain location=8-96; Score=14.4; E_value=3.7e-08; Accession=PF00160.11; Description =Cyclophilin type peptidyl-prolyl cis-
MTKKKNPLVFMDVSIDGDPVERMVFELFYDVAPKTAENFRALCTGEKGISPNTGKSLHYKGSFFHQIIKGSIVQGGDFVNRNVVRVASLVPFACFL

SEQ ID NO: 184371 - protein, 789 aa, Glycine max
  Coding DNA Sequence Number=SeqID_67593
  Gene Ontology: Mol. function=isomerase activity; Biological process =protein folding
  Homolog annotation: Hit_ID=Q1S411; Match level="QueryCoverage=74%, HitCoverage=74%, E-value=4e-39, Identity=58%"; Hit description =Peptidyl-prolyl cis-trans isomerase, cyclophilin type
  Pfam annotation: Domain name=Extensin_2; Domain location=283-654; Score=-128.5; E_value=0.027; Accession=PF04554.4; Description =Extensin-like region
  Pfam annotation: Domain name=Pro_isomerase; Domain location=1-92; Score=19.2; E_value=1.6e-08; Accession=PF00160.11; Description =Cyclophilin type peptidyl-prolyl cis-
  Pfam module annotation: Pfam domain module=Extensin_2::Pro_isomerase; Domain location=283-654::1-92
TAGESIYGSKFPDESPRLKHDATGLLSMAIADRDTLGSHFIITLKADHHLDRKHVVFGKLVQGHNVLKKIEEFGDEEGHPTVTVKIINCGEYSEDSDTESLETDSDSESDMSSSSYMSSSSDDRRKKRKRSKKDKYRRGKRKDKRRDKRRRKKDKRSKRKSKRESGSDSDSESNSDNSSEGENIGAQHKGLKRKDNSQKNAETKSPLVAEKDLPPAHHEKEEMGMLENEEKLSKENGERRNNGIGGADYGSDRSEERQPDVMDDHSGKTRSRSVSPKRPMSKSMSISPRRSASKSPSVTPKRRLSKSPSVRSPPPSQRSLSRSPARSISRSPSRSISRSPVRGRNGRSVNRSPVRGRNGRSVSRSPVRGRNGRSVRRSPVRGRNGRSVRRSPVRGRNGRSVSRSPVRGRNGRNVNRTPVRGGNGKSVSRSPVRTRSLKSVSRSPVRTRSLRSVSKSPVRARSQSHRSRSSPRAPSGKTISRSPVRVLRKSISRSPVRSPARSLSRSSGWVPSKKSISRSPVRAPSRSIRRSYSRSPSPVRRTRTPRGRSVSRSVSPDASPKRIRRGRGFSERYSYARRYRTPSRSPVRSYRYNGRNDRDRYSSYRRFSPRRFRSPPPRGRTPPSSVIVFNNVSGMIIFENLYVGIEAGGAGHHLFHAVHDIELDDIAEVGAQFVVGVQFAVVPQLIDPAPLVWRGVHLLLGAGVHPNPGLGLGPGHPWNLYQEQVETAGPGHRPEAQMERKAWSHMAMVLHTNVKGEICGAEGFGLSCEVVAVFVGIETHVVAPVMSSL

SEQ ID NO: 184372 - protein, 67 aa, Glycine max
  Coding DNA Sequence Number=SeqID_67594
  Homolog annotation: Hit_ID=Q8L9X1; Match level="QueryCoverage=75%, HitCoverage=18%, E-value=9e-12, Identity=66%"; Hit description =Putative lysophospholipase
MSYSGSSMSSGSGSSRRTFEFGRTHVVRPKGKHQATIVWLHGLGDNGSRIIPFLLANLVEWIPSPHA

SEQ ID NO: 184373 - protein, 84 aa, Glycine max
  Coding DNA Sequence Number=SeqID_67595
  Gene Ontology: Mol. function=binding
  Subcellular localization annotation: CTP_CleavageSite=40; ConfidenceScore=5.22e-01
MSYLWFNQNPLKFRRKFFKRWLRSPRHNSVASGNCILAVRAGAVSVLLRVAKGTDNEDLAGTSLAVLSLLARFEEGLNGLKRKC

SEQ ID NO: 184374 - protein, 189 aa, Glycine max
  Coding DNA Sequence Number=SeqID_67596
  Gene Ontology: Mol. function=zinc ion binding; Cellular component =intracellular
  Homolog annotation: Hit_ID=Q1S406; Match level="QueryCoverage=83%, HitCoverage=97%, E-value=3e-54, Identity=62%"; Hit description=Zinc finger, RanBP2-type
  Pfam annotation: Domain name=zf-RanBP; Domain location=140-171; Score= 35.8; E_value=1.5e-07; Accession=PF00641.9; Description=Zn-finger in Ran binding protein and others
  Pfam annotation: Domain name=zf-RanBP; Domain location=20-49; Score =25.5; E_value=0.00019; Accession=PF00641.9; Description=Zn-finger in Ran binding protein and others
  Pfam annotation: Domain name=zf-RanBP; Domain location=76-107; Score =34.2; E_value=4.7e-07; Accession=PF00641.9; Description=Zn-finger in Ran binding protein and others
  Pfam module annotation: Pfam domain module=zf-RanBP::zf-RanBP::zf -RanBP; Domain location=140-171::20-49::76-107
MSLLYMCMVESGNYEGKMNRPGDWNCRTCNHLNFQRRESCQRCGEPRSGGGDYGGGFGGGRGSSSFGGFTTGPDVRPGDWYCTVGNCGAHNFASRSSCFKCGAPKEDSSAGPFDVDMPRMRPFGFGGSGGGGSSARPGWKSGDWICTRSGCNEHNFANRMECYRCNAPRDSSSARFAVQGENREAIPIS

SEQ ID NO: 184375 - protein, 186 aa, Glycine max
  Coding DNA Sequence Number=SeqID_67597
  Homolog annotation: Hit_ID=Q9FJY2; Match level="QueryCoverage=40%, HitCoverage=48%, E-value=4e-16, Identity=56%"; Hit description =Arabidopsis thaliana genomic DNA, chromosome 5, TAC clone:K1F13
MGNCVFSSYHETTSQVSTAKVVVHDGRMQEFSYPVKVSYLLQLYPACFICDSDELGFDDVVTAVHEDEELRPGQLYFALPLTRLKRHLPPQEMAALAVVATSALAKCGRRQIVFLSAADGNAKPARRVAPDGGAAAATVFNHNVASKGKGKIGEELQNMLSVKLIIVHKNGFKVGVSAFRLRLGDG

SEQ ID NO: 184376 - protein, 101 aa, Glycine max
  Coding DNA Sequence Number=SeqID_67598
MVAWPGTQPSLHREDKGPTTQVVVATPDRSLEATSEPPAPVVDLPSPQRTTDPSTPILEIPEDLTTPVLAMDTSPPATLVLHLTNEEDVQTKDTQDQSQEF

SEQ ID NO: 184377 - protein, 72 aa, Glycine max
  Coding DNA Sequence Number=SeqID_67599
MANAQTYTMARFPTKLWGFKLPFTSSEEGDGGCGHEANVIDDLMMRIIACSGEELLEGGDWRVWEKTQISLV

SEQ ID NO: 184378 - protein, 191 aa, Glycine max
  Coding DNA Sequence Number=SeqID_67600
  Gene Ontology: Mol. function=sequence-specific DNA binding; Cellular component=nucleus; Biological process=regulation of transcription, DNA-dependent
  Homolog annotation: Hit_ID=Q1RYX5; Match level="QueryCoverage=99%, HitCoverage=50%, E-value=7e-55, Identity=57%"; Hit description =Calcium-binding EF-hand; Homeodomain-related
MKKLARALKAGRRKTSIKNLAADLCLDRALVLQMLRDPPPNLLMMSLTIPDEPATTVVSLETKPSEIVHKETSIDHAEPEPKAKVPVHTLQRNWHAQKRLKKAHVDTLERVYRRSKRPTQLPLESIVSRGKLQIMHDCTAGTGIENAMISSIVHVTNIPRKKVVKWFEDKRAEEGVPDRRVPYQRSVPETA

SEQ ID NO: 184379 - protein, 61 aa, Glycine max
  Coding DNA Sequence Number=SeqID_67601
MIIVSEPGMDAATVTVEYIPDGILHLVKIRNCTDAGLVSVAEGCSKSSLKLRIVSFGKWPN

SEQ ID NO: 184380 - protein, 97 aa, Glycine max
  Coding DNA Sequence Number=SeqID_67602
MGTEKDLRIENSSTECFSLAVEEEPTRWVAIEMEMIVSLKEAALLLGFTYLLKTQLLKTTKSASIILTLSSITKSLPRPAFRTLLTQFSKSFSCNLS

SEQ ID NO: 184381 - protein, 148 aa, Glycine max
  Coding DNA Sequence Number=SeqID_67603
  Gene Ontology: Mol. function=nucleoside-triphosphatase activity; Cellular component=cytoplasm; Biological process=defense response
  Homolog annotation: Hit_ID=Q1STU9; Match level="QueryCoverage=81%, HitCoverage=11%, E-value=6e-18, Identity=37%"; Hit description=H+ -transporting two-sector ATPase, alpha/beta subunit, central region; Disease resistance protein
MTSVLNEIMMALSQPNIIILWMHGSSNARKGNVVEKITRRVQRDQLFDLVVMSSVRKKPDLRRIQEKTLEGRATCLCNRIKMEEKILIILNDLWGAINLGKIGIPFGNDQKGCKILLVSSHNQGVVVQPNENPNRSLCESSDGRRLKN

SEQ ID NO: 184382 - protein, 203 aa, Glycine max
  Coding DNA Sequence Number=SeqID_67604
  Gene Ontology: Mol. function=DNA binding; Cellular component=nucleus; Biological process=multicellular organismal development
  Homolog annotation: Hit_ID=Q1SFF6; Match level="QueryCoverage=98%, HitCoverage=23%, E-value=1e-101, Identity=85%"; Hit description =Lissencephaly type-1-like homology motif; Single-stranded DNA -binding protein, SSDP; WD40-like
  Pfam annotation: Domain name=WD40; Domain location=165-203; Score =30.7; E_value=5.1e-06; Accession=PF00400.22; Description=WD domain, G-beta repeat
  Pfam annotation: Domain name=WD40; Domain location=4-43; Score=35.3; E_value=2.1e-07; Accession=PF00400.22; Description=WD domain, G-beta repeat
  Pfam annotation: Domain name=WD40; Domain location=86-123; Score =41.1; E_value=3.8e-09; Accession=PF00400.22; Description=WD domain, G-beta repeat
  Pfam module annotation: Pfam domain module=WD40::WD40::WD40; Domain location=165-203::4-43::86-123
MQPGYSLRTFTGHSTSVMSLDFHPNKDDLICSCDGDGEIRYWSINNGSCARVSKGGTTQMRFQPRLGRYLAAAAENIVSIFDVETQVCRYSLKGHTKPVVCVCWDPSGELLASVSEDSVRVWTLGSGSDGECVHELSCNGNKFHKSVFHPTYPSLLSLELWNMSENKTMTLSAHDGLITSLAVSTVNGLVASASHDKFLKLWK

SEQ ID NO: 184383 - protein, 223 aa, Glycine max
  Coding DNA Sequence Number=SeqID_67605
  Gene Ontology: Mol. function=hydrolase activity
  Homolog annotation: Hit_ID=Q6XBH1; Match level="QueryCoverage=90%, HitCoverage=73%, E-value=1e-113, Identity=98%"; Hit description =Phosphohydrolase
  Pfam annotation: Domain name=Metallophos; Domain location=22-220; Score=67.3; E_value=4.9e-17; Accession=PF00149.18; Description =Calcineurin-like phosphoesterase
MGAESGGQWGTIGAGTLMELFMLLAHISDTHFRSRGEKLYGFIDVNAANADVVSQLNALRERPDAVVVSGDIVNCGRPEEYQVARQILGSLNYPLYLIPGNHDDKALFLEYLQPLCPQLGSDANNMRYAVDDFATRLLFIDSSHAGTSKGWLTDETISWLEAQLFDGGDKPATIFMHHPPLPLGNAQMDPIACENGHRLLALVERFPSLTRIFCGHNHSLTMT

SEQ ID NO: 184384 - protein, 641 aa, Glycine max
  Coding DNA Sequence Number=SeqID_67606
  Gene Ontology: Mol. function=DNA binding; Cellular component=nucleus; Biological process=multicellular organismal development
  Homolog annotation: Hit_ID=Q1SFF6; Match level="QueryCoverage=83%, HitCoverage=58%, E-value=0.0, Identity=67%"; Hit description =Lissencephaly type-1-like homology motif; Single-stranded DNA -binding protein, SSDP; WD40-like
  Pfam annotation: Domain name=SSDP; Domain location=29-270; Score =144.6; E_value=2.6e-40; Accession=PF04503.4; Description=Single -stranded DNA binding protein, SSDP
  Pfam annotation: Domain name=WD40; Domain location=556-594; Score =31.1; E_value=3.9e-06; Accession=PF00400.22; Description=WD domain, G-beta repeat
  Pfam annotation: Domain name=WD40; Domain location=598-636; Score =50.8; E_value=4.7e-12; Accession=PF00400.22; Description=WD domain, G-beta repeat
  Pfam module annotation: Pfam domain module=SSDP::WD40::WD40; Domain location=29-270::556-594::598-636
MVYWNLQFYTRVSKLRENTTGPTLHLWFVKLYLQTQLIKAREQQQQQNQQQPQPQQSQHQQQHMQMQQLLLQRAQQQQQQQQQQQQQPQSQQQQSQPQQQQQSRDRPHLLNGSANGLVGNPGTANALATKMYEERLKLPLQRDSLDDAATKQRFGENMGQLLDPNHAPILKSAAAPGQPSGQVLHGAAGGMSPQVQARTQQLPGSTLDIKGEISPVLNPRAVGPEGSLMGMPGSNPGSNNLTLKGWPLTGLEQLRSGLLQQQKPFMQAPQPFHQLQMLTPQHQQQLMLAQQNLASPSASEESRRLRMLLNNRNIGLNKDGLSNPVGDVVSNVGSPLQGGGPPFPRGDTDMLVKLKLAQLQQQQQQQSSTNAQQQQLQQHTLSNQQSQTSNHSMHQQDKVGGGGGGSVTVDGSMSNSFRGNDQVSKNQIGRKRKQPGSSSGPANSSGTANTTGPSPSSAPSTPSTHTPGDVISMPALPHSGSSSKPLMMFSTDGTGTLTSPSNQLWDDKDLELQADVDRFVEDGSLDENVESFLSHDDTDPRDTVGRCMDVSKGFTFSDVNSVRASTSKVSCCHFSSDGKLLASGGHDKKVVLWYTDSLKQKATLEEHSSLITDVRFSPSMPRLATSSFDKTVRVWDVDNVS

SEQ ID NO: 184385 - protein, 112 aa, Glycine max
  Coding DNA Sequence Number=SeqID_67607
MAAFHGFHVSPNHLFLWHPFHTATHQQPFLQDPSPLFSHTPYPYVHLAQSLGIDFESTRNCLLGLFGTRKTLHPSSPTLPLKMESNFHVHVTGSSNDGNNAGKLVVPHYYKK

SEQ ID NO: 184386 - protein, 119 aa, Glycine max
  Coding DNA Sequence Number=SeqID_67608
  Homolog annotation: Hit_ID=Q1SFF6; Match level="QueryCoverage=48%, HitCoverage=6%, E-value=4e-27, Identity=100%"; Hit description =Lissencephaly type-1-like homology motif; Single-stranded DNA -binding protein, SSDP; WD40-like
MGFVLHAQFFDFLAWFVVFRKFCGVYWKLLILAAELGIFCVRDLKASAQAFQAEGKVSSDPVAIDAPGGFLFEWWSVFWDIFIARTNEKHSEVAASYIEVGWVQIFTGFTLCNLLPCQI

SEQ ID NO: 184387 - protein, 238 aa, Glycine max
  Coding DNA Sequence Number=SeqID_67609
  Gene Ontology: Mol. function=unfolded protein binding; Cellular component=soluble fraction; Biological process=protein folding
  Homolog annotation: Hit_ID=P37900; Match level="QueryCoverage=36%, HitCoverage=12%, E-value=3e-30, Identity=74%"; Hit description=Heat shock 70 kDa protein, mitochondrial precursor
MLKPYFLVVPLHPALPLESINNFHCGNSLPSLVLKVRNRADKKVPCDATEELVPWCMIELLIGTPTKPQALPNPPNTLLDTKWLIGRRFGDAQTQKEMKVVPFSIVKAPNGDAWVEANRQQYFPSHISAFVLTKMKEIAKAYMGKADEPGELRWNNPWDPGVPGQKWDSIGFCSPLVHERPRCRHPTASSLTVAIKSESMSTHTTTMCLLPPPWLSMLFPFTTHLTIALSRATTMKSK

SEQ ID NO: 184388 - protein, 402 aa, Glycine max
  Coding DNA Sequence Number=SeqID_67610
  Gene Ontology: Mol. function=oxidoreductase activity; Cellular component=mitochondrial outer membrane translocase complex; Biological process=electron transport
  Homolog annotation: Hit_ID=Q1SFF8; Match level="QueryCoverage=97%, HitCoverage=99%, E-value=1e-176, Identity=72%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=24-402; Score=- 416.7; E_value=0.00015; Accession=PF00743.9; Description=Flavin -binding monooxygenase-like
MESLKAQEGGEEQVKCVWVHGPIIVGAGPSGLAVAACLSHHGVPYVILERTNCITSLWQHRTYDRLKLHLPKHFCELPLIPFPLHFPKYPSNSYASRFNIRPRFNQSVQTAQFDPCSQLWVVKTNGFQYISPWLVVATGENAEPVVPSISGMDKFRGPIVHTSVYKSGSDYKNQRVLVIGCGNSGMEVSLDLCRHNANPYMVARNTVHVLPMEMFGFSTFGIAMALLKWLPIKLVDKLVLAAARLMLGDTARYGVRRPKTGPIELKLVTGKTPVLDVGQVAQIRSGNIKVMEGVKEITRNGAKFMDGQEKEFSAIILATGYKSNVPTWLKSCESFTKDGMPKTPFPMGWKGENGLYTVGFTRRGLLGTASDAVKIAKDIADQWMTVKDRSYCNSHIIFLKST

SEQ ID NO: 184389 - protein, 63 aa, Glycine max
  Coding DNA Sequence Number=SeqID_67611
  Gene Ontology: Mol. function=prephenate dehydratase activity; Biological process=L-phenylalanine biosynthetic process
  Homolog annotation: Hit_ID=Q1RXT6; Match level="QueryCoverage=89%, HitCoverage=14%, E-value=6e-14, Identity=63%"; Hit description =Prephenate dehydratase with ACT region
MVNTEPLMANEFSSSDGGAKLRVAYKGLPGAYTEDAVLKAYPKCETVPCEDFETSFKVALLVS

SEQ ID NO: 184390 - protein, 78 aa, Glycine max
  Coding DNA Sequence Number=SeqID_67612
MVVNFFLAHLLLEVASPIFFLPSSFRCHDLQEAKDSIDGEDPRPTSSTWSYIMWYQSIFMNYHFFSHNLLVLKFLPNF

SEQ ID NO: 184391 - protein, 146 aa, Glycine max
  Coding DNA Sequence Number=SeqID_67613
MDLGEIFLLLGGSRSLILEAFVAPCRLERHYFGSHPYLCCKRDCVVVFKSNTRIRGPHRHLLRFIVLAAFILDAYASNEVDTALLIPNPNLIDFSECHHDELKGVHHEHEEEDGNRVQQHKENRVVQFMSNKGHISLFMLPMRCRK

SEQ ID NO: 184392 - protein, 81 aa, Glycine max
  Coding DNA Sequence Number=SeqID_67614
MTQPHSTDHNERTWIPPPNGFLKRNLDAAILKEINTFGGGLCIRGEHGSYIKSNSNIFQGIPSPSSEAECANPMDPAAGIQ

SEQ ID NO: 184393 - protein, 252 aa, Glycine max
  Coding DNA Sequence Number=SeqID_67615
  Gene Ontology: Mol. function=prephenate dehydratase activity; Cellular component=cytoplasm; Biological process=L-phenylalanine biosynthetic process
  Homolog annotation: Hit_ID=Q1RXT6; Match level="QueryCoverage=95%, HitCoverage=61%, E-value=8e-99, Identity=72%"; Hit description =Prephenate dehydratase with ACT region
  Pfam annotation: Domain name=ACT; Domain location=152-235; Score =24.8; E_value=0.00031; Accession=PF01842.15; Description=ACT domain
  Pfam annotation: Domain name=PDT; Domain location=2-142; Score=133.9; E_value=4.5e-37; Accession=PF00800.9; Description=Prephenate dehydratase
  Pfam module annotation: Pfam domain module=ACT::PDT; Domain location =152-235::2-142
CRSWLVDKAVLPIENSVGGSIHRNYDLLLGHKLHIVGEVQLLINHCLLGLAGVRKEDLKAVMSHPQALVQCKKMLTDLGIAKISVDDTAAAAKAVLLKGRKDIGAIAGSRAANMYGLDVLAEGIQDDDVNITRFLILARDPRIPGNDRPYKTSIVFSLDEGPGVLFKALGAFALRNINLSKIESRPLKQSPLRIVEDLIDERAKYFEYLFYIDFEASMADPQAQYALENLQEYTKFIRVLGCYPVDKTDTSD

SEQ ID NO: 184394 - protein, 151 aa, Glycine max
  Coding DNA Sequence Number=SeqID_67616
MGIRKTATCSVSKDGNASVETDVPFPADYSELLEQARVAADLAIKDNRQLMHRNRIIFSNDSFNGSKLLEDAVFLVWSWLRARETDFVMHYNQWSSNLNEIEFPTAGLGSVPGDGEGGIEMTESMQLIREFCDRFISSEKATRTRIVIFLI

SEQ ID NO: 184395 - protein, 125 aa, Glycine max
  Coding DNA Sequence Number=SeqID_67617
MASKKRKAPSTPTQARFDRSRFTSQEAWERYTDIMVPRKILTERNVVVYYTKFDEFQEELERRHWDEKLTDFADRSTHIAIVKEFYANLYDPEDKSPKQERVRDPCSARRGGEFVYLFHVCTPEA

SEQ ID NO: 184396 - protein, 65 aa, Glycine max
  Coding DNA Sequence Number=SeqID_67618
  Subcellular localization annotation: CTP_CleavageSite=60; ConfidenceScore=5.65e-01
MPTTTSGTPSTVATSRTPTGKRSPTPSPPAAPMLIRQVCEVLIFILSLSQSFGLTSHPLSATLLS

SEQ ID NO: 184397 - protein, 58 aa, Glycine max
  Coding DNA Sequence Number=SeqID_67619
MSPPPLELHNHSQTHLKLSGQLPLQASFSAARLAPLWTAQRALVDFGLAHAFLAQRMD

SEQ ID NO: 184398 - protein, 82 aa, Glycine max
  Coding DNA Sequence Number=SeqID_67620
METRFKRAIKGIKSRKHQQESSQGYCASNQWGKTHQMIMMMYGSNSHKVSLKRQSWTTTTLPHAIKLDRPRPIEKNLMRRQA

SEQ ID NO: 184399 - protein, 215 aa, Glycine max
  Coding DNA Sequence Number=SeqID_67621
  Homolog annotation: Hit_ID=Q9M3G7; Match level="QueryCoverage=91%, HitCoverage=4%, E-value=5e-53, Identity=53%"; Hit description =Serine/threonine-protein kinase ATM
MNSRPSSYSSKTRSTPAKARESAVVSYALSKSPSSWEKVYWLSIDYLLVAKLAALVEHTAGTSQSCGSYFTSVMYVEHWCEEQFKTLTIGGPDFSHNEMLPDHIEILVSAVTRINEPDSLYGILQSHKLTSQIITFEHEGNWGKALEYYDLQVQSDASVQKDGCSKSMSLKQTGAANPSSFASEVDEMRQSRPYKGLIRSLQQIGCTHVLDIFLI

SEQ ID NO: 184400 - protein, 154 aa, Glycine max
  Coding DNA Sequence Number=SeqID_67622
  Homolog annotation: Hit_ID=Q9M3G7; Match level="QueryCoverage=82%, HitCoverage=3%, E-value=8e-35, Identity=54%"; Hit description =Serine/threonine-protein kinase ATM
MAWDLRWRTCHNNSTEFCLLKPTVSPEPVIPSIEQMSWLDMEWCSILQRTQLHMNLLEPFIAFRRVLLQVLSSRDCMLQHLLQSATTLRKGCRFSQAAAALHEFKLLSVETKGQSSSVYWLGRSERERCEYFGKGGMNAGGGWVGRLNAHLRKS

SEQ ID NO: 184401 - protein, 276 aa, Glycine max
  Coding DNA Sequence Number=SeqID_67623
  Gene Ontology: Mol. function=phosphotransferase activity, alcohol group as acceptor
  Homolog annotation: Hit_ID=Q1T4S0; Match level="QueryCoverage=91%, HitCoverage=28%, E-value=1e-109, Identity=82%"; Hit description=PIK -related kinase, FATC
MGASIPNRYMFIHYVANLCIACLSSRKDVVNSMLSTMEEVQSFKFIPLVYQIASRMGNSKDGQGHLNFQFALVSLVKKMAIDHPYHTILQLLALANGDRIKDKQRSRSSFVVDMDKKLAAENLLNELSSYHGAIIRQMKQMVEIYIRLAEMETKREDTNKKVTLPRDLRNLPVLELHTLELPIQLLKITSAVDNLDLGPNSTLENQYVPVVTATISIDHSCQYHEGSFPYFKGLADSVMIMNGINAPKVVECLGSDGRRYRQLAKSGNDDLRQDAV

SEQ ID NO: 184402 - protein, 325 aa, Glycine max
  Coding DNA Sequence Number=SeqID_67624
  Gene Ontology: Mol. function=phosphotransferase activity, alcohol group as acceptor; Cellular component=chromosome, telomeric region; Biological process=regulation of Rab GTPase activity
  Homolog annotation: Hit_ID=Q1T4S0; Match level="QueryCoverage=96%, HitCoverage=36%, E-value=1e-149, Identity=84%"; Hit description=PIK -related kinase, FATC
  Pfam annotation: Domain name=FATC; Domain location=293-325; Score =42.7; E_value=1.3e-09; Accession=PF02260.10; Description=FATC domain
  Pfam annotation: Domain name=PI3_PI4_kinase; Domain location=4-207; Score=96.5; E_value=7.7e-26; Accession=PF00454.17; Description =Phosphatidylinositol 3- and 4-kinase
  Pfam module annotation: Pfam domain module=FATC::PI3_PI4_kinase; Domain location=293-325::4-207
MVEIFHFFMKQVVPFTPSAGVLEWVNGTLPLGEYLIGSMRNGGAHGRYGVGDWSFLKCREHMANERDKRKAFQEVCNNFRPVMHYFFLERFLQPAEWFEKRLAYTRSVAASSMVGYIVGLGDRHAMNILIDQATAEVVHIDLGVAFEQGLMLKTPERVPFRLTRDIIDGMGVTGVEGVFRRCCEETLSVMRTNKEALLTIVEYELNFHFYNLFIIDEYPLQVFIHDPLYKWALSPLKALQRQKCDLSSFSPQEMDDDLDTSLEEPQHDCQGNKDAARALLRVKQKLDGYEDGEMRSIHGQVQQLIQDAIDSERLCQMFPGWGAWL

SEQ ID NO: 184403 - protein, 110 aa, Glycine max
  Coding DNA Sequence Number=SeqID_67625
MEAKLQGKGPPRWLTSLSEETKPVWLENGVTKVAPSKTNAGRAVMCRFEALVDGFWHDKDHVRGARKTPVEEVVVEKGQIGFWQVEWWGHLPERSPEVWQWLAVVAQKVA

SEQ ID NO: 184404 - protein, 120 aa, Glycine max
  Coding DNA Sequence Number=SeqID_67626
MELRQSLLTHADSCQFELLLMGKNKGRQSHSAAKQIMVKGTTSDSGKSQTSVTFGLAGFLDVVHANQNAYTTSQDNLVGKVLVKRQGQVLQKLMMSHTKCLIICQNAVLNLNLPQRFLAP

SEQ ID NO: 184405 - protein, 348 aa, Glycine max
  Coding DNA Sequence Number=SeqID_67627
  Homolog annotation: Hit_ID=Q1T493; Match level="QueryCoverage=50%, HitCoverage=35%, E-value=2e-09, Identity=25%"; Hit description =Nucleic acid-binding, OB-fold, subgroup
  Pfam annotation: Domain name=DUF223; Domain location=39-123; Score= -13.9; E_value=0.056; Accession=PF02721.5; Description=Domain of unknown function DUF223
MSRKENLLYELHTKKGTWKIVVRITDMWRVNKHNGRQSIEMVLMDHTGTKIGATLSQEIFPEFELKLRCGGAYVIKNVKVVDTHSDYKTTSVKEVDRPEIHPNVHTITSFADIISGVAKPDTLVDIVGVITEVIERKTVNPAYRVTVKLRDNSHAEIIMTVWEEYALQLDDAIEKNHLKSNNSMIGTMNDLDFFARLLSSLVQDCYCLTVGTVDEVQLVVRARIMLLTLFQVVKMKQNGEKANFHFWDAVCIKIFGKTADECCQELIASGDEIKVFPACVDQLLGKTWVVRFKHRIQMHQSSVLDFSEQEHHIQSVISTLGLQDEQCISNKSLAVGAASSSQQDYHPT

SEQ ID NO: 184406 - protein, 908 aa, Glycine max
  Coding DNA Sequence Number=SeqID_67628
  Gene Ontology: Mol. function=helicase activity; Biological process =viral genome replication
  Homolog annotation: Hit_ID=Q1SN45; Match level="QueryCoverage=99%, HitCoverage=53%, E-value=0.0, Identity=45%"; Hit description=AAA ATPase
MFAFTSPGVKVDTSYNTGRGPPTLRIHGQSHHLIGSLLPMPDNSPKFAQLYIYDTENEVNNRLSQYPIKNNVDEDIIIGIKNMLDTHNPYAQKFRMARDKLDSSVVCDLKLKLISDRQTDERLYNLPNASEVAALIVGTNNRDIIIEKQTDMLQRINELHPAYLPLQYPLLYPHDEDGYRPNILHKDHPHSHAAKRNKVTMREYFCYMMQSRDNEAQTILYSRRLFHQWVVDGYCMIESQKLNYVRQHQQELRVDKYINLNDCNNQPLTQGNEKGKRIILPSSFVGSQRYMEKLYFDGMTICAHVGFPDLFSTLTCNPAWPEIQRQVAKSNLTAHDCPDVVSRVFKMKLNQLMHDLKSGHVFGPILAFVYTIEWQKRGLSHAHILIFLHPSNKYPNLEDIDNIISAEIPNKDTDPELYQIVSNHMMHGPCGLANKREPCMANGKCFRFFPKKFQPATIVDQDGFPVYRRRDTRQTVQKQSVYLDNQFVVPYSPHLLLKYRTHLNVEWCNQSTSIKYLFKYINKGSDRITAAIVNDQNQDGTHNQVHDEIKHYLDCRYVSAPEACWKIFAFPMHGRAPAVERLYFHLENQQPVYWKDSQEIGTVLAKSTIKESMFTAWMDSNKIYHHGRDLTYAEYVSKFVYDVRKRCWKPRKQGNTIGRLIWVPPSSGELFYMRMMLSFAKGSQCYEDIRTVENVVYHTFREACFAKGFIGSDQEFVGALREANTWGTPHYLRKLFVKLLFMNTMDRPEYVWKQTWQWMADDIVFNHRRQGIQLTNKEKMHLCLTEIQNLLQANRKSLRDFPSMPYPLGYAANPHQNNLIYNELAYNRDILVAEFDKCYQSLTDEQASIFNKIMHVVATQSGGVYFLYGYGGTGKTFVWKTLSSAIRSTGGIVLTVASSGIASILFPG

SEQ ID NO: 184407 - protein, 134 aa, Glycine max
  Coding DNA Sequence Number=SeqID_67629
  Homolog annotation: Hit_ID=Q9FM16; Match level="QueryCoverage=99%, HitCoverage=55%, E-value=2e-12, Identity=33%"; Hit description =Arabidopsis thaliana genomic DNA, chromosome 5, P1 clone:MQB2
  Pfam annotation: Domain name=DUF1645; Domain location=1-112; Score= -31.7; E_value=0.0032; Accession=PF07816.2; Description=Protein of unknown function (DUF1645)
MFEEGETASCSSSTDESVDLEGVAEGAYCVWTPNSVGSERKKSNSTGSTSKRWKLRVRDLLLRSHSDGKNNNKQEQQKQRDLFRIATKPQNGSVGTEQQHHVEQNKRKSFLPYKPELVGLFTNANGLGRNLRPF

SEQ ID NO: 184408 - protein, 117 aa, Glycine max
  Coding DNA Sequence Number=SeqID_67630
MKMMMMTITLHLTHTLEESFNEDDSDDGISDTDDEVTDIVEPVSIVHPTEGVPQIQNPFWNDAMHYNNINWSHLDEEDICGLDMPTTFNVGQELYVGMDFDSKDAVKNALKQYVMKA

SEQ ID NO: 184409 - protein, 98 aa, Glycine max
  Coding DNA Sequence Number=SeqID_67631
AQLKPTSISSGGRSGGVVQLGLPFGTSPLTSIDKLSQAIKAIPFLILIEKIWRFQPFPSLFAFQIRRGSESRTSLALSKTKRRMEDGLLNELSRFTLS

SEQ ID NO: 184410 - protein, 217 aa, Glycine max
  Coding DNA Sequence Number=SeqID_67632
  Gene Ontology: Mol. function=DNA-directed RNA polymerase activity; Cellular component=mitochondrion; Biological process=transcription
  Homolog annotation: Hit_ID=O47884; Match level="QueryCoverage=82%, HitCoverage=16%, E-value=2e-45, Identity=58%"; Hit description=RNA polymerase
MYDNNDVVHSPDECVDPETRKIKVPKSEFVKTYKNSVFSLLDCYRYENNDAQTLESLQREIEDLTLNFSEDSIYKTSPNIMVMLTKNNLPSAKEFLRGKYLMDKEYPGRMTIYAESRSGDSLETSGSELSDEENKNLRCVLSESDKSLLVELGEHSIECLLVHTLGHLFNLENIVSLASLVDRIERNVRDYASSSTLYYNSRVLKHLKLELIPLVQH

SEQ ID NO: 184411 - protein, 336 aa, Glycine max
  Coding DNA Sequence Number=SeqID_67633
  Gene Ontology: Mol. function=nucleic acid binding; Biological process= DNA integration
  Homolog annotation: Hit_ID=Q1S9I4; Match level="QueryCoverage=98%, HitCoverage=31%, E-value=2e-38, Identity=32%"; Hit description =Integrase, catalytic region; Zinc finger, CCHC-type
NGETISELETRFIHIVNHLLGLGKTFEDDELKIKILNCLTRTWESKITMIKESKDLASMWMEALFGKFLEYEHGLIRQFHVEDTKKKRKGIALKVSSTKEDHKESSSDDKDVENLSLMTMRQHPLILLVKKNLQDESLTIEETEHESEKLVSSYKAIGCVCVSTSLNMDDYKSLPNEFEKFKKDYYEELIKLQTEFSYLKDLFRKMNKEKNDLSHLLSVQKHTTSKTGLGLKSRDSLWYLDSGCSRHITGDKSRLADLVLKEGGYVTFGDNNKARIMGEGNIGNQKKTQIKNVLYVDGLKHNLLSISQLCDKGFKIEFNKNCCLICEAKTGEVVHI

SEQ ID NO: 184412 - protein, 178 aa, Glycine max
  Coding DNA Sequence Number=SeqID_67634
  Gene Ontology: Mol. function=chitin binding; Cellular component =extracellular region; Biological process=chitin metabolic process
  Homolog annotation: Hit_ID=Q86AI8; Match level="QueryCoverage=84%, HitCoverage=32%, E-value=9e-16, Identity=32%"; Hit description =Similar to Homo sapiens (Human). Mucin 2
MTDPLNESISCFLIRVDPWVLEPVTFRGLHILTFRGLHALAFRRLHALTFRGSCTFTFRGLHILSFRELHVLTFRGLHVLAFKGSCTFAFVGLHALTFRGLHVLAIRGLHVPTFRGLHAFAFRGLHVPLFKELHALTLRGRHALTFRGLHVLAIIGTTFPHLQKATRPELQRAACPHL

SEQ ID NO: 184413 - protein, 120 aa, Glycine max
  Coding DNA Sequence Number=SeqID_67635
MGPDGCRETRGIGTREMARKPRKNSEALLISHVAFLLPFSSTIVAHQSSKLCSPFLLQIAKGSHFRSRETHHYVVEKYEILRAREAKFGVSVYWSLKTCGKTWAEQMRKMSDKGESKSHF

SEQ ID NO: 184414 - protein, 173 aa, Glycine max
  Coding DNA Sequence Number=SeqID_67636
THLLLEGASPLSLPFSIPLPFIFQEAKDSIDEEDPRPTSSNGAYTTYDEGSPWACKWLMGKAHMTGIKGAPYQRRMDALTVTDVYWMPYAEHRGFGYIQTVPPPPVCDSLTGDDIDDRWLHFSDHMVPAGDFCVVSGQETAKPRHPPPPHDEEFVEPPIPEVSIASDLPTHSV

SEQ ID NO: 184415 - protein, 80 aa, Glycine max
  Coding DNA Sequence Number=SeqID_67637
MTPQFHETVMLRLKPICNVGDQSGSRCFARMLQSYGISIGLKEHSNPVTPKAYTPKSLSGPLPPDSGPTPKIILAYRHCL

SEQ ID NO: 184416 - protein, 182 aa, Glycine max
  Coding DNA Sequence Number=SeqID_67638
MTTTDAPSASTPSPRSLSRCTPVYSFQAVFHVDRNYIEVPRSYHKQWAPHYPAYVKIEYNGAPHIIKVRKNGQQYYLADGLKQFRRNFNIHEGVLLLPTEAVHFVDASTPFMTVQHSSGVRDIWTISMHNGEQHVDDPWNRLLTDNDLMGGDEVIFYYRPNEHVWEIIFRKEPIWDEDEDST

SEQ ID NO: 184417 - protein, 109 aa, Glycine max
  Coding DNA Sequence Number=SeqID_67639
MKVERSSRRRCLWKINVENSVRTLADPWYQYLADNDFMSGDEVVFGLDAATLCLFGIPEHEEIMWNSLKMAGVQQVIHEKPSKHTNSKVQLQNKAKRAIARPVYLRDCV

SEQ ID NO: 184418 - protein, 260 aa, Glycine max
  Coding DNA Sequence Number=SeqID_67640
  Homolog annotation: Hit_ID=Q1S818; Match level="QueryCoverage=30%, HitCoverage=78%, E-value=7e-16, Identity=50%"; Hit description=Zinc finger, GRF-type
  Pfam annotation: Domain name=zf-GRF; Domain location=16-62; Score =48.2; E_value=2.8e-11; Accession=PF06839.3; Description=GRF zinc finger
MERSSSSYTSKARSRVFCLCNIEAPLVTSWTEENPGRRFYGCGLYKDRGTKGCNFFQWHDPVDNNRQKKIIVGLMKEVDELKLREKDLQTMISEMKMKEKCLWIVLVDGHVLTAGIYMWHGTIWKGRGSPSIDCEISIVQTYSLENKNGLPQLWWCRSGSIGKVDFVVKLSNSDIKWCSKICQADKARVYLPLFVEKIRYIYDADDESEVVVVSVDWYPESEFMVVSVWVDWETSVFGWNAKELPIDVVSRVVVHAINVE

SEQ ID NO: 184419 - protein, 190 aa, Glycine max
  Coding DNA Sequence Number=SeqID_67641
  Gene Ontology: Mol. function=RNA-directed DNA polymerase activity; Cellular component=chromatin; Biological process=chromatin assembly or disassembly
  Subcellular localization annotation: CTP_CleavageSite=64; ConfidenceScore=5.07e-01
MARRKSSIGSLNNTCAHSFMIILINGSSFFPWQNGPMTHPCILAQDFLPSKSFMHSTLQRRLLKSQNAMKTQADAHHWDVQLDVGDWPSYFKLSKRYNGPYLVEACVVPIAYQLHLPPGSKIHPIFHVSLLKPHQRPITSDTSPLPPLGTVNHPIVRPLQFLDWKIDTASTPPTQQVLVQWDDLTPEDTS

SEQ ID NO: 184420 - protein, 150 aa, Glycine max
  Coding DNA Sequence Number=SeqID_67642
  Gene Ontology: Mol. function=RNA-directed DNA polymerase activity; Cellular component=chromatin; Biological process=chromatin assembly or disassembly
MVAGAVVLTTGHSMLSPLRTIFPCRQLMSYWINWVAVLGLTSFYRKFIRHYAAITAPLTMLLWKDQFSWSPSAQTAFDQLKLIMMQALVLAMSDFTIPFTIESDASSTAMGTVLLQNSHPIAFFSKPLCPRLQWASTYVRELHAITSSIR

SEQ ID NO: 184421 - protein, 107 aa, Glycine max
  Coding DNA Sequence Number=SeqID_67643
  Subcellular localization annotation: CTP_CleavageSite=42; ConfidenceScore=5.28e-01
MIAQALVSSSGQLFRRKAFNRGFRVWREGSGRDRRRRVGPIMAATLRPTEGIGVETPALRGGVRGRSEMKQLSKEGGARLAMRFARRLNSVRYSFTELCCWSLNKAH

SEQ ID NO: 184422 - protein, 87 aa, Glycine max
  Coding DNA Sequence Number=SeqID_67644
  Gene Ontology: Mol. function=transferase activity, transferring acyl groups, acyl groups converted into alkyl on transfer; Biological process=branched chain family amino acid biosynthetic process
  Homolog annotation: Hit_ID=Q39891; Match level="QueryCoverage=71%, HitCoverage=11%, E-value=2e-30, Identity=100%"; Hit description =Probable 2-isopropylmalate synthase
MVEEYSGMHLQPHKPLVGANAFVHASGIHQDGMLKHKGTYETISPEEIGHKRTTRIGIVLGKLRYVKYFLLKYAYVRKSMTINIRGR

SEQ ID NO: 184423 - protein, 88 aa, Glycine max
  Coding DNA Sequence Number=SeqID_67645
  Subcellular localization annotation: CTP_CleavageSite=45; ConfidenceScore=5.79e-01
MAGCGKTLGSSTAKKATSRSSKAGLQFPVDLSPNSSRPENMSSVLASMLPLTSPLSSNISQPRDNKKTRIMPHHIRLAMRDDEELNNA

SEQ ID NO: 184424 - protein, 61 aa, Glycine max
  Coding DNA Sequence Number=SeqID_67646
MEKVSFVLGALLKHENEQKKKISHACKEKDLSLSKLSVEVAKERIQEGCGKELSAPSPIGD

SEQ ID NO: 184425 - protein, 100 aa, Glycine max
  Coding DNA Sequence Number=SeqID_67647
MPPTKAFPVAQEPDDPLPTQISFHAILGHMAPKTLRVMGSISDQKVLILVDGGSTHNFIQERLVTMLGPHAQSTPPLHIMIGNGIEIECLQICKHISLQL

SEQ ID NO: 184426 - protein, 196 aa, Glycine max
  Coding DNA Sequence Number=SeqID_67648
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=84%, HitCoverage=29%, E-value=3e-90, Identity=99%"; Hit description =Probable 2-isopropylmalate synthase
  Pfam annotation: Domain name=HMGL-like; Domain location=41-195; Score= -22.7; E_value=2.7e-06; Accession=PF00682.9; Description=HMGL-like
MATKTSTPSSQSPKLSHLRPQYIPNHIPDSSYVRILDTTLRDGEQSPGATMTAKEKLDIARQLVKLGVDIIQPDFPSASNSDFMAVKMIAQEVGNAVDDDGYVPVIAGFCRCVEKDISTAWEAVKYAKRPRLCTSIATSPIHMEHKLRKSKDQVIQIARDMVKFARSLGCNDIQFGAEDATRYEPFICLTLFGSRF

SEQ ID NO: 184427 - protein, 382 aa, Glycine max
  Coding DNA Sequence Number=SeqID_67649
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=99%, E-value=8e-82, Identity=44%"; Hit description =Integrase, catalytic region
  Pfam annotation: Domain name=rve; Domain location=58-210; Score=59.5; E_value=1.1e-14; Accession=PF00665.16; Description=Integrase core domain
MGVTKALARLQDNFTWNSIRQDVHDFVAQCLNCRHTKYVTRKPAGLYLHYLFLLSHRRTYHSIFIVELPIYKGNTTILVVVYRFSKGIHLGLLPSQYIAYQVATLFLDIVSKLRGMPQSLVSDRDPLFISKFWQELFKLSGTKLHLSLTYHPQSNGQTKVMNRIIEQFMRAFVHHRPSPWEAVDTLLTTWEAVFDSLRHKLLKAQAQMKHFANNNRPKVHYEKGDWAMVKLRPQRQSSLTGPNKTKLTKRFYGPFKDSRIHLVFHCSLLKPFRHDARNEPSPLPLPGKDFDNRPLITPLTILNTRWVDTNNGPRLHVLVQRASLPVDDTSWEYWASLKEKYHLEDKVIFEGIRSDRPVNMHEAQHGRPQRKVTPHQRFCDYV

SEQ ID NO: 184428 - protein, 51 aa, Glycine max
  Coding DNA Sequence Number=SeqID_67650
MCARSNGRGKPVRRKESLIGGIPPVGGAKPEETLVEARSDTDVQIVRLTWV

SEQ ID NO: 184429 - protein, 248 aa, Glycine max
  Coding DNA Sequence Number=SeqID_67651
  Gene Ontology: Mol. function=solute:hydrogen antiporter activity; Cellular component=integral to membrane; Biological process =potassium ion transport
  Homolog annotation: Hit_ID=Q5H355; Match level="QueryCoverage=96%, HitCoverage=34%, E-value=5e-86, Identity=70%"; Hit description =Cation:proton antiporter
MPVMAGVFGPRSSQGVALAGQRAGRHRLDLRAAGPVRGGDAGGRPPGHSVDPGAYRRHRLARAVHPVGAGDRAGRRVRLGHVVRRLVRAGRVLRRHAAQRIGAEPQGRDRFAAAARCVRGAVLRLGRHAVRPQHPRPAPVAGAGHGADHHVRQVGRRILHRARVRSPDQHRADHLGQPGADRRVRLHHRRPGRGTADPAEGRPVAGAGRCVGIDHAQPAGIRAAGPLAGQAGAVTPGRRARRGHRSLT

SEQ ID NO: 184430 - protein, 235 aa, Glycine max
  Coding DNA Sequence Number=SeqID_67652
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-35, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTSSPLEDCRSSPSEDYKSSTSEEYTPSPSEDYTSSPLEDYKSSASEGCTSSSLEGYMPSPSEGYMLSPSEDYTSSPSEGNTPSPTEDYVSSPLEGYMPSPLEDYTSSPSKGSTPSPSVDYSLHALAFRGLLVLAFRGLHALAFRGLHVLAFSGLHALALRGLHVLPFRWLHTVAFRGLHVLAIRGLHALALRGLLVLAFRGLHALALRGLHVLAFRGLHALAFRGLH

SEQ ID NO: 184431 - protein, 163 aa, Glycine max
  Coding DNA Sequence Number=SeqID_67653
  Gene Ontology: Mol. function=helicase activity; Biological process =viral genome replication
  Homolog annotation: Hit_ID=Q9FHV5; Match level="QueryCoverage=89%, HitCoverage=10%, E-value=2e-38, Identity=55%"; Hit description =Helicase
MDRPEYVWQQTWQWMADDITFDHRKQDEQKTIVDTIIRIVNTQSAVVYFLYGYGGTGKTFVWTTLSSAIRSNGRIVCTVASSGIASLLLPGGRTAHSKFAIPVPATQNSTCNIHQGSELAELLKVTKLIVWDEAPMCHRFAFEALDKSLKDIMPNNLPFGGKI

SEQ ID NO: 184432 - protein, 45 aa, Glycine max
  Coding DNA Sequence Number=SeqID_67654
MHHQKRKILDEASLSLSESETHHDHKSTSTPYGSNRPGYMAQYLK

SEQ ID NO: 184433 - protein, 154 aa, Glycine max
  Coding DNA Sequence Number=SeqID_67655
  Homolog annotation: Hit_ID=Q1S0F5; Match level="QueryCoverage=94%, HitCoverage=33%, E-value=2e-14, Identity=33%"; Hit description=IMP dehydrogenase/GMP reductase
MEIIRTKGKDSHKLGALSADSTEVSWERNQTMTKSFGLPYRLPRYLSSTIPPSSLPIPFDTKEEFHEQLTKERQEKETWKRRCQELEQENETLKGKIAQQSRELFIQNQRMIEKDDLLRRKDALLHRDARRKRRFMDLFSRAHSDSEDPSTPGV

SEQ ID NO: 184434 - protein, 127 aa, Glycine max
  Coding DNA Sequence Number=SeqID_67656
  Subcellular localization annotation: CTP_CleavageSite=20; ConfidenceScore=5.42e-01
MDRLTTMMSALLSAQNSQAAAAAVEQPLVSTTPLSTVTSPPLFLPPGCTWGMPPPVCGSPQPAVSEVPPPFAQQSAPVPQPSTSFPQAAMTYSAPLIHTIQQEVEPIFQAENVVAFDKMEELQERFD

SEQ ID NO: 184435 - protein, 89 aa, Glycine max
  Coding DNA Sequence Number=SeqID_67657
MASGIDYQGWRDGSLVIDYQIAMVAQLIRERVEMECLEGAWETLEGNTRCRFRGTIRFTATSLVHPDEPARTLQRTVEWTALWIRFVYF

SEQ ID NO: 184436 - protein, 101 aa, Glycine max
  Coding DNA Sequence Number=SeqID_67658
NFMDCAIMLPFGSRHVAELHGLPNDGCQVPRSGQAKARMTIRYLRLPPDSLSLDDKRCRRQCQFLRVNGLVCPWLTKGARNHKGAEDDVSLCVLSSVESYR

SEQ ID NO: 184437 - protein, 195 aa, Glycine max
  Coding DNA Sequence Number=SeqID_67659
  Gene Ontology: Mol. function=transporter activity; Cellular component= integral to membrane; Biological process=pathogenesis
  Homolog annotation: Hit_ID=Q66AV4; Match level="QueryCoverage=100%, HitCoverage=47%, E-value=8e-83, Identity=69%"; Hit description =Virulence factor mviN, possible MOP Superfamliy efflux pump precursor
  Pfam annotation: Domain name=MVIN; Domain location=28-195; Score= -133.9; E_value=2.2e-05; Accession=PF03023.5; Description=MviN-like protein
  Subcellular localization annotation: CTP_CleavageSite=28; ConfidenceScore=5.23e-01
MNLLKSLAAVSSMTLFSRVLGFARDAIVARVFGAGMATDAFFVAFKLPNLLRRIFAEGAFSQAFVPILAEYKSKQGEDATRVSLLRVTFPYILLISLASLAGAILNTWNRFSVPAFAPTLLNISMIGFALFAAPHFHPPVMALAWAVVVGGLLQLFYQLPHLKKIGMLVLPRVNLRDAGVWRVMRQKGPAILGVS

SEQ ID NO: 184438 - protein, 74 aa, Glycine max
  Coding DNA Sequence Number=SeqID_67660
MQLFLVLSVCWCFTCVISLLCFSCIFILVCAALCSAYEVVPEGTFCPLVGLFARHLAFQFTFPPTDTCTFVFCI

SEQ ID NO: 184439 - protein, 68 aa, Glycine max
  Coding DNA Sequence Number=SeqID_67661
MTPSFASIDFASLKAWHCRSLDFFHLKCGLYAPVVEAGGFSWRLLRRDVLLRPSPPPPLRCERTKGPM

SEQ ID NO: 184440 - protein, 702 aa, Glycine max
  Coding DNA Sequence Number=SeqID_67662
  Gene Ontology: Mol. function=nucleic acid binding; Cellular component= intracellular; Biological process=DNA integration
  Homolog annotation: Hit_ID=Q1RXN8; Match level="QueryCoverage=94%, HitCoverage=61%, E-value=1e-142, Identity=37%"; Hit description =Peptidase S8 and S53, subtilisin, kexin, sedolisin; Integrase, catalytic region; Zinc finger, CCHC-type
  Pfam annotation: Domain name=rve; Domain location=350-486; Score =47.3; E_value=5.1e-11; Accession=PF00665.16; Description=Integrase core domain
  Pfam module annotation: Pfam domain module=RVT_2::rve; Domain location=637-699::350-486
MQAVLIHQGLGDALKDKALREVAREPAAATIWLKLESLYITKSVANLLFLKQQLYSFKMTEERMLSNQIADFNNILDDLENLEVKMEDEDKALILLNGLASRYDHFKDAMLFGRDQTITLEEVQSSIQTKEMQRKHESKKLHFCDLMLNPTQFQAKEEKAKAVDDSLSETNLLSKMHPLSEASSSLSGWETLEKDKIEICSPSVLPARPSRTLQKLKGLGAFKNTKVGRNEETQRKRRYKKGCPERRGKDLKKSQEPENVDIDQVSYETVDVLVVSNSEIEKDWVMDSGGVMMLGNNKPCIVQAYTTQIEHGMMKIFKDSVMIAKGIKMNGLYILDGSTIIAQVVVASQNQHDNTNLWHMRLGRVSEKGKAKRANFGIGLHATGRPFEYVHFDLWDPARTMTHGEQFNEFCKKLGIQRHKIMANTPQQNSLTERMNRTILKRVRCMLLSADLPKTFWGEAITIVSYLINRCPSSALGFKTPMELWGGKPSYYSNLRVFGALAFAHIKQDKLGARTDRCAFIGYPPGIKGTSYGRWNRVNQTVSSAEINLDITEVEVELPTQSVQVKETDNDQQPEPVVNNYNLARDRVRRNIVPPRRYGQVDLIYFALTVAEEIQAIEPINFREALNHKKSEEWITTMEEEMLSLEKNKTWILVDLPRNQRVARFKARLVARGFSACVVSLPDSFSSNQELEHRERVVGFKS

SEQ ID NO: 184441 - protein, 92 aa, Glycine max
  Coding DNA Sequence Number=SeqID_67663
  Subcellular localization annotation: CTP_CleavageSite=30; ConfidenceScore=5.75e-01
APPSSRKHSPPACCFFPSSARPAPPSSSPRDQRSSPRTSCCLPSRLLPELPEEGVPEDFRKKGSSENTERSSGNFPEEVVHPKTFRKKGSSG

SEQ ID NO: 184442 - protein, 138 aa, Glycine max
  Coding DNA Sequence Number=SeqID_67664
MLMYNDQFSCVGPIELLCTVGKTPDVIINLLQRTMPRTRDAILYYNGKWNMPPQNKFVGCAFTGKNPKKFQIPSTCRFEYSDALIKYEINELRTNEELLKVLVQSNYWKKYGPIEILAVFTKYVVKIEDEVTATSLNN

SEQ ID NO: 184443 - protein, 271 aa, Glycine max
  Coding DNA Sequence Number=SeqID_67665
  Homolog annotation: Hit_ID=Q1SP02; Match level="QueryCoverage=87%, HitCoverage=52%, E-value=2e-24, Identity=31%"; Hit description=IMP dehydrogenase/GMP reductase
MVHMYDQLDEASRTTTRQIAGYLTLLQCWIYEHFPSVHQCATDDTYQEASPRASWWLTSKAHMKGITGAPYRARCDALTVMDVSWLPYTEHRGVRAFELISSFQGQLRWGPMVVTARPERVVRQFGYIQSIPPPPVSARLSYDDIDDRWMHFAEHVLPMGELCLVPGQVSADYIEWFFRISHPFMIPTQAGDQPRDAPAADPEEYIQLPSPQDDYDGYEAVAQRLERVLNLRMVTAGTELYDIMQDCLTIARGGACADESVRARQRRRTEH

SEQ ID NO: 184444 - protein, 212 aa, Glycine max
  Coding DNA Sequence Number=SeqID_67666
SRRQRVGKYRRPHFVQVQNKHAFPPYGLPPNYTPPNVAHTPDENVNNSTPILIESQQPQSDHAHVSQPMGETHEIPHHNLVNFEPCLGYATKEQAVGGVPLPNTLEGPQFRPQPQPQPLYFAIGRIPPTMAKRGKLDHIEERLREIEGGGDHALADMAKLYLVPEVVIPPKFKVPDFDKYKGTTFPKNHLKMYCQKMRVYVKDEKLLMHFFQ

SEQ ID NO: 184445 - protein, 220 aa, Glycine max
  Coding DNA Sequence Number=SeqID_67667
  Gene Ontology: Mol. function=quinoprotein glucose dehydrogenase activity; Cellular component=outer membrane-bounded periplasmic space; Biological process=electron transport
  Homolog annotation: Hit_ID=Q1R174; Match level="QueryCoverage=99%, HitCoverage=32%, E-value=1e-105, Identity=77%"; Hit description =Pyrrolo-quinoline quinone precursor
  Pfam annotation: Domain name=PQQ; Domain location=1-35; Score=4.2; E _value=4.2; Accession=PF01011.11; Description=PQQ enzyme repeat
  Pfam annotation: Domain name=PQQ; Domain location=135-169; Score =17.9; E_value=0.038; Accession=PF01011.11; Description=PQQ enzyme repeat
  Pfam annotation: Domain name=PQQ; Domain location=186-220; Score=1.6; E_value=9.6; Accession=PF01011.11; Description=PQQ enzyme repeat
  Pfam annotation: Domain name=PQQ; Domain location=63-100; Score=12.2; E_value=0.33; Accession=PF01011.11; Description=PQQ enzyme repeat
  Pfam module annotation: Pfam domain module=PQQ::PQQ::PQQ::PQQ; Domain location=1-35::135-169::186-220::63-100
MGTVDGKLYALDADSGKPCENFADKGVLNVNQWNTVNAKFPLSLLQPPTVVGDHLIVGWAGKDWAYAEAPPGTVFSINAQTGAREWTFDAIPASIRQRTGTANVWTHMSADEAHGLVYLPVSSPSPNYWGGNRVDPIPLGTSTTALDVNTGKVVWSRQWVHHDVWDYDINSAPTLMDITVNGKQIPALIQATKQGFLFVVNRLTGEDVWPIEERPVPQGD

SEQ ID NO: 184446 - protein, 53 aa, Glycine max
  Coding DNA Sequence Number=SeqID_67668
MVKVLVACDGATKVLGLHASRVVEHCGVDMGDVMNRQIWVVALVVLEVREEDD

SEQ ID NO: 184447 - protein, 39 aa, Glycine max
  Coding DNA Sequence Number=SeqID_67669
MALPYWWDRKLRQIYGTGDFPPDGSTGSQVSNKRETERW

SEQ ID NO: 184448 - protein, 119 aa, Glycine max
  Coding DNA Sequence Number=SeqID_67670
  Gene Ontology: Mol. function=nucleic acid binding
MDVLGGVEQQASLQVDGTWLYKKYKGTLLVAVSHDGNNKIFPIVFVVVEDKHGSIKNAYSRWVSGWMPENCVHALDLLHQWSPLLLEDQWKRNGEGEKVGEDESRERERKSTKFCASNE

SEQ ID NO: 184449 - protein, 127 aa, Glycine max
  Coding DNA Sequence Number=SeqID_67671
  Gene Ontology: Mol. function=transferase activity; Cellular component= chromatin; Biological process=DNA integration
  Homolog annotation: Hit_ID=Q1SPQ1; Match level="QueryCoverage=65%, HitCoverage=16%, E-value=1e-23, Identity=60%"; Hit description =Polynucleotidyl transferase, Ribonuclease H fold
MESQSKVMVFGIPWRCQIFIEKQEAKSGEANLEGRPIRCTDLLSLSQTNHTIVCPKEGGRVTKSSVSSSHTLFGIEKGCSNPDFFCGSKEGTGEEVTEKSNASSENCLERASTTIVVFSSGPYPQGR

SEQ ID NO: 184450 - protein, 209 aa, Glycine max
  Coding DNA Sequence Number=SeqID_67672
MASSSISKVGTSNSSLRLELVELLCGFWVGCLILKFGDIIACNGGDSDFHRLCDDELRHHEGCMEEMMENVASMNNMNLVSSALWTTLVVSLKHKRRVLSYKGCANTKCVRKRSMISVKTSGIDGFVVDDGGNGMKKGKCLVMVAFVVVADIGSGVARCDDMAVVEAMMVGAVTIAVVENGILGGGCPLCATTMMVFAPLCGHRDKENV

SEQ ID NO: 184451 - protein, 336 aa, Glycine max
  Coding DNA Sequence Number=SeqID_67673
  Gene Ontology: Cellular component=integral to membrane; Biological process=protein transport
  Homolog annotation: Hit_ID=Q944A9; Match level="QueryCoverage=68%, HitCoverage=82%, E-value=8e-86, Identity=69%"; Hit description=Novel plant SNARE 11
  Pfam annotation: Domain name=V-SNARE; Domain location=55-227; Score= -23.9; E_value=0.082; Accession=PF05008.5; Description=Vesicle transport v-SNARE protein
MDQLSAISEDLAEIDGHIADNFRALSNGFQKLEKIKDSNRQSRQLEDLTEKLRECKRLIKEFDKEVKTLESSFDRETNKMLNEKKQSMIKELNSYVALKKQYATNIENKRIELFEGPNEGYAEENGLLASSMTNEQLMDHGNRMMNETDQAIERGKKYILNLDQVAISEEVIHVVQDTINVGTDTAAALKAQTEQMSRVVNELDSIHFSIKKASKLVKEIGRQVATDKCIMALLFLIVIGVIAIIIVKVLMAFYRSTVSSLCIFSVTYQVCLERIVFATTVPKDKTCPSALYLKGVSYFILRNAGGVLVHPENKDIRDIPGLAPPVQNRRLLWSHS

SEQ ID NO: 184452 - protein, 220 aa, Glycine max
  Coding DNA Sequence Number=SeqID_67674
  Gene Ontology: Biological process=cell adhesion
  Homolog annotation: Hit_ID=Q2QVD8; Match level="QueryCoverage=59%, HitCoverage=53%, E-value=3e-27, Identity=43%"; Hit description =Expressed protein
  Pfam annotation: Domain name=Fasciclin; Domain location=42-158; Score= 10.7; E_value=0.00046; Accession=PF02469.12; Description=Fasciclin domain
MANNMVTMVFLILMLISSITPTEIDARNQDLVAATKEMQKANYFTFVMLINMSPLDTIEGNVTFLMPNDRMLANMVLQEGSISSFLLRHSIPSPMLFDVLEQFPTGTTIPTSLPNCMLRVSNNGRKNYVLNNVKIISPNLCVAGSSIRCHGIDGVLSEVCASIASPPSTRDNLNPPTLAAPQPTTLNIGPHKSGSPHWFSYDGSLNFVACLMLYLTGIYF

SEQ ID NO: 184453 - protein, 273 aa, Glycine max
  Coding DNA Sequence Number=SeqID_67675
  Gene Ontology: Mol. function=protein kinase CK2 regulator activity; Cellular component=protein kinase CK2 complex; Biological process =Wnt receptor signaling pathway
  Homolog annotation: Hit_ID=Q8LPD2; Match level="QueryCoverage=85%, HitCoverage=98%, E-value=7e-94, Identity=65%"; Hit description =Protein kinase Ck2 regulatory subunit 2
  Pfam annotation: Domain name=CK_II_beta; Domain location=109-261; Score=353.4; E_value=3.7e-103; Accession=PF01214.9; Description =Casein kinase II regulatory subunit
MWEQLSVGESKTLALTLTTIFSILELCFRDNRAGMYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSNIDGAYFGTTFPHLFLMTYGQLKPQKPAQGYVPRVFGFKVHKP

SEQ ID NO: 184454 - protein, 62 aa, Glycine max
  Coding DNA Sequence Number=SeqID_67676
MTPLLMMKSYLPRALDRRLQEDLVKYSGEGPRVLMSLKGSIVYGGYTSNIGFFCPCILGYLD

SEQ ID NO: 184455 - protein, 155 aa, Glycine max
  Coding DNA Sequence Number=SeqID_67677
MFILDTYFSHSKQDAHSAAEKAYNMAKVDDGVNKVVAAANKAANTARDAAVKAVQNRMHHNNNMRKQRKQNECKEGESQRCAKKCYEVPAWNHFLSLNSMADCGAKLKIWEAQFRYHLYDQTYTSNNDNGGDIATISTGTHAKGVKQAGSYQSPG

SEQ ID NO: 184456 - protein, 320 aa, Glycine max
  Coding DNA Sequence Number=SeqID_67678
  Gene Ontology: Mol. function=metal ion binding
  Homolog annotation: Hit_ID=Q6H6V3; Match level="QueryCoverage=83%, HitCoverage=54%, E-value=1e-59, Identity=50%"; Hit description=Zinc finger (C3HC4-type RING finger) protein-like
  Pfam annotation: Domain name=zf-C3HC4; Domain location=232-279; Score= 59.8; E_value=9.2e-15; Accession=PF00097.15; Description=Zinc finger, C3HC4 type (RING finger)
  Subcellular localization annotation: CTP_CleavageSite=82; ConfidenceScore=5.36e-01
TCAGNGIGDSTSLIPESSRRPSLSSLQIPARSVENALSSFNKTDGPTLISSAGSSRGLPPRPNSASAIKSTMRTLLSERSFRAKNSSQDSERTVLIVPDASPSDGPVDNKPSTSRSLSLNKFLFASSTKAGHSLPVTPTANSGVENVHGRHLGCDSDLSKVKVNQHMTRSVSVPVNIKTANLRHTDSRRLVRVISVRSLPGTSGGISADNALGSEIVNEDASEDIPEEDAVCRICLVELVEGGNTLRMECSCKGELALAHQDCAVKWFSIKGNKTCDVCKQEVQNLPVTLLKISNPQTVTRQPLNAPEPQQREVTSYRQA

SEQ ID NO: 184457 - protein, 353 aa, Glycine max
  Coding DNA Sequence Number=SeqID_67679
  Gene Ontology: Mol. function=kinase activity; Biological process =proteolysis
  Homolog annotation: Hit_ID=Q9AY37; Match level="QueryCoverage=51%, HitCoverage=54%, E-value=2e-66, Identity=49%"; Hit description =Putative phosphatidylinositol-4-phosphate 5-kinase
  Pfam annotation: Domain name=MORN; Domain location=182-204; Score =24.2; E_value=0.00046; Accession=PF02493.10; Description=MORN repeat
  Pfam annotation: Domain name=MORN; Domain location=205-227; Score =32.5; E_value=1.4e-06; Accession=PF02493.10; Description=MORN repeat
  Pfam annotation: Domain name=MORN; Domain location=228-250; Score =24.2; E_value=0.00045; Accession=PF02493.10; Description=MORN repeat
  Pfam annotation: Domain name=MORN; Domain location=251-273; Score =30.1; E_value=7.8e-06; Accession=PF02493.10; Description=MORN repeat
  Pfam annotation: Domain name=MORN; Domain location=274-296; Score =18.8; E_value=0.018; Accession=PF02493.10; Description=MORN repeat
  Pfam module annotation: Pfam domain module=MORN::MORN::MORN::MORN::MOR N; Domain location=182-204::205-227::228-250::251-273::274-296
MHHHHKPELHIGKENPHLSSDDAATSTPQTHFSIQVSPSSPHPPPPNSPNTPFHHERFSNKRIIPIMTFPLFQTPFGAKFPTSKLLPRFRFLLFLPLPSLYLLFSNPSPLDFFSVIAFSAALFVSLNLALSFFTRLFPTKFSSSSSSSSPQPVVWSIGSNPKQVKNTNWGCWVQVYSNGDVYEGEFQKGKCWGSGVYHYHMHGRYEGGWVDGKYDGYGVETWARGSRYRGQYREGLRHGMGIYKFYCGDVYGGEWSNGQCHGFGVHTCIDGSRYVGEFKWGVKHGLGQYHFSCALVTCWSWVRIRKQPLCICKGKAAYNIPPSYLRIAKSLWAMSSYCKGRLNYHIWKFVNER

SEQ ID NO: 184458 - protein, 59 aa, Glycine max
  Coding DNA Sequence Number=SeqID_67680
MVDSRHGNRTGTGIASPIPNPDFSTYSCIHFRYSDGYMDEYGYGYETDNNIPNSNLDHD

SEQ ID NO: 184459 - protein, 59 aa, Glycine max
  Coding DNA Sequence Number=SeqID_67681
MTANLWPETYNIDTSAETRTLPKNSNRTTKEMLRGNLTSSKVRNSNKHASKQTKEKWIK

SEQ ID NO: 184460 - protein, 265 aa, Glycine max
  Coding DNA Sequence Number=SeqID_67682
  Homolog annotation: Hit_ID=Q9LTB9; Match level="QueryCoverage=64%, HitCoverage=54%, E-value=5e-53, Identity=64%"; Hit description =Arabidopsis thaliana genomic DNA, chromosome 5, TAC clone:K14A3
MGRYEWAKRRKRPYIKDGAEERDGDDDDEGGSERETIICLENLYFLRALESTVTLPSQRKAIFSDLLSRDVALFLERYGSKLACSELNEFDSMKDGYEVNWHVKRLRSIISPTSEELRMRPVTVKNRRRACLDKLLCQGHYFSEDAMREREPYLHHEYVGRFQDQSCRRMARPGERWSETLMRRCDETELVVKIRGGAAEDGRAVEGLGWRRRKTKKRKLKRRWKWMKTGEEIVAMDNPVELQCCVIHVIDLTWWDNNTIALVLV

SEQ ID NO: 184461 - protein, 603 aa, Glycine max
  Coding DNA Sequence Number=SeqID_67683
  Homolog annotation: Hit_ID=Q2A994; Match level="QueryCoverage=92%, HitCoverage=94%, E-value=1e-136, Identity=49%"; Hit description =Pentatricopeptide (PPR) repeat-containing protein
  Pfam annotation: Domain name=PPR; Domain location=138-172; Score =12.6; E_value=0.24; Accession=PF01535.11; Description=PPR repeat
  Pfam annotation: Domain name=PPR; Domain location=211-244; Score=1.1; E_value=5.6; Accession=PF01535.11; Description=PPR repeat
  Pfam annotation: Domain name=PPR; Domain location=341-375; Score=3.1; E_value=3.2; Accession=PF01535.11; Description=PPR repeat
  Pfam annotation: Domain name=PPR; Domain location=376-410; Score=8.3; E_value=0.78; Accession=PF01535.11; Description=PPR repeat
  Pfam annotation: Domain name=PPR; Domain location=453-487; Score =19.9; E_value=0.0094; Accession=PF01535.11; Description=PPR repeat
  Pfam annotation: Domain name=PPR; Domain location=488-522; Score=0.2; E_value=7.1; Accession=PF01535.11; Description=PPR repeat
  Pfam annotation: Domain name=PPR; Domain location=527-561; Score =10.8; E_value=0.39; Accession=PF01535.11; Description=PPR repeat
  Pfam annotation: Domain name=PPR; Domain location=54-88; Score=2.5; E_ value=3.8; Accession=PF01535.11; Description=PPR repeat
  Pfam module annotation: Pfam domain module=PPR::PPR::PPR::PPR::PPR::PP R::PPR::PPR; Domain location=138-172::211-244::341-375::376-410::453 -487::488-522::527-561::54-88
LSWERSTEEILLGKLKFALRNHQVQEAWESFHDFRSLYGYPEIVREKSGLLHADTLTKLALSLARLQMTCPASVVLRLMLDKGCVPSMHLLSLVVFHIAKTEIGTYLASNYLFQVCDFYNCLNDKKGNHAVKVELDTLVFNLVLDACVRFKLSLKGLSLIELMSMTGTVADAHSIVIISQILEMNGLRDELKELKDHIGRVSSVYVWHYRQFYDSLLSLHFKFNDIDAAAKLVLDMTSSHNYDVKKECEKHLQKPCFIAIGSPFLRTVLKIHIEPELLHKDSVLKVESRQDLIFYKGGKLVLSNSALAKFISGYKKYGRIGELSKLLLSIQGELNSVAGSSLCSDVIGACIQLGWLECAHDILDDVEATGSPMGRDTYMLLVSAYQKGGMQRETKALLKQMKKVGLDKGLSDDAIDEHNLCEETLNSLGKADLAIALVQILKDEDQTVFPLVYNLNSSIFFFCKAGMIEDALRAYRRMVDMKIQPTSQTFAFLMCGYSSLGMYREITILWGDIKRFMRSGNLVGNRDLYELLLLNFLRGGYFERVLEVISHMRDHNMYPDKWMYKNEFLRLHKNLYRSLKASNTRTEAQSKRLEHVQEFRKWV

SEQ ID NO: 184462 - protein, 111 aa, Glycine max
  Coding DNA Sequence Number=SeqID_67684
MKTDLGEAEAEMPKTHEVGFDMSLHQKRGSLFKLKSHVLSPHSAKRIQKLFSLILTLLFLPFSSTIEASIKAPNFAHHFCSKSQKEAIFGVVKRTSTLWDFKFQKTDKDEG

SEQ ID NO: 184463 - protein, 145 aa, Glycine max
  Coding DNA Sequence Number=SeqID_67685
MVILYKFPKGLHCKALVDLPFSKTPDVMGKFDYRFIKKAQAEKVPPPPPSVITRISIQESHGPLSGGPSKRQRVELIPVATPSVIESLNAFLEVVPCTPMDYIACFTKFWGDEFERANVECQRAQSDCAKVEKALVKATRSNEMC

SEQ ID NO: 184464 - protein, 98 aa, Glycine max
  Coding DNA Sequence Number=SeqID_67686
  Subcellular localization annotation: CTP_CleavageSite=65; ConfidenceScore=5.47e-01
MWVFGRVIGGDGTLSGEGGAFPPFCLKLSSATKSLLLPPSISSSSSVTQSFFTFEFFFFRDQSSKCPAVFSPRPGLLLRARRPPLPAFEALKHSCYAL

SEQ ID NO: 184465 - protein, 145 aa, Glycine max
  Coding DNA Sequence Number=SeqID_67687
  Gene Ontology: Mol. function=calcium ion binding; Cellular component =membrane; Biological process=abscisic acid mediated signaling
  Homolog annotation: Hit_ID=Q5EE13; Match level="QueryCoverage=94%, HitCoverage=64%, E-value=4e-57, Identity=79%"; Hit description =Calcineurin B-like protein
  Pfam annotation: Domain name=efhand; Domain location=34-62; Score =16.0; E_value=0.13; Accession=PF00036.22; Description=EF hand
  Pfam annotation: Domain name=efhand; Domain location=78-106; Score =22.6; E_value=0.0014; Accession=PF00036.22; Description=EF hand
  Pfam module annotation: Pfam domain module=efhand::efhand; Domain location=34-62::78-106
IFDLFDVKKLGVVDFEDFVRSLNVFHPNASLKDKIAFSFRLYDLHNTGFIERPEVKEMLIALLFESDMKLADDVIETILDKTFVEADLKQDGKIDTEEWETFVKRNPSVLKIMTLPYLRDITISFPSFIFNSTNVERVDETSTRL

SEQ ID NO: 184466 - protein, 95 aa, Glycine max
  Coding DNA Sequence Number=SeqID_67688
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q7XJN4; Match level="QueryCoverage=50%, HitCoverage=11%, E-value=1e-14, Identity=81%"; Hit description =Glycerol-3-phosphate dehydrogenase
MENVIDRTRREAENSKKFAIKRYEGKFAEGKFNLFVETVNIKSVGADVKFSASFLGSIAEYVDPGLPFISLSKGLQLNTLRMMTQIIPQALRNPR

SEQ ID NO: 184467 - protein, 41 aa, Glycine max
  Coding DNA Sequence Number=SeqID_67689
  Homolog annotation: Hit_ID=Q1T2F4; Match level="QueryCoverage=76%, HitCoverage=8%, E-value=1e-07, Identity=81%"; Hit description =Actin/actin-like
MSSDNQRQLLENTVVCGDTSSMVGFEERFQKESSLSSSASR

SEQ ID NO: 184468 - protein, 126 aa, Glycine max
  Coding DNA Sequence Number=SeqID_67690
  Homolog annotation: Hit_ID=Q9C516; Match level="QueryCoverage=36%, HitCoverage=5%, E-value=3e-14, Identity=82%"; Hit description=G -protein alpha subunit, putative
MPKNQILIAFSKCGYLVGRWVKEGMEVIGQSGGERLGISSNREKGEASRKDGRGTVGLQVKGKKPDRIISSNLNFIGKLSLDASNGNTEVYMNGREITILELRVLKDESNSRSSNSSFLKIHLKTV

SEQ ID NO: 184469 - protein, 68 aa, Glycine max
  Coding DNA Sequence Number=SeqID_67691
MVRIVACLPWWHCRMKLPENAQQLPLADMEKSSEQEEAKGSYKQDKKKQLSVRGEEEEATQREKPATS

SEQ ID NO: 184470 - protein, 115 aa, Glycine max
  Coding DNA Sequence Number=SeqID_67692
  Gene Ontology: Mol. function=protein serine/threonine kinase activity; Biological process=protein amino acid phosphorylation
  Homolog annotation: Hit_ID=Q5VRS2; Match level="QueryCoverage=66%, HitCoverage=8%, E-value=2e-11, Identity=44%"; Hit description =Putative S-domain receptor-like protein kinase
MKWCLRTKHGTSQHHLRRGCCCEEAKTLSPCHSQVDHGSPSIRRLCFVFGHRVRNTKRRRNMRFRQRQRNQQRACRLERYRATVFCKPISYVTDNKTLVAYWISWHGQTLKPRNM

SEQ ID NO: 184471 - protein, 58 aa, Glycine max
  Coding DNA Sequence Number=SeqID_67693
MARCVGIEPCTLVMDLEGTDGRERGKVMKRLFSRCKTTILFVIRDKTKIWDSIPRPDA

SEQ ID NO: 184472 - protein, 137 aa, Glycine max
  Coding DNA Sequence Number=SeqID_67694
  Subcellular localization annotation: CTP_CleavageSite=63; ConfidenceScore=5.04e-01
MTMQNRQFQQETRASIQSLTNQMGQLATQLNQQQSQNSDKLPSQAVQNPKNKQHIPPLPFPPRAVSNKRMEEAEKEILETFRKVEELCTNKRKLKGSEQISMGRNVSALIGKSVPQIPEKCKDPGPLQSTDVVNSFS

SEQ ID NO: 184473 - protein, 150 aa, Glycine max
  Coding DNA Sequence Number=SeqID_67695
MTKIPFSVFAKLLPLTLAEEMFRGHQRKNLLPSTAEEGSFVDACETFLLRVSTEEELRKNLLPWNYAEELLPRESTKEGSSLHTLQSHTSSSLHFSNSDHAIGVGLIAFSVEMTNMAKGKGKEVAGKGSADKHKGAFDDDKTGGGRKRNK

SEQ ID NO: 184474 - protein, 48 aa, Glycine max
  Coding DNA Sequence Number=SeqID_67696
MVSTMDLGGGVACMRRDRSPTSYGVWVVDVVVAASVGDKIGVGGGGGC

SEQ ID NO: 184475 - protein, 220 aa, Glycine max
  Coding DNA Sequence Number=SeqID_67697
  Homolog annotation: Hit_ID=Q5JN21; Match level="QueryCoverage=39%, HitCoverage=31%, E-value=3e-11, Identity=50%"; Hit description =Glycosyl hydrolase family protein 17-like
NGILPEEASSGNIPDDVLPEIVCEYFRKTQIILPEEVSPLHCLLGAPAIMLGARSNSPNLIVLPVAIDGIGSMDRQSVGLEAHSIRLNGLAICARPTGRALLCAPSTIADTPSTTQCPHRHSPWPLELLGQELWALPHTKVRIVVVEGALVVMGLEHALVGLRDKVEKKGLPPMLGGVKFRGAMELDNVGCGASELKGGKGREEGEPYELSRFEYPYESS

SEQ ID NO: 184476 - protein, 96 aa, Glycine max
  Coding DNA Sequence Number=SeqID_67698
MQQGHAYIPIVRFLNPNYETSLIYVRQSKCKVLREVTKERIERFFSTESLRWILRIPLRLKCSSWCGGLATSNGGSWWPSVVVGGGEEGVRVWVGV

SEQ ID NO: 184477 - protein, 124 aa, Glycine max
  Coding DNA Sequence Number=SeqID_67699
  Gene Ontology: Mol. function=4 iron, 4 sulfur cluster binding; Biological process=electron transport
  Subcellular localization annotation: CTP_CleavageSite=68; ConfidenceScore=5.37e-01
MATPNNNNNNPNIINNNNIATAKPGTLGVGVGAVPTPPKSQRGHNKPKCKQCGNVARSRCPYECCKSCCSRNQNPCHIHVMVVVLLRFLTLPEIGGKCEYNCGHNVVVASPKTLILQLESSTLM

SEQ ID NO: 184478 - protein, 82 aa, Glycine max
  Coding DNA Sequence Number=SeqID_67700
MVSSKTKKKNASQGEDERMPRSRRRRKKQEEEEAEGHIGGRRSRRNAQNKCWVIRKKVAKQEEGTQKKMKSWVQNFLKNKQG

SEQ ID NO: 184479 - protein, 74 aa, Glycine max
  Coding DNA Sequence Number=SeqID_67701
  Gene Ontology: Mol. function=choline-phosphate cytidylyltransferase activity; Cellular component=endoplasmic reticulum; Biological process=biosynthetic process
  Homolog annotation: Hit_ID=Q42619; Match level="QueryCoverage=81%, HitCoverage=22%, E-value=3e-22, Identity=69%"; Hit description =CTP:phosphocholine cytidylyltransferase
MALATTTPPQDHPARVYADGIYDLFHFGHARSLEQAKKSDAVTHKYKGKTVMTEDERYESLRHCKYHITVTFIF

SEQ ID NO: 184480 - protein, 226 aa, Glycine max
  Coding DNA Sequence Number=SeqID_67702
  Gene Ontology: Mol. function=choline-phosphate cytidylyltransferase activity; Cellular component=endoplasmic reticulum; Biological process=biosynthetic process
  Homolog annotation: Hit_ID=Q8L4J8; Match level="QueryCoverage=83%, HitCoverage=63%, E-value=4e-83, Identity=77%"; Hit description =CTP:phosphorylcholine cytidylyltransferase
MSRWVDEVIPDAPWVINQEFLDKHKIDYVAHDSLPYADTSGVANDVYEFVKAVGKFKETQRTEGISTSDVIMRIVKDYNQYVLRNLDRGYSRKDLGVSYVKEKRLKVNRRLKTFQEKVKEHQEKIQTVAKNVGMHQNEWVENVDRFVVGFLEMFEESCHKMGTAIRDQIQKKLIGEQSSDVSFLLQNGKDNEDEEYYYYEGDDSDEEYFDDDELNPLSNVKDQIKK

SEQ ID NO: 184481 - protein, 105 aa, Glycine max
  Coding DNA Sequence Number=SeqID_67703
  Gene Ontology: Mol. function=transcription factor activity; Cellular component=nucleus; Biological process=regulation of transcription, DNA-dependent
  Homolog annotation: Hit_ID=O23112; Match level="QueryCoverage=61%, HitCoverage=25%, E-value=3e-15, Identity=63%"; Hit description=AP2 domain containing protein RAP2.11
  Pfam annotation: Domain name=AP2; Domain location=22-75; Score=71.0; E_value=3.8e-18; Accession=PF00847.10; Description=AP2 domain
MEYQNQRAKEGRFCEKLKIKNKPKFVGVRQRASGKWAADIKDTSKKIRLWLGTYQTVEEAARAYDEDAQPNTRAARASRAKPMIQQKRALSLQHALSPRSNRSTR

SEQ ID NO: 184482 - protein, 267 aa, Glycine max
  Coding DNA Sequence Number=SeqID_67704
  Pfam annotation: Domain name=DUF1723; Domain location=119-168; Score =28.7; E_value=2e-05; Accession=PF08330.1; Description=Protein of unknown function (DUF1723)
MVKTRGLGHALGRVVARGLGRGDGDDFDGAPQRRRPTASAQRRQVPIIVDDVVPTVPVDSPAVPEAEAVVVGDEPMERPELKLSSHGRKVHNLGMPVPAIEDMVAGTRLSPLIACSINIGDRGLISSFVERWYRETSSFHLLVGEVSIMLDDVASLSHLSTVGTFHDFQPLCTDEAMLLLVELLMVSAEVPMAKTGQCGGPYALHDLTLAGQYAWGAAGLVHIYDQLNDCWIYEHFSSVAECNADPDYDEVSPCACRWIATKKTLKK

SEQ ID NO: 184483 - protein, 408 aa, Glycine max
  Coding DNA Sequence Number=SeqID_67705
  Gene Ontology: Mol. function=protein serine/threonine kinase activity; Cellular component=cell surface; Biological process =protein amino acid phosphorylation
  Homolog annotation: Hit_ID=Q9FHG4; Match level="QueryCoverage=96%, HitCoverage=58%, E-value=1e-132, Identity=60%"; Hit description =Serine/threonine-specific kinase like protein
  Pfam annotation: Domain name=Pkinase; Domain location=92-362; Score =155.9; E_value=1.1e-43; Accession=PF00069.15; Description=Protein kinase domain
  Pfam annotation: Domain name=Pkinase_Tyr; Domain location=92-362; Score=87.6; E_value=3.8e-23; Accession=PF07714.7; Description =Protein tyrosine kinase
  Pfam module annotation: Pfam domain module=Pkinase::Pkinase_Tyr; Domain location=92-362::92-362
MTTTLHHPHNVSVVEISRSGATKKRDKRVVGIVVDSVSFFVAFTIFLGYVFVRRWKIGGRKEREKDKFQKSGFVAYPREFHYKELKSATREFHPIRIVGHGSFGAVYKAFFISSGTIAAVKRSRHSHEGKTEFLDELNTIAGLRHKNLVQLQGWCVEKGELLLVYDFMPNGSLDKMLYKEPERGKLLSWSHRQNIALGLASVLVYLHQECEQRVIHRDIKAGNILLDGNFNPRLGDFGLAKLMDHDKGPVSTLTAGTMGYLAPEYLQYGKATDKTDVFSYGVVVLGVACGRRPIEREGSKMLNLIDWVWRLHSEGKVIKAADKRLNGEFEEEEMRKLLILGLSCANPDSAERPSMRRVLQILNNEAAPLAVPKVKPTLTFSSDLPLPLTIEDIVSEADQESMCEIKID

SEQ ID NO: 184484 - protein, 185 aa, Glycine max
  Coding DNA Sequence Number=SeqID_67706
  Gene Ontology: Mol. function=protein serine/threonine kinase activity; Biological process=protein amino acid phosphorylation
  Homolog annotation: Hit_ID=Q9FHG4; Match level="QueryCoverage=95%, HitCoverage=33%, E-value=2e-32, Identity=43%"; Hit description =Serine/threonine-specific kinase like protein
MVKLDASLSGSREANVDGVSEVMRKIELDREESDGVAALEVDAVQDGVSGYEGLHGVHVEAHVVLVRVVRARVKFDGDEAGGGGEAEGFGEGEGGVGGEEEGEAVAGGGGVEVVDGEGEGGGEGGVEEGDRLAVDNGAGAGGGGGVGESYDAVVSERGIAEEGDVVESERREVEAHVVCYCHLPQ

SEQ ID NO: 184485 - protein, 105 aa, Glycine max
  Coding DNA Sequence Number=SeqID_67707
MKLKRMRHNILVSPLRTLGPARLGEHIALALSFRRAAFASSAHFPINRRARETEEGFQGSEGEGIERREKEEEERRGNEAEMLLNRDRDQSLRCSSFGVLRATIG

SEQ ID NO: 184486 - protein, 293 aa, Glycine max
  Coding DNA Sequence Number=SeqID_67708
  Gene Ontology: Mol. function=protein serine/threonine kinase activity; Cellular component=cell surface; Biological process =protein amino acid phosphorylation
  Homolog annotation: Hit_ID=Q9FHG4; Match level="QueryCoverage=91%, HitCoverage=39%, E-value=1e-109, Identity=72%"; Hit description =Serine/threonine-specific kinase like protein
  Pfam annotation: Domain name=Pkinase; Domain location=2-247; Score =85.7; E_value=1.5e-22; Accession=PF00069.15; Description=Protein kinase domain
  Pfam annotation: Domain name=Pkinase_Tyr; Domain location=7-247; Score=27.4; E_value=3.8e-14; Accession=PF07714.7; Description =Protein tyrosine kinase
  Pfam module annotation: Pfam domain module=Pkinase::Pkinase_Tyr; Domain location=2-247::7-247
MSSMNCGKSFYLSRKTEFLDELNTIAGLRHKNLVQLQGWCVEKGELLLVYDFMPNGSLDKMLYKEPERGKLLSWSHRQNIALGLASVLVYLHQECEQRVIHRDIKAGNILLDGNFNPRLGDFGLAKLMDHDKGPVSTLTAGTMGYLAPEYLQYGKATDKTDVFSYGVVVLEVACGRRPIEREGYKMLNLIDWVWGLHSEGKVIEAADKRLNGEFEEEKMRKLLILGLSCANPDSAERPSMRRVLQILNNEAAPLAVPKVKPTLTFSSDLPLPLTIEDIVSEADQESMCKIKID

SEQ ID NO: 184487 - protein, 203 aa, Glycine max
  Coding DNA Sequence Number=SeqID_67709
  Gene Ontology: Mol. function=nucleotidyltransferase activity; Cellular component=nucleus; Biological process=NAD biosynthetic process
  Homolog annotation: Hit_ID=UPI00004C033A; Match level="QueryCoverage =41%, HitCoverage=30%, E-value=6e-21, Identity=60%"; Hit description =PREDICTED: similar to nicotinamide nucleotide adenylyltransferase 1
  Pfam annotation: Domain name=CTP_transf_2; Domain location=130-203; Score=-9.3; E_value=0.0065; Accession=PF01467.16; Description =Cytidylyltransferase
MAEQPSRHYHLRDPLKKQTPNVKIDPECKFALAKSQILRSERNPNLSRGVGTSQAKTGWRIVSILFISFIVLLRTSPILGFSFVEHSYSVTQHIQVMDVPLPLDKLALDLIDNEPSPANMSNSRIYVILVATGSFNPPTFMHLRMFELARDALNSDGYCVIGGYLSPVNDAYKKKGLISAEHRIQLCHFACKSSDFIMVDPWE

SEQ ID NO: 184488 - protein, 95 aa, Glycine max
  Coding DNA Sequence Number=SeqID_67710
  Gene Ontology: Mol. function=nucleotidyltransferase activity; Cellular component=nucleus; Biological process=NAD biosynthetic process
  Homolog annotation: Hit_ID=Q9FM58; Match level="QueryCoverage=84%, HitCoverage=33%, E-value=1e-26, Identity=69%"; Hit description =Arabidopsis thaliana genomic DNA, chromosome 5, P1 clone:MDF20
MLDGSLSIQYQMVKTICKDYGVVCIPREGQDVEKTIFKDDILNENKDNIKVVNELVPNQISSTRVRDCIARGLSIKYLTADEVIDYIREQQLYLN

SEQ ID NO: 184489 - protein, 172 aa, Glycine max
  Coding DNA Sequence Number=SeqID_67711
  Gene Ontology: Mol. function=N-acetylmuramoyl-L-alanine amidase activity; Biological process=peptidoglycan catabolic process
  Homolog annotation: Hit_ID=Q8KD30; Match level="QueryCoverage=91%, HitCoverage=51%, E-value=8e-11, Identity=33%"; Hit description=N -acetylmuramoyl-L-alanine amidase, putative
MDKAKLYTLRWSAMQIARLSADPKVDALALSQIEILSQLLEEPIPEEFRPPEPPRPSLHVEEAAPAKKRYPLGEKKLWYPEALVRTDIKRAAQGEYPKGYPYGAIVHFTAGQYSKGVENAVTAISSSPYFFCCIGTEGKLVQANPLNQWGYHAGESAWIIDGAKRNGVSNFL

SEQ ID NO: 184490 - protein, 170 aa, Glycine max
  Coding DNA Sequence Number=SeqID_67712
  Gene Ontology: Mol. function=RNA-directed DNA polymerase activity; Biological process=RNA-dependent DNA replication
  Homolog annotation: Hit_ID=Q1SAS4; Match level="QueryCoverage=77%, HitCoverage=5%, E-value=1e-42, Identity=66%"; Hit description=RNase H, putative
MEAVLPFEVEVPSQKILAESGLEESEWAQTRYDQLNLIEGKRLTTMSHERLYQQRIKNAFDKKVCPCKFNEGDLVLKKISHVVQDNRGKWAPNYEGPFVVKKGFFWRGSGAHQHGWRGATLTRELRCCQAILRLGSGAIEEITACSFIFVCSPWFSLGIPIRCNFLVTIL

SEQ ID NO: 184491 - protein, 456 aa, Glycine max
  Coding DNA Sequence Number=SeqID_67713
  Gene Ontology: Mol. function=protein serine/threonine kinase activity; Biological process=methionine biosynthetic process
  Homolog annotation: Hit_ID=Q9F0P1; Match level="QueryCoverage=83%, HitCoverage=94%, E-value=0.0, Identity=87%"; Hit description=5 -methylthioribose kinase
  Pfam annotation: Domain name=APH; Domain location=107-373; Score= -1.3; E_value=0.0069; Accession=PF01636.13; Description =Phosphotransferase enzyme family
MPHQRLYRCRVQPAFLLRKRLLVENKELIIRHPQAGRLYCLHVVNSLLRCCSTLCQDEIQMYRRLHVFIRKISEEQAMSQYRTFTAQDAVEYARQFGGLDNPSSLVEAQEVGDGNLNLVFKIYDTQGVSRIIVKQALPYVRCVGESWPLTLDRARLEAQTLVEHYRHSPQHTVKIHHYDPELAVMVMEDLSSHRIWRGELIKNHHYPQAARQLGEYLAHTLFHTSDFYLHPHDKKAQVAKFINPEMCEITEDLFFNDPYQIHARNSYPAELESDVAALRDDAQLKIAVASLKHRFFSHAEALLHGDIHSGSIFVAEDSLKAIDAEFGYVGPIGFDVGTAIGNLLLNFCGLPGHLGIRDAAAAREQRLTDIQELWNTFAERFQALAHEKTRDAALSVPGYASAFLKKVWHDAIGFSGTELIRRSVGLSHVADIDTIADDAMRHECLRHAITLGKALI

SEQ ID NO: 184492 - protein, 248 aa, Glycine max
  Coding DNA Sequence Number=SeqID_67714
MAFLGETSNQTVVNYTLGFIFPNGSIVHNDNGVSFQASTPVPIRVPNGCDFETNKQFLDEIYYWQPFTYADDADVNTMLMCNHGFSFVGPVELLCSIARTPDGILNLLQATMTPTHDALLYYNGRWNMSCQNEFVGYSFTGKNPKKFGIPTGCTMDEMKDLIKQVAPIGIPLYGIDETQMVWRLFFRKPSHHEYSEKVIKFEIIELKTNDDVMKVLIESNYWKKIGPIKILAVFSTPVPEMEDELSLS

SEQ ID NO: 184493 - protein, 290 aa, Glycine max
  Coding DNA Sequence Number=SeqID_67715
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=7e-25, Identity=30%"; Hit description= UPI00006A17C9 related cluster
RLLEDPTLAFRGVHILPLRGLHALAFVGLHTLTFKGVHVLNIRGLYIVAIRGLHVLAFRGLHVLHFRGLHAHTFKGYLHRTTRPWLRKASRPHLQRTTHARLQRTTRLYLRRATRPHLQRTTHPRFQSDTCPRLQRTTRLTFQGSARPSLQWATQDYMSSTSEDYTFSPLEDYMSLPYEGYTASPFEDYTPSPSEDYTGLHNLAFRGLDALAFRGVHILPLRGLHALAFVGLHTLTFKALHILNFRGLYIVTIRGLHVLAFRGLHIEFLQPGGSTSSRAAATAVELQFAL

SEQ ID NO: 184494 - protein, 213 aa, Glycine max
  Coding DNA Sequence Number=SeqID_67716
  Homolog annotation: Hit_ID=Q2NQD6; Match level="QueryCoverage=56%, HitCoverage=56%, E-value=1e-21, Identity=47%"; Hit description =Hypothetical phage protein
MALGNVLEHGDLRRRRRAQQARIAFHDCQFAHQLGADFGYVCNVVRLLTEVPVHQVALNLPSQVIGEALDQHQVAGFGQKGDASALDGNQLVGGDFGRGSYEMLAQLRRCHLEVVFRFNEARAVFVKAAPGRTFGALMDAVNHGEGDDAHALHLDDGDVGAVDVDELLKAFAAAVGAVGDVRGDICAQVGQLVDPRQQHCGIRMAAAICAVRD

SEQ ID NO: 184495 - protein, 44 aa, Glycine max
  Coding DNA Sequence Number=SeqID_67717
MIWKYSTPYQERNAKLPHQYFINNACILHITFAARFGFSKPMCL

SEQ ID NO: 184496 - protein, 319 aa, Glycine max
  Coding DNA Sequence Number=SeqID_67718
  Gene Ontology: Mol. function=transferase activity, transferring glycosyl groups; Cellular component=cytoplasm; Biological process =regulation of apoptosis
  Homolog annotation: Hit_ID=Q1GY13; Match level="QueryCoverage=99%, HitCoverage=44%, E-value=1e-124, Identity=67%"; Hit description =Sucrose-phosphate synthase, glycosyltransferase region
MHGLIRGDQLELGVDADTGGQCTYVLELTKALAKQSQVAKVDLLTRLIDDPHVSADYAQPEEVLSSKARIIRLPCGPKRYMRKESLWPHLDQMVDKCLHYLRQQRRLPDVIHSHYADAGYVGRQLSMLLGIPLVHTGHSLGLPKRERLLSSGRKATTIEKQFNFERRIAKEEALLRDAALIVTSTRQEIELQYGMYAQMDGKRFKVIPPGTDTTRFSPAGRRPIAGGVELSITRFLEQPKKPMILCICRPELRKNINGLLKAYGSHPALHERANLVLVARSREDIRQLDKAQQSVLNELLLDIDAYDLWGKVAIPKHLP

SEQ ID NO: 184497 - protein, 82 aa, Glycine max
  Coding DNA Sequence Number=SeqID_67719
  Subcellular localization annotation: CTP_CleavageSite=50; ConfidenceScore=5.14e-01
MVLVAAIAASLTSIISFMLIMASIIVAICPFKASMSAFICSYTSSTSPITLALAWVRKQSSDVTQFIFCPNLQVGYFHTVIP

SEQ ID NO: 184498 - protein, 157 aa, Glycine max
  Coding DNA Sequence Number=SeqID_67720
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=3e-15, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LSSLVTDAWSANTFPVRKYNSRGLHVLAFRGLHVLAIRGPHVLAFRRLHVLTFRGLHALNFRGLHVLTFRGLHVLAFRGLHVLAIRGPHVLAFRGLHVLTFRGLHVLTFRGLHVLTFRGLHTLIFRGLYVLPLRGLHVLAFGGLHALAFRGLHVLTT

SEQ ID NO: 184499 - protein, 154 aa, Glycine max
  Coding DNA Sequence Number=SeqID_67721
  Gene Ontology: Mol. function=oxidoreductase activity, acting on sulfur group of donors, disulfide as acceptor; Biological process =sulfate reduction, APS pathway
  Homolog annotation: Hit_ID=Q8W1A1; Match level="QueryCoverage=76%, HitCoverage=19%, E-value=1e-23, Identity=57%"; Hit description =Adenosine 5'-phosphosulfate reductase
  Subcellular localization annotation: CTP_CleavageSite=47; ConfidenceScore=5.88e-01
MALAVSTTSSSSAAAAASSSFFSRLGSSSDAKAPQIGSFRFPERSLVSSVVVNVTQRRSLVRPLNAEPQRNDSIVPLAATIVAPAPPPPPPPPQMEANKGFFLRFGGGFAEGGKEKENFEQKRQDLEKASPPEIMEKAPPKIGKKIAFAFWEIL

SEQ ID NO: 184500 - protein, 654 aa, Glycine max
  Coding DNA Sequence Number=SeqID_67722
  Gene Ontology: Mol. function=intramolecular transferase activity, phosphotransferases; Biological process=carbohydrate metabolic process
  Homolog annotation: Hit_ID=Q1SGB6; Match level="QueryCoverage=49%, HitCoverage=61%, E-value=1e-136, Identity=73%"; Hit description =Phosphoglucosamine mutase
MKGVTSIVGAVATDMGILTTPQLHWMVRARNKGMKASEQDYFEQLSSSFRCLVDLIPAEKCKFDGVNDKVVVDGSNGVRNSSEDGGVLNDGVGADYVQKEKVLPNNFGSKDTGIRLGEVGGGLTESWINADRLVYFIVPPKSSGRIDLVDGDKILSLFALFIREQLSFLNEKEDMKNCHQAHVGVIQTAYANGASTNYLKLLGLEVNFTPTGVKYLHEKATEFDIGIYFEANGHGTVLFSESFIESLEARTNEISLGSKEGEKAALRLLALSKLINQAVGDALSGFLLVEVILQHMGWSINKWNELYHDLPSKQLKVKVADRTAVVTVEYPCNLAMFERVAAVRRRVVRRPPPRRPPPPAAAISGGFLRRDQGSDRLEKRDPTLQLAPPSVVARASTRRFFFSRLPARAAHAPPCQRRKLPLPVLAASSSLPGSVSGFTSRFRQAIWSALECLPLLGVRLWFLGQGHHDHLEKTSDSVSVDKRPEWEKLDYQLCAVLWQSVEPDILEILRSFKSCRSFWKKAQEIFANDIQSLFDATMKVTALKQTSHDMIAHVGKARAAVEELRKFLVADSLEEVNRKLDKFYMVLILRSLHSDFDHVRDQVLAGDQIPSMDSLITRLLRVPHLLKDENPTDGVETSAMVASRGRGSGRNSRG

SEQ ID NO: 184501 - protein, 178 aa, Glycine max
  Coding DNA Sequence Number=SeqID_67723
  Homolog annotation: Hit_ID=P27323; Match level="QueryCoverage=25%, HitCoverage=6%, E-value=8e-10, Identity=75%"; Hit description=Heat shock protein 81-1
MLPTEKTPEMLNKSASFNGVSGAYLCLLLIIGAEFSKMMVFIHTGKMIPEASMVKSPAGREKGTGILMPPNPPAALCIPRDGLLSIPTAPKTTLFSSMGPKNDKVTAQGYISLQCLHELLGPGTRNGNQVVHQICFGQSNAAVNNGKSLAGLDVDGSGDDGGGGGYGGGGGRGSGHWC

SEQ ID NO: 184502 - protein, 114 aa, Glycine max
  Coding DNA Sequence Number=SeqID_67724
MDCVGQLQSLNPQHHIFGGIHEHVENLYVLEANDSPFACLCGGGGYEGGVGGGYGHGSGGAGGGNGGFGGGVGSGNGGFGGAAGAGNGVFGGGGMGDGGYGGGICGEFMDQLRP

SEQ ID NO: 184503 - protein, 265 aa, Glycine max
  Coding DNA Sequence Number=SeqID_67725
  Gene Ontology: Mol. function=isopentenyl-diphosphate delta-isomerase activity; Cellular component=peroxisome; Biological process =chlorophyll biosynthetic process
  Homolog annotation: Hit_ID=O48964; Match level="QueryCoverage=80%, HitCoverage=90%, E-value=1e-113, Identity=92%"; Hit description =Isopentenyl-diphosphate Delta-isomerase I
  Pfam annotation: Domain name=NUDIX; Domain location=83-235; Score =82.9; E_value=9.9e-22; Accession=PF00293.18; Description=NUDIX domain
MTLPSKAGKHLHLRRLKETNLEIELWSIWCFCNGFSFLILMYNFFLDKASLKCILVDENDRVVGHDSKYNCHLMEKIEAENLLHRAFSVFLFNSKYELLLQQRSATKVTFPLVWTNTCCSHPLYRESELIDENALGVRNAAQRKLLDELGIVAEDVPVDQFTPLGRILYKAPSDGKWGEHELDYLLFIVRDVNVNPNPDEVADIKYVNCDQLKELLRKADAGEEGLKLSPWFRLVVDNFLFKWWDHLERGTLGEVTDMKTIHKLT

SEQ ID NO: 184504 - protein, 197 aa, Glycine max
  Coding DNA Sequence Number=SeqID_67726
  Gene Ontology: Mol. function=aminomethyltransferase activity; Cellular component=mitochondrion; Biological process=glycine catabolic process
  Homolog annotation: Hit_ID=P49364; Match level="QueryCoverage=91%, HitCoverage=44%, E-value=3e-95, Identity=94%"; Hit description =Aminomethyltransferase, mitochondrial precursor
  Pfam annotation: Domain name=GCV_T; Domain location=1-85; Score= -16.4; E_value=4.2e-06; Accession=PF01571.11; Description=Glycine cleavage T-protein (aminomethyl transferase)
  Pfam annotation: Domain name=GCV_T_C; Domain location=94-186; Score =137.5; E_value=3.6e-38; Accession=PF08669.1; Description=Glycine cleavage T-protein C-terminal barrel
  Pfam module annotation: Pfam domain module=GCV_T::GCV_T_C; Domain location=1-85::94-186
LGSTVHDKTLFTETFRYTGEDGFEISIPSESAVDLAKAILEKSEGKIRLTGLGARDSLRLEAGLCLYGNDLEQHITPIEAGLTWAIGKRRRAEGGFLGADVILKQLEEGPKIRRVGFFSSGPPPRSHSEIQDEGGNNIGEVTSGGFSPCLKKNIAIGYVKSGLHKAGTKVKIIIRGKSNEGVVTKMPFVPTKYYKPS

SEQ ID NO: 184505 - protein, 70 aa, Glycine max
  Coding DNA Sequence Number=SeqID_67727
  Subcellular localization annotation: CTP_CleavageSite=58; ConfidenceScore=5.58e-01
MVLINPINGVSPSPTFNTTFFSDPCLPPHTFSTFTIARNKLNSPGIELAFYRLVQNATLRMYADVGEWNC

SEQ ID NO: 184506 - protein, 443 aa, Glycine max
  Coding DNA Sequence Number=SeqID_67728
  Homolog annotation: Hit_ID=Q9FFD9; Match level="QueryCoverage=74%, HitCoverage=84%, E-value=6e-64, Identity=44%"; Hit description =Genomic DNA, chromosome 5, P1 clone:MQK4
MQQYSTFLCLSFPSKFPTSPHLSETTLHSISMEEHKKEGFFLPTPVAKLISFQTDLIYNGLVSLFSPIHSLFSVASESYHRAEETKDSVESAVQRALSHQITHGSALLLKKLGLCFLSVAYVCMVMILALILAAVVGVALVRLWVEEPVSVKDNLHFDYTEAHPTAVFSFNGVRSLKGHLKKKHISVPVGHSFFASLVLVMPESDFNRELGVFQDVFLQELIRDILQLTAELLSVNGNVIEKSSQPCMLRFRSSPIRLVRTFMMGVPLVLGISGETQNINVDILKHKEDYRRSNSIRVTLHPRAGTSSLPQLYEAKIAINSHLPWTKELVRNWKWTFYVWVSLPLIFLVTPEYFSDHRVSELTREEPGQLQVEELGDESEVSELLRKWRRSRSKRKTVLAHGGVPETIVGSSTSSISMMTTREDVTSVAVEDEVEDSESACIG

SEQ ID NO: 184507 - protein, 90 aa, Glycine max
  Coding DNA Sequence Number=SeqID_67729
MVDEPRSRPITCEPVSSGPIDDPLRARTLPTRPQSGEASSVADRAQVPWKGAPERVRAPSCPDPVAPRGAVGESGCLGMQPQSGGNSVQG

SEQ ID NO: 184508 - protein, 207 aa, Glycine max
  Coding DNA Sequence Number=SeqID_67730
  Homolog annotation: Hit_ID=Q8TGM5; Match level="QueryCoverage=19%, HitCoverage=61%, E-value=1e-07, Identity=70%"; Hit description =Uncharacterized protein ART3
PWTELPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 184509 - protein, 192 aa, Glycine max
  Coding DNA Sequence Number=SeqID_67731
  Gene Ontology: Mol. function=DNA binding
  Homolog annotation: Hit_ID=Q1SFS3; Match level="QueryCoverage=62%, HitCoverage=26%, E-value=1e-09, Identity=40%"; Hit description =Lambda repressor-like, DNA-binding
MGTNQTGKRFYQVKVKSLDTTSIKELGRLMEPLQMQAFRKTYGKILELTLAETSNWYRPSKNFKEILGCPLGIATVVKDSARGLYRVKQTRNGIAGLPRKYLEDKARDMANQEDWVPFMDVLALLIFGVVLFPNVDGLVDLAAIDAFLAYRHSKESPVVAVLADLFDTFDRSKTRGIHVRSKAIARVLKREE

SEQ ID NO: 184510 - protein, 46 aa, Glycine max
  Coding DNA Sequence Number=SeqID_67732
MQLRDQGSVLSELTLAQRICTAYPSSRFFSALSQWWSRLTGCSLSG

SEQ ID NO: 184511 - protein, 176 aa, Glycine max
  Coding DNA Sequence Number=SeqID_67733
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=9e-27, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSKGYASSPSEGYASSPLEGCTSSPLEDYTSSPPKDYRSSPSEGCTSSTPEDYMSSPPEDYTSPPSEGCTPSPSEDYTSLPSEDYMSSTSEGYVSYPSEGYASSPLEGCTSSPLKDYMSSPPKDYKSLPSEGCTFSPPEDYTSSPPEDYTSPPLESYTPSPLEGYMSSPSEDY

SEQ ID NO: 184512 - protein, 85 aa, Glycine max
  Coding DNA Sequence Number=SeqID_67734
MTPFVALCFLSALGCFDGRGGYWVEVGLALERQEQLCPFRSFGGCRKQKGEVQEVKAWSLPLSGPMGYKMVFDLAISMFMPFNDK

SEQ ID NO: 184513 - protein, 746 aa, Glycine max
  Coding DNA Sequence Number=SeqID_67735
  Gene Ontology: Mol. function=sequence-specific DNA binding; Cellular component=nucleus; Biological process=regulation of transcription
  Homolog annotation: Hit_ID=Q1S442; Match level="QueryCoverage=99%, HitCoverage=100%, E-value=0.0, Identity=59%"; Hit description=DNA -binding WRKY
  Pfam annotation: Domain name=WRKY; Domain location=264-322; Score =145.0; E_value=2e-40; Accession=PF03106.6; Description=WRKY DNA -binding domain
  Pfam annotation: Domain name=WRKY; Domain location=479-538; Score =145.9; E_value=1.1e-40; Accession=PF03106.6; Description=WRKY DNA -binding domain
  Pfam module annotation: Pfam domain module=WRKY::WRKY; Domain location=264-322::479-538
  Subcellular localization annotation: CTP_CleavageSite=101; ConfidenceScore=5.01e-01
MEQDNLNNNCDEENFVSDSRGRKRSIAERRGFNSNAARINTALFRTATTSTTTPSPSPAVRSPRLTIPPGISPTALLDSPIMLPNSQAISPTVGSFFTLPLLSHEGSMLTTEQGNVDVSTAFDVAASFKFKPRGHLDPNPLPPFPASLNQGHVSSHFHSVKGENRESHLLAQVQPPLDFSCQADFSKGHSVKNSEVNSYNDMKMVNDAIVNANNVEMPMSGSEEVSDESAMLKNAINGEDFGGQPASEGEQKEVSHATGAVRTSEDGYNWRKYGQKQVKGSEYPRSYYKCTQPNCQVKKKVERSHDGQITEIIYKGAHNHAQPHPGHRASSLSTDEVSDMAEDSTLAKIEGGYVWRNIQTGLKDTKQSFDWKADGQERTSSTSAVTELSDPISTNKAKSLRIFELEDTPELSSTLASHDDDEDGTAHALVSAEDEAENDELEPKIRKKESYAVEPNLPPTRAVREPRVVVQIESDVDILDDGYRWRKYGQKVVKGNPNPRSYYKCTSTGCMVRKHVERASHNLKYVLTTYEGKHNHEVPTARTNNQVNSSDGGLPPNGANGQVSLTLPGNAGIPKPETHQTLGHHFDRKPEFSDEFLRPSLVGSFGNDMKFRPSSLCQMKYPSLNNAMPYGSYGLNPERCTAPQAGSIPSMFPDFPMPLPLNLPSSGNFSIAGLNFNRVKPMNPDQSFLSGQQVKDIDTGFLRPKQEQKDDTMYGSCMPPLDHANASLTSSPSPSIYQRVMHNFPS

SEQ ID NO: 184514 - protein, 400 aa, Glycine max
  Coding DNA Sequence Number=SeqID_67736
  Homolog annotation: Hit_ID=Q6H6J8; Match level="QueryCoverage=86%, HitCoverage=81%, E-value=1e-47, Identity=34%"; Hit description=F-box- like
VDVSAPKIRTIKQAEELKSKDTTPLSEKKSFNSTISSHDIDEQHHSTYTNALIQLYAILEAVADRVEMHDNIGEQRNNWNTLLLNSINMITLTATTMAGVAATCSEGAGAPLLALKLSSALLFSAATGMSLIMNKIQPSQLTEEQRNASRLFRNLQSEIETAIALGINNNNPTEEDVKGAMEKVLALDKAFPLPLLGAMLEKFPKKFEPAVWWPSKPYNGKGKSQRKGNKMNGWSEELEIELKEVVEVVKRKDIEDYERLGNMILKINKTLAIAGPLLTGIAAAGTAFIGNNNGYWGALVPLIAGSLASAVNSFEHGGQVGMIFEMYRASGGFFKMLESSLESTLEEEDLERRENGELFEMKMALKLGRSVSQLRELASKSASYRMEGVLDIDEFASKLF

SEQ ID NO: 184515 - protein, 95 aa, Glycine max
  Coding DNA Sequence Number=SeqID_67737
  Gene Ontology: Mol. function=transition metal ion binding; Cellular component=endoplasmic reticulum; Biological process=intracellular protein transport
  Homolog annotation: Hit_ID=Q9FH68; Match level="QueryCoverage=99%, HitCoverage=37%, E-value=5e-30, Identity=68%"; Hit description =Arabidopsis thaliana genomic DNA, chromosome 5, TAC clone:K16E1
MIQLLFTVIFSETAMIALLLFKTPLRKLVIMGLDRLKRGRGPLMVKTVAGTVLVVFFSSVYSMVNIQKRGIEEGAIVNPTDQVLMAKHLLEATLM

SEQ ID NO: 184516 - protein, 403 aa, Glycine max
  Coding DNA Sequence Number=SeqID_67738
  Homolog annotation: Hit_ID=Q6H6J8; Match level="QueryCoverage=85%, HitCoverage=82%, E-value=4e-82, Identity=46%"; Hit description=F-box- like
  Subcellular localization annotation: CTP_CleavageSite=39; ConfidenceScore=5.25e-01
MDSSKFSSFSYCSSRRIAATINVPKIKPPAQLMQKENPYCSNLSAKSSTAPRTSTPNSTEVTKLHVIMEIVAERIEMHKNIGAQRDNWNCLLTTSVNMITLSAATMVGLAAVGSSGATVVALKVSSTILYMAATGLLVVMNKIQPSQLVEEQRNAARLFKQLHRELQTRLSLGNPSENDVNEAMEKVLALDRAYPLPLLGSMLEKFPQTVEPAVWWPRQKQKCLKKEEFGGKFKGKNGWDARLEDEMRKVVLVLRKKDMEDYLRLGKEVLNFNKVLAVSGPLLTGLAALGSVFLGSVNAPWPVMLGVIGGALASVVNTLEHGGQVGMVFEMYRTTTGFFKLMEESIELNINEQDPHKRENGELFEIKVALQLGRSLSELRQFTASISSSPEENDCQEFASKLF

SEQ ID NO: 184517 - protein, 102 aa, Glycine max
  Coding DNA Sequence Number=SeqID_67739
  Homolog annotation: Hit_ID=Q1SSN0; Match level="QueryCoverage=50%, HitCoverage=13%, E-value=4e-14, Identity=71%"; Hit description =Survival protein SurE
MIFGEFELFQCVDHGKTSLGNRSVCGHSVTTGETLAVYSAQVGGANAYQVSGTPADCVSLALSGALFSWSKPVLALVNARVRARRFKNIPPKQNTHTLLISV

SEQ ID NO: 184518 - protein, 175 aa, Glycine max
  Coding DNA Sequence Number=SeqID_67740
  Gene Ontology: Cellular component=integral to membrane
  Homolog annotation: Hit_ID=Q6H6J7; Match level="QueryCoverage=57%, HitCoverage=51%, E-value=6e-14, Identity=40%"; Hit description =Putative peroxisomal membrane protein 22 kDa
  Subcellular localization annotation: CTP_CleavageSite=64; ConfidenceScore=5.18e-01
MSFWDNNNNNSHELQSQNQLPVVQSKGGSKMGSLAKKGLNNYGQTAPATPFENQGVLSAISDIVSQKLTGIQKLQLRRLLLKVVFGAAYLGPFGHFFHLILDKIFKGKRDSKTVAKKEKLQNLLFNLSIYHELNSGIAVGTCVINLLFIGSTKYQLTYAVQHLCLKHFDSRTKKN

SEQ ID NO: 184519 - protein, 144 aa, Glycine max
  Coding DNA Sequence Number=SeqID_67741
  Gene Ontology: Mol. function=transition metal ion binding; Cellular component=endoplasmic reticulum; Biological process=intracellular protein transport
  Homolog annotation: Hit_ID=Q9FH68; Match level="QueryCoverage=67%, HitCoverage=38%, E-value=1e-20, Identity=51%"; Hit description =Arabidopsis thaliana genomic DNA, chromosome 5, TAC clone:K16E1
  Pfam annotation: Domain name=M; Domain location=119-139; Score=2.9; E_ value=52; Accession=PF02370.7; Description=M protein repeat
  Pfam annotation: Domain name=M; Domain location=63-83; Score=15.0; E _value=0.28; Accession=PF02370.7; Description=M protein repeat
  Pfam module annotation: Pfam domain module=M::M; Domain location=119 -139::63-83
MQVGCMHLTGFTVLHPSGAILFLALMIDRLHHYIRELRIRRKGMEAVKKQTRGTEDGKVANSEEIKAVEEERARLRAELSRLESELQSKTKDVDAAEANVAALRKQSEGFLLEYDRLLEENQNLRNQLQSLDRKLSHSGSKKNM

SEQ ID NO: 184520 - protein, 109 aa, Glycine max
  Coding DNA Sequence Number=SeqID_67742
  Homolog annotation: Hit_ID=Q2HW10; Match level="QueryCoverage=84%, HitCoverage=53%, E-value=2e-33, Identity=82%"; Hit description =Wiscott-Aldrich syndrome, C-terminal
MDRLVILPFSAGCISEASVAVGVPHPRRSKPDTNASPPTIKRSKSVEDSEILSGESMKNSLRLLDVVPKSNLSYGFNRLVKGFKNFSQLFGEKFNMMVSFYNPLIYLRI

SEQ ID NO: 184521 - protein, 422 aa, Glycine max
  Coding DNA Sequence Number=SeqID_67743
  Gene Ontology: Mol. function=protein serine/threonine kinase activity; Cellular component=cell cortex; Biological process=protein amino acid phosphorylation
  Homolog annotation: Hit_ID=Q9FLQ2; Match level="QueryCoverage=74%, HitCoverage=76%, E-value=1e-79, Identity=47%"; Hit description =Similarity to NPK1-related protein kinase
  Pfam annotation: Domain name=Pkinase; Domain location=3-249; Score =245.9; E_value=8.6e-71; Accession=PF00069.15; Description=Protein kinase domain
  Pfam annotation: Domain name=Pkinase_Tyr; Domain location=3-249; Score=23.9; E_value=6.1e-14; Accession=PF07714.7; Description =Protein tyrosine kinase
  Pfam module annotation: Pfam domain module=Pkinase::Pkinase_Tyr; Domain location=3-249::3-249
MDWTRGHTLGRGSTAAVYIGESHRSGEVFAVKSAELHRSEFLKREERILSTLKCPQIVAYRGCDNTFENGVQWFNMFMEYAPHGTLAERGGGMEEAVVGSCTRQILQGLNYLHSNGIVHCDVKGQNVLVTEQGVKIADFGCARRVEESSSVIAGTPRFMAPEVARGEQQGFPADVWALGCTVLEMITGTPPWQGGGDPAAVVYRIGFSGESPEIPGYVSEQGRDFLGKCLKREPGERWSVEELLGHGFVKECTELKLLVLDSDTPTGVLERGFWDSLETAQHEALDCPSPRDRIRRLFSDEPVWASNDDEWVTVRGNEIHDIHLEAEGLFFHQTNTTFCNVVSDEDNVLVTFCDPEIVESTAAELSISDNDCYLRGRNCDCRTRESLLSACVCLVIVFHGKFDSNKMRFFIMPCILLPFHSL

SEQ ID NO: 184522 - protein, 93 aa, Glycine max
  Coding DNA Sequence Number=SeqID_67744
MMRCVKGTTCLWSLTESQKEPDLQPLRRNGGGWGGVARGGGGWGWFWMTGRHGWGTETSKGKGRRCRDLTLTRVARGPYQKAAYAHIAFALPQ

SEQ ID NO: 184523 - protein, 296 aa, Glycine max
  Coding DNA Sequence Number=SeqID_67745
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=98%, HitCoverage=58%, E-value=1e-127, Identity=73%"; Hit description =Aspartic proteinase 1
  Pfam annotation: Domain name=Asp; Domain location=79-296; Score =265.3; E_value=1.2e-76; Accession=PF00026.14; Description=Eukaryotic aspartyl protease
MSNVVVFCFCLWTLLFSLVFCAPNDGLGRIGLKKVKLNTHDVEGLKEFRSSIRKHHLQNILGGAEETDVVALKNYLDAQYYGEIAIGTPPQKFTVIFDTGSSNLWVPSSKCYFSIACFMHARYRSSQSSTYRENGTSAAIQYGTGAISGFFSNDDVKVGDIVVKDQEFIEATREPGVTFVAAKFDGILGLGFQDISVGYAVPVWYSMVEQGLVKDPVFSFWLNRKPEEENGGELVFGGADPAHYKGKHTYVPVTRKGYWQFDMGDVLIAGKPTGYCADDCSAIADSGTSLLAGPTV

SEQ ID NO: 184524 - protein, 122 aa, Glycine max
  Coding DNA Sequence Number=SeqID_67746
  Gene Ontology: Mol. function=nucleic acid binding; Cellular component= nucleus
  Homolog annotation: Hit_ID=Q9SWF9; Match level="QueryCoverage=66%, HitCoverage=79%, E-value=2e-37, Identity=68%"; Hit description=Zinc finger CCCH domain-containing protein ZFN-like
  Pfam annotation: Domain name=zf-CCCH; Domain location=62-88; Score =44.1; E_value=4.7e-10; Accession=PF00642.15; Description=Zinc finger C-x8-C-x5-C-x3-H type (and similar)
MATLEKPWAHSKTDFQCGLDKNIKLKKMSLKVEISYIFINAMWQINLRSSETMESEPYPEHPGEPDCSYYIRTGLCRFGATCRFNHPPNRKLAIAAARMKGEFPERIGQPECQACTCLSMNA

SEQ ID NO: 184525 - protein, 88 aa, Glycine max
  Coding DNA Sequence Number=SeqID_67747
MTIQNEYMFFNCSQDSLCSACEHFSEHCDSSCDSASYLCSHLPGSSYYPKATQSLRLMLKYCATYASVYWKNVGAPMPYDQVPEYGIR

SEQ ID NO: 184526 - protein, 127 aa, Glycine max
  Coding DNA Sequence Number=SeqID_67748
  Homolog annotation: Hit_ID=Q9SZ28; Match level="QueryCoverage=45%, HitCoverage=40%, E-value=2e-09, Identity=40%"; Hit description=STIG1 like protein
  Pfam annotation: Domain name=Stig1; Domain location=4-119; Score =20.6; E_value=2.3e-07; Accession=PF04885.4; Description=Stigma -specific protein, Stig1
MALVIADSEKKESPFLTYVKNHNYTQNHATPSSESEVLASLRGSKGLRGHKNVRGGGAMTCDKYPRVCRAKGSEGPDCCKRKCVNVSNDRNNCGMCGKRCKYSQVCCKAMREGIREDKNSERVPIIN

SEQ ID NO: 184527 - protein, 488 aa, Glycine max
  Coding DNA Sequence Number=SeqID_67749
  Gene Ontology: Cellular component=nucleus; Biological process =regulation of transcription, DNA-dependent
  Homolog annotation: Hit_ID=Q9SNQ6; Match level="QueryCoverage=81%, HitCoverage=51%, E-value=3e-48, Identity=34%"; Hit description =Putative early flowering 3
MTDASLISLEKGKNSKSMNKEHRSLKEENRSISVDSLKTLQGSSVRTQEELAAFRDQIKSRDHHIEKPAASELHKCSGELEIGRRCFLDKVNRNEDEETYSHYDAVNKYNSECTSVMDISPDNVVGAIGEQQFWKVRRTIINQQKIFVKQVSELHRLIKVQRLIAGSPHILLEDNLLHNKPPQKTSTTQKFQSDFAGKKPSSVVKLDNKSVKVNTDEKATNSAVGKIPIPCISNITKGHANQLPNYGHHLGNLALGSADSNSKQPPSYVYPPPGNQWLVPVMSPSEGLVYKPIIGPCPPNAGFMAPIYGSCGTMSFNPLSKDASSDATLAPSSHQKLGIISGSSLSQLPSFMNHPSSLSASAIEQMGQSNGPENHHSCGEVNSAILHQSSSNMSSPTSQMMSRNISTYHHSLKDKELQRSTASSPSKRMSGEALPLFPLAPTFWQSEDRNTQVEHRPRVIKAMPHNPKTASESAARIFRSIQEERKHL

SEQ ID NO: 184528 - protein, 397 aa, Glycine max
  Coding DNA Sequence Number=SeqID_67750
  Gene Ontology: Mol. function=pectate lyase activity; Cellular component=anchored to membrane; Biological process=pathogenesis
  Homolog annotation: Hit_ID=O65456; Match level="QueryCoverage=99%, HitCoverage=98%, E-value=1e-147, Identity=63%"; Hit description =Putative pectate lyase 16 precursor
  Pfam annotation: Domain name=Pec_lyase_C; Domain location=130-315; Score=313.0; E_value=5.3e-91; Accession=PF00544.9; Description =Pectate lyase
MATLTTLLVTLYFIVPALASTPNRDSTKEFNALSPISSYINKTPEDVVIMNTIDSCWRAKTNWASNRKALADCAIGFGKEAIGGKFGDIYEVTDPSDDPVDPKPGTLRYGAIQTEPLWITFAKDMVIRLKNELMVNSYKTIDGRGAKVEIANGACITIQGVCHVIVHGISIHDCEPGKGGMVRSSPEHVGYREGSDGDAISIFASSNVWIDHCFLARCTDGLIDVIHASTAVTISNNYFTQHDKVMLLGHSDEYTADKVMRVTVAFNRFASGLIERMPRVRFGYAHVVNNLYDEWLMYAIGGSADPTIFSEGNYFTASNDSAAKQVTKRESSEKWNNWKWRSFRDEFINGAYFVPSGYGSCTPIYSAAQSFIAAQASMVPLLTLNAGPLNCVVDKAC

SEQ ID NO: 184529 - protein, 50 aa, Glycine max
  Coding DNA Sequence Number=SeqID_67751
MEVEEPWLGLWLSLNCRVDMGASHHRTPELGVYAYMFLVEVGIVGARYAG

SEQ ID NO: 184530 - protein, 161 aa, Glycine max
  Coding DNA Sequence Number=SeqID_67752
MASRKRARTEDIPSSSNPSPSTAAMEPDAQQAHSLIPMLQSLFRGQLMIVCNQQELAHHRLIISMEQFLEKVPWPEAHLPLERAHKDVPPRLVPARTELTSAEPQPPIVDPPASPELETLSPPAPPLIIIPDDSADEVVAPPDSPSCNIDDGSNFSDRMDC

SEQ ID NO: 184531 - protein, 82 aa, Glycine max
  Coding DNA Sequence Number=SeqID_67753
  Homolog annotation: Hit_ID=Q1SRR6; Match level="QueryCoverage=54%, HitCoverage=3%, E-value=1e-08, Identity=60%"; Hit description =Integrase, catalytic region; Zinc finger, CCHC-type
  Subcellular localization annotation: CTP_CleavageSite=35; ConfidenceScore=5.04e-01
MAAVDITGSNSNDLNKPFRFKGYHFKRWQQKMMFSLTMRKAAYVLNTDIRVVPEDVEKEVKDKMIVELDVKKGGTTSKKEQK

SEQ ID NO: 184532 - protein, 109 aa, Glycine max
  Coding DNA Sequence Number=SeqID_67754
  Homolog annotation: Hit_ID=Q851B2; Match level="QueryCoverage=97%, HitCoverage=31%, E-value=5e-13, Identity=35%"; Hit description =Putative ATP synthase subunit
MRSNGTWCIPKEEEIMEALENVGDIYQEEISKAPVPLVEHFAMVLGRKSNHSLGVGSAPITKKFSHKKIIQNQLENAQNRVNNLELEVQKLTNITKKQEDVITQLHIEV

SEQ ID NO: 184533 - protein, 129 aa, Glycine max
  Coding DNA Sequence Number=SeqID_67755
MVIPKFKVLDFDKYKGTTCPKNHLKMYCRRMGAYANDEKLLIYFFQESLIGVAITWYSDLEPSRYQYNSAQDRMQLQNMCKKGHKSFKEYAQRWRDLAAQVAPPMTEKEMITIIVDTLPVFYYEKWWGT

SEQ ID NO: 184534 - protein, 80 aa, Glycine max
  Coding DNA Sequence Number=SeqID_67756
MVTKRVKKYEKMMTHQYIPSSFADLVFAGERIEAGLKRGKFDHPALMNEKTGANEEDENEEGTHVVAVIPTWPNFPPAQQ

SEQ ID NO: 184535 - protein, 174 aa, Glycine max
  Coding DNA Sequence Number=SeqID_67757
MLNEGSVGKLFYKNEKDNVQLLMCISQCSPTINHNNNPTTSFQSTPPSHGTLSINDSERYSKRHTVNVSCIQRNLMSSFEHQKNRTTASTSTCQGSNPYSNMTQSDIHRDKHERATNTTQHNQFVAHDSSHSTDNDAVVAEIKLLMDKYAERRKRRRSILQERKKQRSATNGST

SEQ ID NO: 184536 - protein, 410 aa, Glycine max
  Coding DNA Sequence Number=SeqID_67758
  Gene Ontology: Mol. function=glutamyl-tRNA reductase activity; Biological process=tetrapyrrole biosynthetic process
  Homolog annotation: Hit_ID=Q6AVG1; Match level="QueryCoverage=90%, HitCoverage=89%, E-value=1e-129, Identity=58%"; Hit description =Expressed protein
  Pfam annotation: Domain name=DUF266; Domain location=148-282; Score =205.2; E_value=1.5e-58; Accession=PF03267.4; Description=Arabidopsis protein of unknown function, DUF266
MQSRLEEGKDPAGLRTTPSRPFPLRLLQFFLAFLVIGLGASFLSMYMIRHFGIHNVALLQSSFKPCFEQPANIESWTMPRSNLLHAMNDTELFWRASFVPRIKSYPFKRTPKIAFMFLTKGPLPMAPLWEKFFKGHARLYSIYVHLLPSYNADFPPSSVFYRRQIPSQVRYHSFVSFRVKISNQPSPSPSQVAEWGMMSMCDAERRLLANALLDISNEWFILLSESCIPLQNFSIVYRYIAHSRYSFMGAVDEPGPYGRGRYDGNMAPEINVSDWRKGSQWFEIKRELALRIVEDRTYYPKLKEFCRPHKCYVDEHYFQTMLTINTPHLLANRSLTYVDWSRGGAHPATFGKDDIKEEFFKKILQDQKCLYNNQPSSLCFLFARKFAPNALGPLLDIAPKALGIGKRPGF

SEQ ID NO: 184537 - protein, 192 aa, Glycine max
  Coding DNA Sequence Number=SeqID_67759
  Gene Ontology: Mol. function=protein dimerization activity; Cellular component=endoplasmic reticulum; Biological process=proteolysis
  Homolog annotation: Hit_ID=Q0GXX4; Match level="QueryCoverage=82%, HitCoverage=35%, E-value=2e-58, Identity=71%"; Hit description=Auxin conjugate hydrolase
MFFFKWFHLFITFHVLAATPIFSLTDSSNQVSTNFLDNAKKPEVFYWMVKIRRRIHENPELRYEEFETSKLIREELDKLGIPYKYPVAVTGVIGYIGTGNSPSVALRADMGALPIQEKVEWEHKCKIPEKMHACGHDAHVTMLLGAAKILKQHENEIQNSSYVNLWFLSNILVNCCALSNCQMSVSSIMPIL

SEQ ID NO: 184538 - protein, 172 aa, Glycine max
  Coding DNA Sequence Number=SeqID_67760
  Homolog annotation: Hit_ID=O80895; Match level="QueryCoverage=90%, HitCoverage=85%, E-value=7e-36, Identity=45%"; Hit description =Expressed protein
  Pfam annotation: Domain name=DUF1068; Domain location=1-172; Score =261.2; E_value=2.1e-75; Accession=PF06364.3; Description=Protein of unknown function (DUF1068)
MSRRQQKVFKLFIWILGIFLVAYIAGRPLYWHLNETLNATSYPCPPCHCDCSPQPLLTLPEGLTNNSIVDCMRQDPEESEEVGKSFTDLLAEEVKQKEAEAEEKQRSVDTKLLEAKKLASQYQKEADKCNSGMETCEQARERAEAALENQMKETALWELRARQRGWNKKMLQ

SEQ ID NO: 184539 - protein, 450 aa, Glycine max
  Coding DNA Sequence Number=SeqID_67761
  Gene Ontology: Mol. function=protein dimerization activity; Cellular component=endoplasmic reticulum; Biological process=proteolysis
  Homolog annotation: Hit_ID=Q0GXX4; Match level="QueryCoverage=96%, HitCoverage=97%, E-value=1e-178, Identity=70%"; Hit description =Auxin conjugate hydrolase
  Pfam annotation: Domain name=M20_dimer; Domain location=211-317; Score=40.1; E_value=7.5e-09; Accession=PF07687.4; Description =Peptidase dimerisation domain
  Pfam annotation: Domain name=Peptidase_M20; Domain location=106-424; Score=203.4; E_value=5.3e-58; Accession=PF01546.18; Description =Peptidase family M20M25M40
  Pfam module annotation: Pfam domain module=M20_dimer::Peptidase_M20; Domain location=211-317::106-424
MCCFRKRFNLFFIFLALDATPIFSLTDSSNQLSTNYLENAKKPEVFDWMVKIRRKIHENPELGYEEFETSKLIREELDKLGISYKHPVAVTGVIGYIGTGSSPFVAIRTDMDALPIQEMVEWEHKSKVPGKMHACAHDAHVAMLLGAAKILKQHEKQLQGTIVLVFQPAEEGGAGAKKILDTGALDNVIAIFGLHVKPEIPVGEVASRSGPLLAGSGVFEAIIRGKGGHAALPQLSIDPVMAATNVIISLQNLVSREADPLDPQVLTIAKLQGGDAFNVIPDYVTIGGTFRAFSRETLEHLKQRIEQVIIGQAAVLRCNASVNFFEEENPLYPPTINNGDLHKLFVDVAGNLLGINKVDTNMEQDMAAEDFAFYQEVIPGYYFTLGMKNASSFEPVAPLHSPYLVINEDGLPYGAALHASLATGYLTKYQRGIAKVVGKYHDQFFNCHML

SEQ ID NO: 184540 - protein, 169 aa, Glycine max
  Coding DNA Sequence Number=SeqID_67762
  Gene Ontology: Mol. function=protein binding; Cellular component =intracellular
  Homolog annotation: Hit_ID=Q01FY7; Match level="QueryCoverage=80%, HitCoverage=55%, E-value=4e-36, Identity=58%"; Hit description=[R] KOG3157 Proline synthetase co-transcribed protein
MELGNSCNIIMSFRQDFRISLEVFRIGCIEMIANLLDRAVENVGRKSLKVFFQVNTSGETSKFGVEPAQWVDLVKHITNCPNLEFCGLMTIGMLDYSSTPENFKTLSNCRSEVCKAIGISETQCELSMGMTGDFEQALTLILKIEMGSTNVRNGTAIFGSREYPPKEEE

SEQ ID NO: 184541 - protein, 222 aa, Glycine max
  Coding DNA Sequence Number=SeqID_67763
  Homolog annotation: Hit_ID=Q6H6J8; Match level="QueryCoverage=87%, HitCoverage=46%, E-value=3e-35, Identity=41%"; Hit description=F-box- like
  Subcellular localization annotation: CTP_CleavageSite=42; ConfidenceScore=5.31e-01
MSGLAAACPGSGAPPLSLKLSSTLLFCAATGLLLVMNKIQPSQLAEEQRNATRLFKCLNTKIETTIALRNPTEEDVNDMIEKVLALDRAYPLPLLGGAMLEKFPEKFEPVVWWPNNKTSQPHEGKAKSEKMEQELMNGWSEELEMELREVVEVTKRKDFEDYERLGNMALKINKSLAIIGPLLMGIATIGSVFVDNIGSSSWAYLVTLLAGSSAAVVNSFEH

SEQ ID NO: 184542 - protein, 419 aa, Glycine max
  Coding DNA Sequence Number=SeqID_67764
  Gene Ontology: Mol. function=glutamyl-tRNA reductase activity; Biological process=tetrapyrrole biosynthetic process
  Homolog annotation: Hit_ID=Q9LVD1; Match level="QueryCoverage=70%, HitCoverage=55%, E-value=5e-30, Identity=31%"; Hit description =Arabidopsis thaliana genomic DNA, chromosome 5, P1 clone:MJB24
  Pfam annotation: Domain name=DUF266; Domain location=101-227; Score =175.7; E_value=1.2e-49; Accession=PF03267.4; Description=Arabidopsis protein of unknown function, DUF266
  Subcellular localization annotation: CTP_CleavageSite=51; ConfidenceScore=5.07e-01
MASMARGAKRRHSIISRKMLILFSASLSCVVVLVICSLFRFHSPKPPISISISRVVFDGPPKIAFLFLVRRNLPLDFLWDAFFQNVDVSRFSIYVHSAPGFVLDESTTRSQFLYGRQISNSIQVLWGESSMIQAERLLLAAALEDPANQRFVLLSDRKGWVGLGICLCKLTCSCCVPLYNFSYVYNYLMVSPRSFVDSFLDAKEGRYNPKMSPKIPREKWRKGSQWITVVRKHAEVVVDDDVIFSVFKKYCKRRPPIDTSKGKLNLHSSDSENRTSWSEGLNRKGGSMARQKLQKQHNCIPDEHYVQTLLAMHDLEGELERRTLTYTLWNQSTTKMENKGWHPITFGYSNASPQRIKEIKGINHVYYETEYRIEWCHTNSTSVPCFLFARKFSQGAAMRLLSQEVVNHFEVSALLATPT

SEQ ID NO: 184543 - protein, 755 aa, Glycine max
  Coding DNA Sequence Number=SeqID_67765
  Gene Ontology: Mol. function=hydrolase activity; Cellular component =intracellular; Biological process=metabolic process
  Homolog annotation: Hit_ID=Q9C507; Match level="QueryCoverage=92%, HitCoverage=97%, E-value=1e-117, Identity=30%"; Hit description=PPR -repeat protein, putative
  Pfam annotation: Domain name=PPR; Domain location=128-162; Score =47.0; E_value=6.3e-11; Accession=PF01535.11; Description=PPR repeat
  Pfam annotation: Domain name=PPR; Domain location=226-260; Score =31.2; E_value=3.7e-06; Accession=PF01535.11; Description=PPR repeat
  Pfam annotation: Domain name=PPR; Domain location=261-295; Score=6.5; E_value=1.3; Accession=PF01535.11; Description=PPR repeat
  Pfam annotation: Domain name=PPR; Domain location=327-361; Score =47.1; E_value=5.8e-11; Accession=PF01535.11; Description=PPR repeat
  Pfam annotation: Domain name=PPR; Domain location=362-396; Score=5.5; E_value=1.7; Accession=PF01535.11; Description=PPR repeat
  Pfam annotation: Domain name=PPR; Domain location=428-462; Score =44.2; E_value=4.5e-10; Accession=PF01535.11; Description=PPR repeat
  Pfam annotation: Domain name=PPR; Domain location=463-497; Score=5.7; E_value=1.6; Accession=PF01535.11; Description=PPR repeat
  Pfam annotation: Domain name=PPR; Domain location=529-563; Score =34.2; E_value=4.4e-07; Accession=PF01535.11; Description=PPR repeat
  Pfam annotation: Domain name=PPR; Domain location=564-598; Score =10.1; E_value=0.48; Accession=PF01535.11; Description=PPR repeat
  Pfam annotation: Domain name=PPR; Domain location=62-96; Score=7.0; E_ value=1.1; Accession=PF01535.11; Description=PPR repeat
  Pfam module annotation: Pfam domain module=PPR::PPR::PPR::PPR::PPR::PP R::PPR::PPR::PPR::PPR; Domain location=128-162::226-260::261-295::327- 361::362-396::428-462::463-497::529-563::564-598::62-96
  Subcellular localization annotation: CTP_CleavageSite=30; ConfidenceScore=5.12e-01
MFSYKPKQSPSGLKRCVVSLPHPATTNSVNATINHHSTQGAHHQVLATYASMLKTHVPSDAYTFPSLLKACSFLNLFSLGLTLHQRILVSGLSLDAYIASSLINFYAKFGFADVARKVFDYMPERNVVPWTTIIGCYSRTGRVPEAFSLFDEMRRQGIQPSSVTVLSLLFGVSELAHVQCLHGCAILYGFMSDINLSNSMLNVYGKCGNIEYSRKLFDYMDHRDLVSWNSLISAYAQIGNICEVLLLLKTMRLQGFEAGPQTFGSVLSVAASRGELKLGRCLHGQILRAGFYLDAHVETSLIVVYLKGGKIDIAFRMFERSSDKDVVLWTAMISGLVQNGSADKALAVFRQMLKFGVKPSTATMASVITACAQLGSYNLGTSILGYILRQELPLDVATQNSLVTMYAKCGHLDQSSIVFDMMNRRDLVSWNAMVTGYAQNGYVCEALFLFNEMRSDNQTPDSITIVSLLQGCASTGQLHLGKWIHSFVIRNGLRPCILVDTSLVDMYCKCGDLDTAQRCFNQMPSHDLVSWSAIIVGYGYHGKGEAALRFYSKFLESGMKPNHVIFLSVLSSCSHNGLVEQGLNIYESMTKDFGIAPDLEHHACVVDLLSRAGRVEEAYNVYKKKFPDPVLDVLGIILDACRANGNNELGDTIANDILMLRPMDAGNFVQLAHCYASINKWEEVGEAWTYMRSLGLKKIPGWSFIDIHGTITTFFTDHNSHPQFQEIVCTLKILRKEMIKMEEVEIYLESSHISQ

SEQ ID NO: 184544 - protein, 106 aa, Glycine max
  Coding DNA Sequence Number=SeqID_67766
  Subcellular localization annotation: CTP_CleavageSite=58; ConfidenceScore=5.32e-01
MEFCATLPLSQLPYVYPSTLSSNKAYPFWSCKRRISSRPTRLHCSKMFVPGFGEASPEAKAAENLHNFFTFVAVKIVAAQLEVPSPFAFSFVPHLPIAFRARLYSF

SEQ ID NO: 184545 - protein, 262 aa, Glycine max
  Coding DNA Sequence Number=SeqID_67767
  Gene Ontology: Mol. function=protein dimerization activity; Cellular component=endoplasmic reticulum; Biological process=proteolysis
  Homolog annotation: Hit_ID=Q0GXX4; Match level="QueryCoverage=99%, HitCoverage=51%, E-value=1e-72, Identity=56%"; Hit description=Auxin conjugate hydrolase
  Pfam annotation: Domain name=M20_dimer; Domain location=1-102; Score =19.2; E_value=0.0021; Accession=PF07687.4; Description=Peptidase dimerisation domain
  Pfam annotation: Domain name=Peptidase_M20; Domain location=10-242; Score=-18.9; E_value=0.024; Accession=PF01546.18; Description =Peptidase family M20M25M40
  Pfam module annotation: Pfam domain module=M20_dimer::Peptidase_M20; Domain location=1-102::10-242
SGVFEAIIRGKGGHAALPQLSIDPVMAATNGIISLQNLVSRKAGPLDPQVLTVAKLQGGAAFDVIPDYVIIGGTFRALSREALKHLKQRIEQDYDYEFKGDPIHNCNVAFKFITVVGAKADSYMQVIIGQAAVLRCNASVNFLDEEKPLYPPTIKNDDLHKVFVDVAGNLIGIYNVNIDMQTDMAAEDFAFYQEAIPGYYFTLGMKNASSIETVAPLHSPYLVINEDGLPYGAALHASLATDYLTKYKQDVARVVGKYHGQL

SEQ ID NO: 184546 - protein, 223 aa, Glycine max
  Coding DNA Sequence Number=SeqID_67768
  Homolog annotation: Hit_ID=UPI000034F5B3; Match level="QueryCoverage =25%, HitCoverage=7%, E-value=2e-08, Identity=42%"; Hit description =transcription factor
  Pfam annotation: Domain name=C1_4; Domain location=132-171; Score= -5.7; E_value=0.011; Accession=PF07975.2; Description=TFIIH C1-like domain
MSCVKNSTALGIELSVVLGERSNQCTDNLTYKIPRRPRDFGSSKKRKVQDIIKSKSMGEDVLVCSKRTELPFRKWLEAKKCLTSLKKKRKLENNILINNLEDNKVYVPSKTNSRSKARKMDDVKDTEQTSRRCHQCMKKERAAYVPCTKCQKIFPDLSIEDIAQECPFCQKNCNCNVCLSSRGMIKVNILTHTAEVTLTDEQNSVISKLKKAHIAQDEKEHRA

SEQ ID NO: 184547 - protein, 213 aa, Glycine max
  Coding DNA Sequence Number=SeqID_67769
  Gene Ontology: Mol. function=protein serine/threonine kinase activity; Cellular component=membrane; Biological process=protein amino acid phosphorylation
  Homolog annotation: Hit_ID=Q6ZD33; Match level="QueryCoverage=100%, HitCoverage=37%, E-value=2e-88, Identity=73%"; Hit description =Receptor protein kinase PERK1-like protein
  Pfam annotation: Domain name=Pkinase; Domain location=1-211; Score =6.8; E_value=5.7e-09; Accession=PF00069.15; Description=Protein kinase domain
  Pfam annotation: Domain name=Pkinase_Tyr; Domain location=1-200; Score=-1.8; E_value=2.3e-12; Accession=PF07714.7; Description =Protein tyrosine kinase
  Pfam module annotation: Pfam domain module=Pkinase::Pkinase_Tyr; Domain location=1-211::1-200
MDMQASNEFLAELKVLTHVHHLNLGSLFLVYEYIENGYLSQHLRGSGRDPLTWAARVQIALDAARGLEYIHEHTVPVYIHRDIKSANILIDKNFRAKVADFGLTKLTEYGSSSLHTRLVGTFGYMPPEYAQYGDVSSKIDVYAFGVVLYELISGKEAIVKINEPENESKGLVSLFEEVLGLSDPNEDPRQLVDPRLGDKFPLDSVFKVSQLAK

SEQ ID NO: 184548 - protein, 36 aa, Glycine max
  Coding DNA Sequence Number=SeqID_67770
DCRLLAADDGIRDILKENLPYQIHLLVKDDVSHFPP

SEQ ID NO: 184549 - protein, 139 aa, Glycine max
  Coding DNA Sequence Number=SeqID_67771
  Gene Ontology: Mol. function=protein dimerization activity; Cellular component=endoplasmic reticulum; Biological process=proteolysis
  Homolog annotation: Hit_ID=Q0GXX4; Match level="QueryCoverage=92%, HitCoverage=24%, E-value=1e-39, Identity=65%"; Hit description=Auxin conjugate hydrolase
MVKIRRKIHENPELRYEEFETSKLIREELDKLGIPYKHPVAVTGVIGFIGTGGSPFVAVRADMDALPIQDFDIFLIIDGWFIWVTGLKEMVEWEHKSKVPGKMHGCGHDAHLTMLLGAAKILKQYEKEIQVNLHFILSS

SEQ ID NO: 184550 - protein, 197 aa, Glycine max
  Coding DNA Sequence Number=SeqID_67772
  Gene Ontology: Mol. function=protein dimerization activity; Cellular component=endoplasmic reticulum; Biological process=proteolysis
  Homolog annotation: Hit_ID=Q0GXX4; Match level="QueryCoverage=99%, HitCoverage=39%, E-value=3e-62, Identity=63%"; Hit description=Auxin conjugate hydrolase
  Pfam annotation: Domain name=Peptidase_M20; Domain location=7-177; Score=-9.7; E_value=0.0065; Accession=PF01546.18; Description =Peptidase family M20M25M40
KFQGGNAFNVIPDSVTIGGTFRAFSKESFQQLRQRIEQEGEARFEGAFSKKGKRVGVATKVYVVIAQAAVLRCNATVNFFEGEKPFFPATINNNDLHEHFGTVAVNLLGINKVNDMPPLMGAEDFSFYQEVMPGYFAFIGIQNPSHEKLEQVHSPYFKINEDVLPYGAALHASLAVSYLLKHPQDVPSAEGKHHDEL

SEQ ID NO: 184551 - protein, 313 aa, Glycine max
  Coding DNA Sequence Number=SeqID_67773
  Gene Ontology: Mol. function=protein dimerization activity; Cellular component=endoplasmic reticulum; Biological process=proteolysis
  Homolog annotation: Hit_ID=Q0GXX4; Match level="QueryCoverage=99%, HitCoverage=70%, E-value=1e-131, Identity=74%"; Hit description =Auxin conjugate hydrolase
  Pfam annotation: Domain name=M20_dimer; Domain location=93-199; Score= 36.2; E_value=1.1e-07; Accession=PF07687.4; Description=Peptidase dimerisation domain
  Pfam annotation: Domain name=Peptidase_M20; Domain location=2-306; Score=160.8; E_value=3.5e-45; Accession=PF01546.18; Description =Peptidase family M20M25M40
  Pfam module annotation: Pfam domain module=M20_dimer::Peptidase_M20; Domain location=93-199::2-306
MVEWEHKSKVPGKMHACGHDAHVTMLLGAANILKQHEKEIQGTVVLVFQPAEEGGGGAKKILDAGALENVTAIFGLHVVPLIPVGTAASRSGPLTAGSGFFEAKISGKGGHAAIPQLSIDPILAASNVIISLQHLVSREADPLDPRVVTVSKIQGGDAFNVIPDYATIGGTYRGFTNKSMDQLKLRIKQVIIGQAAVQRCNATVNFFENVGPANPPTVNNGDLHKHFQNVAENVLGVNNVNLNMPPFMVAEDFAFYQEVIPGYFFTLGMKYASPNEPFQSLHSPYLRINEDGLPYGAALHASLATSYLIKLQQ

SEQ ID NO: 184552 - protein, 602 aa, Glycine max
  Coding DNA Sequence Number=SeqID_67774
  Gene Ontology: Mol. function=protein kinase activity; Cellular component=integral to membrane; Biological process=protein amino acid phosphorylation
  Homolog annotation: Hit_ID=Q6R2J8; Match level="QueryCoverage=97%, HitCoverage=77%, E-value=0.0, Identity=65%"; Hit description =Strubbelig receptor family 8
  Pfam annotation: Domain name=LRR_1; Domain location=27-49; Score =12.6; E_value=1.3; Accession=PF00560.23; Description=Leucine Rich Repeat
  Pfam annotation: Domain name=LRR_1; Domain location=3-25; Score=9.4; E_value=4.9; Accession=PF00560.23; Description=Leucine Rich Repeat
  Pfam annotation: Domain name=LRR_1; Domain location=51-72; Score =11.5; E_value=2; Accession=PF00560.23; Description=Leucine Rich Repeat
  Pfam annotation: Domain name=LRR_1; Domain location=73-95; Score=5.5; E_value=26; Accession=PF00560.23; Description=Leucine Rich Repeat
  Pfam annotation: Domain name=Pkinase; Domain location=265-568; Score =112.2; E_value=1.5e-30; Accession=PF00069.15; Description=Protein kinase domain
  Pfam annotation: Domain name=Pkinase_Tyr; Domain location=265-568; Score=73.1; E_value=8.7e-19; Accession=PF07714.7; Description =Protein tyrosine kinase
  Pfam module annotation: Pfam domain module=LRR_1::LRR_1::LRR_1::LRR _1::Pkinase::Pkinase_Tyr; Domain location=27-49::3-25::51-72::73 -95::265-568::265-568
  Subcellular localization annotation: CTP_CleavageSite=79; ConfidenceScore=5.00e-01
MGSLNYLNLSNNALSMTVGDIFASLQDLGTLDLSFNNFSGDLPPSVGALANLSSLFLQKNQLTGSLSALVGLPLDTLNVANNNFSGWIPHELSSIHNFIYDGNSFENRPAPLPPTVTSPPPSGSHRRHHSGSGSHNKTQASDNEKSNGHKGLTVGAVIGIVLGSVLVAAIVFLALVFCIRKQKGKKKGARNFSGSLPRGVINVTPQMQEQRVKSAAVVTDLKPRPAENVTVERVAVKSGSVKQMKSPITSTSYTVASLQSATNSFSQEFIIGEGSLGRVYRADFPNGKVMAIKKIDNSALSLQEEDNFLEAVSNMSRLRHPNIVTLAGYCAEHGQRLLVYEYIANGNLHDMLHFAEDSSKDLSWNARVRIALGTARALEYLHEVCLPSVVHRNFKSANILLDEELNPHLSDCGLAALTPNTERQVSTQMVGSFGYSAPEFALSGVYTVKSDVYSFGVVMLELLTGRKPLDSSRVRSEQSLVRWATPQLHDIDALAKMVDPTLNGMYPAKSLSRFADIIALCVQVKGNAEIWDKSKNECIRGKVEVAWTVLLEPEPEFRPPMSEVVQALVRLVQRASVVKRRPSEESGFGHKTPDHDAMDMSF

SEQ ID NO: 184553 - protein, 127 aa, Glycine max
  Coding DNA Sequence Number=SeqID_67775
  Gene Ontology: Mol. function=structural constituent of ribosome; Cellular component=intracellular; Biological process=translation
  Homolog annotation: Hit_ID=Q2R1Z9; Match level="QueryCoverage=98%, HitCoverage=44%, E-value=2e-51, Identity=79%"; Hit description =Ribosomal protein L4/L1 family protein, expressed
  Pfam annotation: Domain name=Ribosomal_L4; Domain location=2-124; Score=36.8; E_value=4.4e-08; Accession=PF00573.12; Description =Ribosomal protein L4L1 family
MVLPGDVFDLPIRKDIIHRVVRWQLAKRQQGTHSTKTISEVSGTGRKPWNQKGTGRARHGSLRGPQFRGGATMHGPKPRSHAFKVNKKVRRLGLKIALSARAAEGKASLLPNPCPHSPSKNKKCYLP

SEQ ID NO: 184554 - protein, 173 aa, Glycine max
  Coding DNA Sequence Number=SeqID_67776
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=85%, HitCoverage=39%, E-value=4e-86, Identity=99%"; Hit description =Homeobox protein SBH1
  Pfam annotation: Domain name=ELK; Domain location=55-76; Score=37.7; E_value=4.1e-08; Accession=PF03789.4; Description=ELK domain
  Pfam annotation: Domain name=Homeobox; Domain location=86-137; Score =4.1; E_value=0.0019; Accession=PF00046.19; Description=Homeobox domain
  Pfam module annotation: Pfam domain module=ELK::Homeobox; Domain location=55-76::86-137
MEWNNASHWRPALYPMHQFKCKLSWASNEGGDRNGSSEEDVDLHNMIDPQAEDRDLKGQLLRKYSGYLGSLKQEFMKKRKKGKLPKEARQQLLEWWNRHYKWPYPSESQKLALAESTGLDQKQINNWFINQRKRHWKPSEDMQFVVMDPSHPHYYMDNVLGNPFPMDLSHPML

SEQ ID NO: 184555 - protein, 78 aa, Glycine max
  Coding DNA Sequence Number=SeqID_67777
MEEGYSTNKPLLLKGVKCDYWKECLIAHFESIHIDLWDVAQNDLMATSWMTEANLYRMANTTSEESNEEVNLNNLETL

SEQ ID NO: 184556 - protein, 211 aa, Glycine max
  Coding DNA Sequence Number=SeqID_67778
  Homolog annotation: Hit_ID=Q9LT25; Match level="QueryCoverage=72%, HitCoverage=18%, E-value=4e-32, Identity=48%"; Hit description =Similarity to transcription factor CA150b
  Pfam annotation: Domain name=FF; Domain location=101-150; Score=41.4; E_value=3e-09; Accession=PF01846.10; Description=FF domain
  Pfam annotation: Domain name=FF; Domain location=33-83; Score=15.4; E_ value=0.053; Accession=PF01846.10; Description=FF domain
  Pfam module annotation: Pfam domain module=FF::FF; Domain location =101-150::33-83
AIPSYSARRSLFEHYVKTRAEEERKEKRAALKAAIEGFKRLLDEASEDINYNTDYQTFRKKWRNDPRFEALDRKEQEHLLNERVLPLKKAAEEKAQAMRAAAAASFKSMLKERGDISFNSRWSRVKENLRDDPRYKCVRHEDREVLFNEYISELKAAEHAAERETKAKREEQVLAAKYLKLKLVYRTSSGKENGSCAKERKEKNRKWKGCD

SEQ ID NO: 184557 - protein, 91 aa, Glycine max
  Coding DNA Sequence Number=SeqID_67779
  Gene Ontology: Mol. function=ribonuclease H activity; Biological process=DNA integration
  Homolog annotation: Hit_ID=Q1S8I9; Match level="QueryCoverage=97%, HitCoverage=18%, E-value=1e-28, Identity=65%"; Hit description =Probable integrase-common tobacco
MTVSYKDWHEMLPFALHGYRTSVCTLIGATPFSLVYRMEVVLLFEVEVPSLRILVESGLEESEWAQTHFDQLNLMEGNRLAAMSHVRFYKI

SEQ ID NO: 184558 - protein, 144 aa, Glycine max
  Coding DNA Sequence Number=SeqID_67780
  Homolog annotation: Hit_ID=Q6CQF3; Match level="QueryCoverage=39%, HitCoverage=59%, E-value=2e-08, Identity=72%"; Hit description =Kluyveromyces lactis strain NRRL Y-1140 chromosome D of strain NRRL Y- 1140 of Kluyveromyces lactis
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRVFLTATLE

SEQ ID NO: 184559 - protein, 89 aa, Glycine max
  Coding DNA Sequence Number=SeqID_67781
MFGFGYDPSSDKYKVVAIALTMLSLDVFEKTEMKVYGAGDSSWRNLKEKSMILPLCMSNNGDFFMLKFTRNADDEYQTILYNQGDDVSS

SEQ ID NO: 184560 - protein, 95 aa, Glycine max
  Coding DNA Sequence Number=SeqID_67782
IAPAGHPVDPKKSNRVLGLPALITGLCQFYGVSVTPSKVIRPPTNRAFIKKYCAPRQAEGETPQQPGDGQQQATNAPSPPAEPLSSSTKRLEYCL

SEQ ID NO: 184561 - protein, 55 aa, Glycine max
  Coding DNA Sequence Number=SeqID_67783
MDKSLNKLNFSEAASSLSECKTLEDDKSETIPLSVHSARPARKLSLLTLSAPRLA

SEQ ID NO: 184562 - protein, 264 aa, Glycine max
  Coding DNA Sequence Number=SeqID_67784
  Gene Ontology: Mol. function=RNA-directed DNA polymerase activity; Cellular component=intracellular; Biological process=RNA-dependent DNA replication
  Pfam annotation: Domain name=rve; Domain location=137-263; Score =69.5; E_value=1e-17; Accession=PF00665.16; Description=Integrase core domain
MYEVSHRNNLPTIRIQRLERPAHVFAVEEVVDDKPWFHDIKCFLQSQEYPPGASNKDRRTLRRLSDKQEAEFLMHEVHEGSFGTHSNGHAMARKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKD

SEQ ID NO: 184563 - protein, 320 aa, Glycine max
  Coding DNA Sequence Number=SeqID_67785
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=72%, HitCoverage=61%, E-value=3e-84, Identity=69%"; Hit description =Homeobox protein SBH1
  Pfam annotation: Domain name=KNOX1; Domain location=122-166; Score =92.5; E_value=1.3e-24; Accession=PF03790.4; Description=KNOX1 domain
  Pfam annotation: Domain name=KNOX2; Domain location=175-226; Score =109.7; E_value=8.2e-30; Accession=PF03791.4; Description=KNOX2 domain
  Pfam module annotation: Pfam domain module=KNOX1::KNOX2; Domain location=122-166::175-226
MEGGSSSSNGTSYLLAFGENNSGGLCPMTMMPLVTSHHAGHHPINPSNNNNVNTNCLFIPNCSNSTGTPSIMLHNNHNNNKTDDDDNNNNTGLGYYFMESDHHHHHHGNNNNNGSSSSSSSSAVKAKIMAHPHYHRLLAAYVNCQKVGAPPEVVARLEEACASAATMAGGDAAAGSSCIGEDPALDQFMEAYCEMLTKYEQELSKPLKEAMLFLQRIECQFKNLTISSSDFGDDPLPLSIFYLLKYSAYLKSLAGFASFILLKVLLEMNTEMDECAECSLLVNLGLWLFPGVVRLDTLIGNVICRRKSGRKELKFFGDKW

SEQ ID NO: 184564 - protein, 67 aa, Glycine max
  Coding DNA Sequence Number=SeqID_67786
MDIMCRNNISQGYGSSFAKPTLLVYLLFPRSSKKGLEQQEELHDQKSTQLLKASRIAALPKSELSYR

SEQ ID NO: 184565 - protein, 108 aa, Glycine max
  Coding DNA Sequence Number=SeqID_67787
MTSEAAKEIANKIDAFEEQASQGSFVAHGRHDVLTTAIGRPEHPGRVRVAGASVTIKQYFGLASRTSYTSSSMAPKDLHQLKQQIRDQLEDSFTEKVTRQLMLSFSLI

SEQ ID NO: 184566 - protein, 83 aa, Glycine max
  Coding DNA Sequence Number=SeqID_67788
MRVFHMKELGRGVEWKILKARERSPKGERAHEKNRRLAAKGSVATTAETIIWAWTCFSWSRVVHLSDMSARVARVLCSGGGLK

SEQ ID NO: 184567 - protein, 134 aa, Glycine max
  Coding DNA Sequence Number=SeqID_67789
  Gene Ontology: Mol. function=binding; Cellular component =intracellular; Biological process=metabolic process
  Homolog annotation: Hit_ID=Q2R484; Match level="QueryCoverage=91%, HitCoverage=47%, E-value=8e-29, Identity=44%"; Hit description =Pentatricopeptide repeat-containing protein, putative
  Pfam annotation: Domain name=PPR; Domain location=77-111; Score=34.0; E_value=5.3e-07; Accession=PF01535.11; Description=PPR repeat
MRRSNVLPGKHTFPFLLKACARVRSFTASQQVHVHVIKFGLDFDSHVVDALVRCYSVSGHCVSARQVFDETPEKISSLWTTMVCGYAQNFCSNEALRLFEDMVGEGFEPGGATLASVLSACARSGCLELGGKDS

SEQ ID NO: 184568 - protein, 806 aa, Glycine max
  Coding DNA Sequence Number=SeqID_67790
  Gene Ontology: Mol. function=RNA binding; Cellular component =spliceosome; Biological process=protein modification process
  Homolog annotation: Hit_ID=Q1SIS0; Match level="QueryCoverage=99%, HitCoverage=100%, E-value=0.0, Identity=70%"; Hit description =SWAP/Surp; Ubiquitin
  Pfam annotation: Domain name=Surp; Domain location=195-239; Score =66.1; E_value=1.2e-16; Accession=PF01805.10; Description=Surp module
  Pfam annotation: Domain name=Surp; Domain location=70-114; Score =71.5; E_value=2.7e-18; Accession=PF01805.10; Description=Surp module
  Pfam annotation: Domain name=ubiquitin; Domain location=732-801; Score=38.6; E_value=2.1e-08; Accession=PF00240.13; Description =Ubiquitin family
  Pfam module annotation: Pfam domain module=Surp::Surp::ubiquitin; Domain location=195-239::70-114::732-801
MMLGSLPILPLPAPPSDGNLGPLPESQVIDDNEEEQNKSNSASVPAPATVATHTRTIGIIHPPPDIRTIVDKTSQFVAKNGPEFEKRIIANNTGNVKFNFLNSSDPYHAYYQHRLSEFRAQNQSSGQQQPADSAAVPESVPSDSNGVVAAAAAAAEKPDFSAQFKPVRKVLEPPEAEQYTVRLPEGITGEELDIIKLTAQFVARNGKSFLTGLTSREVNNPQFHFLKPTHSMFTFFTSLADAYSKVLMPPKGLMEKLKNSVSDMTTVLERCVNRLEWDRSQEQARQKAEDEIEQERIQMAMIDWHDFVVVETIDFADDEDQELPPPMTIEEVIRRSKVTAMEEEDIVEPGKEVEMEMDEEEAQLVEEGMRAASLEDRDDRKQNEVRVTEDPEPPMRIVKNWKRPEERISAERDSTKFVVSPITGELIPISEMSEHMRISLIDPKYKEQKERMFAKIRETTLAADDEISRNIVGLARTRPDIFGTTEEEVSNAVKAEIEKINDEQPKQVIWDGHTGSIGRTANQAMSQNIGNEDQNDASNNEARNFLGPAAPPPRPGMPSVRPLPPPPGLALNLPRVPVQYSAPHSGALPMPPPRPMMPSIRPAPPPPMPMNTGQQSVMAGQPPPMHPSIPMNNQGIPIPPPPGSHFTHVPVPRPFVPLSVPQSVMPMMHPPPLPQGVPPPLPPEEAPPPLPEEPEPKRQKLDDSALIPEDQFLAQHPGPVRISVSVPNVDEGNLKGQVLEITVQSLSETVGSLKEKIAGEIQLPANKQKLSGKPGFLKDNMSLAHYNVGGGETLTLSLRERGGRKR

SEQ ID NO: 184569 - protein, 186 aa, Glycine max
  Coding DNA Sequence Number=SeqID_67791
  Gene Ontology: Mol. function=methyltransferase activity; Cellular component=intracellular; Biological process=protein kinase C activation
  Homolog annotation: Hit_ID=Q2R484; Match level="QueryCoverage=98%, HitCoverage=38%, E-value=7e-42, Identity=49%"; Hit description =Pentatricopeptide repeat-containing protein, putative
  Pfam annotation: Domain name=PPR; Domain location=145-179; Score=6.2; E_value=1.4; Accession=PF01535.11; Description=PPR repeat
  Pfam annotation: Domain name=PPR; Domain location=43-77; Score=11.7; E_value=0.3; Accession=PF01535.11; Description=PPR repeat
  Pfam annotation: Domain name=PPR; Domain location=7-41; Score=43.3; E_ value=8e-10; Accession=PF01535.11; Description=PPR repeat
  Pfam annotation: Domain name=PPR; Domain location=79-113; Score=6.1; E_value=1.4; Accession=PF01535.11; Description=PPR repeat
  Pfam module annotation: Pfam domain module=PPR::PPR::PPR::PPR; Domain location=145-179::43-77::7-41::79-113
MPERNVVTWNAMICGLGAYGYVDDALGLFEKMKKEGVVVPNGVTFVGVLSACCHAGLIDVGREIFRSMKSVYGIEPKIEHYGCLVDLLGRGGWLLEAVELVKGMPWKADVVILGTLLAASRISGNTEVAERVVKDILALEPQNHGVHVALSNMYAEAGQWQEVLRLRKTMKEERLKKAPGWSLVAT

SEQ ID NO: 184570 - protein, 95 aa, Glycine max
  Coding DNA Sequence Number=SeqID_67792
MSDHELLASGESIKERESDDVVCGDSSSSSRSGEMGSVWLEATYTVPSSRQRSDSFGTLTGTRSQPYDLQNRSGQLRFDPVPSKDKPCAELLGFR

SEQ ID NO: 184571 - protein, 74 aa, Glycine max
  Coding DNA Sequence Number=SeqID_67793
MEQKLKAKVVVQTCYYELGTGLESLFSTLEVEHVSLSYVITWCYHTICNNLPELLGSQEILHQHAPMIIMTIKT

SEQ ID NO: 184572 - protein, 220 aa, Glycine max
  Coding DNA Sequence Number=SeqID_67794
  Homolog annotation: Hit_ID=Q2R3X6; Match level="QueryCoverage=53%, HitCoverage=45%, E-value=3e-25, Identity=49%"; Hit description =Expressed protein
DKKNAENNNEEKEKVKKKERKSGSGSGASSAELNINIWPFSRSRSAGNAGTRPKLFAGAPVTRKVNSAPCSRSNSAGESKSRKWPSSPGRAGVHVGRSSPVWQVRRKNSNEPPQKPKTRRSKVAAGGGTARVLNLNVPMCIGYRHHLSCRSDENSAVGVSGSAAAVINCNSNNNNTNNNNSGGNDGGSGGNIFNLRNLFTKKCAGLDFCIRKATVSLFIL

SEQ ID NO: 184573 - protein, 120 aa, Glycine max
  Coding DNA Sequence Number=SeqID_67795
MALTQDPDTNVFDHHPKKSVPCMTPLPCAGGDAPGWGRLHAPMTASHEPYAAPRTAPTSSTPPPLFDDPVAKPSSFYSAANANVDFDPNYYNRFLLHDFSDICLSKTNAIKKSLDLLLLH

SEQ ID NO: 184574 - protein, 178 aa, Glycine max
  Coding DNA Sequence Number=SeqID_67796
MVKEECKEVSVSSKSLAKKESHLAIKTNLKETSPLRQPPHLLLCKKTLVSIATPLGKKTFIGDMMNVLSGAALFCKITHAPNIFMIHVHRDSLGRNNQHENTERDQGVPTYPKRIKVITACKHINIDYLQYVSPVYILDYMSSVYKVPLVGMCHHDYWPPYEGPQFCANLAMRRNKKG

SEQ ID NO: 184575 - protein, 115 aa, Glycine max
  Coding DNA Sequence Number=SeqID_67797
PRDHTLADSESGLGYATEGLAFDGLSLPNTLGDPQYRPQPQPFHFVVGRVPPAMVEREKLDHIEERLRVIEGGRNYAFADMAKLCLVPDVVIPPKFKVSNFDKYKGTTCPKNHLK

SEQ ID NO: 184576 - protein, 92 aa, Glycine max
  Coding DNA Sequence Number=SeqID_67798
KNYTFGTSDDGAWMTVLQEKPREEGIKKLREKLRRRENEKMTSPWTSPRSAQVRGLPVSPLNPWFENPTNYNTLRIPLNPDLSLLACDILSI

SEQ ID NO: 184577 - protein, 89 aa, Glycine max
  Coding DNA Sequence Number=SeqID_67799
  Subcellular localization annotation: CTP_CleavageSite=73; ConfidenceScore=5.01e-01
EENCFRGKNPSRGASVTLLRRFRERFHEDSSSFFTVLHLLHRSSFVLRRSSVFNWKGPVTRAMSKRLQEDWARAAEEGPRVLMNLRADF

SEQ ID NO: 184578 - protein, 191 aa, Glycine max
  Coding DNA Sequence Number=SeqID_67800
MLAAATSASRHLLQRDARIGACSGSGNRVRSLLTASAITTTYPIRIRKCYSDGYGISFNNPKHRTRPSLLFAVKGFLSDSSNSNSPHGRVTRPYLPHLLIDYLKKNNLVDLSYVHGIGCRRAGLQHLAPLCLPEYQTLSFSLSLSLMQVQSHFNNRALKNDVYQCSEFRLRASFYLDSKVRLCHSSEFTSK

SEQ ID NO: 184579 - protein, 401 aa, Glycine max
  Coding DNA Sequence Number=SeqID_67801
  Gene Ontology: Mol. function=carbohydrate binding
  Homolog annotation: Hit_ID=Q6ZLH2; Match level="QueryCoverage=76%, HitCoverage=57%, E-value=7e-95, Identity=54%"; Hit description =Lipase-like protein
  Pfam annotation: Domain name=DUF620; Domain location=133-398; Score =563.7; E_value=1.8e-166; Accession=PF04788.3; Description=Protein of unknown function (DUF620)
MGSRARWRQSWAPQPLTPLMEGPGPEMQEEGTKKESSWEVIREWFRTQKISPSGSFSQSSSSFYGTIHAKTQDLRLLLGVLGCPLAPIPSAHDPTLSIHIKDTPFETSTAKYIIQQYLAATGCLKQQKDTKNMYATGMVKMICCETEISSGKNVKCLGTRSSENGCFVLWQMQPGMWSLELVVGDHKVVAGSNGKTVWRHTPWLGTHAAKGPQRPLRRLIQLMSHDLGIATYCRLLRGLDPKTTASLFTNAQCLGENRIGTVDCFVLKVSADRAAVVERSEGPAEVIRHILYGYFCQKSGLLIYLEDSHLTRVPTQDNDTVYWETTIGSSIGDYRDVDGILIAHQGRSVATVFRFGELSMQHSRTRMEEIWTIDDVMFNVPGLSMDHFIPPADIFDNINSP

SEQ ID NO: 184580 - protein, 555 aa, Glycine max
  Coding DNA Sequence Number=SeqID_67802
  Subcellular localization annotation: CTP_CleavageSite=43; ConfidenceScore=5.41e-01
MASKSNNKTPPDPMISSGHTLIPAIRRRRKHRNPGIAVAFRLKGAHKKHSASNNNSSPVNFGEGFQKSEEASARKLAAGLWQWRFMNGTVFRYAPSLPPSKSQLESSTPCLKYCSKEEATKWNPALNNEAFNKFTMLYSMKHLEKKQIVGDCYFGVTNLLELLRAQRSINELKATQKSSRKRGEQFLQNLEDKKVLRKCRECHKIETTFDNIKDKLAREKRSRERMELFNTKLVHELAKTKTSAKQYMTNYKKEKRERKVIEEVCNELAMKVREDTAKLEMLLRDSVKICKVVEEEREMMEMTELWREERMQMKLADAQFVLEDKYNQMVQLIAFLQVFLRSRGAELDTTELEDVELIKQAVESVNIKRIVELSYDFSKSSDDAVSTSEELRKENTEEELNKSPILHHNSPSSDYYIELELNNNGYLEDQKFNSMPQRGDTDTYSVNVNQDKDMLLGSEAECSEKACLEPLKSSKVCLTSKQLIRSCPNGGRTISSTKSSQDRRLGDDGWHKQKECNQRLPTSSVQCQSSVEGSFKHTEEQDKTHLKIKQLKLKL

SEQ ID NO: 184581 - protein, 163 aa, Glycine max
  Coding DNA Sequence Number=SeqID_67803
MEMDFGSEENASIVYAALAVDKELQPDKGLICIPDRYLAWCIRVLLGAPSIFAGAPSAVKVKVRCGGQRRQTRYTEGGGCVANMNEDEWMYEIMSEQADMDYENEEACGANEPYVDCSNAFNTSQVFECREDVLRWARFVAHENRFVTVILRSDTNIGSRGRT

SEQ ID NO: 184582 - protein, 188 aa, Glycine max
  Coding DNA Sequence Number=SeqID_67804
  Gene Ontology: Mol. function=zinc ion binding
  Homolog annotation: Hit_ID=Q2HTH7; Match level="QueryCoverage=89%, HitCoverage=61%, E-value=5e-40, Identity=53%"; Hit description=Zinc finger, RING-type
MSQLGAVLRTQREPRRSTILGLLTEQMDGVDSGTRRRRSFKERFGFIGMGCCGATWGFRSDALSVTQGEQQQQETDPECVGPAGLGSGMNLAAALAAERQLRGPQEEAVRAPGTPWRVSLMRLLEETEAEKEKEKEKEENVVGNDSVCCVCMGRKKGAAFIPCGHTFCRYKFVRPCASLTCGRSSVFT

SEQ ID NO: 184583 - protein, 113 aa, Glycine max
  Coding DNA Sequence Number=SeqID_67805
MWKHLGLIRVFVTRFLEAKNRQKFLFIRNTWIKSFREYSQQQSFIIHSRSALGESKDEPIYSNYDAHLAGDDSDAYKRALAAAHIVNPAVSALNRKISLLRYIAVLATNKFTD

SEQ ID NO: 184584 - protein, 222 aa, Glycine max
  Coding DNA Sequence Number=SeqID_67806
  Gene Ontology: Mol. function=zinc ion binding; Cellular component =cytoplasm; Biological process=ubiquitin cycle
  Homolog annotation: Hit_ID=Q1SYI9; Match level="QueryCoverage=84%, HitCoverage=60%, E-value=3e-65, Identity=64%"; Hit description=Zinc finger, RING-type; Zinc finger, CHY-type
  Pfam annotation: Domain name=zf-C3HC4; Domain location=138-172; Score= 15.2; E_value=0.0042; Accession=PF00097.15; Description=Zinc finger, C3HC4 type (RING finger)
  Pfam annotation: Domain name=zf-CHY; Domain location=14-87; Score =14.3; E_value=3.2e-05; Accession=PF05495.3; Description=CHY zinc finger
  Pfam module annotation: Pfam domain module=zf-C3HC4::zf-CHY; Domain location=138-172::14-87
MRQNLTFIGELAVYYYVFLQNDINIDLKLRHDIPRHEVKQVICSLCGTEQELKFSSPDFNFFQVQQNCINCGVCMGKYFCGTCKLFDDDISKQQYHCCGCGICRLCIKFRLIDFDIFSLDTELEEAKISSIATSVYLFESRNDVTVMPCGHTIHKSCLNEMREHFQYACPLCSKSVCDMSKVWEKFDLEIAATRMPEQYQNKMVSVLFQHDYGYYMLVIPAN

SEQ ID NO: 184585 - protein, 139 aa, Glycine max
  Coding DNA Sequence Number=SeqID_67807
MSLFLISQVGQLATQLSEHGSGSFSVNTQVNPKEQCNSITTRWGIVVDLKDNGEKKNKGVEKEKVKNVGQLATQLSEHGSGSFSVNTQVKNDEVVTSEKMEEKVSYHCMAWGQAYFSGGGIADEDEDMEDPIDYFIVGN

SEQ ID NO: 184586 - protein, 37 aa, Glycine max
  Coding DNA Sequence Number=SeqID_67808
MVKGNAGLPIKVIFLTLSSNFMSVFCEEELERLLMLH

SEQ ID NO: 184587 - protein, 133 aa, Glycine max
  Coding DNA Sequence Number=SeqID_67809
  Gene Ontology: Mol. function=RNA-directed DNA polymerase activity; Biological process=RNA-dependent DNA replication
  Homolog annotation: Hit_ID=Q1S4N5; Match level="QueryCoverage=50%, HitCoverage=13%, E-value=6e-18, Identity=59%"; Hit description =Peptidase M, neutral zinc metallopeptidases, zinc-binding site
MDSNFFFYHTYWDVVGIKVWEMIVHSFHSSTINPALVETLIVPIPKVDNPMSLKDFRPIGLCNVILKAISKILEFMRLTLSEFGFPSYKKNLMMNCVISTSLALRWKNEMIVCFYLSQDFSGEDGSKGIRHVL

SEQ ID NO: 184588 - protein, 225 aa, Glycine max
  Coding DNA Sequence Number=SeqID_67810
  Homolog annotation: Hit_ID=Q1SU57; Match level="QueryCoverage=34%, HitCoverage=57%, E-value=2e-10, Identity=35%"; Hit description=Zinc finger, CCHC-type
MVWIRFPGHNFYFYDESILLALSFAVGSPVKVDVKALDARRGLHRICSSYGCYGHLTRDYKTQPASNNDLKQQQPQPGQEATIKKEKNQAKDTLVVGSKVVFTIPAKPTMSSPHVTTTTNSNHKMVAKNKCHRKEPDFPMWQLLINTKNEASTSKAGSSSINSNQIFPTPKIQEVSGIVSTVNLQQLAGNFIVVVHDDNVQQTTMEVSNVLVPDNICNDVTDDTM

SEQ ID NO: 184589 - protein, 59 aa, Glycine max
  Coding DNA Sequence Number=SeqID_67811
MPFAFWFFLESMSSSITVTMVTKMTTIDNDDSYNSDHDGDNNNHKSYDIDGRDNDDGLR

SEQ ID NO: 184590 - protein, 431 aa, Glycine max
  Coding DNA Sequence Number=SeqID_67812
  Homolog annotation: Hit_ID=Q6V8P1; Match level="QueryCoverage=25%, HitCoverage=77%, E-value=2e-17, Identity=45%"; Hit description =Putative senescence-associated protein SAG102
  Pfam annotation: Domain name=DUF581; Domain location=327-380; Score =83.9; E_value=4.8e-22; Accession=PF04570.5; Description=Protein of unknown function (DUF581)
MLRKRTRSIQKDQHHTGQMAISDTNSESHALGGNGKSNSIFNAPLLFVGMGHKGLLDCDSVKSPTSPLDFGFLSNLSNPFRTPSSLSNEGPHRSWDCAKVGLSIIDSLEECSKFSWKILQASESKKTSLCPQMITKAPKCKSYMDSTQASKSLPKDFCKIPCTQNGSIVPKGESTVLFEIGETPLEHEFFGKAVSFSLDSYSPTKYLSGLTGSNFDTDSENFALKQMCSPPHFIGGSQNNTKILLPSELNSNPVAAVYSNEFIESLSACEIENSEDYTCVISHGPNAKTTHIFCGCILETHANDSERHYKAEEEGKGLSLFSVNILHTPNQYPSHDFLSVCYHCNKKLEEGKDIYIYRGEKSFCSLSCREIEIMMDEQEKSNSSPENSPKCGFGGEPWMIVLYITAFAICFSAFMVSVEDGSPQLLDLVSI

SEQ ID NO: 184591 - protein, 214 aa, Glycine max
  Coding DNA Sequence Number=SeqID_67813
  Homolog annotation: Hit_ID=Q1STZ2; Match level="QueryCoverage=91%, HitCoverage=42%, E-value=6e-11, Identity=29%"; Hit description=IMP dehydrogenase/GMP reductase
MRRKRKSRLGPTFGWIGGNAINWFPHWKEGKEGVLFSCGDYPNVPLIGTRGCINYNPALAIRQLGYPMSGAPTEESLSPFLVRDLGAQSLKVIQRVHKAWRSRLRKDKELRGIQNGVIGGYRGWLRVHTRGLDWLSKLKVINEENFEAPEEDEEVQALKLELGKARLAKEKFKSAATHIRKEYTELQEENAATARALEQETKRARKEEHGREKF

SEQ ID NO: 184592 - protein, 58 aa, Glycine max
  Coding DNA Sequence Number=SeqID_67814
MPLVGGGSIIGAKVDGDEEEIDIAVWIFVKKHKLNSMNRNKKECSAASREALKLNFVQ

SEQ ID NO: 184593 - protein, 139 aa, Glycine max
  Coding DNA Sequence Number=SeqID_67815
MVILKFKVPDFDKYKGTTCPKNHLKMYCRKMGAYTKDEELLIHFFQESFTGLAVTWYTNLEPSRVHSWKDLMVAFVRQCQYNSDMAPDRMQLQNMCIKGHESFKEYTQRWRDLVAQVAPPMMEREMINRDGRHIVSILL

SEQ ID NO: 184594 - protein, 64 aa, Glycine max
  Coding DNA Sequence Number=SeqID_67816
MDGEELPSPVNSDVGQNRLRPWSEVETKLRAETNQEARVMTDRSSSLPYSGQAENAAARQPSIL

SEQ ID NO: 184595 - protein, 227 aa, Glycine max
  Coding DNA Sequence Number=SeqID_67817
  Gene Ontology: Mol. function=nucleic acid binding; Biological process= DNA integration
MDHEDEEEDDDNNNTTTNNNDDDNDDHDGIIMAEDMNIDTVTPTMEHVDTLLDMHGVAFAFTMKNPNFVGPAKELEQWNHVNKDTNRMEYVAVRAKALSAKANMVQDKPIQKRNDNPPKPRANLVEGDDIIVMLISQANVVTDKNVYLGDSRTTPVLGKVKVLLKLKYGKMLALSDVLHIHIIRVNLVSVALLRKVGVKVSFESDKMVMTKNNVFVGKGYCDYGLFV

SEQ ID NO: 184596 - protein, 88 aa, Glycine max
  Coding DNA Sequence Number=SeqID_67818
MVMNHQVNVFLKLMMVRIGKVKKDAPKEKIWCNRRYGMEDGVLFGDLRKLASEEGASEADISMVLKNNCANGDAREGSRGHNSITLVK

SEQ ID NO: 184597 - protein, 230 aa, Glycine max
  Coding DNA Sequence Number=SeqID_67819
  Gene Ontology: Mol. function=oxidoreductase activity; Cellular component=mitochondrial respiratory chain; Biological process =carotenoid biosynthetic process
  Homolog annotation: Hit_ID=Q2HTI6; Match level="QueryCoverage=80%, HitCoverage=54%, E-value=1e-75, Identity=74%"; Hit description =Alternative oxidase
  Subcellular localization annotation: CTP_CleavageSite=36; ConfidenceScore=5.43e-01
MAAIFSSSLFVSSPLPKPLSSSYSRIHKAPQLFRARSSLLQDKEEKVIVQDSFPSKTSPLHSADKSTSGNSINTSAFEKRIIKVEQSVNIFLTDSVIKILDTLYHDRHYARFFVLETIARVPYFAFMSVLHMYESFGWWRRADYLKVHFAESWNEMHHLLIMEELGGNAWWFDRFLAQHIAIFYYIMTVLMYSSKPKNGILISSSAQTKKNEETDIVPFAKLSTVNHHVD

SEQ ID NO: 184598 - protein, 315 aa, Glycine max
  Coding DNA Sequence Number=SeqID_67820
  Gene Ontology: Mol. function=extracellular ligand-gated ion channel activity; Cellular component=membrane; Biological process=transport
MEDERGSLLLPKNMEEHHPAHDRGTTELRNFRSYLRWVYVDHSNVCKAGLSWTVFFTLAFVVPTLSHFLLDCPTCDRDHSRPYHIPVQISLSVFAALSFISISSWDRRYGFRKFLFLDKLGDESLKIQRGYSEQMQGTMKLIMRWGLPCFIAECAYKIWWYVSGASQIPHYGSIYVSSIILCTLDLCSWLYRTSIFFLVCVLFRLICYLQILRLDEFARVFQRETEVGSILLEHLRMRRNLRIISHRFRGFILASLLLVTASQLIFLLMVTKPHADVDILKAGELAVKLLSSIDNTSANRLVMYLFNNIMSLAHN

SEQ ID NO: 184599 - protein, 71 aa, Glycine max
  Coding DNA Sequence Number=SeqID_67821
MAIPTTSRGSNGELTVTAEFGASEQSHFDHSVNHKRNMSKGGSSIKGFSSSSHNTQRTANSSFSDHSVIFI

SEQ ID NO: 184600 - protein, 291 aa, Glycine max
  Coding DNA Sequence Number=SeqID_67822
  Gene Ontology: Mol. function=transition metal ion binding; Cellular component=chromatin; Biological process=chromatin assembly or disassembly
  Homolog annotation: Hit_ID=Q852J6; Match level="QueryCoverage=82%, HitCoverage=36%, E-value=3e-41, Identity=34%"; Hit description =Putative TNP-like transposable element
  Pfam annotation: Domain name=Transposase_21; Domain location=136-247; Score=-66.5; E_value=6.2e-09; Accession=PF02992.5; Description =Transposase family tnp2
MDRRLMNASCISPVYENEVEQFLEFALEKTQPNEEEKYLCPYMQMGPKLSSDSKKPLYLECKKSLTFLLVVLSLVNVKAIYEWSDKSFTSLLKVVHDEFEEMHKCPKCGVSRYKVKVDECSNDESTKKDPQKRCYDRRNYDGMLFHSIDSSLWKKINHLYPDFGKEARNIRLGVAIDGMNLFGNLSTNHSSCPILLVFEWVEDINTIFGKTQKKLTSEKNIWKKRSIFFDLPYWSDLDVIHCIDAMHVEKSVRDSVINMLLNIKGKTKYGLNTHQDLVEMGICDQLHPRFD

SEQ ID NO: 184601 - protein, 122 aa, Glycine max
  Coding DNA Sequence Number=SeqID_67823
MHKLCELYVDVDPPLLVEIGKVYNLGSTIHRKKIEDDNVRVVIEEVIDSNAQVLFLIDEVQIVGHALNHFIQWPKRLVRAITTKVVERCSKDVPHKKLEPELDPLERLLMVASQNKDPIQLP

SEQ ID NO: 184602 - protein, 159 aa, Glycine max
  Coding DNA Sequence Number=SeqID_67824
  Homolog annotation: Hit_ID=Q53M14; Match level="QueryCoverage=74%, HitCoverage=71%, E-value=8e-15, Identity=35%"; Hit description =Expressed protein
  Pfam annotation: Domain name=DUF538; Domain location=6-145; Score =129.3; E_value=1e-35; Accession=PF04398.3; Description=Protein of unknown function, DUF538
MSSIRFLWILMVSLKVSCVLSQPQKLSAYDVLMEYGFLVGLLPKGAIGYSLNRDNDKFVVYFQGACSFDIESYTLKYKSTITGVISKGRLYNLKGVIAKILLLWLNITKVSCQGNNIYFSIEITSVDFGVKNFLESPQCGCGFDCKPLPLNGDVSVSSI

SEQ ID NO: 184603 - protein, 53 aa, Glycine max
  Coding DNA Sequence Number=SeqID_67825
MDFSSCQTQPRSYEYGYYVIEHILKIVTDNINTAWKHNFDNSGPMPDEDIASI

SEQ ID NO: 184604 - protein, 66 aa, Glycine max
  Coding DNA Sequence Number=SeqID_67826
MKFPKSGKCECNWYYTHLSSFQYFHLADHCAKRARETARIRPLSERSMHLADKGSLSAHIAARNSA

SEQ ID NO: 184605 - protein, 155 aa, Glycine max
  Coding DNA Sequence Number=SeqID_67827
MDEVQSQSESSLSNHQSHQEPIIEENFMEIDSSINDPLSPINKKETQAELIVLGKMSYQTSPKLASGSPGPPNSFMVKKLARMDELTIAGLSFSSLGCPKGVLKGSKVQKWRELRELRKKKKKKKEEETKLRHCQIATMINLYIVPCLVFFVRPS

SEQ ID NO: 184606 - protein, 132 aa, Glycine max
  Coding DNA Sequence Number=SeqID_67828
MYPPLFSLNLVDVPSTRTDPQEMYPLLFSVKPKEWEESKEFSDCVVLNPLTREKADTKEFRRLVLCSFGKGRRETQKEFRRLVLGEFFLAKGEENEKMNNTSFQGLENQKTSENFWYKEEEEVQRDSRLVKD

SEQ ID NO: 184607 - protein, 112 aa, Glycine max
  Coding DNA Sequence Number=SeqID_67829
  Subcellular localization annotation: CTP_CleavageSite=42; ConfidenceScore=5.06e-01
MSASSDQHYEKVSFAIQKTQSTIASSGYGRPLHLSRRCPLLQAETMKKFYLLSIRLKGRCERLSTDTTKKSHLLSVRHKARLQAVTNVVTCTLSRDVSVFRPTQRKSLIRYA

SEQ ID NO: 184608 - protein, 122 aa, Glycine max
  Coding DNA Sequence Number=SeqID_67830
  Gene Ontology: Mol. function=transporter activity; Cellular component= outer membrane-bounded periplasmic space; Biological process=transport
  Homolog annotation: Hit_ID=Q8D032; Match level="QueryCoverage=99%, HitCoverage=29%, E-value=4e-52, Identity=78%"; Hit description =Periplasmic putrescine-binding protein of putrescine ABC transporter
MQAANRAKEAKNGVNVAYAIPKEGALTYFDMFAMPADAKNKDAAYQFLNFLMKPDVMAGISNYVYYANAVKDSTPLVNAEVRNNPNVYPPADLRAKLFTLNVQSPKLDRVITRAWTKVKSGK

SEQ ID NO: 184609 - protein, 69 aa, Glycine max
  Coding DNA Sequence Number=SeqID_67831
MREMRAAITANNCAIGMVEYAAYVAWQANFGDQLVAAQGGGNKAAHEEAAHEDNNSKMDADSSLDEARS

SEQ ID NO: 184610 - protein, 187 aa, Glycine max
  Coding DNA Sequence Number=SeqID_67832
MSMLGVVASLESPVLVQQPPPIEPTPLPPPSSPPQPQVQEEIGDSSYRYSSKVEPRFELMCDTNDYAVGVMLGQQRNKIFHVIYYASKMLNEAYLNYITTKKEIFAVVYALEKFRSYLVGLKIVVYTDHSTIQFLLTKVVREEFPNEKLMVMKKAKAKVPLVCCHGNFKATWEPPEDLKLAEKKKFF

SEQ ID NO: 184611 - protein, 113 aa, Glycine max
  Coding DNA Sequence Number=SeqID_67833
  Gene Ontology: Mol. function=RNA-directed DNA polymerase activity; Biological process=RNA-dependent DNA replication
MAVDYVSKLMEAMATPTNDAKTMIKFLQKNILARFGVPQVLISDGGTHFFNAQLAKVLQHYESSKLDDSLWAYHTTFKTPIGISSFSDGVWKGMPPSGVVGTQSLLGSQVSNF

SEQ ID NO: 184612 - protein, 103 aa, Glycine max
  Coding DNA Sequence Number=SeqID_67834
  Subcellular localization annotation: CTP_CleavageSite=26; ConfidenceScore=5.06e-01
MKSSDMRGYRMVTRTFRQPGANEPVDAQRLTSSFALFVVLTRKVRFYSRCPETFKPGDVQDSSLLGRDDRVQWRREVSWLSNFFAFKTLKFVDASDAFSFLSE

SEQ ID NO: 184613 - protein, 509 aa, Glycine max
  Coding DNA Sequence Number=SeqID_67835
  Gene Ontology: Mol. function=binding; Cellular component=plastid chromosome; Biological process=positive regulation of transcription, DNA-dependent
  Homolog annotation: Hit_ID=O23278; Match level="QueryCoverage=80%, HitCoverage=75%, E-value=1e-117, Identity=50%"; Hit description=Salt- inducible protein homolog
  Pfam annotation: Domain name=PPR; Domain location=138-172; Score =31.0; E_value=4.1e-06; Accession=PF01535.11; Description=PPR repeat
  Pfam annotation: Domain name=PPR; Domain location=173-207; Score =43.3; E_value=8.1e-10; Accession=PF01535.11; Description=PPR repeat
  Pfam annotation: Domain name=PPR; Domain location=208-242; Score =25.0; E_value=0.00027; Accession=PF01535.11; Description=PPR repeat
  Pfam annotation: Domain name=PPR; Domain location=243-277; Score =30.8; E_value=4.8e-06; Accession=PF01535.11; Description=PPR repeat
  Pfam annotation: Domain name=PPR; Domain location=278-312; Score=8.5; E_value=0.74; Accession=PF01535.11; Description=PPR repeat
  Pfam annotation: Domain name=PPR; Domain location=382-416; Score=3.5; E_value=2.9; Accession=PF01535.11; Description=PPR repeat
  Pfam module annotation: Pfam domain module=PPR::PPR::PPR::PPR::PPR::PP R; Domain location=138-172::173-207::208-242::243-277::278-312::382 -416
  Subcellular localization annotation: CTP_CleavageSite=49; ConfidenceScore=5.55e-01
MVNALSHNQSHFLVVLLNSNSNCRGSKSGNNTVFRKPFVKFRTLTTQICHSSYHRFADTKHTTLLVETYHLHDSLRALLAKLQKEDCNPLHVLAEDGDWSKDHFWAVVRFLKSASRFTQILQVFDMWKNIEKSRISEFNYNKIIGLLCEGGKMEDALSALRDMKVQGIKPSLDTYNPIIHGLSREGKFSDALRFIDEMKESGLELDSETYDGLLGAYGKFQMYDEMGECVKKMELEGCSPDHITYNILIQEYARAGLLQRMEKLYQRMVSKRMHVQSSTLVAMLEAYTTFGMVEKMENFYRKILSSKTCLEDDLIRKVAEVYIKNYMFSRLEDLALDLCPAFGESNLVWCLRLLSYACPLSKKGMDIVVREMRDAKVNWNVTVANIIMLAYVKMKDFRHLKILLSQLPIYRVQPDIITIGILFDATRIGFDGSGALETWRRMGYLYRVVEIKTDSLVLTAFGKGHFLKSCEEVYSSLHPEDRKRKTWTYHDLIALLSKHTGTIDCIKPR

SEQ ID NO: 184614 - protein, 918 aa, Glycine max
  Coding DNA Sequence Number=SeqID_67836
  Gene Ontology: Mol. function=protein serine/threonine kinase activity; Cellular component=integral to membrane; Biological process=protein amino acid phosphorylation
  Homolog annotation: Hit_ID=Q8LKR3; Match level="QueryCoverage=99%, HitCoverage=100%, E-value=0.0, Identity=64%"; Hit description =Receptor-like kinase RHG4
  Pfam annotation: Domain name=APH; Domain location=549-730; Score= -11.9; E_value=0.04; Accession=PF01636.13; Description=Phosphotransfer ase enzyme family
  Pfam annotation: Domain name=LRRNT_2; Domain location=289-328; Score =15.2; E_value=0.022; Accession=PF08263.3; Description=Leucine rich repeat N-terminal domain
  Pfam annotation: Domain name=LRRNT_2; Domain location=3-29; Score =4.1; E_value=0.31; Accession=PF08263.3; Description=Leucine rich repeat N-terminal domain
  Pfam annotation: Domain name=LRR_1; Domain location=103-127; Score =1.3; E_value=1.6e+02; Accession=PF00560.23; Description=Leucine Rich Repeat
  Pfam annotation: Domain name=LRR_1; Domain location=129-151; Score =11.5; E_value=2; Accession=PF00560.23; Description=Leucine Rich Repeat
  Pfam annotation: Domain name=LRR_1; Domain location=153-175; Score =18.6; E_value=0.022; Accession=PF00560.23; Description=Leucine Rich Repeat
  Pfam annotation: Domain name=LRR_1; Domain location=202-223; Score =8.8; E_value=6.3; Accession=PF00560.23; Description=Leucine Rich Repeat
  Pfam annotation: Domain name=LRR_1; Domain location=225-247; Score =10.0; E_value=3.8; Accession=PF00560.23; Description=Leucine Rich Repeat
  Pfam annotation: Domain name=LRR_1; Domain location=249-270; Score =6.9; E_value=15; Accession=PF00560.23; Description=Leucine Rich Repeat
  Pfam annotation: Domain name=LRR_1; Domain location=32-54; Score=2.7; E_value=91; Accession=PF00560.23; Description=Leucine Rich Repeat
  Pfam annotation: Domain name=LRR_1; Domain location=331-353; Score =6.3; E_value=19; Accession=PF00560.23; Description=Leucine Rich Repeat
  Pfam annotation: Domain name=LRR_1; Domain location=355-377; Score =13.7; E_value=0.66; Accession=PF00560.23; Description=Leucine Rich Repeat
  Pfam annotation: Domain name=LRR_1; Domain location=379-400; Score =14.3; E_value=0.44; Accession=PF00560.23; Description=Leucine Rich Repeat
  Pfam annotation: Domain name=LRR_1; Domain location=56-77; Score =16.6; E_value=0.09; Accession=PF00560.23; Description=Leucine Rich Repeat
  Pfam annotation: Domain name=LRR_1; Domain location=79-101; Score =14.7; E_value=0.33; Accession=PF00560.23; Description=Leucine Rich Repeat
  Pfam annotation: Domain name=Pkinase; Domain location=546-847; Score =156.3; E_value=7.9e-44; Accession=PF00069.15; Description=Protein kinase domain
  Pfam annotation: Domain name=Pkinase_Tyr; Domain location=546-847; Score=113.4; E_value=6.5e-31; Accession=PF07714.7; Description =Protein tyrosine kinase
  Pfam module annotation: Pfam domain module=APH::LRRNT_2::LRRNT_2::LRR_ 1::LRR_1::LRR_1::LRR_1::LRR_1::LRR_1::LRR_1::LRR_1::LRR_1::LRR_1::LRR_ 1::LRR_1::Pkinase::Pkinase_Tyr; Domain location=549-730::289-328::3 -29::103-127:...
  Pfam module annotation: Domain location=:129-151::153-175::202 -223::225-247::249-270::32-54::331-353::355-377::379-400::56-77::79 -101::546-847::546-847
  Subcellular localization annotation: CTP_CleavageSite=27; ConfidenceScore=5.58e-01
MSKLAKALIPSPSGWTGSSFCQWTGVKCSANRVTIIKIASQSLGGTLPPDLNSLSQLTSLSLQNNKLSGALPSLANLSMLESVFLDGNNFTSIPDGCFQGLTSLQTLSMADSVNLAPWTIPTELTDSNNLVKLDLGNANLIGTLPDVFDKFVSLQELRLSYNNLTGGLPKSFGGSEIQNLWLNNQNGFGFSGSIEVLASMTHLSQVWLQKNQFTGPIPDLSNCTTLFDLQLRDNQLTGVVPPSLMSLSSLQNVSLDNNALQGPVPSFEKGVKFTLDGINSFCLKDVGPCDSRISTLLDIAAGFGYPLQLARSWTGNDPCDDWSFVVCAGGKIITVNLAKQNLTGTISPAFANLTDLRNLFLNDNNLGGSIPGSLTNLAQLEVLNVSNNNLSGDVPKFPTKVKFTTAGNDLLGRSDGGGGGSGTTPSKGSGDAPSGSPSTGPGGSSLSPAWIAGIVLIAVFFVAVVVFVFCKCHAKNRHGKFGRVNNPENGKGEVKIDMMSVTNSNGYGGVPSELQSQGSERSDVHVFEGGNATISIQVLRQVTDNFSEKNILGRGGFGVVYKGELHDGTQIAVKRMESVATGSKGLNEFQAEIAVLSKVRHRHLVALLGYCINGNERLLVYEYMPQGTLTQHLFDWGENGCAPLTWKQRVAIALDVARGVEYLHSLAQQSFIHRDLKPSNILLGDDMRAKVADFGLVKNAPDGKYSVETRLAGTFGYLAPEYAAPSVAALFSVGTVQFTVGFPDAQTCPTGRVTTKVDVYAFGVVLMELITGRRALDDTVPDERSHLVSWFRRVLINKENIPKAIDQTLDPDEETMESIYKVAELAGHCTAREPYQRPDMGHAVNVLGPLVEQWKPTTHEEEEGYGIDLHMSLPQALRRWQANEGTSTMFDMSISQTQSSIPAKPSGFADSFDSMDCR

SEQ ID NO: 184615 - protein, 168 aa, Glycine max
  Coding DNA Sequence Number=SeqID_67837
  Gene Ontology: Mol. function=RNA-directed DNA polymerase activity; Biological process=RNA-dependent DNA replication
MDRCIVAPLGSSPVEVLKFFRFVTCCLRWLFDTDAVAALCSNMTAINASLSGHWVNWNTLTRPKSRGGLGIRTAREMNVTLLGKNAWSLMHDQHKLWVQLLSHKYSKDMFVLNGASYTWASIVKAVSILQPGFHFRLGRGSLSVWFDKCSVQISRDALIGQQGGIVPI

SEQ ID NO: 184616 - protein, 769 aa, Glycine max
  Coding DNA Sequence Number=SeqID_67838
MWMLTAKKLTVWINFSPWEEIKMLKPIYSVSFYISFKCVLAYGKCSIHFTKCLCLVYSEHYLKITLDIITFKIHYLGALLNCEKDDDLHEHIKDMHSLISVIVTGLQLPSEEIRGEVLFVLYKLSVLQSTSAEGDGSDMLIPFCPQILYLLVDVLMKIQNDDVRLNCVDTDIRTLSLKEICYLSHRKVDFLLVSFSPRVCIYSLYPNHQSFRLNERVIDVNHSKAEYKDPAVKMCLQVLGILSTAEETFKLRLVVGISTLIPTLRYVAEVPFHPVQCETLKLIYECISECPGSVSTFQLEELVLVLIRMLSDGEMGIIPETFIMVCSVFVALIRSPSCNGALDLLKSIEEATNHAILACLSVSERNINQILQCLYLLKEAFAYSHDGNSINSSKLELRSSILDICRTHLLPRLVVGINEMEEDIALGLLETFHLILLLHSSINAVEFAESLISIGDRMKNRIYLLLSSLMDSLLGNDSGQPIRETALHLPCDPIDLLFLLGQRSTKSLDLPSCQSAVLLIMYTSSLYDERSYNLEEADIIIGNNNQTINVQTLAELVSTEDNYGARLVVCLLAQLLEEEGQEHDIICVLNVMATMVLICPAVCEQLSLHGIATKIRTWCYLNNSLSTRTYMSILILVFNTLSSVHPETLSTDQSWVAVTMKMMEYSILSKEVDILSDESLFVIGILSLILYLSTNKALEETSKAILFNTCIISMGPALVDHDEGTCTGETLIFVLLIHYFAVKRVRGLAKLLCFNESIGAASLHWHPLP

SEQ ID NO: 184617 - protein, 417 aa, Glycine max
  Coding DNA Sequence Number=SeqID_67839
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=99%, HitCoverage=45%, E-value=0.0, Identity=81%"; Hit description =Aspartokinase-homoserine dehydrogenase
  Pfam annotation: Domain name=Homoserine_dh; Domain location=200-407; Score=350.6; E_value=2.6e-102; Accession=PF00742.9; Description =Homoserine dehydrogenase
  Pfam annotation: Domain name=NAD_binding_3; Domain location=63-192; Score=122.3; E_value=1.4e-33; Accession=PF03447.6; Description =Homoserine dehydrogenase, NAD binding domain
  Pfam module annotation: Pfam domain module=Homoserine_dh::NAD_binding_ 3; Domain location=200-407::63-192
MASTPGVSASLFDALAKARGFYKGCSEYNITVVVKREDSIKALRAVHSRFFLSRTTIAMAIIGPGLIGSTLLDQLCDQAANLKEEFNIDLRVMGIMGSKLMLLEDDTELRQEKGEVANLEKIVQHVHGNHFIPNTVLVDCTADSVIASNYEDWLRKGIHVITPNKKANSGPLYEYLRLRALQRQSYTHYFYEATVGAGLPIISTLRGLLETGDRILQIEGIFSGTLSYIFNNFKDGRVFSEVVAEARDAGYTEPDPRDDLSGIDVARKVIILARESGLKLELSDIPVENLVPEPLREEYLDDFLQGSSSAEEFMQQLPKFDEELTEILKDAESSGEVLRYVGVVDVSNEKGVVELRRYKKDHPFAQLSGSDNIIAFTTRRYRNQPLIVRGPGAGAQVTAGGIFNDILRLATYLGAPS

SEQ ID NO: 184618 - protein, 879 aa, Glycine max
  Coding DNA Sequence Number=SeqID_67840
  Homolog annotation: Hit_ID=Q2Z1Z1; Match level="QueryCoverage=15%, HitCoverage=54%, E-value=7e-11, Identity=30%"; Hit description =Hypothetical salt-inducible protein
MSRVHWCNAISDVAFLVVFLLCLFHCLSITITITIGGERSYMDNHQDQGHEGRACRCSECRWPSPNPNPCPKKSLSHKNKCGTIEGYELSTSERQTHSNASESDDDEHLSDDDPHSQGPNSLDPGNNEKLNVGTRKFLSSSGDELFLDAIANFSDGAPSPGSKEPLRDSHEWARDVEIGNIKYQEFSSGSSDFNDINQFNVKGQMQEHSILQRERVKEGNMLEMQGQLSGSHVHPPSSSSITDLRTIERIDDCFGLSSDSNPSKAEATPDMMLENKIHTGENVRPCSLASVAKETNLKENDETKSDSDMFDISIFSDNAVSDRIALSDVVNSDSQVARGAFNLEEKNNADLLSLMLQEELSLEVNSTISSTNTSTNSVQVNSAHTIQFATSGDAKTLQEMGEENVNMFTSPVCDDSADVAHPQNECADFKDHKGVLPQNPLSPPSSEAGKPKQDDLKDSDDEENYFHINQNHLSGKRQVLPPDGRVLDSSMKEQESWEIVAEEMHAEESIGVSSVNFMTENDKASDEIGISMNRMKLEMYENYMGATHFSDKPSSGVYKSDDVVEMDKFEKCDITDAQYTERLIVKDSSLPKPAGSNFERSILSEAAMDFYARTPKDIECANKSSLSGAQEDNEDNEIKSSCRVNKECNRFISTSTDSRQTQNAELLVKAAEEPGRNSSLYSLDVEPSAQCVSVVGETQGEHGREVYGITDVPVQDQSGNNNSNAQLPSSAIHTYIDYGLPSNLNDPKAASEGQQHPSSTSSQAGWFPTLTQAINESQGRKKNEEIVAEITNRNSEQKTPPQSPLSEAANSNKLESPKLEESSIFGKNGESAAAAKAVKGEGEKGSNSSADIRRKNKKVKSKLYCTPCMCCSSVDSPPR

SEQ ID NO: 184619 - protein, 92 aa, Glycine max
  Coding DNA Sequence Number=SeqID_67841
MTAIGTSGPYTGAMRGTMHEPQANLGVDQKFLPENPRGFTLAHLRRKLIRPRAPGKCPKTIVIVGISPCHKVLAGSTDPWHHSMTLNQERFT

SEQ ID NO: 184620 - protein, 133 aa, Glycine max
  Coding DNA Sequence Number=SeqID_67842
MGSSGFDPIPFRSVLLIEFCKRFRSFFGESRGLSDGCAQPNVIYVDPSQTSLQLRGRAFGRKGGKHWFMPTRLKGGFLAGEKEERRGEGAQSTLNYPFLRHQLDIRIVERIACGTDFTRDVSELDCKTESQGE

SEQ ID NO: 184621 - protein, 70 aa, Glycine max
  Coding DNA Sequence Number=SeqID_67843
MEGQNKIEGVKLNVPSFKGRSDPDTYLDWEMKIEHLQQNHAIETPEVVPGKFDCGGVLQRDGDGTRWSQH

SEQ ID NO: 184622 - protein, 376 aa, Glycine max
  Coding DNA Sequence Number=SeqID_67844
  Gene Ontology: Mol. function=catalytic activity; Biological process =trehalose biosynthetic process
  Homolog annotation: Hit_ID=Q9FJQ1; Match level="QueryCoverage=89%, HitCoverage=91%, E-value=1e-141, Identity=71%"; Hit description =Trehalose-6-phosphate phosphatase
  Pfam annotation: Domain name=Trehalose_PPase; Domain location=107 -342; Score=327.5; E_value=2.3e-95; Accession=PF02358.7; Description =Trehalose-phosphatase
  Subcellular localization annotation: CTP_CleavageSite=62; ConfidenceScore=5.39e-01
MTQQNVVVSDTKSGVSLTVFPTTTQKPPAAPGGYISIPRRRVLKNLEINGGQRINAWVESMRASSPTHHKSTPLSQEHNSWILHHPSALDMFDQIIDASKGKQIVMFLDYDGTLSPIVDDPDRAFMSDSMRKTVRKLARCFPTAIVTGRCKDKVYNFVRLAELYYAGSHGMDIKGPTRSSKYNKDSKAEAILCQPASDFLPLIDEVYQQLVEKTKSTPGALVENNKFCLSVHFRCVDEKKWSELARQVKSVLKEYPKLRLTQGRKVLEIRPTIKWDKGKALEFLLESLGLANCSDVFPVYIGDDRSDEDAFKKLRDRGQGFGILVSKFPKDTSDELSSTLGGVETCVPGSTFPSVNEKDEMTCTSLPCHEKEAQLG

SEQ ID NO: 184623 - protein, 46 aa, Glycine max
  Coding DNA Sequence Number=SeqID_67845
MANSSLPIKHSTLFMKKTYQRIHDSDGNQNASPLSALPMLLRKCMK

SEQ ID NO: 184624 - protein, 134 aa, Glycine max
  Coding DNA Sequence Number=SeqID_67846
MGTMLKLEMKGFLREIMKFDADYPVQVYVDIEIQGNLPYYSKLPYSDINGGNRGQWRLPRRSTLTTLPRRWFVAPLHGNKKNKNQTQAPLHGNRFVAEEEEESNEEDREGSGRETGPRGHQQNTKMALRKNQTL

SEQ ID NO: 184625 - protein, 65 aa, Glycine max
  Coding DNA Sequence Number=SeqID_67847
MTTQTTETRWKRMVGAIDGGSCGGGAARSIFAIRTIRDLGSSVELTKSWLYGTECMLPLELVDAK

SEQ ID NO: 184626 - protein, 500 aa, Glycine max
  Coding DNA Sequence Number=SeqID_67848
  Gene Ontology: Mol. function=binding; Cellular component=ubiquitin ligase complex; Biological process=protein ubiquitination
  Homolog annotation: Hit_ID=Q1SXA3; Match level="QueryCoverage=99%, HitCoverage=100%, E-value=1e-131, Identity=55%"; Hit description=IMP dehydrogenase/GMP reductase
  Pfam annotation: Domain name=Arm; Domain location=146-189; Score=7.5; E_value=1.4; Accession=PF00514.13; Description=Armadillobeta-catenin -like repeat
  Pfam annotation: Domain name=Arm; Domain location=235-279; Score =10.1; E_value=0.66; Accession=PF00514.13; Description=Armadillobeta -catenin-like repeat
  Pfam annotation: Domain name=Arm; Domain location=280-318; Score=3.6; E_value=4.3; Accession=PF00514.13; Description=Armadillobeta-catenin -like repeat
  Pfam annotation: Domain name=Arm; Domain location=322-361; Score=4.5; E_value=3.4; Accession=PF00514.13; Description=Armadillobeta-catenin -like repeat
  Pfam module annotation: Pfam domain module=Arm::Arm::Arm::Arm; Domain location=146-189::235-279::280-318::322-361
  Subcellular localization annotation: CTP_CleavageSite=47; ConfidenceScore=5.13e-01
MANYHRNNVENVVLGHHHRSKSASVAGHTFRLCTAASFRRLIFDAVSCGASSRYAARSNTSSDGEKQQKQKPKTSSRKPNNAKSEKLSDLLSIAEAEADVETKKKEEKLEELKLLVKELQQHEEVDDSTKKKREAAAKVRLLAKEDLEVRGTLAMLGAIPPLVAMLDETELNDVDSLIASLYALLNLGIGNDANKAAIVKIGSVEKMLKFIESPDDLDSSVSEAIVANFLGLSALDSNKPMIGSSASISFLVRTLQSLDDKSSSQAKQDALRALYNLSIFPGNVSFILETDLVVFLVNSIGDMEVTERSLATLSNIVSTREGRKAISTVPDSIPILVDVLNWTDSPECQEKASYILMVMAHKSYGDKQAMIEAGVASSLLELSLLGSTLAQKRASRILEILRVDKGKQVSGSYGLGAAVSAPICGSSSARPDGGGGGRECFEEDEEMMSEEKKAVKQLVQQSLQNNMRKIVKRANLPHDIAPSDHFMSLTSSSTSKSLPF

SEQ ID NO: 184627 - protein, 150 aa, Glycine max
  Coding DNA Sequence Number=SeqID_67849
MVMQWEKTVLLIGKRGERIKKRRENSLSSLNSSTFPCAGALHSATVTEWVQLIEQQIDTWAKEHQSNGQEFNSSKGFLIKVFFWYVNVMHGATTTGASAKELPRGEGHASSSSGFAFCLRGVGRATSTDALCMEARNASQTGVLALQQAQ

SEQ ID NO: 184628 - protein, 436 aa, Glycine max
  Coding DNA Sequence Number=SeqID_67850
  Homolog annotation: Hit_ID=Q1SAV4; Match level="QueryCoverage=13%, HitCoverage=22%, E-value=6e-12, Identity=64%"; Hit description =Integrase, catalytic region
MSSVGVIPASTEYGQRSDDRLVILVRDRTVITFGKLRVWCPGNRDLTVRSQLNHNPASSCKIYFPVMVIGKMNPLCIEETLAASFQRLPQTVRFQCLNFVRILIEDQAFRHTMVFCNDVQEERCNSIGGIPTMKSKNKSSQGLAGIGNGSSNPTNFLGSYLVPGGAIVIHDSAPATTFDLPDLYWMVNACKSLGQNCLLKKAMGWPFCDKTALIPTPEASISKVKGHSLELVLYLVPTPHDLNTQSSVEQKSIWITKGKTSRSIATRMFVQDEFTQKRHDPSPFLTKKTGDENGLEVDSMISVARWGELNGHDSNVEEGIRPIGPGQSATRPEIVWKLIWAWDWSPCSISRILVVSVVWSSKGGGGSKGGGGIYPKGFTIKVQYFEFHAIRVYRQGKGGEIELGGGEFGYDVFKAIHVGLGAHRFDHWSSMKAPNC

SEQ ID NO: 184629 - protein, 316 aa, Glycine max
  Coding DNA Sequence Number=SeqID_67851
  Gene Ontology: Mol. function=DNA topoisomerase (ATP-hydrolyzing) activity; Cellular component=chromosome; Biological process=DNA topological change
  Homolog annotation: Hit_ID=Q0GPE3; Match level="QueryCoverage=61%, HitCoverage=75%, E-value=2e-67, Identity=66%"; Hit description=BZIP transcription factor bZIP133
  Pfam annotation: Domain name=DUF632; Domain location=1-247; Score =274.9; E_value=1.6e-79; Accession=PF04782.3; Description=Protein of unknown function (DUF632)
MDDNGSDFCEEPCMIAGSHSCTLDRLYAWERKLYDEVKAGEFIKKDFDRKCDQLRHQFAKDEGNKVIDKTRTVVKDLHSRIIVAIYSVDLISKRIERMRDEELFPQLLELTQGLMRMWKAMLECHHAQYITISLAYHSRNSMRTLEGDTRREIMTQLLEEFECFGLSFSNCIDSHTSYIEALNVWLQNCILQPRERSKSRKPFSSRRALAPPIFVLCRDWCAGIKALPSEELSRAIKNFVSDLRRMIEQQDQELHEKQNSTVASIGGETESKTNEESEDDSSHLCCIHASLTKLVHQLTKFAEASLKLYGRYQTKK

SEQ ID NO: 184630 - protein, 309 aa, Glycine max
  Coding DNA Sequence Number=SeqID_67852
  Gene Ontology: Mol. function=transcription factor activity; Cellular component=nucleus; Biological process=regulation of transcription, DNA-dependent
  Homolog annotation: Hit_ID=Q4QYE1; Match level="QueryCoverage=98%, HitCoverage=100%, E-value=1e-63, Identity=46%"; Hit description=DREB2
  Pfam annotation: Domain name=AP2; Domain location=120-184; Score =151.8; E_value=1.8e-42; Accession=PF00847.10; Description=AP2 domain
MATVMDMYNTSSIMIPDFLDQCSDQELMKALEPFMKSDSSSITYPSFSSFSSSPNFSSTTSYEQKVSITPNHASSIKLNQLTPSQMFQIQARIQVPRGQFLSPKPIPMKHVRASPSSKPTKLYRGVRQRHWGKWVAEIRLPKNRTRLWLGTFDTAEEAALAYDNAAFKLRGENARLNFPHLRHHGARAYGEFGNYKPLPSAVDAKLQAICQSLGTNSQKLKTQNPIVLDTHKAETETSEFQDFNKVENYQTSSSSAFSDEYSSSSSSSSPESDITLLDFSDSCETMDNLGLDLEKYPSVEIDWAALSDS

SEQ ID NO: 184631 - protein, 464 aa, Glycine max
  Coding DNA Sequence Number=SeqID_67853
  Gene Ontology: Mol. function=transcription regulator activity; Cellular component=nucleus; Biological process=regulation of transcription, DNA-dependent
  Homolog annotation: Hit_ID=Q1T1X6; Match level="QueryCoverage=64%, HitCoverage=69%, E-value=1e-113, Identity=67%"; Hit description =Ethylene insensitive 3
  Pfam annotation: Domain name=EIN3; Domain location=5-352; Score =565.0; E_value=7.6e-167; Accession=PF04873.4; Description=Ethylene insensitive 3
MVLIREEEIVEEMSEAECNIDYEKLKKRMWKDRVLLQKLKEKRQKQEPDVEAKQEASKRKKMSRAQDSVLKYMVKIMEVCNAQGFVYGIIPEKGKPMSGSSGSLRKWWKDQIRFDQNAPVAVSKYLPLLSKDIDLDIASYIHLLQDLQDSTLGSLLSALMQHCAPPQRRFPLEGGLSPPWWPNGEEIWWGEQGLLAQENGPPPYRKPHDLKKAWKVSVLAAVIKHISPDFDKLRRLVTQSKTLQDKMTARDSATWSKVMNHEEALLDLTEKCLKISNDDDNLEEEEEEEEEEEEEGFSGSHEPQLLKRKGAFGFGSTDALVDKLYACQNAGCPQSEPSMEFADKNLRLDHEALRAFRTVDSDVLPFHRYLSNDAPPITSLDDLMNVAFQNDVNLGEAAGGSGTLEDDPCYWLNAIENLELQAALELLVRDNMDFAQNVPVQIPQGQGQEDAASVWGLGTHPTQG

SEQ ID NO: 184632 - protein, 277 aa, Glycine max
  Coding DNA Sequence Number=SeqID_67854
  Subcellular localization annotation: CTP_CleavageSite=37; ConfidenceScore=5.66e-01
MATPPSYPPTPPKSSAPSSSTSKKTRKETHLRSLATRPMAKRPTVHVDPTTGKADGPHRKKLRTYLGIITRDKVEFYILEVPDQRTRKKSSDHRKDSLEEQATQGSFVAYRRQDVLTVALGGPEHPARVRATRVGVMTKQYFGLASKSSHTSTSMAFEDLEQLTKNQGLVGGGLVPPPEPEVSPSAACVDPSRKDPNTGASDRRGLYVNENSPCLVAIARVYVGSTTVHNVPLGNDQVKDKQEPNGPSKPVDKSDPDVDPLYLMTLTIPQFFLKSLQ

SEQ ID NO: 184633 - protein, 136 aa, Glycine max
  Coding DNA Sequence Number=SeqID_67855
MEEYMKTKEALPRCRRVMQCGHWFLTKVVHGVMANVMNLLAMDRTERLVMLMTNEHRTGLSQRRRRKKRKEKGEGATYPSQKEEGEWGSMRMRGWGNEELPWEGGVLSKKECHHERVPSRVKRREKGGVGVEKWEE

SEQ ID NO: 184634 - protein, 253 aa, Glycine max
  Coding DNA Sequence Number=SeqID_67856
  Gene Ontology: Mol. function=structural constituent of ribosome; Cellular component=intracellular; Biological process=translation
  Pfam annotation: Domain name=DUF1666; Domain location=13-252; Score =433.8; E_value=2.3e-127; Accession=PF07891.2; Description=Protein of unknown function (DUF1666)
MNKKPGDMRHNPYHDLEAAYVAQTCLTWEALNWNYKNFQSKRDSRGHDVDVGCPATIAQRFQQFQVLLQRYVENEPYEHGRRPEIYARVRHLAPKLLLVPEYRESDDDQRDDNGIHSKISSASFLVIMEDGIRTFMSFLKADKEKPCQILAACFRRNRKPLVDPTLLRLIKKKKMKVKDLRRSRKCLRKRKLKGEEEMEILMALIDLKVVSRVLRMSELSEEQLHWCEEKMSKVRVMDGKLQRDSTPLFFPAH

SEQ ID NO: 184635 - protein, 356 aa, Glycine max
  Coding DNA Sequence Number=SeqID_67857
  Gene Ontology: Mol. function=nucleic acid binding; Cellular component= mitochondrion; Biological process=regulation of transcription
  Homolog annotation: Hit_ID=Q1RV65; Match level="QueryCoverage=85%, HitCoverage=84%, E-value=8e-52, Identity=40%"; Hit description=Zinc finger, C2H2-type
  Pfam annotation: Domain name=zf-C2H2; Domain location=142-165; Score =21.9; E_value=0.0023; Accession=PF00096.16; Description=Zinc finger, C2H2 type
MVSFTSYFIYRRAENPLQILKFRCTFFFSPETTSWQTYGALRYCHSGSECGKNPKLTPNEKPNRVGLFWDLDNKPPNSIPPYEVANKLRIAASSFGVVRYMAAYANSHTFSHVPQGVREIRKEKELLYRLENKGVIKPNQPYRCKVCGRKFHTNDKLVNHFKQLHEREHAKRMNQIESSRGSRRVKLVAKYSMKMEKYKKAASDILTPKVGYGLADELRRAGFWVQTVSDKPQAADQALQSHIVDIMDHRRVECVVLVSDDSDFVDVINEAKMRCLKTVVIGDIDDGFLKRTADTAFSWEEILMGKAKKQAVSVVKNWKDRDILKRLEWTYNPDEDKNNFSLDDAITEASEDDNID

SEQ ID NO: 184636 - protein, 1200 aa, Glycine max
  Coding DNA Sequence Number=SeqID_67858
  Gene Ontology: Mol. function=microtubule motor activity; Cellular component=microtubule associated complex; Biological process =microtubule-based movement
  Homolog annotation: Hit_ID=Q9LDN0; Match level="QueryCoverage=92%, HitCoverage=93%, E-value=1e-171, Identity=56%"; Hit description =Phragmoplast-associated kinesin-related protein 1
  Pfam annotation: Domain name=Kinesin; Domain location=68-386; Score =455.7; E_value=5.9e-134; Accession=PF00225.13; Description=Kinesin motor domain
  Pfam annotation: Domain name=Kinesin-related; Domain location=461 -1141; Score=882.0; E_value=2.9e-262; Accession=PF06548.2; Description=Kinesin-related
  Pfam module annotation: Pfam domain module=Kinesin::Kinesin-related; Domain location=68-386::461-1141
  Subcellular localization annotation: CTP_CleavageSite=81; ConfidenceScore=5.37e-01
MKRFMLPRNPLRDAAELPSSPSPTPTTSSAKPRPSSRKHKPSKENDPPSDPNLVTPSPAKLKSPLPPRPPSSNPLKRKLTAADALTDNSLPAPSDSGVKVIVRMRPLSSDKDEGDPTVQKLDIFEHVGVPLVEHCLAGFNSSVFAYGQTGSGKTYTMWGPANCLSDENDQQGLAPRVFQQLFERISEIYNEQIMDLLDPSQKNLQIREDVKSGVYVENLTEEDVSSMKDVTQLLIKGLSNRRTGATSINSESSRSHTVFICVVESRCKSASDGMSRFKTSRINLVDLAGSERQKSTGAAGERLKEAGNINRSLSQLGNLINILAEVSQTGKQRHIPYRDSRLTFLLQESLGGNAKLAMICAISPAQSCRSETFSTLRFAQRAKAIKNKAVVNEVMEDNVKHLRQVIRQLRDELHRIKANGYNPMESSGGHSAAWIRRSLTLLQSSLNRPPPLSRLDEDGDEEMEIDEEGLEDHDGVSYNANMPSNCNIIADNDNEMNTNDQDLAQPSEEENIASCSVSKGLNEEPSCAMVRSSFSCPVGESDSPSAAMNCVSPAGLSIVHCDLSPILSPTPSVSPRISTSRKSLRTSTGLSPSENDLHVEKDLDMKTSNKKSSTSAFSSQTAPNFLNKTENLAASIQHGLEIIDSYQRNSALRQSPYRFSLQPRKSKLTFPASKVDVGLQTSLDDIVGEDSVLFTCSNCNSRTQLHVNETDNDSNLQLVPVDCHESADKTKKQVIKAVEKVLAGSIRREMALEEFCAKQTSEIMQLNRLVQQYKHERECNAIIAQTREDKILRLESLMDGVLPTEEFMEEELVVLTHEHKILKEKYENHPEVLKMEIELKKVQEELEKYQNFYKLGEREVLMEEIQSLRSQLQFYVDSSSTSARKQYPLLQLTYLSEPSMAATLTAIPVSTEERVETNETLASSRNDIEVQFEQERIKWTEAESRWISLSEELRAELESSRLLAEKRKQELDAERQCTQELQEAMHMAIEGHARLLEQYADLEEKHIHLLARHRQIQDGIEDVKKAASRAGVRGAESKFINALAAEISALKAEREKEQRILRDENKGLQSQLKDTAEAVQAAGELLLRLKEAEEAVTTAQKQAMDAEQEAAKAYKQIDKLKNKHEKEIITLNELLAEARLPKESVLPTYDDDGVMPSYDNSKEPNSVNDQFEPFTNNAEYGELAKLAEPSWFSGYDRCNI

SEQ ID NO: 184637 - protein, 1001 aa, Glycine max
  Coding DNA Sequence Number=SeqID_67859
  Gene Ontology: Mol. function=ATP-dependent helicase activity; Cellular component=nucleus; Biological process=mRNA processing
  Homolog annotation: Hit_ID=Q38953; Match level="QueryCoverage=93%, HitCoverage=99%, E-value=0.0, Identity=82%"; Hit description =Probable pre-mRNA-splicing factor ATP-dependent RNA helicase
  Pfam annotation: Domain name=DEAD; Domain location=294-451; Score= -15.8; E_value=0.00012; Accession=PF00270.19; Description=DEADDEAH box helicase
  Pfam annotation: Domain name=DUF1605; Domain location=806-906; Score =121.8; E_value=2e-33; Accession=PF07717.6; Description=Domain of unknown function (DUF1605)
  Pfam annotation: Domain name=HA2; Domain location=682-772; Score =112.1; E_value=1.6e-30; Accession=PF04408.13; Description=Helicase associated domain (HA2)
  Pfam annotation: Domain name=Helicase_C; Domain location=527-621; Score=54.9; E_value=2.6e-13; Accession=PF00271.21; Description =Helicase conserved C-terminal domain
  Pfam module annotation: Pfam domain module=DEAD::DUF1605::HA2::Helicas e_C; Domain location=294-451::806-906::682-772::527-621
MALEDLQYLSLLSKVCTELESHTGTADKVLAEFITDLASSSENLQEFNAKLNDNGADMPDYLVRTLFTIIRSVLFPNPTSNHLKHCANFVHDGESSQLRIIPQDATALSGISIVEKDDVSSSLKKTMNSPEIWEAKQLIASGFLNVEERDEFIYQEEEDAEEDLEIELNQDEPAFLQGQTKYSVDMSPVRIFKNPEGSLSRAAALQSALTKERREVREQQHRTVFDSIPKDLNRPWEDPMPETGERYLAHELRGVGLSAYDMPEWKKEAYGKTITFGRKSKLSIQEQRQSLPIYKLKKELIQAVHDNQVLVVIGETGSGKTTQVTQYLAEAGYTTKGKIGCTQPRRVAATSVAKRVAEEFGCRLGEEVGYSIQFENCTGPDTVIKYMTDGMLLREILVDENLSQYSVIMLDEAHERTIYTDLLFGLLKQLVKRRPELRLIVTSATLNAEKFSEYFFDCNIFTIPGRMFPVEILYAKQPESDYLDAALITVLQIHLTEPEGDILLFLTGQEEIDFACQSLHERMKGLGKNVPELIILPVYSALPSEMQSRIFEPAPPGKRKVVVATNIAEASLTIDGIFYVIDPGFAKQNVYNPKQGLDSLVITPISQASAKQRAGRAGRTGPGKCYRLYTESAYRNEMSPTTIPEIQRVNMATTTLNMKAMGINDLLSFDFMDSPSTQALISAMGQLYSLGALDEEGLLTKLGRKMAEFPLDPPLSKMLLASVELGCSDEILTIISMIQTGNIFHRPREKQAQADQKRAKFFQPEGDHLTLLAIYEAWKAKNFSGPWCFENFVQSRSLRRAQDVRKQLLTIMDKYKLEVVSAGNNLTKVRKAITAGFFFHVARKDPREGYRTLVENQPVYIHPSSALFQRQPDWVIYHELVMTSKEYMREVTVIDPKWLVELAPKFFKVADPTKMSKRKRQECLEPLYDRYHEPNSWRLTCESVRNLVKTIQIRMAKDSEDRHLYRFIRRKKGSAHRQLCALSYSDQMKCVNILVRPTPEK

SEQ ID NO: 184638 - protein, 472 aa, Glycine max
  Coding DNA Sequence Number=SeqID_67860
  Gene Ontology: Mol. function=L-isoleucine transporter activity; Cellular component=integral to membrane; Biological process=amino acid transport
  Homolog annotation: Hit_ID=Q53MQ4; Match level="QueryCoverage=86%, HitCoverage=84%, E-value=1e-134, Identity=60%"; Hit description =Transmembrane amino acid transporter protein
  Pfam annotation: Domain name=Aa_trans; Domain location=71-457; Score =165.6; E_value=1.2e-46; Accession=PF01490.8; Description =Transmembrane amino acid transporter protein
  Pfam annotation: Domain name=Spore_permease; Domain location=74-393; Score=-147.1; E_value=0.0059; Accession=PF03845.4; Description=Spore germination protein
  Pfam annotation: Domain name=Trp_Tyr_perm; Domain location=82-451; Score=-273.0; E_value=0.036; Accession=PF03222.4; Description =Tryptophantyrosine permease family
  Pfam module annotation: Pfam domain module=Aa_trans::Spore _permease::Trp_Tyr_perm; Domain location=71-457::74-393::82-451
MWGKILKSIRKSLISLQQKCMNSRKSEVDSSVSVHGVQWANCKCCIEESNCDHINAAEGASNVDAQRDANANSSFTHAVINMVGMLIGLGQLSTPYAVENGGWSSAFLLMGLGMMCAYSSHILGICLRKNPKLTSFVDIGKHAFGSKGRNVAATIIYMEIFMALVSYTISLHDNLTTVFLGTNLNLHLPNFSSSQLLTVVAVLIAMPSLWIRDLSSISFLSSVGILMSLLIFLCVAATALLGYVQSNHTIPVLHLHNIPSVSGLYVFGYGGHIVFPELYTAMKDPSKFTKVSIVSFAVVTAIYTTLGFMGAKMFGKDVKSQITLSMAPEHIVTKIALWATVVAPMTKYALEFTPFAIQLEHALPSSMSARTKTIIRGCIGSFSLLVILTLALSVPYFEHVLSLTGSLVSVAVCLILPCAFYVKICWGQISKPLLLLNLFLIIFGFVLAVMGTISSSQLLLKNLQSHNLRHKE

SEQ ID NO: 184639 - protein, 368 aa, Glycine max
  Coding DNA Sequence Number=SeqID_67861
  Homolog annotation: Hit_ID=Q1SF98; Match level="QueryCoverage=94%, HitCoverage=94%, E-value=1e-127, Identity=65%"; Hit description=NnrU
  Pfam annotation: Domain name=NnrU; Domain location=148-364; Score= -98.4; E_value=0.0048; Accession=PF07298.2; Description=NnrU protein
  Subcellular localization annotation: CTP_CleavageSite=52; ConfidenceScore=5.68e-01
MAAPVVVSTSVSVCSNYGYHRRPSLSALSYYSNSISNANLKLSSQCFSNLLRSNSKAPIYCRKFVARTSIGENESESESEKDLGLVGEDSAAFELGKQKISSWIYFTAILGVVLCVLNVAWIDNSTGYGKAFIDAVSTLSDSHEVVMLILILIFAGVHSGLASFRNTGEKLIGERPFRVIFAGISLPLAVSTVDAPGLHQLLWLSNFISFFFLYPSTFNLLEVAAVDKPKLHLWETGIIRITRHPQTYFLHLTFALQMVGQVIWCLAHTIWIGNSVAVAASIGLIAHHLFGVWNGDRRLAIRYGEDFELVKSRTSVVPFAAILDGRQKLPKDFYKEFIRLPYLTVTALTLGAYFAHPLMQTASFNLHW

SEQ ID NO: 184640 - protein, 454 aa, Glycine max
  Coding DNA Sequence Number=SeqID_67862
  Gene Ontology: Mol. function=RNA binding; Cellular component =ribonucleoprotein complex; Biological process=response to cold
  Homolog annotation: Hit_ID=Q9LK47; Match level="QueryCoverage=79%, HitCoverage=85%, E-value=1e-106, Identity=63%"; Hit description =Similarity to 30s ribosomal protein s1
  Pfam annotation: Domain name=S1; Domain location=126-205; Score=0.9; E_value=0.19; Accession=PF00575.13; Description=S1 RNA binding domain
  Pfam annotation: Domain name=S1; Domain location=215-293; Score=64.9; E_value=2.7e-16; Accession=PF00575.13; Description=S1 RNA binding domain
  Pfam module annotation: Pfam domain module=S1::S1; Domain location =126-205::215-293
MYRSYPSNDQSNPNECCGGSDLNLVELKLKDNKQQTRMPIFSATLGSFTSISSSFLSQSHLSPFVKTPCQWQHHYHTAKVLVSASGNTQIDQNPDSGLLQRPTPPDPLDDARQARRSSDWKAAKTYQDSKVIYNGRVEGFNSGGLLVRFYSVMGFLPFPQLSPVHASKEPEKSIQEIAQGLIGSIMSVKVILADEDNKKLIFSEKEAAWSKYSKQVNVGDIFEVRVGYVEDYGAFVHLRFPDGLYHLTGLIHVSEVSWDLIQDVRDILKVGDEVRAKVVGIDWGKSRINLSIRQLEEDPLLETLDKVIPQDGSADPDSMSGGDSGSIEPLPGLETILEELLQEDGIYDVRISRQGFEKRVVSQDLQLWLSNVRQLAFTIFLFGLSFDFSEFLNLSTWQRRHLPRTKGLLYLPGLEDRCRRYISLHPLIRKVSGGHYNEYWSVSPEFHSLRPFFR

SEQ ID NO: 184641 - protein, 329 aa, Glycine max
  Coding DNA Sequence Number=SeqID_67863
  Gene Ontology: Mol. function=structural constituent of ribosome; Cellular component=intracellular; Biological process=translation
MPCSKEEALVRLFYNASSSFHLLFLFLFSSSVLLIKFINFIGSFNIFQRDHYEYVSSEYDEEEEEAEEEIQESFSYVHDSIESDHLVADIICGGETLLFVHNNKPQRILSSSEEFSSPRDSLIEDSEENCSTESLSFHKSPLVSDFENEQDAEEFPAEDADSVPNSVPAESRPTSSITLNLYKSDLVGSDNNYDEDHVEIGVIENKKVQEESLARDERFFAYAPTQLEAKKLIVEEKDYEEIYGDSCTVGSTSKSSSEWRSSINCRDSGTEDPFSSSSRRSCPKWESYTVFQKYDEEMSFLDRISAQKLHETGNTTQSSFPFFLSIIHS

SEQ ID NO: 184642 - protein, 189 aa, Glycine max
  Coding DNA Sequence Number=SeqID_67864
MPLRGRIASKSLMNTWEDLDNSLSDKDNEEETNLCLMVIFKSREDLIKGYNQLLSTSTSTSKAYRKLNKRFQHLEREYEDLKKIHQVHLVDFVLETSSPGDVHDTCICEEFKSLLDEELKGHEVLKELPPKIVKLYEETKTLRDKLGNFFGGHEVFNKIIKVGHGTHKCKDLPKKGNPSKGSSNAYQHP

SEQ ID NO: 184643 - protein, 182 aa, Glycine max
  Coding DNA Sequence Number=SeqID_67865
  Gene Ontology: Mol. function=nucleic acid binding; Biological process= DNA integration
  Homolog annotation: Hit_ID=Q1SX43; Match level="QueryCoverage=91%, HitCoverage=27%, E-value=3e-12, Identity=27%"; Hit description=IMP dehydrogenase/GMP reductase
MEEGFVLNKPCMFKGANYDYCKEKMIAFFESTHIDINALLCALSEEYSKVHGFRSAKQIWDTLVITYEGSSKVKHNKLILLTRKYGRGRRHPNHVWMLPNHSERASLSRKWRPQIIALRSIKNLDSMTLEEIVGILKLYEQDLAQDEGTKKGKSLALTAQRPKRNSASKEKLSKALAVDDTF

SEQ ID NO: 184644 - protein, 70 aa, Glycine max
  Coding DNA Sequence Number=SeqID_67866
MLSHELLIIHYQYFKTPIEVWSNKTPEYSMLKVFGCLAFYHVSEGLGKAKDVTKQVDFKSSIIRNISDRE

SEQ ID NO: 184645 - protein, 78 aa, Glycine max
  Coding DNA Sequence Number=SeqID_67867
MHVDQGSKHFDVWSQRWSGSCWMSDHMSQISNLDIVCEPSSVGESLSVYHGMGVLRIIIEFKSMSLLSCGSSSCNGLV

SEQ ID NO: 184646 - protein, 109 aa, Glycine max
  Coding DNA Sequence Number=SeqID_67868
MEETSEFLVLFGGENSNPPNDGSEDKILGLELIARLQNNGLKDRIFVRLELNARLQHRTIGPLMVIFHCGDAVEDKGEEDASMEEKKEGEKERGGSTKLKEEKGREVEL

SEQ ID NO: 184647 - protein, 144 aa, Glycine max
  Coding DNA Sequence Number=SeqID_67869
  Gene Ontology: Mol. function=transition metal ion binding; Cellular component=chloroplast; Biological process=iron ion homeostasis
  Homolog annotation: Hit_ID=Q948P6; Match level="QueryCoverage=96%, HitCoverage=54%, E-value=5e-65, Identity=87%"; Hit description =Ferritin-3, chloroplast precursor
  Pfam annotation: Domain name=Ferritin; Domain location=58-142; Score =21.1; E_value=3.2e-05; Accession=PF00210.14; Description=Ferritin -like domain
MFMSQGKNLVPCATKDSNNHPLTDVIFEPFEEVKKELNLVPTVPQASLARKKYTNDYKATIKEQISVEYNVSYVYHVIFAYFDRDNVALKGLAKVFKESSEEERVHAEKLMEYQNKRGGKVKLQSIVMPLSEFGHEKKGDALYG

SEQ ID NO: 184648 - protein, 66 aa, Glycine max
  Coding DNA Sequence Number=SeqID_67870
MENGMTQDSDVEDGGSIEEDDHNQIDISELALSEDEDSDGFDNEDNSDWDDDEDSEFSEFINDEHP

SEQ ID NO: 184649 - protein, 135 aa, Glycine max
  Coding DNA Sequence Number=SeqID_67871
MRGRRRHQDEQSRALYDLSSLVLNLLRSPLTFSDEVPPASRRPGQAQISPAGFASLLLGISLALMLCGSVTFFIGFVLMPWVLGLVMLFYVAGILSTLSVFGRSILCYATSPPSPRKDIPVGLAVRIWGPPFVGG

SEQ ID NO: 184650 - protein, 270 aa, Glycine max
  Coding DNA Sequence Number=SeqID_67872
  Gene Ontology: Mol. function=sequence-specific DNA binding; Cellular component=nucleus; Biological process=regulation of transcription, DNA-dependent
  Homolog annotation: Hit_ID=Q5GMP6; Match level="QueryCoverage=69%, HitCoverage=90%, E-value=7e-97, Identity=86%"; Hit description=MADS transcription factor
  Pfam annotation: Domain name=K-box; Domain location=75-163; Score =71.4; E_value=2.9e-18; Accession=PF01486.8; Description=K-box region
  Pfam annotation: Domain name=SRF-TF; Domain location=9-59; Score =116.6; E_value=7e-32; Accession=PF00319.9; Description=SRF-type transcription factor (DNA-binding and dimerisation domain)
  Pfam module annotation: Pfam domain module=K-box::SRF-TF; Domain location=75-163::9-59
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRLEEFQINPLQLNPSAEDMGYGRHPGQPQGHALFQPLECEPTLQIGVCGSTRLKVIVAVDIRGGGRRKRAEDCDNVLLLEREAHAAEARRKFFDVECGSRGRGRWLAVVVVDEVVVIVFLVGGRVHL

SEQ ID NO: 184651 - protein, 469 aa, Glycine max
  Coding DNA Sequence Number=SeqID_67873
  Gene Ontology: Mol. function=RNA binding; Cellular component =ribonucleoprotein complex; Biological process=regulation of translation
  Homolog annotation: Hit_ID=Q6K4E4; Match level="QueryCoverage=86%, HitCoverage=41%, E-value=1e-102, Identity=49%"; Hit description =Putative CRS1
  Pfam annotation: Domain name=CRS1_YhbY; Domain location=115-199; Score=46.1; E_value=1.2e-10; Accession=PF01985.11; Description=CRS1 YhbY domain
  Pfam annotation: Domain name=CRS1_YhbY; Domain location=326-428; Score=52.7; E_value=1.2e-12; Accession=PF01985.11; Description=CRS1 YhbY domain
  Pfam module annotation: Pfam domain module=CRS1_YhbY::CRS1_YhbY; Domain location=115-199::326-428
MVYRGIDYQGPDSQKEVNEKKGDGFFVPDVSKREDSSTATSTSEKSEVVVREREHPENMSEAEAEYNALLDGLGPRFVGWWGTGILPVDADLLPRTVPGYKTPFRLLPTGMRSRLTNAEMTNLRKLAKSLPCHFALGRNRNHQGLACAILKLWEKSLVAKIAVKRGIQNTNNELMAEELKMLTGGTLLLRNKYFIVIYRGKDFVPTSVAAVLAEREELTKQVQDVEDKVRCRAVDAIPLGQGEATAQAGTLAEFYEAQARWGREISPEEREKMVEEAAKTKTAKLVRQIEHKIFIAQTKKLRAEKLLAKIEASMVPAGPDYDQETITDEERVMFRKVGLRMKPYLPLGEKFSTVQKLLYSSNAKLTPFYDNLQNMHLHWKHRELVKLMTKQKTVAFVEDTARLLEYESGGILVAIEKVSKEFALIYYRGKNYKRPITLRPRNLLTKGKALKRHVAMQRHEVLFSPCDNY

SEQ ID NO: 184652 - protein, 668 aa, Glycine max
  Coding DNA Sequence Number=SeqID_67874
  Gene Ontology: Mol. function=calcium ion binding; Cellular component =nucleus; Biological process=regulation of transcription, DNA -dependent
  Homolog annotation: Hit_ID=Q9FYG2; Match level="QueryCoverage=92%, HitCoverage=64%, E-value=1e-122, Identity=39%"; Hit description =Calmodulin-binding transcription activator 4
  Pfam annotation: Domain name=CG-1; Domain location=53-171; Score =264.1; E_value=2.8e-76; Accession=PF03859.7; Description=CG-1 domain
  Pfam annotation: Domain name=TIG; Domain location=427-510; Score =28.0; E_value=3.3e-05; Accession=PF01833.14; Description=IPTTIG domain
  Pfam module annotation: Pfam domain module=CG-1::TIG; Domain location= 53-171::427-510
MRVEPWILTTTVEDEVKVCVCGEASAISPILVPLSSPRLITMPPGLEYNIDDLFQEAKRRWLKPVEVLYILRNHDQCEFTHQPPHQPAGGSLLLFNRRIMRFFRKDGHNWRKKKDGKTVGEAHERLKVGNVEILNCYYAHGEENRTFQRRSYWMLEPEYDHIVLVHYRETSEGKSKSEHVTQLSSGSSPVFSQSHSSYTTHNPGTASMFGDSCEPNQKFSSSGSLEDTSEAQALRQLEEQLSLNEDIFNEIALDLIPGQDQRVVYKQDNSVALSGPNDPGQPCDGYNGREDDSGTYYHDFLDDCPGGNEKTIYWTEVLESCKPLSVTKLPDQHAYDAIENGKSLFSSGRGMIANREKNQWLNSNSNNVENSVFLFPQDIGVKFPPYSMVETPGTNYDYYETCFDQFQNQEPLGVDSSFTVVQKQKFTIRAVSPEYCYATETTKVIIIGSFLCHDSDSTWACMFGDVEVPAEIIQDGVICCEAPSYLLGKVNLCVTSGNRVPCSEVRGFEFRNKTTSCTRCNSLETEGSKSLEDLLLLVRFAEMLLSASTTKDDRIESGSYLSTEQKDDDDSWSHIIIDTLLDGTRTSSDTVNWLLEELLKDKLQLWLSNRRDEGTGCSFSRKEQGIIHMISGLGFEWALSPILSCGVNINFRDINGWTALHWAARFGR

SEQ ID NO: 184653 - protein, 109 aa, Glycine max
  Coding DNA Sequence Number=SeqID_67875
  Homolog annotation: Hit_ID=Q9LS53; Match level="QueryCoverage=82%, HitCoverage=11%, E-value=1e-25, Identity=63%"; Hit description =Genomic DNA, chromosome 3, P1 clone: MYF24
MIIFDFPTSITIASKRFLQLGFDWDTNEMSILLLAKLAKPLIGTARIVINSLHIKGDLLASPILDGKALLYSFVSTPEVRIGVAFGSGGSQSLPATEWPGVSSWLVCFH

SEQ ID NO: 184654 - protein, 458 aa, Glycine max
  Coding DNA Sequence Number=SeqID_67876
  Gene Ontology: Mol. function=DNA binding; Cellular component=nucleus; Biological process=regulation of transcription, DNA-dependent
  Homolog annotation: Hit_ID=Q5Z818; Match level="QueryCoverage=86%, HitCoverage=84%, E-value=2e-54, Identity=36%"; Hit description =Squamosa promoter binding protein 2-like
  Pfam annotation: Domain name=SBP; Domain location=170-248; Score =183.4; E_value=5.5e-52; Accession=PF03110.5; Description=SBP domain
MEWNAKSLGQWDWEHLFFNTKAAENPRLQPTDCSSEADPEINVGLLYPSGGSACSGSELIHASSSRSSKSASNNSSSNGDSRESILTLEGSQDDSTGKKELCNGEPVETSPAAVPSPVSGEPLLTLKLGKRLYFEDVCTGSDSKKPSSFEVPILSGKKYKTSSQTVQHPSCQVEGCGLDLSSAKDYHRKHRVCEAHSKSPKVVIAGLERRFCQQCSRFHALSEFDDKKRSCRQRLSDHNARRRKTQPDSIQLNPSALSSSPYGIDTVECPSHRKLDSTHIIEAKHVLDGRQIMSPFAFSRTATNLAWQDMHSSKHPQTKEFLPKPAKAFNKIPSIVSMLSDDSSGLLTSRGIATKSIVPGMEVPNGTQDVNRALSLLSTNSSWCPYETKSLSLEHSTRTTHSITQHRLPLPSSEYWHTDQQNSSMCISFSDCDSSNRFQDFQLLSSPYESGFPCNQLD

SEQ ID NO: 184655 - protein, 115 aa, Glycine max
  Coding DNA Sequence Number=SeqID_67877
MIGGETLSTWQALMRSWMAAIFRLLEEAELPSGQRGEDGAQAAAEATAMVVGEFLMDLGLKNDKVSAKVCDEGVATVFDSDVIGDINLFGGEGGEEEAAAGAEVIGNGGSKGRRK

SEQ ID NO: 184656 - protein, 119 aa, Glycine max
  Coding DNA Sequence Number=SeqID_67878
  Gene Ontology: Mol. function=nucleoside-triphosphatase activity; Cellular component=integral to membrane; Biological process=transport
  Homolog annotation: Hit_ID=Q9M2V6; Match level="QueryCoverage=54%, HitCoverage=9%, E-value=2e-15, Identity=64%"; Hit description =Probable white-brown complex homolog protein 17
MTPMTNHEGAGEVEAGGWFVEEERDGVMDDVGANGDAVAFAARDVAVVLVADDQRREKLKHSVVNPVGCTENLIHRVSSRAESLESDCCYRNPRMRYTCLNFVDQCANTPRKEVVNDAE

SEQ ID NO: 184657 - protein, 209 aa, Glycine max
  Coding DNA Sequence Number=SeqID_67879
  Gene Ontology: Mol. function=metal ion binding; Cellular component =intracellular
  Homolog annotation: Hit_ID=Q8GZ43; Match level="QueryCoverage=86%, HitCoverage=92%, E-value=5e-74, Identity=68%"; Hit description =RanBP2-type zinc-finger protein At1g67325
  Pfam annotation: Domain name=zf-RanBP; Domain location=142-173; Score= 32.1; E_value=2e-06; Accession=PF00641.9; Description=Zn-finger in Ran binding protein and others
  Pfam annotation: Domain name=zf-RanBP; Domain location=96-127; Score =26.9; E_value=7.3e-05; Accession=PF00641.9; Description=Zn-finger in Ran binding protein and others
  Pfam module annotation: Pfam domain module=zf-RanBP::zf-RanBP; Domain location=142-173::96-127
MDHLFLPMMVPFSGGSAYHYNYGSRLSAGSPYRPLHLSGPTPYTGGPVMGNGGIYGMPQLLDRYGLGVPIGPGTMGARPGFFHDDKSQKKGTDATRDNDWTCPKCGNVNFSFRTICNMRKCNTPKPGSQASKSDKNSKQKMPEGSWKCEKCNNINYPFRTKCNRQNCGADKPAESEKSPSPAADQNDQVFGGGLYRVITLSANLEFSGI

SEQ ID NO: 184658 - protein, 284 aa, Glycine max
  Coding DNA Sequence Number=SeqID_67880
LRYGVSLKVNTDMAARSCPVFAAYGGIFRESSNASMGCFAKNLGISKALLLSCWALYWLLRLLLIKLTDGTNVFNWLQILSLEFLTFSEKHTIGNAGGTKAARWKRWWVALTWTIWHHRNKTVFDNQTFITSKVLDDALLLLWVVARILCSRRMSGVILGLGLADFLVVQHAGSCEMETIVEELESLVELLKKTTCDNGLRTEAIVEESWTWARKHELISFNCSYPLEWIAWAEQFFDQQQTKPLAKVQLTFVNMEWLQVLRREKIELDTGRSANKATSNKSGT

SEQ ID NO: 184659 - protein, 111 aa, Glycine max
  Coding DNA Sequence Number=SeqID_67881
  Gene Ontology: Mol. function=heat shock protein binding; Cellular component=integral to membrane; Biological process=protein folding
  Homolog annotation: Hit_ID=Q8GYX8; Match level="QueryCoverage=99%, HitCoverage=32%, E-value=7e-46, Identity=74%"; Hit description =Chaperone protein dnaJ 10
  Pfam annotation: Domain name=DnaJ; Domain location=6-48; Score=43.8; E_value=5.7e-10; Accession=PF00226.21; Description=DnaJ domain
MVKETEYYDVLGVSPTASEAEIKKAYYIKVLGEAYQVLSDPAQRQAYDAHGKSGISTEAIIDPAAIFAMLFGSELFEEYIGQLAMASMASMDIFTEGEQFDSKKLQEKMRV

SEQ ID NO: 184660 - protein, 74 aa, Glycine max
  Coding DNA Sequence Number=SeqID_67882
  Subcellular localization annotation: CTP_CleavageSite=66; ConfidenceScore=5.09e-01
MELAQAISPLKRFASSNVRRLLLKPIGPEITITFFFFFVSNTVTRNRQRQLNKCEDSQNSADGETVAREREREE

SEQ ID NO: 184661 - protein, 74 aa, Glycine max
  Coding DNA Sequence Number=SeqID_67883
MEERRRNGEGPKDTERRPRFKRSSPFVRASRRPSSLSKQPKSLDYRQVICEFYPTYVQIKLIKIGGVRPTSSFI

SEQ ID NO: 184662 - protein, 282 aa, Glycine max
  Coding DNA Sequence Number=SeqID_67884
  Homolog annotation: Hit_ID=Q9SA98; Match level="QueryCoverage=71%, HitCoverage=53%, E-value=3e-57, Identity=57%"; Hit description =Alkylated DNA repair protein alkB homolog
MDRTERSSTPFTDGKSRLLWRTCVTAAVAGLFVTRPLSTTTHEVFPLTEEKWKGVKRPGVTDETLTSSVSSDPFPMYGTENDRDDSERTAFRRAEKKYKLYYDNNASSKNKRKKLPKPVDLTEVLDFRSILECYLQNDVLPPGVIVLHDNFTSPVFSLQNRPGFYFIPGALSIERQCSLIRESLTDFPQPPNRTNHNAMYGPIQDVFVAAKEGKVLVEDNSPITSSETDTDIDHKDGKEWKFTTEKDALSRKCRSASASVLLRKLRWSTLGLQFDWSKLCVY

SEQ ID NO: 184663 - protein, 52 aa, Glycine max
  Coding DNA Sequence Number=SeqID_67885
MAKRVEDPRSRVSGCGETRRELSLKRKLSCIALDEILSDCEVFEDDAWLGLG

SEQ ID NO: 184664 - protein, 130 aa, Glycine max
  Coding DNA Sequence Number=SeqID_67886
MPISPCRCIGWDRAHKSPSGPEVVLQGARFPRQGHVIIGIAPAKHPVDPKKSNRVLELSTLITGLCQFYGVPVTSSKGIRPPTNRAFIKKYCVSRQAQGETPQQPGDGRQRATDAPPSPLEFTSAHPQKG

SEQ ID NO: 184665 - protein, 374 aa, Glycine max
  Coding DNA Sequence Number=SeqID_67887
  Gene Ontology: Mol. function=nucleotide binding; Cellular component =integral to membrane; Biological process=transport
  Homolog annotation: Hit_ID=Q6S9Z3; Match level="QueryCoverage=93%, HitCoverage=100%, E-value=1e-144, Identity=69%"; Hit description =Allantoin permease
  Pfam annotation: Domain name=FAE_3-kCoA_syn1; Domain location=37-319; Score=556.9; E_value=2e-164; Accession=PF07168.2; Description=Fatty acid elongase 3-ketoacyl-CoA sy
  Pfam annotation: Domain name=MFS_1; Domain location=32-361; Score= -49.1; E_value=0.056; Accession=PF07690.6; Description=Major Facilitator Superfamily
  Pfam annotation: Domain name=Sugar_transport; Domain location=79-361; Score=-181.0; E_value=0.02; Accession=PF06800.3; Description=Sugar transport protein
  Pfam module annotation: Pfam domain module=FAE_3-kCoA_syn1::MFS _1::Sugar_transport; Domain location=37-319::32-361::79-361
EFSGLCSLAPSLSESILCTTGLKMYMLESKGGAIACMFLSLFFLGTWPALLTMLERRGRLPQHTYLDYSITNFLAALLIAFTLGGIGKGTHDQPNFLVQLAQDNWPSVLFAMGGGLFLSLGNLSCQYAFAFVGLSVTEVITASITVVIGTTLNYFLDDKINKAEILFPGVGCFLIAVFLGSAVHSSNAADNKAKLNNFTGDYKNGDTSLKDGDIVKSKDLEGGSSSADNVEAGTAVFLMELEEKRAIKAVSCFVIAMILNITFLYHPVLNLPKSSFKAYLADSDGRVWAMLAGLLCGFGNGLQFMGGQAAGYAAADAVQALPLVSTFWGVVLFGEYRKSSRRTYILLGSMLFMFIVAVAVLMASSGQRTSTAKE

SEQ ID NO: 184666 - protein, 104 aa, Glycine max
  Coding DNA Sequence Number=SeqID_67888
MATTKLMDSSRQIANLLGCGNPKPKQECNPIWVLEVVVERHGHRLKHVVVNVVPMERSSSSYTSNPQSHVMCLCNVEAPLVTSWIEDNPRRRFYGCGLYKACRL

SEQ ID NO: 184667 - protein, 38 aa, Glycine max
  Coding DNA Sequence Number=SeqID_67889
MESVVEGHCFFYKFFESLDPKGLDLLKKLYLTYMEQSN

SEQ ID NO: 184668 - protein, 389 aa, Glycine max
  Coding DNA Sequence Number=SeqID_67890
  Gene Ontology: Mol. function=transferase activity; Cellular component= membrane
  Homolog annotation: Hit_ID=Q5BM99; Match level="QueryCoverage=98%, HitCoverage=70%, E-value=1e-139, Identity=65%"; Hit description =Secondary cell wall-related glycosyltransferase family 47
  Pfam annotation: Domain name=Exostosin; Domain location=40-389; Score= 225.7; E_value=1e-64; Accession=PF03016.6; Description=Exostosin family
MFGNRAILVDNEDVVEEASETKTLNGKEKLLKHDEVVLKVFLYDLPPEFHFGLLDGKPSGNSVWPDVRTNIPGYPGGLNLQHSIELWLSLDILASEFPQASKARTVIRVRNSSEANIIFVPFFSSLSYNRYSKGSPHVKKSRNKILQEKLVKYLTTQEERKRSGGNDHLILAHHPKSMLDARMKLWPATFILSDFGRYPPNIANVEKDVIAPYKHLINFYVNDNSNFDSRPTLLYFQGAIYRKDCLRGLMGSLFYKSHLIGILKEQSLTILHPFMKGGLARQELFYLLKNEKDMHFSFGSIGKDGIKKAIEGMHASKFYLNIAGDTPSLNRLFDAIASYCGPVIIDDKIELPYEDVIDYSEFCIFVYTSDAIKENFLINFIRVIAKEEW

SEQ ID NO: 184669 - protein, 50 aa, Glycine max
  Coding DNA Sequence Number=SeqID_67891
MKGIFTLSPTLLSAPAKMLDAPSNYHQKNVRDVGQSHQTCAATHISATSE

SEQ ID NO: 184670 - protein, 69 aa, Glycine max
  Coding DNA Sequence Number=SeqID_67892
MRRVEAVLENGDFWTRGWWRHCEREMDKCPCGPRYEGDSHRSFVLLCVGTRTIQQLPVPLGMELVAAVD

SEQ ID NO: 184671 - protein, 616 aa, Glycine max
  Coding DNA Sequence Number=SeqID_67893
  Gene Ontology: Mol. function=RNA-directed DNA polymerase activity; Cellular component=chromatin; Biological process=chromatin assembly or disassembly
MPFGLCNAPSSFQTTMNSLFRPYLRCFIIVFFDDILIYSASFEKHLTHLEVAFQTQVEYLGHLVSYEGVQPVTSKVEAIQQWSVPQSIRAVRNFLGLIGFYRQFIKGYASIVALLVQIATLDRFHWSTQAQTSFEHLKQALSEAPVLAFLDFALPFTIETNASGVGMGAVLSQQGHPIAFFSKPFTAKLFSASTYVRELFEITMAVKRWRQYLLGHPFLIIIDHRSLKELLTLAIQSPEQHTYLARLMGYDYQIIYCSGTHNQVMDALSRLPEQPRSSLMTLSVPCLTFILELHQQLEACPVYVDHKNAILQSPTAHPNFTITNNLVLHKRHIWLPRGFLMIPTLLTKYHSTPIGVLHRPWEDLSLDFISVLPPYHDNTVILVVVDPFSKGIHLGMLPTSHTAHTMASLFVDTPSRIVNHERGANYSSGLSGPTIPLGMQQQGSSKLDAVEDILTDRDETFRIVKKKLLKAQTTMKDWVLLKLRPRHPLSTKDSSEVKGNLAKHFYEPFKGSPKLDEAVQLPSQFFQNQPRISPLAILNYRRLSPSGPWEDKVILQGPPVDSITNTWENTTSRGKDATNTKVPLANDHAQQAEIEVQTGSKTKRKISRPAYLKDFV

SEQ ID NO: 184672 - protein, 38 aa, Glycine max
  Coding DNA Sequence Number=SeqID_67894
MVGARHSGSEDEVPGACHHKARASGSMILGSELTLIPY

SEQ ID NO: 184673 - protein, 255 aa, Glycine max
  Coding DNA Sequence Number=SeqID_67895
  Gene Ontology: Mol. function=protein domain specific binding; Cellular component=spindle pole body; Biological process =intracellular signaling cascade
  Homolog annotation: Hit_ID=Q9C5W6; Match level="QueryCoverage=97%, HitCoverage=86%, E-value=1e-106, Identity=79%"; Hit description=14-3- 3-like protein GF14 iota
  Pfam annotation: Domain name=14-3-3; Domain location=1-235; Score =395.9; E_value=5.9e-116; Accession=PF00244.10; Description=14-3-3 protein
MVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKIYNWLFSLKSKRKLSGQIWKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEVCAL

SEQ ID NO: 184674 - protein, 409 aa, Glycine max
  Coding DNA Sequence Number=SeqID_67896
  Gene Ontology: Cellular component=mitochondrion
  Homolog annotation: Hit_ID=Q7XAM2; Match level="QueryCoverage=93%, HitCoverage=61%, E-value=1e-135, Identity=61%"; Hit description =Pentatricopeptide (PPR) repeat-containing protein-like protein
  Pfam annotation: Domain name=PPR; Domain location=13-47; Score=10.9; E_value=0.38; Accession=PF01535.11; Description=PPR repeat
  Pfam annotation: Domain name=PPR; Domain location=289-323; Score =28.5; E_value=2.3e-05; Accession=PF01535.11; Description=PPR repeat
  Pfam annotation: Domain name=PPR; Domain location=324-358; Score =24.0; E_value=0.00054; Accession=PF01535.11; Description=PPR repeat
  Pfam module annotation: Pfam domain module=PPR::PPR::PPR; Domain location=13-47::289-323::324-358
MLQSGNDALPDDESYDLVIGMLFSMGQIDTAFKYIDLILKSGNVLSMKVFMNCVGSCVNKGRLDTLVTIIERCRASDQNKALCPNWDLCNFIVEIATREDNSKLSFYGLEFMAKWIVKGERQRPPIYLSVDEGLVLSALLTAGRTYNSDLLVASWAVLDRSLRKKKVPNPESYLGKIYALASLGNLQKAFGTLNEYEAAYGDSGQEAEDLFCPFTSLHPLVVACSKKGFETLDNVYFQLENLNRAEPPYKSVAALNCVILGCANIWDLDRAYQTFESIGSTFGLIPDIHSYNGLMYAFGKLKKTHEATRVFEHLVSLGLKPNAKSYSLLVDAHLINRDVKSALAVIDDMRAAGYEPSKEVLKKVRRRCMREMDNESDARVQSLELLKIGNSENKTDLSFLLDELKLNGV

SEQ ID NO: 184675 - protein, 679 aa, Glycine max
  Coding DNA Sequence Number=SeqID_67897
  Gene Ontology: Mol. function=methyltransferase activity; Cellular component=cellulose and pectin-containing cell wall; Biological process=metabolic process
  Homolog annotation: Hit_ID=Q1SBM2; Match level="QueryCoverage=65%, HitCoverage=99%, E-value=1e-162, Identity=64%"; Hit description =Putative methyltransferase, putative
  Pfam annotation: Domain name=DUF248; Domain location=130-674; Score =391.2; E_value=1.5e-114; Accession=PF03141.7; Description=Putative methyltransferase
  Pfam annotation: Domain name=Methyltransf_11; Domain location=283 -372; Score=29.3; E_value=1.4e-05; Accession=PF08241.2; Description =Methyltransferase domain
  Pfam module annotation: Pfam domain module=DUF248::Methyltransf_11; Domain location=130-674::283-372
VVVAFHFACCSWNSGLVEFGVGFESFCQRKFKDLDMRSSWFNKLSIIIGPRPPVNWLFLWLMSLLVLIVVLGSSSSNIVDPAPHIPVSLIYTNYRRVKEQAAVDYLELRSVAQGVSRQREFDLCGKERENFVPCYNVSASLLAGFKDGEEFDRHCELLVEAERCLVRPPKEYKIPLQWPTARDVIWSGNVKITKNQFLSSGSMTKRLMLLEENQIAFHSEDGLIYDGMKDYSRQLAEMIGLGSDYELPQAGVSLPFIIISPLGNIMSDKADFCAKWFNVHTILDVNCGFGSFAAHLAPLKIMTVCIAPYEATGSQVQLALERGLPAVIGNFIARQLPYPSLSYDMVHCAQCGIIWDEKEVDRVLKPGGYFVLTSPTSRSQGSSSQMKRRNMLMPMEQLTQKLCWTPLAQQDETFIWQKTADVNCYESRKKHAIPLCKEDDDAQSYYRPLQPCISGTSSKRWIAIQNRSSGYELSSAELKMNGKYCVQPEDFFEDLQFWRSALKNYWSLLTPLIFSDHPKRPGDEDPLPPFNMMRNVMDMSTKYGGLNTALLEENKSVWVMNVVPATASNSLPFILDRGFAGVMHDWCEPFPTYPRTYDMLHANGLLSHLTSERCSLVNLFLEMDRILRPEGWVILSDNMGDIEMARTLAAQVRWEARVIDLKNGSDQRLLVCQKPFLKK

SEQ ID NO: 184676 - protein, 381 aa, Glycine max
  Coding DNA Sequence Number=SeqID_67898
  Gene Ontology: Mol. function=protein binding; Cellular component =intracellular; Biological process=defense response
  Pfam annotation: Domain name=PPR; Domain location=160-194; Score =26.7; E_value=8.2e-05; Accession=PF01535.11; Description=PPR repeat
  Pfam annotation: Domain name=PPR; Domain location=226-260; Score =29.9; E_value=8.8e-06; Accession=PF01535.11; Description=PPR repeat
  Pfam annotation: Domain name=PPR; Domain location=284-318; Score=0.8; E_value=6; Accession=PF01535.11; Description=PPR repeat
  Pfam annotation: Domain name=PPR; Domain location=30-64; Score=7.9; E_ value=0.86; Accession=PF01535.11; Description=PPR repeat
  Pfam annotation: Domain name=PPR; Domain location=89-123; Score=25.6; E_value=0.00018; Accession=PF01535.11; Description=PPR repeat
  Pfam module annotation: Pfam domain module=PPR::PPR::PPR::PPR::PPR; Domain location=160-194::226-260::284-318::30-64::89-123
MLDVIGKSRNIDLFWDLLNDMACRRFVNDKTFVTALRTLGGARELKKCVEFFHLVNSNGCEYNLGTLNKIIEAMCKSRLVEEAKFVVFKLRENLIRGYCDKGDLVEASKVWNLMEDEGFEADVDAVEKMMETLFNVNEYGEALRLFETLRFKRMDELGASTYGLVIRWLCKKGMTAQAHEVFVEMHKRGVWVENSTLGDVVYGLLMRRRVREAYGVFEGIEAPDLSVYHGLIKGLLKLRRAGEATQVFREMIGRGCEPTMPRYILLLQGHLGRRGRKGSDPLVNFDTIFVGGMVKAGKSKEATKYVERVLNRGMEVPRFDYNKFLHSFSNEEGVHMFEDVGKKLREVGLVDLADILERYGQKMATRDRRRNRSPITEDSND

SEQ ID NO: 184677 - protein, 78 aa, Glycine max
  Coding DNA Sequence Number=SeqID_67899
MQGSGFEGPMPQKKRERESSNLAASFPHDHECSDEILEAVARKVPPMRLKLNRFERISRSPPSPDEGLRSIPAPKNFW

SEQ ID NO: 184678 - protein, 460 aa, Glycine max
  Coding DNA Sequence Number=SeqID_67900
  Gene Ontology: Mol. function=catalytic activity; Cellular component =integral to membrane; Biological process=response to nematode
  Homolog annotation: Hit_ID=Q69V70; Match level="QueryCoverage=77%, HitCoverage=99%, E-value=1e-129, Identity=65%"; Hit description =Transporter-related-like
  Pfam annotation: Domain name=DUF6; Domain location=276-413; Score =4.8; E_value=0.035; Accession=PF00892.11; Description=Integral membrane protein DUF6
  Pfam annotation: Domain name=TPT; Domain location=271-413; Score =162.0; E_value=1.6e-45; Accession=PF03151.7; Description=Triose -phosphate Transporter family
  Pfam annotation: Domain name=UAA; Domain location=120-419; Score= -162.0; E_value=0.026; Accession=PF08449.2; Description=UAA transporter family
  Pfam module annotation: Pfam domain module=DUF6::TPT::UAA; Domain location=276-413::271-413::120-419
MVVMVGREALGVGREACEGGGKKQEGSVVGGERQRCNHQSGSAKRSSQLRIITQIEIEFKVKFGKTNLCHCTFTDLRLRASLCRSSVRKAVTISPLTTTKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQVFLASARKRCAINSQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITSYKMSSGAILCILLSCSLAVFCNVSQYLCIGRFSAVSFQVLGHMKTVCVLTLGWLLFDSELTFKNIMGMIIAVVGMVIYSWAVELEKQSNAKTLPHVKNSMTEEEIRLLKVGVENSPLKDVELGEAQG

SEQ ID NO: 184679 - protein, 432 aa, Glycine max
  Coding DNA Sequence Number=SeqID_67901
  Gene Ontology: Mol. function=protein kinase activity; Cellular component=intracellular; Biological process=protein amino acid phosphorylation
  Homolog annotation: Hit_ID=Q2QNV4; Match level="QueryCoverage=99%, HitCoverage=61%, E-value=2e-79, Identity=31%"; Hit description =Pentatricopeptide, putative, expressed
  Pfam annotation: Domain name=PPR; Domain location=128-161; Score =10.2; E_value=0.46; Accession=PF01535.11; Description=PPR repeat
  Pfam annotation: Domain name=PPR; Domain location=228-262; Score =31.0; E_value=4e-06; Accession=PF01535.11; Description=PPR repeat
  Pfam annotation: Domain name=PPR; Domain location=24-58; Score=33.9; E_value=5.4e-07; Accession=PF01535.11; Description=PPR repeat
  Pfam annotation: Domain name=PPR; Domain location=332-366; Score =47.5; E_value=4.4e-11; Accession=PF01535.11; Description=PPR repeat
  Pfam annotation: Domain name=PPR; Domain location=367-401; Score =12.1; E_value=0.27; Accession=PF01535.11; Description=PPR repeat
  Pfam module annotation: Pfam domain module=PPR::PPR::PPR::PPR::PPR; Domain location=128-161::228-262::24-58::332-366::367-401
MYVKIGDLHSGLKVFEEMPQRNVVSWSAVMAGCVQNGCASEALWLFSRMQQEGVTKPNEFTFVSALQACSLTETENVTLAYQIYSLVVRSGHMSNIFLLNAFLTALVRNGRLAEAFQVFQTSPGKDIVSWNTMIGGYLQFSCGQIPEFWCCMNREGMKPDNFTFATSLTGLAALSHLQMGTQVHAHLVKSGYGDDLCVGNSLADMYIKNHRLDEAFRAFDEMTNKDVCSWSQMAAGCLHCGEPRKALAVIAQMKKMGVKPNKFTLATALNACASLASLEEGKQFHGLRIKLEGDIDIDVCVDNALLDMYAKCGCMDSAWGLFRSMNCCRSVISWTTMIMACAQNGQSREALQIFDEMRETSVVPNHITYVCVLYACSQGGFVDEGWKYFSSMTKDCGIFPGEDHYACMVNILGRAGLIKEAKELILRMPFQP

SEQ ID NO: 184680 - protein, 84 aa, Glycine max
  Coding DNA Sequence Number=SeqID_67902
  Gene Ontology: Mol. function=DNA binding; Biological process=DNA integration
MAIVTCELIWLKQLLRELRFEETTRMTLICDNTSNPVFHERTKHIEVNCHFIQEKIKSGDTSTRGPRIAFICNKQDTYDLYALA

SEQ ID NO: 184681 - protein, 136 aa, Glycine max
  Coding DNA Sequence Number=SeqID_67903
  Homolog annotation: Hit_ID=Q1SR56; Match level="QueryCoverage=24%, HitCoverage=15%, E-value=4e-08, Identity=85%"; Hit description=HAT dimerisation
MAGDILAIPISTVASESTFSAGGRVIDEYRSKLNGVREGDARQKWSIRSNVICRSIVFWNSTSTSSGNVDQRNIHVSGDRRGWREEVANQRESEIASEERSQIKEEITHQRERSQSKSNCKNPSQSKREKSQICVD

SEQ ID NO: 184682 - protein, 847 aa, Glycine max
  Coding DNA Sequence Number=SeqID_67904
  Gene Ontology: Mol. function=binding
  Homolog annotation: Hit_ID=Q336U8; Match level="QueryCoverage=97%, HitCoverage=64%, E-value=1e-153, Identity=38%"; Hit description=TPR Domain containing protein, expressed
  Pfam annotation: Domain name=TPR_1; Domain location=143-176; Score =11.0; E_value=0.26; Accession=PF00515.18; Description=Tetratricopepti de repeat
  Pfam annotation: Domain name=TPR_1; Domain location=561-594; Score =0.1; E_value=5.3; Accession=PF00515.18; Description=Tetratricopeptide repeat
  Pfam annotation: Domain name=TPR_1; Domain location=74-108; Score =12.7; E_value=0.16; Accession=PF00515.18; Description=Tetratricopepti de repeat
  Pfam annotation: Domain name=TPR_2; Domain location=143-176; Score =11.5; E_value=1.5; Accession=PF07719.7; Description=Tetratricopeptide repeat
  Pfam annotation: Domain name=TPR_2; Domain location=300-333; Score =5.6; E_value=7.4; Accession=PF07719.7; Description=Tetratricopeptide repeat
  Pfam annotation: Domain name=TPR_2; Domain location=38-73; Score=2.5; E_value=17; Accession=PF07719.7; Description=Tetratricopeptide repeat
  Pfam annotation: Domain name=TPR_2; Domain location=561-594; Score =1.7; E_value=21; Accession=PF07719.7; Description=Tetratricopeptide repeat
  Pfam annotation: Domain name=TPR_2; Domain location=74-108; Score =6.3; E_value=6; Accession=PF07719.7; Description=Tetratricopeptide repeat
  Pfam module annotation: Pfam domain module=TPR_1::TPR_1::TPR_1::TPR _2::TPR_2::TPR_2::TPR_2::TPR_2; Domain location=143-176::561-594::74 -108::143-176::300-333::38-73::561-594::74-108
SSLHVNGAVAYCSPAYRASEEEGAEHLFRRLQDSSDDASIHFDIGVFLWEKGGEAKEKAAQHFILSAKLNPKNGDCFKYLGHYYGGVSLDTQRAIKCYQRAVVLNPDDSESGEALCNLLDQGGKESLEVVVCREASEMSPRAFWAFRRLGFLQVHQKKWSEAVLSLQHALRGYPTCADLWERLGRFTAAIKVAPLLGSLLYLLDDGSLNCCFTYGLWVLHQSYGRAIELDDTMVFALVESGNISVTLGSFSKAINICARIAVNPSSPSSSLLPLAAPGVEQFRQALEISPRCVPAQYGLALGLLGLAKDCINLGAYQWGASLLEEASEVARASAYFLRNISCIWKLHADIQLAYARCYPWIEDVQELEANKEAFSASIISWRRTCFLAAKHARFSYQRASHLSPWQANIYADIAVISDLITSLDKNYKQDINAWQLAEKMSMGALLLEGDSYEFWLALGCLSDHNALNQHALIRALQLNVSLAVAWGYLGKVARTPDSTALVAHTGNSFACISQTPLVPWVLDSGAFDHISGNRSLFSSLSTSGHLPTITSADGSQTPSKAYVFVECFQLYRKVDEKQLARQMFDRARSIDPGLALPWASMSFESCVGELESDEAFESCSRAVQIMPLAEFQLGLTKLALLSGHLSSSQVFGAIQQAVQLSPHYPESHNLHGLAGNAADALQECEHLKKEGALDDEGLQVYGFSLWQLGENDLALSVARSLAATLSSMQKTSVATSICFICRLVYYIRGLDAAITSIVKMPKELFQSSKVSFVMTAINALDRQNRLGFVVSSSRYFLKYHEEIAGMHLLIALSKLVKNESDCCLDIQSGVAHLKKALHMFPNCSLIR

SEQ ID NO: 184683 - protein, 332 aa, Glycine max
  Coding DNA Sequence Number=SeqID_67905
  Gene Ontology: Mol. function=DNA binding; Biological process =regulation of transcription, DNA-dependent
  Homolog annotation: Hit_ID=Q9LJL1; Match level="QueryCoverage=47%, HitCoverage=47%, E-value=2e-28, Identity=42%"; Hit description =Arabidopsis thaliana genomic DNA, chromosome 3, P1 clone: MVI11
  Pfam annotation: Domain name=B3; Domain location=73-167; Score=73.9; E_value=4.9e-19; Accession=PF02362.12; Description=B3 DNA binding domain
MAEKERWPVCSFMGDGEAVAVPHSKLKKKGRPPIPKKGEGTGMGIVIDAPPCNTQAYQRAKEVQANLSPQFPTFLKSMLPSHVAGGFWLGLPKKFCNLYMPKLDTTIALEDETGQLYETKYLAQKAGLSAGWRGFSIAHNLLEMDVLIFHLVQPSKFRVYIIRSQESDELDGALVLLKSDGCRKQSDDANDHKNSGMIFCANVSHPDQVENTSEDFDSGIRFSESVVSFKQVTGVENFRIVVNGLVIDSELSKYIRNKYYELCCSQRSFLHDHLLEGLNTKLAAGIISETINIADAIKASNLTTSPDSLLLAYFGLDQLMKLALKLKRVQGR

SEQ ID NO: 184684 - protein, 345 aa, Glycine max
  Coding DNA Sequence Number=SeqID_67906
  Gene Ontology: Mol. function=histone deacetylase activity; Cellular component=nucleus; Biological process=regulation of transcription, DNA-dependent
  Homolog annotation: Hit_ID=O22446; Match level="QueryCoverage=93%, HitCoverage=64%, E-value=1e-127, Identity=68%"; Hit description =Histone deacetylase
  Pfam annotation: Domain name=Hist_deacetyl; Domain location=1-177; Score=134.3; E_value=3.3e-37; Accession=PF00850.10; Description =Histone deacetylase family
MAGYIITCFKMWVLRDIAFYNSINRVLYVDIDIHHGDGVEEAFYTTDRVMTVSFHKFGDYFPGTGDIRDIGYAKGKYYSLNVPLDDGIDDESYQSLFKPIMGKVMEIFRPGAVVLQCGADSLSGDRLGCFNLSIKGHAECVRYMRSFNVPLLLLGGGGYTIRNVARCWCFETSVALGIELDDKMPQHEYYEYFGPDYTLHVAPSNMENKNSRQLLDEIRAKLLDNLSRLQHAPSVPFQERPPDAELLERDEDQDDRDERWDPDSDREVGDDSNPVRRRVKSECVDAEDKDTESYHKHLDCGRDYLTPFKEISCSKVSGVDSMAVDEPCIKEEQDNLKELSDHRPR

SEQ ID NO: 184685 - protein, 116 aa, Glycine max
  Coding DNA Sequence Number=SeqID_67907
  Gene Ontology: Mol. function=zinc ion binding; Cellular component =nucleus; Biological process=regulation of transcription
MAKALFEVMLGAYHGLCTWYLNQNGMEHLDEEQFEEGLRTIIKYCVKKNTRLQKVYTLKEKWAHCYMMKALTLGMQSTQPSESINAHIKSYMNVNLDIIKFFKNFEDFVEAKRYEE

SEQ ID NO: 184686 - protein, 259 aa, Glycine max
  Coding DNA Sequence Number=SeqID_67908
  Gene Ontology: Mol. function=four-way junction DNA binding; Cellular component=nuclear chromosome; Biological process=microsporogenesis
  Homolog annotation: Hit_ID=Q9M6R5; Match level="QueryCoverage=98%, HitCoverage=46%, E-value=1e-109, Identity=70%"; Hit description =Meiotic asynaptic mutant 1
  Pfam annotation: Domain name=HORMA; Domain location=13-201; Score =161.3; E_value=2.5e-45; Accession=PF02301.8; Description=HORMA domain
MVVAQKVKEAEITEQDSLLLTRNLLRIAIFNISYIRGLFPEKYFNDKSVPALGVYDALQKKYLKTLLFCVCEAVDGPMIEEYAFSFSYSNSDNQEVSMNINRTGSKKNRGTFKYNSTTEITPQQMRSSACKMIRTLVQLMRTLEKMPEERTILMKLLYYDDVTPADYEPPFFKGCTDEEAYHPWEKNPLKMEVGNVNSKHFVLALKVKSVLDPCEDDNEGIQDDLSAGDDSMQHNEYYDTDSEVDLTQGNRYIVAPIRN

SEQ ID NO: 184687 - protein, 548 aa, Glycine max
  Coding DNA Sequence Number=SeqID_67909
  Gene Ontology: Cellular component=nuclear chromosome; Biological process=microsporogenesis
  Homolog annotation: Hit_ID=Q9M6R5; Match level="QueryCoverage=57%, HitCoverage=50%, E-value=1e-76, Identity=52%"; Hit description =Meiotic asynaptic mutant 1
  Pfam annotation: Domain name=REF; Domain location=321-527; Score =313.9; E_value=3e-91; Accession=PF05755.3; Description=Rubber elongation factor protein (REF)
MTDKEQEQEENGMIDEDNTQDPVEDEQQLVRVKEWINCCHRDTIELNDVLSNFPDISVVLTEEIMEKLVEEGVLSKTGKETYAINKDKKLEYEFPVVKEEIDGQIPQAFDRGLQFEDRIYMKALYHVLPMTHVSLTKLQSLLEGEVNQTAGRKILDKMVRDGFVEPKGSKRLGKRVIHSELTERKFIEVQKALSATEAMDVDHCEPNSKFKKTGFHLNGDGLRHNYDVSTCGVLHSIGSDLTRMKVTSETNYSDSGSGQKTIKAKEPGNTPISRPVISRESFAQGKENGRTNGIENQGDEADTIICSKSSQDKRPRKTSAVTVESKNKDLKHLGFVRIAAIQTFVIVSNLYEYAKQNSGPLRSVVGTVENTVTTILGPVCNKFKDVPDDVLVFVDKKVDEASHKFDEHAPPFAKHIADQAKGVIQKVTCEAGKVASEAQSGGPRAAVHYVATESKHFVLINSVKLWNGLNHYPPFHALSEMAIPTVAHWSEKYNHVIKAMTQKGYSFVGYLPLIPIEEIAKAFKQGEANLKGDNAASEEQRSESSDSD

SEQ ID NO: 184688 - protein, 713 aa, Glycine max
  Coding DNA Sequence Number=SeqID_67910
  Gene Ontology: Mol. function=metallopeptidase activity; Cellular component=mitochondrion; Biological process=protein maturation via proteolysis
  Homolog annotation: Hit_ID=Q8VY06; Match level="QueryCoverage=81%, HitCoverage=52%, E-value=0.0, Identity=71%"; Hit description =Presequence protease 2, chloroplast/mitochondrial precursor
  Pfam annotation: Domain name=M16C_assoc; Domain location=579-713; Score=-98.9; E_value=0.0025; Accession=PF08367.1; Description =Peptidase M16C associated
  Pfam annotation: Domain name=Peptidase_M16; Domain location=107-268; Score=-30.3; E_value=0.057; Accession=PF00675.10; Description =Insulinase (Peptidase family M16)
  Pfam annotation: Domain name=Peptidase_M16_C; Domain location=301 -502; Score=93.8; E_value=5.2e-25; Accession=PF05193.11; Description =Peptidase M16 inactive domain
  Pfam module annotation: Pfam domain module=M16C_assoc::Peptidase _M16::Peptidase_M16_C; Domain location=579-713::107-268::301-502
  Subcellular localization annotation: CTP_CleavageSite=81; ConfidenceScore=5.13e-01
MERAALVRCLPCSSVLCRRYLHSHSHLCRPSSSISIIPSLSLPTIRPLCLPRRRSSSSSRLLPLYFRTTINRKHFSSLAPRAVLSPSPSSGFAEVNDEVALKLGFEKVSEEFIPECKSKAVLFRHIKTGAQVMKDSTGIPHILEHSVLCGSRKYPLKEPFVELLKGSLHTFLNAFTYPDRTCYPVASTNAKDFYNLVDVYLDAVFFPRCVEDFQIFQQEGWHFELNDPSEDITYKGVVFNEMKGVYSQPDNILGRAAQQASFLMACPFLIFILLLSLFIQALFPDTTYGVDSGGDPRVIPKLTFEEFKEFHRKYYHPSNSRIWFYGDDDPNERLRILSAINHLLLPLLCCPEYLDLFDSSLASHESRVEPQTLFSKPVRIVETYPAGEGGDLKKKHMVCLNWLLSDKPLDLETELTLGFLNHLLLGTPASPLRKILLESRLGDAIVGGGVEDELLQPQFSIGMKGVSEDDIHKVEELVTSTLKKLAEEGFDTDAIEASMNTIEFSLRENNTGSFPRGLSLMLQSIGKWIYDMNPFEPLKYEKPLQDLKSRIAKEGSKSVFSPLIEKFILNNPHQVTVEMQPDPEKAARDEVAEKQILQKVKASMTTEDLAELARATHELRLKQETPDPPEALKTVPSLSLQDIPKEPIRVPTEVITTSPRVSIQHEIIEARASSIGATVLPFPCICKEAVSGFEPMTNKSPRHNFTAAPGLAL

SEQ ID NO: 184689 - protein, 478 aa, Glycine max
  Coding DNA Sequence Number=SeqID_67911
  Gene Ontology: Mol. function=phosphoric monoester hydrolase activity; Cellular component=chromosome, pericentric region; Biological process= response to salt stress
  Homolog annotation: Hit_ID=Q84K83; Match level="QueryCoverage=96%, HitCoverage=98%, E-value=1e-100, Identity=46%"; Hit description =Putative NLI interacting factor
  Pfam annotation: Domain name=NIF; Domain location=274-453; Score =247.0; E_value=4e-71; Accession=PF03031.8; Description=NLI interacting factor-like phosphatase
MQTKKKTSRRNASQECGSPKVLRAPRKVSENGRATEKKVKDLITSSARKNKSFSTLENKAREPIPPTDLNNGYEFMDSGNSNACLENDAVDGISLDSMGCNNQAVHLESGTIFSPGFHLSKNSGGVDKVDFIKIFQNEDHERVSPCQEIESPQEDAVDGHVSQDSDTAMEVDINNSSNYSNSGRCGNQMLALSTTNVNGCNSDYDGNGLSMEVSAIYLAVKNSKLECVDEHSQNPMSSEICTEEDEFEDFDDFDPYLFIKTLPDLSTVVPTFRRLLLPKQTRSCPSTTLVLDLDETLVHSTLEHCEDVDFTFPVNFNSEEHIVYVRCRPHLKDFLERVSGLFEIIIFTASQSIYAEQLLNVLDPKRKIFRHRVYRESCVYVEGNYLKDLTVLGRDLAHVIIIDNSPQAFGFQVDNGIPIESWFDDRSDQELFLLLPFLESLVGVDDVRPLIAKKFNLREKIAAAALPLNTNRRDFLSE

SEQ ID NO: 184690 - protein, 311 aa, Glycine max
  Coding DNA Sequence Number=SeqID_67912
  Gene Ontology: Mol. function=nucleic acid binding; Cellular component= nucleus; Biological process=response to DNA damage stimulus
  Homolog annotation: Hit_ID=Q0PCS3; Match level="QueryCoverage=97%, HitCoverage=36%, E-value=1e-127, Identity=66%"; Hit description=Rad54
  Pfam annotation: Domain name=DEAD; Domain location=1-129; Score= -43.8; E_value=0.028; Accession=PF00270.19; Description=DEADDEAH box helicase
  Pfam annotation: Domain name=SNF2_N; Domain location=1-233; Score =67.3; E_value=5e-17; Accession=PF00176.13; Description=SNF2 family N- terminal domain
  Pfam module annotation: Pfam domain module=DEAD::SNF2_N; Domain location=1-129::1-233
FDGKPMVRKAIIVTPTSLVSNWEAEIKKWVGERVPLVALCESTREDVISGIDNFTSPKSNLQVLIVSYETFRMHSSKFSSTDSCDLLICDEAHRLKNDQTITNRALAALPCKRRILLSGTPLQNDLEEFFAMVNFTNPGILGDIAHFRRYYEENQLQNVSGRCDAGMGQWAPIICGREPAATAEEKKLGAEQSAELSVNVNRVKRAITEELKQSKILAYITALKKLCNHPKLIYDTIRSGSPGTSGFEDCIRFFPPEMLSGRSGSWTGGHGAWVELSGKMHVLARLLAHLRQRTNDRIVLVSNYTQVYGNK

SEQ ID NO: 184691 - protein, 394 aa, Glycine max
  Coding DNA Sequence Number=SeqID_67913
  Gene Ontology: Mol. function=nucleic acid binding; Cellular component= nucleus; Biological process=transcription from RNA polymerase II promoter
  Homolog annotation: Hit_ID=Q0PCS3; Match level="QueryCoverage=58%, HitCoverage=25%, E-value=5e-96, Identity=75%"; Hit description=Rad54
  Pfam annotation: Domain name=Helicase_C; Domain location=160-238; Score=73.1; E_value=8.9e-19; Accession=PF00271.21; Description =Helicase conserved C-terminal domain
  Subcellular localization annotation: CTP_CleavageSite=66; ConfidenceScore=5.14e-01
MLFGPVNARFMLQEHGLNFTNLKIGNLIKSMASYSVGSPSSTRSRCSGLLWTLQRHFGAGDRVEVSGFCPKSTTQICIQQLLKAFHQKSLIEATQGGTDLVLPMLDTQQRQLRCHDLQSEIECEIVFGDGDDEGATSEECSSGEEGGEFIAEAMNEKEDQNCALYPHLRLDGSTSISKRQKLVNCFNDPSKDEFVFLLSSKAGGCGLNLIGGNRLVLFDPDWNPANDKQAAARVWRDGQKKRVYIYRFLSAGTIEEKVYQRQMSKEGLQKVIQQEQTDSLVAQGNLLSTENLRDLFTFHENIKSEIHENMQCSRCQTFDGPRSTEAQSTITDSESDEETSDIGGFAEIAGCLQNLKRSEKQVGSPLEEDLGSWGHHFFPTSVPDAILQASAGDE

SEQ ID NO: 184692 - protein, 301 aa, Glycine max
  Coding DNA Sequence Number=SeqID_67914
  Gene Ontology: Mol. function=microtubule binding; Cellular component =phragmoplast; Biological process=positive regulation of microtubule polymerization
  Homolog annotation: Hit_ID=Q6ZJ66; Match level="QueryCoverage=91%, HitCoverage=56%, E-value=2e-76, Identity=55%"; Hit description =Putative microtubule-associated protein
MWIPVTGTPGKRLIYFILYICLLITPIIWDEVGEDKFEREKVLLDLEQECLEVYRRKVDRANISRARLHQELAEAEAEFTHLLLSLGERSLPGRPEKRAGSLKEQLDSITPALREMRLRKEERLNQFRTVQGQIQKISAEIAGNSDNEPSTIVVNENDLSLKRLEEYQNELHRLYNEKNERLQQVEKYIDIIHSLSTILGKDSSAIIMEVHPSLNDLCGITKNISDTILDKLNITVESLFEEKQTRLDKLHHLGKALSNLWNLMDTSYSERQSFSHVINLLSLSSAEVTDPGSLTLEIVQQ

SEQ ID NO: 184693 - protein, 636 aa, Glycine max
  Coding DNA Sequence Number=SeqID_67915
  Gene Ontology: Mol. function=hydrolase activity; Cellular component =chromosome, telomeric region; Biological process=response to DNA damage stimulus
  Homolog annotation: Hit_ID=Q1S9Y2; Match level="QueryCoverage=99%, HitCoverage=100%, E-value=0.0, Identity=69%"; Hit description=AAA ATPase
  Pfam annotation: Domain name=Prefoldin_2; Domain location=267-358; Score=-9.6; E_value=0.1; Accession=PF01920.10; Description=Prefoldin subunit
  Pfam annotation: Domain name=SMC_N; Domain location=3-625; Score= -124.0; E_value=0.015; Accession=PF02463.9; Description=RecFRecNSMC N terminal domain
  Pfam module annotation: Pfam domain module=Prefoldin_2::SMC_N; Domain location=267-358::3-625
MSTVDKMLIKGIRSFDPENKNVITFFKPLTLIVGPNGAGKTTIIECLKLSCTGELPPNARSGHSFIHDPKVAGETETKGQIKLRFKTAAGKDVVCVRSFQLTQKASKMEYKAIESVLQTINPHTGEKVCLSYRCADMDKEIPALMGVSKAILENVIFVHQDEANWPLQDPSTLKKKFDDIFSATRYTKALEVIKKLHKEQAQEIKTYKLKLENLQTLKDAAYKLRESIAQDQEKTESAECQLQQLDGSIQELDHKIHHTEETLKYLRKLQEQISTKTAQRSILFKEQQKQYLALTEEIEDTDEELMEWKTKFEERIASLETKISRLERETEDIDCTSSTLKETIAESIEVIAKLQAEAEAHMSFKNERDSSIHNLFTTYNLGSLPKSPFSAEVALNLTNRVKSRLEDLEKDLDDKKKANDNEIKMAFDCYMNANDRLKHTEAKIKAMTGSKSGISKRIEEKKNELDSLELQISDENFSQLDERERNLENEVKRKASQLDERQFEPNKCEVEKEIYSVDQKIKAVSREKDIMVSDSQDRVKLSYKKGELESQKKKHKKIIDEQKDKIRKVLKGRVPLDKDVKKEIMQALRAVGAEFDDLNAKYREAEKEVNVLQVKIQEVNSNLSKHHKDLECNLLV

SEQ ID NO: 184694 - protein, 205 aa, Glycine max
  Coding DNA Sequence Number=SeqID_67916
  Gene Ontology: Mol. function=3'-5' exonuclease activity; Cellular component=intracellular; Biological process=DNA recombination
  Homolog annotation: Hit_ID=Q1S9Y1; Match level="QueryCoverage=65%, HitCoverage=43%, E-value=6e-58, Identity=83%"; Hit description=3-5 exonuclease
  Pfam annotation: Domain name=3_5_exonuc; Domain location=50-205; Score=17.8; E_value=3.1e-06; Accession=PF01612.11; Description=3'-5' exonuclease
MKIQTKHTLYIVEYFLSDIGYVSKKLCQASPGTAVKLCLGDSLVMGSNPETASLHMQGASLFCVANYNVDEGVPPGKVAVMQICGDTRHCHVLHLIHSGIPQNLQLLLEDPTVLKVGAGIDGDAVKVFRDYNISVKGVTDLSFHANQKLGGDHKWGLASLTEKLLSKQLKKPNKIRLGNWEAPVLSKEQLEYAATDAFASWCLYQ

SEQ ID NO: 184695 - protein, 717 aa, Glycine max
  Coding DNA Sequence Number=SeqID_67917
MPEFLQLSSQLLILKASCYQLLTWFITYGLPFLTLLFMNILAASILDSHLELEEVSEHSKAFMPADSLRAPTHVSESKSSVLQKNNILTIPSQPAFRLSPTMVRGHSTETKDLAAEKSTVQKFDLISNSENKPTLLWKMPQNPSIPTYSTTETPSMKIKSSEMPFPNSKMTMATSSTTGDKLSSSFTPESWGKGFPSSGSHLSTISAPSTFLGKVTEFHVDKSLPKENISAVPTFGGSFKSLLFPTIKTSPSPSSSSVSSAAVSVASSSLTSSNTSTDSNRVMSSSSTSASLHLSNQAPKDTVPSIPNPPGLKLTLESLKSEIPPAAALKSDMQPAAVSNSKTVLDASAEVVTRPNEPLNGASELKLGPSRNFSPTIEQPSNNTTSFGLNVVSVSQAAQPSDAPLQLSTSFLSSASVSNRKNEGLDFGISHEDEMEEEAPETSNNTTELSLGSFGGFGISSSPNPSMPKTNPFGGSFNNVATSLPSSTVTFSVPSGELFKPASFNFSSPQSSSPTQTTISGAFSGGFNAVAAVPAQAPGGFGQPAQIGSGQQVLGSVLGGFGQSRQLGSGFAAPSGFGGGFAGGSSPSGFSNTAIGGGFAGIASTGRGFGSVASTSSGGFSGIASGGGFGGGAAPGGGFGAAAPGGGFGAAATPGGGFAGAAAPGGGFGAASSTGGFAGAGSGGGFGAFSSQGSGGFGAFGSGGGSKPPELFTQMRK

SEQ ID NO: 184696 - protein, 141 aa, Glycine max
  Coding DNA Sequence Number=SeqID_67918
  Homolog annotation: Hit_ID=Q00M75; Match level="QueryCoverage=24%, HitCoverage=5%, E-value=2e-10, Identity=91%"; Hit description=PPR -repeat containing protein
MARKIYMEGIYKQASDSRYWDLWNRQKLNSELELKRQHILSLNQDLTYQLIELERHFNALELNKFSQYGGRCLGHGPSQNRYGPSRVVTHLATETKMYSVVQLMPYPCICKEAVSGFEPMTNKSPRHNFTAAPGLALNLFK

SEQ ID NO: 184697 - protein, 163 aa, Glycine max
  Coding DNA Sequence Number=SeqID_67919
MKVSVSIESRTARCGGEAEKGGRSRTASEDGCCAVKVSGGGDAQSISSLQRFDARYVPHYVLQSKHHHWSPFDILEAIFDNDAFFLVTFTIFSSYLALFSSSPTHHQDPPKTTIITKFAKTHCTTRSAPIVTQATTVVLFPKRRPLFKPMTNDGDINEDPKEA

SEQ ID NO: 184698 - protein, 94 aa, Glycine max
  Coding DNA Sequence Number=SeqID_67920
MEALSLKSQTEERKNVKELFETIGIPYEAAFGSPDMKGFMKTPPSKKTLFSDLTANKDQSRRNQASAMKCFEPETARRRRDSLDQFCSYNMPKN

SEQ ID NO: 184699 - protein, 700 aa, Glycine max
  Coding DNA Sequence Number=SeqID_67921
MKNTDQHIMLLGWSADEDKSEAVVIDIERENCAPRIELQGSLAKWWTSWLDYRDDSWIKWETVCRSKEEGGLGIKDIRNFNLALLGKWKWSLFYHNGDLWAKVLESKYGGWRSLNVASSDHTDSIWWRDLKQALHHQQLASAFQNGLSWRVGCGDKIKFWEDNWINDDISLVAKYPRLYSISNQHNQVIQQLGAHTDSGEVTIADSFLNDIEGKTVHPCKRDEWVWKAEPSGIYSTQSAYNLLQGEITEASDDGVFAELWKLKIPKKISVFAWRLIRDRLPTKKFEKTTVKLFISGGSPYLGLTPLWLYQKIPENGDDNLLLGLCIDNVSIYQKVGVQIDVEERTELLPHCVLICLTLEGKLVMFHVASLAGCKTSPEVDSVLHNDEDTSVNLPEDEGCTLPQRLQKQESDKVSGNLTAKPSGNPQQITRTDTNYPEVELVGNSESLKSNVQQVVPDVDAFQNTGNQNPFLPGEQQKNLGQKTATLGTSIGPLMVNSHSVSSGLSSYNNLQSTTKTRELWTANSSRDSQRASLPGETFSFPKKYDVSSISASSYADGVGFQNKKYTMGATNVPGSMGGKPVLVQDVNDVSPAIDSASRLVQSGGQLSTLGAGNMQPILNSSSHFSSDGNTAAIKSSARKFLPSNEQHGTPSKLGIFSSDLSKQFGNKRLVALEMLAQGHYEVQLKQWSKAWMLCLKNAKY

SEQ ID NO: 184700 - protein, 272 aa, Glycine max
  Coding DNA Sequence Number=SeqID_67922
MSPSKKIEPEEVEGEMISTSDYFFVKVGEALPLKSSDSVFDAETLPSQPLALSERFRLTFVAHSSGFFVAKTKDLIDSAKELKDKGSGSPVEQLSLVDVPVGRVRALALSTDNSTLAASVSGDIRFYSVESFLNKEVKQSFSCSLNDSTFVKDMRWITTPKHCYVVLSNIGKLYYGDIGFPLKHVMDNVDAVDWGLKGSFVAVASKSVLSILSTKFEERVSISLSFRSWIGDFSADGSIKAVLDQGGRYEVNDFLEYSRDLDSTPLSNLVFG

SEQ ID NO: 184701 - protein, 272 aa, Glycine max
  Coding DNA Sequence Number=SeqID_67923
  Gene Ontology: Mol. function=protein binding; Cellular component =cytoskeleton; Biological process=phagocytosis
  Homolog annotation: Hit_ID=Q2R485; Match level="QueryCoverage=95%, HitCoverage=83%, E-value=1e-100, Identity=69%"; Hit description =Phagocytosis and cell motility protein ELMO1, putative, expressed
  Pfam annotation: Domain name=ELMO_CED12; Domain location=84-253; Score=286.9; E_value=4e-83; Accession=PF04727.4; Description=ELMOCED- 12 family
MGKSPDWLYIDHATCGSPAWIGKGLTCVCFKRKGNCQRICISLTPLQEERLRRLKRRMKVYFDASKLEHQCLAFFCKLLIQKFFQGQEALRALWSASFPDQELQSLISDQWKEMGWQGRDPSTDFRGAGFISLENLLFFAKTFSTSFQRLLKKQGGKGAVWEYPFAVAGVNITFMIMQMLDLDATKPRTFVRAVFLQMLSENEWAFDLLYCAAFVVMDKLWLERNATYMEFNVLLLKGLRDVLKSTRVQLEKELLMDDVLRIEDMPSYSLLC

SEQ ID NO: 184702 - protein, 330 aa, Glycine max
  Coding DNA Sequence Number=SeqID_67924
  Gene Ontology: Mol. function=protein binding; Cellular component =nucleus; Biological process=regulation of transcription
  Homolog annotation: Hit_ID=Q7XAM3; Match level="QueryCoverage=55%, HitCoverage=51%, E-value=4e-73, Identity=72%"; Hit description =Putative cobW protein
  Pfam annotation: Domain name=cobW; Domain location=175-330; Score =158.7; E_value=1.5e-44; Accession=PF02492.9; Description=Cobalamin synthesis proteinP47K
MAKGLSLARMHTWNNLSLGQSFSNLVAFSKGKADGYKLMEFIKQKPTIVEDSSEGKCLAEIASFDSWMSYNADHFEMPKQTLQLKWLGYQIGLVNQEPALFATTILENILYGKPVATMAEVEAATSAANAHSFITLLPNGYNTQWILHDEDEVPPLAVQIQGNDDSVYQRSSSVGVTLITGYLGAGKSTLVNHILNTQYGKRIAVILNEFGEEKGVERAMINEGGKGALVEEWVELANGCICCTVKHSLVQALEQLVQRKERLDHILLETTGLANPAPLASVLWLDEQLESEVRLDSIVTVVDAKNLRFQLEEHRGSSSFPEAYFQITFA

SEQ ID NO: 184703 - protein, 494 aa, Glycine max
  Coding DNA Sequence Number=SeqID_67925
  Gene Ontology: Mol. function=nucleic acid binding; Cellular component= intracellular; Biological process=regulation of transcription
  Homolog annotation: Hit_ID=P93718; Match level="QueryCoverage=99%, HitCoverage=98%, E-value=2e-50, Identity=30%"; Hit description =PEThy; ZPT4-2
  Pfam annotation: Domain name=zf-C2H2; Domain location=104-126; Score =10.6; E_value=0.73; Accession=PF00096.16; Description=Zinc finger, C2H2 type
  Pfam annotation: Domain name=zf-C2H2; Domain location=437-459; Score =22.4; E_value=0.0016; Accession=PF00096.16; Description=Zinc finger, C2H2 type
  Pfam annotation: Domain name=zf-C2H2; Domain location=7-29; Score =16.6; E_value=0.09; Accession=PF00096.16; Description=Zinc finger, C2H2 type
  Pfam module annotation: Pfam domain module=zf-C2H2::zf-C2H2::zf-C2H2; Domain location=104-126::437-459::7-29
MEETRKFVCKYCSKRFPCGKSLGGHIRTHMMSSEHHHSALANNEERNNNNNNAANAMFKFDGGRKKKRDLGSEENGNNNNYGLRENPKKTTRFVHSNATLQLDKFCKECGKGFPSLKALCGHMACHSEKDKGGFATEKQKLVMDSQSDTETSSAPRRSKRMKSKTLSSSNNNNNNQPQSSSVSEVEQEQEELARCLMMLSKDSSYKGRFALLTESSDNNSVVITKSPSLETKVTTMMNVYGKNSMERKLELEQHKDLKFKSVEVGYDSDNSDSGYFRYGPKSDESNDEFFRNEVKSSKVGYLNGFDQEYDVVESRKVLSRGRSRSSEFKKFVLEDWESYDREDGDVAARKFGSKKFKKSNYDDDSLGQNLGGVSTRKYECLTSERYNGCSDDSAYESDENSTDTDSYPAPKAHHSNRNNLSGNKGKKKLKSKKSKAHECPICNKIFRSGQALGGHKRSHFIGGSEENTLVIRPSAPPAAVPCLIDLNLPAPVDE

SEQ ID NO: 184704 - protein, 218 aa, Glycine max
  Coding DNA Sequence Number=SeqID_67926
  Gene Ontology: Mol. function=protein kinase activity; Biological process=protein amino acid phosphorylation
  Homolog annotation: Hit_ID=Q2QZ78; Match level="QueryCoverage=68%, HitCoverage=28%, E-value=1e-36, Identity=55%"; Hit description=AT hook motif-containing protein, putative
MLLICNVVTSSLWLWENWKNFYVEDISLCIAFKGTYCFNSWIKWHSILIVAWGRTAHSSKFAIPVPTLQNSTCNVLQGSELAELLKVTKLIIWDEAPMAHKFCFEALDKSLRDLMSSSNNGDSPYGGKVVVFGGDFRQIHPVIPRDDDKKLKIQDHFMITKMMTFKNEFKIESRTLQGSRGNLISRIKIQDSRRIKIKIQDSKIQESRIKRRLNQDKY

SEQ ID NO: 184705 - protein, 118 aa, Glycine max
  Coding DNA Sequence Number=SeqID_67927
KLLAEKTKKKLEEAAHSGSVDGVIDPPSPVRRHVKWKMARTKKIGEMTTEAAKEIAEKIATQGSFVPHGRQDVLTTVIGRPKHPRRVRAAGAGVTIKKYFGSAPQMSRSSSSLPLEEL

SEQ ID NO: 184706 - protein, 98 aa, Glycine max
  Coding DNA Sequence Number=SeqID_67928
MVTALRTVKNLDSKSTEELIGTLMVHEYELQQDEGFKKGKSLALTTQKAKTSSTCKESSSRPASRRSSKVFNIDTPSDDESNDEKGSDKDDQLAFISR

SEQ ID NO: 184707 - protein, 146 aa, Glycine max
  Coding DNA Sequence Number=SeqID_67929
MTYRGMLFDPARNLRNHLGVGGLTAKDRMLVHLITYILTLRSSIQMNWVLLIEDIMLKSFRLVDYEFSYVVLASRFIEYFNIDVSNEIVDFTKASSEITERHLKKLGMRFVEHERIMVGEPPTAAKMDQMEEAEGSTRACELMESF

SEQ ID NO: 184708 - protein, 138 aa, Glycine max
  Coding DNA Sequence Number=SeqID_67930
MEDKDRAASDPAEFAGDTSWTLATDDSDGAYLFPGDRERSILREFGWNLEPDQPNRIGTDDGSWRPVQSSLTGSIEPAAAMSSRSNNQSVSSSSSEDPPEKSTVSDEKPPEIPPRARRYCGGNGLLLSHPWLGRVIII

SEQ ID NO: 184709 - protein, 272 aa, Glycine max
  Coding DNA Sequence Number=SeqID_67931
  Gene Ontology: Mol. function=transporter activity; Cellular component= membrane; Biological process=transport
  Homolog annotation: Hit_ID=Q0K424; Match level="QueryCoverage=96%, HitCoverage=96%, E-value=2e-90, Identity=61%"; Hit description=ABC -type transporter, permease component: POPT family
  Pfam annotation: Domain name=BPD_transp_1; Domain location=68-272; Score=47.3; E_value=5.3e-11; Accession=PF00528.12; Description =Binding-protein-dependent transport s
  Subcellular localization annotation: CTP_CleavageSite=77; ConfidenceScore=5.27e-01
MTRSHNDKLIALLGKLLVIAILTFVMLPTVVVFISSFSSTSVLFFPPKGWSLRWFERALSYDDFRHGFWSGLIVTAWASTLAVIIGATLAIAIERYRFPCKQVLESILLSPLFIPHFTIGLGLLMLVSQLNLGRGYALVIFCHVVLVLPFVLRSVYVSLKNLEQRIELAAASLGASPLRVVWTITVPLILPGLFGGWLFAAILSFNEFTASLFITTQATQTLPVAMYNYVREFADPTLAALSVIYIVVTAAMLIIANKFFGLGKILNVEAGH

SEQ ID NO: 184710 - protein, 105 aa, Glycine max
  Coding DNA Sequence Number=SeqID_67932
  Gene Ontology: Mol. function=transporter activity; Cellular component= membrane; Biological process=transport
  Homolog annotation: Hit_ID=Q0K423; Match level="QueryCoverage=73%, HitCoverage=27%, E-value=2e-21, Identity=66%"; Hit description=ABC -type transporter, permease component: POPT family
MQEARHALQRQQQQNGQQQASNAQRCGKREVHRGEAQLIHQRSHGTDAPAANQLWRRESAEGPGKRGGQAGDDAGNRQRNGHRQQRAYRPGTKAGGGFFVVRIDV

SEQ ID NO: 184711 - protein, 100 aa, Glycine max
  Coding DNA Sequence Number=SeqID_67933
MQPCCKIENSILELTDPTELESQSVSVTADHDRSMLDSSEPTELESQSVFVTGDHDPLLRIPLTPTKRVSFDELDYERKNFQISPAEVSSNKLAKHSQAE

SEQ ID NO: 184712 - protein, 124 aa, Glycine max
  Coding DNA Sequence Number=SeqID_67934
MVKEECKEVSVSSKRLAKKEIHFAIKTNIKETSLLRQPPHLLLCKRTLLSTVTPLKLKVIPQVKELLDEDLVRKSLNPCALLVPKICIMRHQIPKIGAPLIELVRNMFPHGKMSRKGVSDLTLL

SEQ ID NO: 184713 - protein, 87 aa, Glycine max
  Coding DNA Sequence Number=SeqID_67935
MAIQAEESRVDQKVEGVKQQLADELVLEPVDDLVELVEIVEEVEEKVVEIEKKKGKSEANIEKMKEATPIECKEVPYPLAPSRKDKE

SEQ ID NO: 184714 - protein, 60 aa, Glycine max
  Coding DNA Sequence Number=SeqID_67936
MVKACRKGVRKANEIKIKARETMKGEKREVVAAQLAKASWVASTRRHHLLLEHPERPKWA

SEQ ID NO: 184715 - protein, 181 aa, Glycine max
  Coding DNA Sequence Number=SeqID_67937
  Subcellular localization annotation: CTP_CleavageSite=19; ConfidenceScore=5.16e-01
MLTDQVIHKQPSNFPTAFSANVGKNQNANDKLTSKKKQKREEEAEMRRRSPNVKNHTTNAKIHTFLLNMATMAAKKKRRMKKLRGRKKKTEEAEKARSRTVGGRRRTCVGEREAREREQLLGAPAKLLGAPSSTQIAIELERAKVRFLWALREPPKAQLEDPRDWELLRAPSIIVGAPSKQ

SEQ ID NO: 184716 - protein, 60 aa, Glycine max
  Coding DNA Sequence Number=SeqID_67938
MRNGHPPLSQGTGTPTQKNPEHGYLNMKKGFFDVQTLEMSALHCLRALAHPRKKIPNMGT

SEQ ID NO: 184717 - protein, 82 aa, Glycine max
  Coding DNA Sequence Number=SeqID_67939
MTCRFLVADDDSDDDDYMISNSYVEDSLDEEEDIDDISDTDEEVTLIGVIRMKKTSVVSIWDQPSILAKNYLLAWNLKAKMQ

SEQ ID NO: 184718 - protein, 163 aa, Glycine max
  Coding DNA Sequence Number=SeqID_67940
TLVSIATPLRLEFIPQVKELLDEGLVRKSLNPCALFVPKIGIIRHQIPKIGGMMNVLSGATLFCKITRAPNIFMICVHRDSLGSDQGVPMNPKRIKVIPEWPTPPTPLIELDVPSWEDSQEMCFQTLPYFNIQNPEFEKPQDLRSNPFQGGGNDAILPRKGIG

SEQ ID NO: 184719 - protein, 170 aa, Glycine max
  Coding DNA Sequence Number=SeqID_67941
  Gene Ontology: Mol. function=RNA-directed DNA polymerase activity; Cellular component=mitochondrion; Biological process=RNA-dependent DNA replication
  Pfam annotation: Domain name=RnaseH; Domain location=1-115; Score= -10.1; E_value=0.0005; Accession=PF00075.14; Description=RNase H
MKGNGARIILEGPDNVTLEKSPKLNFKASNNQAEYEALIIGLKLTREVTAKKLRCYTDSHLVQGQVANRYQTKEIMLLKYYQISKTFIDNFECFDMFYIPRESNTRADLLSKLANTKKTEYLQPIIKETLQTPTIDTEEVMAGEDEEPDYITPYKNFLIRGMLPSNENEA

SEQ ID NO: 184720 - protein, 749 aa, Glycine max
  Coding DNA Sequence Number=SeqID_67942
MSSFLSDFANGLGSSNSGGSIHQPLMDRKVISIDGFSLKDTRHGASDNEHSLGEVEGFTLYWWMHFSPAHEGEVVVGTLRHFPVCDVAITLGHHRPSLLLLAMNECLFEVLGLIIPLTAFYSALLEHLNVAFSQIHPVVGPCMSKKLFEFDSNVFRRFKDRFLKVLATDVVVDGSFDPCGEGQQGYLGAIADLARRTCHFFSSLGERSPHYLGRPLVKQGGPVGGTMPPSVSPIAGVAKVSLDVPSSFLAKKKRNDNIGESRPLLSLRALRQAAGFPPGSGRPSSLQDVPQAPSTVEGLAPIVEIALATEVDVPTALAGPIVAPLSAITAPLLSVDVATTSAPEMPPPPSLVPRVPSSVMLASTSPSSSSHPYVSLDHIYTFNNVNSLWGMGLVILEENGLKHQEALSKVAFLEVEVIKWRATTRTVWRVERSKVASAIVAFAQAVKSNHELSSKAGSVLAKLFRTRERKKDLASKVKGIAAEKNELAKVAADLEARLKESESRLEKSKLWTAREREASKELEEELLMYKKEVEFFAKDLDFGLFDLFKDMKDSVLIDEKDIAAKKEDAKEQDVLSTSPVIGHLTYGASPLMVVRRVRTKGGPWVFVPKENLGVDLVYLDMEMELSNRRCVCLGEDLGFDKPLEKKDSSRADLGANHRFDKPMRLTKGGPWVLRAFGEPRLTKGKLWVRRVCETRQGRTLGFVSLWRSDQGIVCHRFWRDLPRVDLGFDEPLEKRDSPRVDLGFDKLRM

SEQ ID NO: 184721 - protein, 37 aa, Glycine max
  Coding DNA Sequence Number=SeqID_67943
MDKYFFGIESGILDRYVRCMCNTLAYMSLVERAHTET

SEQ ID NO: 184722 - protein, 412 aa, Glycine max
  Coding DNA Sequence Number=SeqID_67944
  Gene Ontology: Mol. function=nucleic acid binding; Cellular component= beta-galactosidase complex; Biological process=DNA integration
  Homolog annotation: Hit_ID=Q1RYT8; Match level="QueryCoverage=80%, HitCoverage=90%, E-value=4e-62, Identity=50%"; Hit description=IMP dehydrogenase/GMP reductase
  Subcellular localization annotation: CTP_CleavageSite=57; ConfidenceScore=5.23e-01
MTCLITKAHYQLIMLRPQAVQNPRHPYLNRRRHHQNPSPPTAQLALTTVPLTLLTTSAMRALAFPSMAHYNQTNLFQRYLVVQYVVNYSSISRSRTRFFMSLSPEQEPTTFREAAKHRFWQEAMKYEIQALVRNQTWDIVQMPPHVRPIGCKWVYKIKRGPDGSIERCKACLVDKGYSQIEDIDYLDIFSPIVKMSMIHVVLVIASIHHWHLQQLDGVSGYQPSQCCKLKRSLYGLKQASRQWIAKLSNLLKHYRFMQAHVDHSLFTKAVSWMFDIPNQYPSGHRLCNPTTQLIHDCSYSNSFSSCLESCSLFEGYSWEGIILPQKYFFPTICQSPLYIAANPVFHKWTKHLEIDYHLVREKLLSGLMNLFSVSSSHQLANMFTKALSPKLFQSNLSKLELHDIFEPPTCGG

SEQ ID NO: 184723 - protein, 181 aa, Glycine max
  Coding DNA Sequence Number=SeqID_67945
  Subcellular localization annotation: CTP_CleavageSite=52; ConfidenceScore=5.11e-01
MDLGTMISSQITQIDHIPRGQEGSRASHIGGPSSTTTNSYVCIHSSFIATTSSGAFVTHVVEHSSWLVLDHASIVVDRHNTLPTHYDAKGILLGGEPAAAAIEEPTIVVVTEDPTTVVAEESPDVAATEEEPTTAATANPDEPIPAEDPTADDVEPELDEDYIFDISAAQTPVWDPSSTQD

SEQ ID NO: 184724 - protein, 600 aa, Glycine max
  Coding DNA Sequence Number=SeqID_67946
  Gene Ontology: Mol. function=galactose oxidase activity; Biological process=cell wall catabolic process
  Homolog annotation: Hit_ID=Q8S198; Match level="QueryCoverage=87%, HitCoverage=82%, E-value=1e-129, Identity=46%"; Hit description =Glyoxal oxidase-like
  Pfam annotation: Domain name=DUF1929; Domain location=492-599; Score =109.9; E_value=7.3e-30; Accession=PF09118.1; Description=Domain of unknown function (DUF1929)
  Pfam annotation: Domain name=Glyoxal_oxid_N; Domain location=87-337; Score=361.5; E_value=1.4e-105; Accession=PF07250.2; Description =Glyoxal oxidase N-terminus
  Pfam module annotation: Pfam domain module=DUF1929::Glyoxal_oxid_N; Domain location=492-599::87-337
MAPLNKVLLLLTLLFLAVDAKYKNKKDKKNSVFHKIPKFPKFPVPIIGGDQKVVVDGGNNAIAKPDFETNNLGHWELINKQSGVSAMQINLMPNNKMLVYDATVYRTSRLPYPKGMPCVQWVDDNLKQSKEDCFAHSMEYDIETNQVRALTVKTDPWCSCGGLTPDGTLVVAGGFADGGKTSRYYGGQPDCQDCDWREYPNKLQEPRWYATQAILANGEYIVIGGRRSFSYEFFPKEGQPSDKPIFFPFLYETSDIDENNLYPFVHLSSDGNLFIFANNRSLLLNPTTNKVVRTYPVLPGGSRNYPASGMSSILPIKLDGTELSSASIKVEVLVCGGNSHDSFILAETEKIFKPAIKDCSRMVITDPDPKWDSEEMPSGRTMGDSLVLPNGQILFINGAQKGTAAWWDADEPNFTPVLYFSEKPKGQRFKVLKPSQIARMYHSTSAVLPSGKIWVGGSNTHDTYKDKDRFPTETRIEAFSPPYLDPKLDKYRPQIVEESSEKKLMYGKNFETQFKLQDTNQKLTKQDIKVSMYFPPFTTHGYSMNQRLLFLKTFIAQNSEGTYKVTSKAPTFREVAPPGYYLLFIVHRGVPSKGMWVQIG

SEQ ID NO: 184725 - protein, 76 aa, Glycine max
  Coding DNA Sequence Number=SeqID_67947
MLSSKVWEVGAMLKCGETRRRQGTSRPPIRPQASPGRRAVMGIINVGVELLHQCYINVLLRKTGELLVPSSSLQLL

SEQ ID NO: 184726 - protein, 144 aa, Glycine max
  Coding DNA Sequence Number=SeqID_67948
MEVGGILREGRDFSKCFLFGGGVCVKLVEVVVTQSGLIRWWHGRWGEEKKNKILEWCVGVWRWNLAWHREWFVSEEEVVDRLLLELRGVSLRRNESNSWKWVLNQIGTYSVKATYVVLCDHHFASTKDDVLAHTWNLKVPPKIK

SEQ ID NO: 184727 - protein, 250 aa, Glycine max
  Coding DNA Sequence Number=SeqID_67949
  Gene Ontology: Mol. function=transferase activity, transferring phosphorus-containing groups; Cellular component=cytoplasm; Biological process=phosphoenolpyruvate-dependent sugar phosphotransferase system
  Homolog annotation: Hit_ID=Q1H518; Match level="QueryCoverage=98%, HitCoverage=42%, E-value=2e-88, Identity=63%"; Hit description =Phosphoenolpyruvate-protein phosphotransferase
  Pfam annotation: Domain name=PEP-utilizers_C; Domain location=2-219; Score=238.7; E_value=1.2e-68; Accession=PF02896.8; Description=PEP -utilising enzyme, TIM barrel domain
MKGYPVTIRTLDIGADKQLNPDEVVTATNPALGLRAVRYCLAEPHIFHTQFRALLRASHYGQVKILIPMLSNLAELRQARLLLERAKESLRKQSIPFDEKIQMGGMVEVPAAAINADAFAQELDFLSIGTNDLIQYTLAIDRADDAVAHLYNPLHPAVLRLIQLTIQAAEKFQKPVSVCGEMAGDIKLTRLLVGMGMRQLSMHPSHILSVKSQILQSEESVLAKQAKKILSFSDLEKIEPLIKKYNGEML

SEQ ID NO: 184728 - protein, 121 aa, Glycine max
  Coding DNA Sequence Number=SeqID_67950
EMEKEVMDKRRCSSIWGDDDMNEWLLHLLAAWKENGREVVIVNIYAPCDKGACERVGVGGEDVGVGESEELNDFFMRKIEGMKKELKIWNVEHFGNLERRQTQVEKELKLELKEEGDLEEK

SEQ ID NO: 184729 - protein, 180 aa, Glycine max
  Coding DNA Sequence Number=SeqID_67951
  Gene Ontology: Mol. function=helicase activity; Biological process =proteolysis
  Homolog annotation: Hit_ID=Q9LTU4; Match level="QueryCoverage=98%, HitCoverage=12%, E-value=3e-46, Identity=49%"; Hit description =Helicase-like protein
MVESERLSYIRNNQKKLRVDKYSSLQTSLDTGTAKGLTKGKRVILPSTFVGSPRYMDQLYFDGMAICNHVGFPNLFITLTCNPNWPEIRRLLSPLNLKPTDRLDIVSRIFRLKYEHMLSDLTKGQLLGKVVAYMHTIEFQKRGLPHVHLLLFLHPDNKYPSSTDIDKIISTEIPSHEDDP

SEQ ID NO: 184730 - protein, 48 aa, Glycine max
  Coding DNA Sequence Number=SeqID_67952
MADQQATKSKAKKFPVKRSRKGTIEEDSNVAPQSDTGFDKHRFHSVEH

SEQ ID NO: 184731 - protein, 80 aa, Glycine max
  Coding DNA Sequence Number=SeqID_67953
MAPKKLSAKKSRRDTAAEGTSAAPKFDSHRFRSTEHQQRFEAIKGWSFHRERRVQLRDNEYTDFQEEIARRRWTSLVTLM

SEQ ID NO: 184732 - protein, 115 aa, Glycine max
  Coding DNA Sequence Number=SeqID_67954
LEVNTQERRSLEQTDQWLALENPDESLETSNNRFTRDSPQISASLHQLDLAPYASEPYNAQWNAPGLLRDKHTLRSSRILGEMEVDEPWLGLWLPFELSSGLRHWKCGRQTLWLI

SEQ ID NO: 184733 - protein, 44 aa, Glycine max
  Coding DNA Sequence Number=SeqID_67955
MAGTFFLLKQQNSLEIMSESLDEDDSVDGISDTDDEVTDMIQPV

SEQ ID NO: 184734 - protein, 239 aa, Glycine max
  Coding DNA Sequence Number=SeqID_67956
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 184735 - protein, 184 aa, Glycine max
  Coding DNA Sequence Number=SeqID_67957
MTNAATIKEEERTEIETHQESICQVTSINHQLTNKEETPEVSSTPEYPYLDTVGYVGGKDKGRLELSIKVEKIFFDLFEAMKHPDMGDAYFEEEEVEQEITLSTATMVLQSPLEKEPGYGRDCLACDEELDDSKDSCVDQVVFEELEKLRPAEKPKAELKTLPAHLKYVFLEEDETNLLSLATL

SEQ ID NO: 184736 - protein, 116 aa, Glycine max
  Coding DNA Sequence Number=SeqID_67958
  Gene Ontology: Mol. function=transferase activity; Cellular component= endoplasmic reticulum; Biological process=polysaccharide biosynthetic process
  Homolog annotation: Hit_ID=Q9M2M5; Match level="QueryCoverage=92%, HitCoverage=25%, E-value=1e-46, Identity=81%"; Hit description=UDP -GlcNAc:dolichol phosphate N-acetylglucosamine-1-phosphate transferase-like protein
  Pfam annotation: Domain name=Glycos_transf_4; Domain location=1-107; Score=61.6; E_value=2.6e-15; Accession=PF00953.11; Description =Glycosyl transferase
MGLLAVFCTNSINIHAGINGLEVGQTVVIASAILIHNIMQIGASTDPEYKQAHAFSIYLAQPLLATSLALLSYNWYPSSVFVGDTYTYFAGMTMAVIGILGHFRHRIIDILGTLNL

SEQ ID NO: 184737 - protein, 253 aa, Glycine max
  Coding DNA Sequence Number=SeqID_67959
  Gene Ontology: Mol. function=transporter activity; Cellular component= outer membrane; Biological process=transport
  Homolog annotation: Hit_ID=Q4UNL3; Match level="QueryCoverage=60%, HitCoverage=19%, E-value=1e-59, Identity=74%"; Hit description=TonB -dependent receptor
VAATLVVVTHGDAGASTEFGGRVHREVLDGAAQVARRRHAQRADALRQLCAGQVLGDDRAGNAQAVVVAVAVVTQRNAVQRIAEAALVEAAQADGLRFFVGTEGVVGLHRHARQAVEDLLAAGARRQHLLVDGGDALHLAGLALADHGDGIQRLRAQRGIGAGAGIGGGGGMGAGGGGERDRHGDRQVSGLHGGPLHWGWSPARVRGAWPLCERNMKPSLRKTNERCRAVVRVLQHVRHGGRPVGIRSAPQAS

SEQ ID NO: 184738 - protein, 79 aa, Glycine max
  Coding DNA Sequence Number=SeqID_67960
MGRGDSATIDLAPFVVAGRIKGPSGQIYTDASGRIIKGITLRLSGACISRKQMGRRYPDFNVLSVPQGIAWTSRRCSAQ

SEQ ID NO: 184739 - protein, 80 aa, Glycine max; identical to SEQ ID NO: 124032
  Coding DNA Sequence Number=SeqID_67961

SEQ ID NO: 184740 - protein, 226 aa, Glycine max
  Coding DNA Sequence Number=SeqID_67962
EIERRNWHKELTNFSEGSIDVAIVKEFYANLYDLEDQSPKQVRVRGHLIKFDVDALNTFLKTPMVIEEGESLPAYSWFANLRLVPQELASRLCISGRGFELNADGLPLKILRKNLTTLAYPAINLAYIKKNCWNLNDPSVTFRGTQKSRARRSEVPPSSALAPAYASTSAPSASTPIYFYSSSSSNSYTFSRSEFRGFLKVARPGVHPSPLGGGEASVAQEPQQDQ

SEQ ID NO: 184741 - protein, 160 aa, Glycine max
  Coding DNA Sequence Number=SeqID_67963
MNYVIRTLFAIQRQLSLMARGDELRSSAPFLLSRDNQSPLRQPEASELVDTQRQIWSSALLVEDSMSIDQDYFSLLLPSRDKFDGMRRKNMVIRHARQPEACELVDTQRQRYRSSSESCEGTNIEDLDVDFERMENQVEDEEDEDSGFSPELERMVTQED

SEQ ID NO: 184742 - protein, 89 aa, Glycine max
  Coding DNA Sequence Number=SeqID_67964
MLNGMPRGSSMISTRCVRVVSSEKWRLRKSSRGYGYHCSIKWCLALVVWKVGFVVDLGMAFVDNWVVGKEKGCYWLSNDIVGLVGNLAV

SEQ ID NO: 184743 - protein, 124 aa, Glycine max
  Coding DNA Sequence Number=SeqID_67965
MSEIEEVQKRMKADIKTLKEKMATMMEAMMSMKRMMEVNAAAVAATSAAAEVDPTPPSSLNQINHPTSNMVGKELGSTGGPHFMQVQNQHAFPSYGLPPNYAPPNVAHAPDENVNNSTPILIES

SEQ ID NO: 184744 - protein, 78 aa, Glycine max
  Coding DNA Sequence Number=SeqID_67966
MLIDVGNALACARCVCSWGAKCTNLPGSLALALGHVHTLDVVYVCGGQSALIFQGLWHLLWATFIRRMLCMFIGGGVH

SEQ ID NO: 184745 - protein, 308 aa, Glycine max
  Coding DNA Sequence Number=SeqID_67967
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=9e-27, Identity=28%"; Hit description= UPI00006A17C9 related cluster
  Subcellular localization annotation: CTP_CleavageSite=16; ConfidenceScore=5.01e-01
RTTGRRLQRTAYPHLQGTTRPPLQRNTRPHLQRIGGPHLQRATRPRLQRTTCPRHKGPQALTFVGKHTLTFRGLHVLAFIRLHALAFRGLHVLPFRGLRVLTFRGLHVLTLRGLHVLSLRGLDVLTFRGLQVLGFRELHVLTFRGLHALAFCGLHALAFRGLHVLPFRGLHVLAFRERHVLTFEGLYVVTFIGPHALTFRELEVLAFRGLDVLALRTKGAHLKRATRPHLGYSYPYLQRTTRPRLHRATRPRLQRTTRPHLGYSYPNLQRTTRRRLQRARCPRIQRTTRPHLWRTTPPRLLRGTRPRL

SEQ ID NO: 184746 - protein, 128 aa, Glycine max
  Coding DNA Sequence Number=SeqID_67968
  Homolog annotation: Hit_ID=Q3XL07; Match level="QueryCoverage=62%, HitCoverage=50%, E-value=2e-10, Identity=38%"; Hit description=BLUF
  Pfam annotation: Domain name=BLUF; Domain location=1-94; Score=38.4; E_value=2.5e-08; Accession=PF04940.3; Description=Sensors of blue -light using FAD
MKFVLYTSVLNQEHYDVLAVPEIVRTARVENSIHGITGVLLFDGLNFTQYFEGDEATVDRLLANILRDKRHKNIVLVLTGHQESRLYHDWGMGYIDISDNAIDIGRCIAAADFSVDVFKQKISRLDVE

SEQ ID NO: 184747 - protein, 122 aa, Glycine max
  Coding DNA Sequence Number=SeqID_67969
MKLGGGNIEDSEHAHGAIVKGYLYMKIVKNAIIRIEIIPQRNHLSNLFGTKMKMTKIVINKGVPVEADPAQTLMDYLTPTLRESNTITLPNLPKEVTFDLKHGFLQMLENNPFNGVAHENPM

SEQ ID NO: 184748 - protein, 214 aa, Glycine max
  Coding DNA Sequence Number=SeqID_67970
  Gene Ontology: Mol. function=nucleic acid binding; Cellular component= proton-transporting two-sector ATPase complex; Biological process=DNA integration
  Homolog annotation: Hit_ID=Q1SG63; Match level="QueryCoverage=97%, HitCoverage=15%, E-value=2e-49, Identity=47%"; Hit description =Integrase, catalytic region; Zinc finger, CCHC-type
MARTILNDNSTPKHFWVETMNTACYLQNRIYIRPILKKTPYELWMGRKPNISYFHPFGLKCFILNTKDNLGKIDLKSENGIFLGYFETSNAFRVYNSRTLVVEEAIHIRFYENNSIATSLSKQNPETKVFTQHEVQEEVREPIGGIMRRNHPESQIIGDPANHVQTRSSLITQGHTALISEMEPKHIDGAMQDDNWVKQCKKSLIIFRRMMFEI

SEQ ID NO: 184749 - protein, 116 aa, Glycine max
  Coding DNA Sequence Number=SeqID_67971
MENLPFDLPHTIYINIPRNLKGLGVLNDIYYVAFINKFLWDQGAYYVFNKIDEDSKHTLIAKGLVVAKHQNFRKTNLKAMKATLEQSLMKATLEQSLVDLDAINRKKAEEASQSHC

SEQ ID NO: 184750 - protein, 55 aa, Glycine max
  Coding DNA Sequence Number=SeqID_67972
MAAHSGHRWSWVVKEERASLTKRKSTFVAKRDFLRLVQFLSVGIALSALFELSER

SEQ ID NO: 184751 - protein, 163 aa, Glycine max
  Coding DNA Sequence Number=SeqID_67973
MEYLEGTSNSLPDYLTLEFLQTKTNLCCLRHPRSSGKGFKLALLEPSPKRVSPSKIGSSTQAGSSTQKSKQQDGSFTQLVEIKSESSTQGPSKIQTSKQTKADYAFPIETLFALQEIGLTKLPKKTWSSFRAPNFALFSSSPIIHLLLPPISNPWPPMVVSFF

SEQ ID NO: 184752 - protein, 152 aa, Glycine max
  Coding DNA Sequence Number=SeqID_67974
  Subcellular localization annotation: CTP_CleavageSite=53; ConfidenceScore=5.88e-01
MASPPASPPPPPPSPSPPPTPPSPPPSDSSASSSIAKKTRKDSRLRSLSTRPPGAERPVVHVHPAIGKADGPHRKKLRTYLGMMARDKVDDTYENWKEAEFEIPEASDSKTKKKLLQTIDERLMQFKSDLTRKGALVANQDSVDDTVCENTA

SEQ ID NO: 184753 - protein, 79 aa, Glycine max
  Coding DNA Sequence Number=SeqID_67975
MSRGSGDLGDVRWGAIAQNQAWSIPTQLGHIQPCDRALVIDYQLCVIDYIVLPATGNRLPFMCNRLHSVTFRFQCAKVV

SEQ ID NO: 184754 - protein, 91 aa, Glycine max
  Coding DNA Sequence Number=SeqID_67976
  Subcellular localization annotation: CTP_CleavageSite=42; ConfidenceScore=5.22e-01
MRRSNRVAPERQSGNLELTRRSATRALWRSSGNINPNSASTRANSASERACYTCMPKSQRWFMTLFAKEANEMMLLWNWMDRAAAAAQVDK

SEQ ID NO: 184755 - protein, 66 aa, Glycine max
  Coding DNA Sequence Number=SeqID_67977
MWDATLFGMFNEDFPLYIKHEDPSEIAHGGQCLNISVIQLWIMHMTETSMRAGNANVYGFLEPQSI

SEQ ID NO: 184756 - protein, 114 aa, Glycine max
  Coding DNA Sequence Number=SeqID_67978
MFMTSICLSLANTIFSFSFETWMVTQHEKQGHRLDSLNDTYWLMTFFESACFIASQMFANWLIGNNTEKITAPSSAVIFFAAICFTFITRGWTENPGSASLKEYSRSLYAYILG

SEQ ID NO: 184757 - protein, 314 aa, Glycine max
  Coding DNA Sequence Number=SeqID_67979
  Gene Ontology: Mol. function=asparagine synthase (glutamine -hydrolyzing) activity; Biological process=asparagine biosynthetic process
  Homolog annotation: Hit_ID=Q7WR34; Match level="QueryCoverage=98%, HitCoverage=49%, E-value=1e-141, Identity=74%"; Hit description =Putative asparagine synthetase
  Pfam annotation: Domain name=Asn_synthase; Domain location=1-240; Score=133.2; E_value=7.2e-37; Accession=PF00733.11; Description =Asparagine synthase
MSYQFKTEHYDMVLKAGDMERIMPAMAWHLEEPRVGQSYPNYYAAKLASKFNKVVLAGTGGDEIFGGYPWRYYRAVVNDDFEHYIDKYYAYWQRLIPNTQIREVFAPVWGDVKQVWTRDIFRDVFASHASTLTRPEDYVNHSLYMEAKTFLHGLLVVEDKLSMAHGLESRVPFLDNDLVDFAMKLPTRLKLGHLEDVVQLNENEPGSKTARYFQKTRDGKLLLRKMMARHVPQDIVEREKQGFSAPDASWFKGESMDYVRRQLFSSNARIYDFLDRGTVQKLVDQHLNGEQNRRLLIWSLLNVKSFCQAYLGKY

SEQ ID NO: 184758 - protein, 173 aa, Glycine max
  Coding DNA Sequence Number=SeqID_67980
MSIRVKEDLLLNNFNLNGPRSTQQLPERKTPIAHGGVLMSSSFLYGSDTDRKGLIVFLRAKRNDESGLLPYVIAVKHYFVAACCSHGVSVVAKIRRGGHGGLSVELEKPSKEHKHDLLSMFDDVQGKGWCPDPSSSDCPIEIIPSQNKNPANANPGHQNPTVAIGNGGYFEGN

SEQ ID NO: 184759 - protein, 329 aa, Glycine max
  Coding DNA Sequence Number=SeqID_67981
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=93%, HitCoverage=38%, E-value=1e-61, Identity=43%"; Hit description=DNA -directed DNA polymerase
MESPFKDYSNSLFESRSNAKKKGNNALSFVYKLLMNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRYLSLMKKVNIKLKRKTAILEKENSALSQKLQKLEQERGIIAQRRVEEGNNTEDNNTLEQNNAKRAEDNINGDLLDPDTMPRDKKPP

SEQ ID NO: 184760 - protein, 64 aa, Glycine max
  Coding DNA Sequence Number=SeqID_67982
MFRLASSGDSFRDTATGRLYFSLPLLSAQANVDRNTTAVEFPRKTTGKLDGKPIIERNQQGKFA

SEQ ID NO: 184761 - protein, 69 aa, Glycine max
  Coding DNA Sequence Number=SeqID_67983
MRLPGKESLLMKSPITINEILDVSISFLNDHLEETLGSTKIEEIHSKCINLAQILSGPKTSLHIPSVFP

SEQ ID NO: 184762 - protein, 185 aa, Glycine max
  Coding DNA Sequence Number=SeqID_67984
MALFFEVLRLRFVLNAEGAPWMLLRKDLTTLAQTWSVLSYSNLAPTSHTSDLNMDRARLVYGLVMKMDMDVGFLISHQISQMAQSNSLRLGFPALISTLCVGRGVVSDSLTFKSLDPAINLAYIKKNCWNLDDPTIVFLGTRKARARGSEGLSSSATPAPASSAPTPSPTPAPSTLAPPLPSAPV

SEQ ID NO: 184763 - protein, 110 aa, Glycine max
  Coding DNA Sequence Number=SeqID_67985
  Homolog annotation: Hit_ID=Q00M75; Match level="QueryCoverage=25%, HitCoverage=4%, E-value=4e-07, Identity=92%"; Hit description=PPR -repeat containing protein
MVQLICVRLWRIIDYQLHDLVYTRISFIVLQNGEVFGVQDQKNAKSKIICEKHSYARVKLCLGDLLVMGSNPETASLHMQGCYNSVKLSLNYITLLTPLYDTFRERFFIP

SEQ ID NO: 184764 - protein, 95 aa, Glycine max
  Coding DNA Sequence Number=SeqID_67986
  Gene Ontology: Mol. function=transferase activity; Cellular component= intracellular; Biological process=translation
MRYDAFGRRGLSLLQKCTTTIRILAYGSPFDSVDEYVRIGESTVVECLKDFVKGVNEAFGDEYLRRLNNNDINRLLQIGETHEFLGMVGSIDYMH

SEQ ID NO: 184765 - protein, 93 aa, Glycine max
  Coding DNA Sequence Number=SeqID_67987
MGHPVMAPPMPMSAHLGLVQARHEAKNPRCSMLRSYQLHNLHQQRHPPPQRPPKLPLEWPHEVPPVVTEAPRLRKPHLPPKEKAGLLARPLEK

SEQ ID NO: 184766 - protein, 122 aa, Glycine max
  Coding DNA Sequence Number=SeqID_67988
  Gene Ontology: Mol. function=RNA-3'-phosphate cyclase activity; Cellular component=nucleolus; Biological process=biological_process
  Homolog annotation: Hit_ID=Q683I1; Match level="QueryCoverage=82%, HitCoverage=26%, E-value=3e-24, Identity=60%"; Hit description=RNA 3'-terminal phosphate cyclase-like protein
MGKTAYYGLKELHCGEVLFSPGYGISLVVEITSGCFISADTVVSQVRDEDTSGLTGDAKRDLMPPEDVGVGIVNALLGKIAQSGVVDSSHQGLLFLLCALCPQDVSKVCVGKLSQHGVETQT

SEQ ID NO: 184767 - protein, 91 aa, Glycine max
  Coding DNA Sequence Number=SeqID_67989
  Homolog annotation: Hit_ID=Q2HUC6; Match level="QueryCoverage=53%, HitCoverage=8%, E-value=1e-10, Identity=66%"; Hit description=ELM2; AT-rich interaction region; Homeodomain-related
MQRSKYSSALDAWVKKVVECKVGLTEEPTLTSNPYSSLTESHNFLVHIASYPPFPFTTKNLYKSKCCLSPSNGEKGKKQLTAEFSPQHGIS

SEQ ID NO: 184768 - protein, 68 aa, Glycine max
  Coding DNA Sequence Number=SeqID_67990
MVGSSSFDVNYSLQEAEMEEKEEESYMHSSLIDGDEDSCVESAMAKVVLFKDVWRRRSSNDDGALTLK

SEQ ID NO: 184769 - protein, 69 aa, Glycine max
  Coding DNA Sequence Number=SeqID_67991
MNENAIHGSPKQGREWRIALSHHYAWLQTCGWRMHERKCNSWGSEKRLRMENCTKQSLRLTPNSWVEDA

SEQ ID NO: 184770 - protein, 34 aa, Glycine max
  Coding DNA Sequence Number=SeqID_67992
MANPWGLTAIRDASYACDSVCSTQQKGSIFNSMQ

SEQ ID NO: 184771 - protein, 385 aa, Glycine max
  Coding DNA Sequence Number=SeqID_67993
  Gene Ontology: Mol. function=metal ion binding; Cellular component =intracellular; Biological process=inflorescence development
  Homolog annotation: Hit_ID=O22800; Match level="QueryCoverage=98%, HitCoverage=97%, E-value=4e-44, Identity=32%"; Hit description=Zinc finger protein CONSTANS-LIKE 14
  Pfam annotation: Domain name=CCT; Domain location=344-382; Score =73.9; E_value=5e-19; Accession=PF06203.4; Description=CCT motif
  Pfam annotation: Domain name=zf-B_box; Domain location=1-46; Score =36.2; E_value=1.1e-07; Accession=PF00643.14; Description=B-box zinc finger
  Pfam module annotation: Pfam domain module=CCT::zf-B_box; Domain location=344-382::1-46
MLPCDYCDSKPALLFCRADSAKLCLVCDQHVHAANALSLKHVRFQICDSCKSDTAVLRCSTHNLVLCHNCDVDAHGADASSLHHHHHHHRRLHGLSGCPSVPEIASALGLDFRAQEPVVPTAASRDEVYEQVLEIARQRNNGLGAEQLKFDDSPGNDVVVVVDEMLIQQTPFTSLLMLQNSESEFDARKSNDNNGYGTEAWDLHWNYNNPAYQPPQVWDFQLQKSTDCNEPRVVTFDGLEVPKLFQDVHNMNYSTIGDDIDILSRNNQSDQSSSSHAKRKEESNKKARGGLSSESTLFESIPYSGTNNVVVMEHLVGGNENVSTLKARVSLQELAKNRGDAMLRYKEKKKTRRYDKHIRYESRKARADTRKRVRGRFVKASDVQA

SEQ ID NO: 184772 - protein, 140 aa, Glycine max
  Coding DNA Sequence Number=SeqID_67994
  Homolog annotation: Hit_ID=Q2VCI0; Match level="QueryCoverage=47%, HitCoverage=27%, E-value=1e-12, Identity=73%"; Hit description =Translocon-associated protein beta family protein-like
MAERSATKYMNRTMMEITEIRDPYLASNLCGQEKFDIKFKYTGNIPIQTSSREVYQKEHPKAIWELNMPPNREKNYYNKKQVAHQKSVLLNGRAMAATAEWHGRFFANCHKQFVKESPQWHVYMVEFWHSAIDNIARNKK

SEQ ID NO: 184773 - protein, 124 aa, Glycine max
  Coding DNA Sequence Number=SeqID_67995
  Gene Ontology: Cellular component=endoplasmic reticulum
  Homolog annotation: Hit_ID=Q2VCI0; Match level="QueryCoverage=56%, HitCoverage=36%, E-value=2e-22, Identity=67%"; Hit description =Translocon-associated protein beta family protein-like
  Pfam annotation: Domain name=TRAP_beta; Domain location=12-122; Score= -1.3; E_value=4.7e-07; Accession=PF05753.5; Description=Translocon -associated protein beta (TRAPB)
MADPIAKALIAFALLASLLLCLQASSDVPFIVAHKKASLNRLKSGAERVSVTIDIYNQGTSTAYDVSLSDDSWPSDAFDVISGSTSKSWERLDALPPVSALLHFSSSLFTNKCYFQWWHHFSHI

SEQ ID NO: 184774 - protein, 1034 aa, Glycine max
  Coding DNA Sequence Number=SeqID_67996
  Gene Ontology: Cellular component=nucleus
  Homolog annotation: Hit_ID=Q9LV69; Match level="QueryCoverage=40%, HitCoverage=96%, E-value=1e-107, Identity=48%"; Hit description =Arabidopsis thaliana genomic DNA, chromosome 5, P1 clone:MJE7
  Pfam annotation: Domain name=CAF1; Domain location=23-444; Score =167.9; E_value=2.6e-47; Accession=PF04857.10; Description=CAF1 family ribonuclease
  Pfam annotation: Domain name=DAO; Domain location=642-1014; Score =156.3; E_value=7.9e-44; Accession=PF01266.14; Description=FAD dependent oxidoreductase
  Pfam module annotation: Pfam domain module=CAF1::DAO; Domain location= 23-444::642-1014
MAWVFELRSRSLCTSSSSKWRVKQVTTSNFQESLQEIKTHISNSDFVAISMGKTGSPSAPSWLRPLPFDTAQTAYSKARRAAQRFQLLHFAVCPFSVSRSDKLLAHPYNFMLFPRDEMKMGMPTYSFSCQTSLLASMARQGFDFNACVYNGHGFKSSHGAKIEYIYPLCTFFGVGISYLSRAQESAARIRLGTALPSLRVMKSSSPSTVADTVFVERIRSKVKYWRESCKSSDTNKSRDEELVNSLRNIVLGNEQFRSRPCMTVDVCSERQVQLILEMVLDYSDDLLPLPIPTKSGTIHAVRIVLANSKEDKDLLERELRNLEEEESKKIRGFREVIDLISASQKPVISHNCLNDCTLIHSKFIAPLPPEIDEFVSSLCSVFPEVLDINYLMKKHGTMRKVTNIPSAISYLNNHFFAPVDLEIPDQATVKEGKIHGLTALRLSYLFMKLCSILKISPNVTESGNKHLAPELEDFTNVFHPFSTPIQDSFNGGDVGMWTNNTKKVSCEHLVFLWGFKIGITAGMLKSLLRSSHDIFSREFDVKLVDKSCAIVVFWQSGVSKRFLDILNSEEIRGDLKELVSDGMRSSSTMASLSTLLPNPNLISKHNSTLSSTHPCAYSWKNKTPTSKGRFSVSCSSSSQAYDVVVVGAGVIGLTIARHFLVSSDLSVAVVDKAVPCSGATGAGTSVDGKQNPWECYVGSCVKESSTLEDAGTEHRRARTDAESDVLKGRVKLLCEAGLKAEYLCSSDLIKEEPDLLVDKDSAAAFLPDDCQIDAYRTVAYIEKVLYSWSFASKGRYTEFYDDPVKCFIRSDSNGEVKAVQTSKNTIYSKKAVIVAAGCWTGSLMQDLFRNWGMDLHVPVMPRKGHLLVVQNFNFLQMNHGLMEADYLNHPTISGSESPDHQKNLSVSMVASIDAAGNLLLGSSREFVGFNTNLDESVVSYIWKRVGEFFPKLKTLPLSDLSASRKVRIGLRPYMPNGKPVIGPVPGLSNVYLAAGHEGSGLLMALGTAEMIVEMVLGYPAKVDSTPFAVQKVLV

SEQ ID NO: 184775 - protein, 44 aa, Glycine max
  Coding DNA Sequence Number=SeqID_67997
MTETAVSLADKVAEAEEDDGKRDRINKMGDAAERSSFSHGRCHR

SEQ ID NO: 184776 - protein, 207 aa, Glycine max
  Coding DNA Sequence Number=SeqID_67998
  Gene Ontology: Mol. function=iron-sulfur cluster binding; Cellular component=mitochondrion; Biological process=electron transport
VPGPRFGEGNDHTFEVVVEENLASEPGVFVEDPCSGIANEDVLLVVGARGRRSPPGGGTPGRPGPCLSAPSAGSDRPGPPPRASYPRSRSPTAARCGPRPSSWRRKRWRCGRSGIWRRTRRRGGGALARTVSADSPLPLVIVVRPRKPVQSALLVRKSEQREMNLGWARSFSDGLNAEYGGKTFCTPTIASYISHCISKIFRKGNRK

SEQ ID NO: 184777 - protein, 175 aa, Glycine max
  Coding DNA Sequence Number=SeqID_67999
MESRKRAITEDIPSSSTPAPPSVTVGQDVQSSPTLVPMLQSLFRGQFIIMHSLQELAHNRPIISMEHFLEQVAWPEAQLPLVRPNEAASLEPTPVQVNLEPANPQSPVVNPPSSPELEAVPPSPPLIVIFDTSSYAPPDSPVVETADPPVSPIGGIADLFDSLSGETVALTDSPI

SEQ ID NO: 184778 - protein, 241 aa, Glycine max
  Coding DNA Sequence Number=SeqID_68000
  Gene Ontology: Mol. function=oxidoreductase activity; Cellular component=anchored to membrane; Biological process=lignin catabolic process
  Homolog annotation: Hit_ID=Q1EPX7; Match level="QueryCoverage=89%, HitCoverage=36%, E-value=7e-71, Identity=57%"; Hit description=C -terminal peptide-binding protein 1
  Pfam annotation: Domain name=Cu-oxidase_3; Domain location=32-148; Score=209.1; E_value=1e-59; Accession=PF07732.5; Description =Multicopper oxidase
MAIVEAVKSTKVKHRGATTGHTSDPYVFYDWTVSYTSASPLGVKQKVIGINGQFPGPTLNVTTNWNVVVNVKNNLDEPLLLTWNGIQHRKNSWQDGVSGTNCPIPAGWNWTYEFQVKDQIGSFFYFPSLNFQRAAGGYGGIIINNRPVIPVPFGLPDGDITIFLSDWYTRSHKELRKDVEDGIDLGVPDGVLINGLGPYRYDENLVPNGISYRIINVEPETLDNYESPNLGPTRQFKIQTP

SEQ ID NO: 184779 - protein, 140 aa, Glycine max
  Coding DNA Sequence Number=SeqID_68001
  Gene Ontology: Mol. function=DNA binding
  Homolog annotation: Hit_ID=O82166; Match level="QueryCoverage=72%, HitCoverage=35%, E-value=9e-09, Identity=44%"; Hit description =Putative AT-hook DNA-binding protein
MQHDGEARNEGDDEASRGYSTSVTGCDSRCATVTEGSKKRPKLKSLVIITRESTNTPHAQILKVGIDCNIFEIVANYTPVLVQDLYPQQQRNDHKCEPIEAIIDECCGHTSRKVRDTIPDRVVPSFVDAIRGEESPHIKS

SEQ ID NO: 184780 - protein, 164 aa, Glycine max
  Coding DNA Sequence Number=SeqID_68002
MVEPYRRPKSFTPLVTIYMAAFYSGVIGAAITEQLYKEKYWEEHPGKAVPLMRPKFYGGPWRVMGGTRVVDIVSYASIISDKWVAIATDQFDQQHPKENKDRKALSLFGVAMIIALLIFMLGTTTYRFNIQGSPDKSHFLRIGRVFIAAIRNRSSSLEQSSGQF

SEQ ID NO: 184781 - protein, 194 aa, Glycine max
  Coding DNA Sequence Number=SeqID_68003
  Homolog annotation: Hit_ID=Q10EV2; Match level="QueryCoverage=58%, HitCoverage=64%, E-value=5e-17, Identity=37%"; Hit description =Expressed protein
MVVKIKVFGGVLLLGANGDAFGRGFEEGQGEALGGGADVEVDEAGAGDVDADTHDLEPEEEILGLEAGEGVDHAVAEVAGDVALVMQLVLELGVAGLVEAHPEATILAHRELPHALREQAHGQPVLAQDLVDGRRIATQAQRRGPGARNNDWKDKDEDDGVREGKHGCGNIVGGRGIIEMGFGIWRRRERERER

SEQ ID NO: 184782 - protein, 60 aa, Glycine max
  Coding DNA Sequence Number=SeqID_68004
MVNGLLVRFNLEGFGISSNREPLEEMFYRVWTVQKKILIKREATEMNFLNPFLIEKMVVM

SEQ ID NO: 184783 - protein, 71 aa, Glycine max
  Coding DNA Sequence Number=SeqID_68005
MEPSHTWFSRIANWTMQASSLYADFEGHWVSCVSLKMRNLPERLKWRVRSIDHIPEDNGLKLCGGKQLLGI

SEQ ID NO: 184784 - protein, 370 aa, Glycine max
  Coding DNA Sequence Number=SeqID_68006
  Gene Ontology: Mol. function=calcium ion binding; Cellular component =cytoskeleton; Biological process=actin filament bundle formation
  Homolog annotation: Hit_ID=Q67XH3; Match level="QueryCoverage=99%, HitCoverage=94%, E-value=1e-168, Identity=58%"; Hit description =Fimbrin 2
  Pfam annotation: Domain name=CH; Domain location=124-240; Score =105.0; E_value=2.2e-28; Accession=PF00307.21; Description=Calponin homology (CH) domain
  Pfam annotation: Domain name=CH; Domain location=269-370; Score=78.0; E_value=3e-20; Accession=PF00307.21; Description=Calponin homology (CH) domain
  Pfam module annotation: Pfam domain module=CH::CH; Domain location =124-240::269-370
  Subcellular localization annotation: CTP_CleavageSite=55; ConfidenceScore=5.10e-01
MSGHWGILVSDPWLQNQFTQVELRSLKSQFVSMRRESGRLTVGDLASKMARLKVVGENLSEEERGSYIQDLYQNTGEEVDFELFLKVYLKLQTFASSRTGSNAKNSSAFLKAATTTLLHTISESEKAAYVAHINNYLAGDEFLKKCLPIDPSTNDLFEIAKDGVLLCKLINVAVPRTIDERAINTKRLLNPWERNENHTLCLNSAKAIGCTVVNIGTQDFIEGRRHLVLGLISQIIKIQLLADLNLKKTPQLLELINDSEGMEELMSLAPEKILLRWMNFHLKKTCYKKIVTNFSSDVRDAEAYAHLLNVLAPEYTNPSTLAVKNPYERAKLVLEHADKMGCKRYITARDIVEGSPNLNLAFVAHIFQHR

SEQ ID NO: 184785 - protein, 98 aa, Glycine max
  Coding DNA Sequence Number=SeqID_68007
SEFLMGGYVGAKASLLSTAPLSVTMTQELVARGDTLRSEFFIGGYVGARALLFVGRPIIFVILTLRGGGLDDTRRYLTVIRTLVSSRGGGPDDMQRLT

SEQ ID NO: 184786 - protein, 81 aa, Glycine max
  Coding DNA Sequence Number=SeqID_68008
  Subcellular localization annotation: CTP_CleavageSite=63; ConfidenceScore=5.04e-01
MDEITIKKHNYLSFRLLWLICLASLCGGIMGSPSASTTPSPPPSPPSSPRPPPYFGRIGFDVCREADTQSLTFTIVVHKTT

SEQ ID NO: 184787 - protein, 545 aa, Glycine max
  Coding DNA Sequence Number=SeqID_68009
  Gene Ontology: Mol. function=RNA-directed DNA polymerase activity; Biological process=RNA-dependent DNA replication
  Homolog annotation: Hit_ID=Q1SFJ7; Match level="QueryCoverage=28%, HitCoverage=21%, E-value=6e-34, Identity=41%"; Hit description=RNA -directed DNA polymerase
MRIWSDLHHLWLDQLEDGFVFGRNDASKLDITSSERDLLVYKEHSWRMVRRLLLLMFMHQMIKVPSGVVGIGGEDGSGDEREEFNRFIGDLGVKDIPMVGRKFTWYRPNERAKSMIDRVMVTSEWFSLWQGCTQYVLEINISGHCPLLLKNTNIDLGPKPLRVGAYVLKEKLMEIKKSLKIWNEDDMELSEEEINKRKWNYKRSFGGWWLVMNLWLDKSQELDGWREPCRVKLEVARFFEERFKEEEVKEAVCNCRSLKSLGLDGTNFKFIKAFWHLSKSDVMRPISLEGWIYKILVKVLSNRLKRVLDGVIDKRQSAYLGARYLLHGALVANEAIYEARRLKKKCLIFKVDYGKAYDSVSWDFLIYMLKRLGFNGRWIKWIKRCLESCRVSILVNGSLSKKFPVSKGLSGMMRDAIEKNLNTSYLVGTMGVGGRFLGKVRIIFVKVRKIAGSKYGGCKAFEKEKRGVGRLSGGGIGSNGSKNCWNFLEDFRGGVALGYIWSNPSSIELCMREVLVMITMGDQGQCLGCNKVVESISHVLFWCPK

SEQ ID NO: 184788 - protein, 60 aa, Glycine max
  Coding DNA Sequence Number=SeqID_68010
MQKTSGQMKRCRVKNCIFRCNKNAEDGEGNENLQRKASGEISKSMSSKGDIRSFHLSSIA

SEQ ID NO: 184789 - protein, 108 aa, Glycine max
  Coding DNA Sequence Number=SeqID_68011
YAPPYPPPQGYPPPGYPSAPPQPPPGYVPYPPPQYEGYQGYFNHGYPLPPPPNYHCHHAQHHHNDNPGFTSFLQGCLAIQNHDQPVIKAQLFLLIGNKINIYITRLFK

SEQ ID NO: 184790 - protein, 59 aa, Glycine max
  Coding DNA Sequence Number=SeqID_68012
MKLLLVCFTGLNFIPSDININLVSNEEEKLCLDDRLVMILNSKAAYNNPLPYLRLARSL

SEQ ID NO: 184791 - protein, 104 aa, Glycine max
  Coding DNA Sequence Number=SeqID_68013
  Subcellular localization annotation: CTP_CleavageSite=73; ConfidenceScore=5.11e-01
MEDAPVSPASPSHRRVGCDNPENPFSPHAISYQNPFSLSSSSLRLFVLLTHAAIPVRVGVRVRVGVRVRVRVRTSSRSSLSSSSCFSWSSSSHQFVFVFVTMAI

SEQ ID NO: 184792 - protein, 82 aa, Glycine max
  Coding DNA Sequence Number=SeqID_68014
CDLDSSGIGVDLDGDAAKRHNTKKILRVRSNGGTIVGSSGGIIVNSSGGVIVVLEQKHSCVCFKVMEVLPLTMSSVPSMEVA

SEQ ID NO: 184793 - protein, 88 aa, Glycine max
  Coding DNA Sequence Number=SeqID_68015
  Homolog annotation: Hit_ID=Q9FKI0; Match level="QueryCoverage=60%, HitCoverage=7%, E-value=2e-08, Identity=60%"; Hit description =Fimbrin-like protein 2
IFVAIDAIQHPSTSKEPEIHSHGKEIIDADILRWANSKVSSLGSQSRMDSFKNEFWRDSTLRVLTKKFWSGLANCYVMPHNNLAMCLE

SEQ ID NO: 184794 - protein, 155 aa, Glycine max
  Coding DNA Sequence Number=SeqID_68016
MSLIREDWCGLIWNILVIFLVNVGKVVGLDDIPFEVWKWMGEQGFIWLPMLFNEFVDTKWLESLTEAEKQALLQEVEEEKSRWLEVRRGIGVACLSIYIKMKFCQIEKGFSYAFFNLLRQKDETSKSLVFRSQKFPDGSNSETCSVKDKLMRYID

SEQ ID NO: 184795 - protein, 95 aa, Glycine max
  Coding DNA Sequence Number=SeqID_68017
MGVPVGSEGDPPSHGKDEILNGMVHNTIVQVENLTNESKTRKQNVHRRETKPWRKGCYKYLLRTEGCKFSHTKKKGNTDINNTCNRKCYMSLGKV

SEQ ID NO: 184796 - protein, 244 aa, Glycine max
  Coding DNA Sequence Number=SeqID_68018
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-24, Identity=31%"; Hit description= UPI00006A17C9 related cluster
RTRRPRHQGTTCPRHQRAACPYLQRTRCPHHQRVARPHHQRVARPHHQRTAKLRGLHVLTSRGLHVLAVRGLDVLAIKGLYVQTFRGLHVLTFRGLDFFAIRGLHVLSIRGLHALTIRGLHVLTFRGLDVLAIRGLYVLTFRGLHVLIFRGLDVLAIRGLHVLAIRGLHALTFRGLHILTIRGMHTLTFKGLHVLTIRGLHALTFRGLHVLALRGLQVHTFRGLHVLAFRWLHVLAFRGLHVLH

SEQ ID NO: 184797 - protein, 762 aa, Glycine max
  Coding DNA Sequence Number=SeqID_68019
  Homolog annotation: Hit_ID=Q6K649; Match level="QueryCoverage=43%, HitCoverage=85%, E-value=1e-130, Identity=67%"; Hit description =Kelch repeat-containing F-box protein-like
  Pfam annotation: Domain name=F-box; Domain location=47-94; Score =31.7; E_value=2.6e-06; Accession=PF00646.23; Description=F-box domain
  Pfam annotation: Domain name=Kelch_1; Domain location=136-185; Score =34.0; E_value=5.4e-07; Accession=PF01344.15; Description=Kelch motif
  Pfam annotation: Domain name=Kelch_1; Domain location=187-233; Score =57.9; E_value=3.2e-14; Accession=PF01344.15; Description=Kelch motif
  Pfam annotation: Domain name=Kelch_1; Domain location=235-282; Score =37.9; E_value=3.5e-08; Accession=PF01344.15; Description=Kelch motif
  Pfam annotation: Domain name=Kelch_2; Domain location=136-185; Score =3.8; E_value=12; Accession=PF07646.5; Description=Kelch motif
  Pfam annotation: Domain name=Kelch_2; Domain location=187-233; Score =32.6; E_value=1.4e-06; Accession=PF07646.5; Description=Kelch motif
  Pfam annotation: Domain name=Kelch_2; Domain location=235-282; Score =25.4; E_value=0.00021; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=47-94::136 -185::187-233::235-282::136-185::187-233::235-282
MPGFTVGKKRFIQPNMCFTNLIHQDKSTLSQSNHCLFPEALNKDYSPILPGLPDDVAEYCLALVPRSNFPAMGVVCKGWRSFIQSKEFTTVRKLAGMLEEWLYFLTTDCEGKESHWEVMDCLGHKCRSLPPMPGPGKAGFQVVVLNGKLLVMAGYSVIEGTAFASAEVYQYDSCLNSWSRLSDMIVARYDFACAEVDGLVYAVGGYGVNGDSLSSAEVYDPDTDTWTLIESLRRPRWGCFACGFEGKLYVMGGRSSFTIGNSKFVDIYNPERHSWCEIKNGCVMVTAHAVLGKKLFCIEWKNQRKLAIFSPEDNSWKMVPVPLTGSSSIDFRIGILDEKLLLFPLEAETAFQTLLYDPNATLGSEWQTCDIRPSVEGAENTNTMFGSAQPSSSPFGTPSSTPAFGTPSSTPAFGTPSSTPAFGTPSFGTPSSTPAFGTPSSTPAFGSSLFSTPFSSQPQQQQQQQQQQQQTPLFQQQQTSSAFGFQNSLALAAPQPSLFPNAQLTTQMANVAPVPFSLADRDVQTIVDAYKEDPGNPKYAFKHLLFSVTEPQFRVKPAGVSDIMWAEAMGKLEGMESADRERLWPQLVQGFKDLSQRLKIQDEVIVSDAERLRITQSNVKMVLLFPLLNQEHNVNVVLVMRIVEALEEKGCRIPLTKGEAELAEKLATITRQLKGSGAELSRRVQNLLTVSRVKANSNGFGSSVYLPGSTKIHEQSLGDLQEVLQQQMEAIARLGSVLKRDIRDMEIMMTEDTARTENGNLI

SEQ ID NO: 184798 - protein, 210 aa, Glycine max
  Coding DNA Sequence Number=SeqID_68020
  Gene Ontology: Mol. function=structural constituent of ribosome; Cellular component=ribonucleoprotein complex; Biological process =translation
  Homolog annotation: Hit_ID=Q93VI3; Match level="QueryCoverage=82%, HitCoverage=98%, E-value=6e-86, Identity=90%"; Hit description=60S ribosomal protein L17-1
  Pfam annotation: Domain name=Ribosomal_L22; Domain location=46-182; Score=262.7; E_value=7.4e-76; Accession=PF00237.9; Description =Ribosomal protein L22pL17e
MYSKTIIDPSSTKAVALLQHCGSRRSAAAMVKYSREPDNPTKSCKARGADLRVHFKNTRETAFAIRKLPLVKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEAETQLATSKKKGALRSGASS

SEQ ID NO: 184799 - protein, 189 aa, Glycine max
  Coding DNA Sequence Number=SeqID_68021
  Homolog annotation: Hit_ID=Q3HVN8; Match level="QueryCoverage=30%, HitCoverage=15%, E-value=3e-20, Identity=87%"; Hit description =Serine/threonine protein kinase SAPK8-like protein
MDRATWTWSNEGSRYHFCNTTIQDRENLKSSGHAFWAINNTRKHENAAYEANNLSRRHPQNDVVTISHKSSFPLALSLSLSHSLTHRSPNLSPHPQPPPPYPPLLLQPMDRPATGPGVDMPIMHDSDRYDFVRDIGSGNFGVARLMRDKQTQELVAVKYIERGDKFFWAVSLVLVTSARDMVAEYGKFA

SEQ ID NO: 184800 - protein, 473 aa, Glycine max
  Coding DNA Sequence Number=SeqID_68022
  Gene Ontology: Mol. function=GTPase activity; Cellular component =membrane; Biological process=cell cycle
  Homolog annotation: Hit_ID=Q010M4; Match level="QueryCoverage=78%, HitCoverage=84%, E-value=4e-76, Identity=40%"; Hit description =Homology to unknown gene
  Pfam annotation: Domain name=DUF258; Domain location=82-391; Score =440.0; E_value=3.1e-129; Accession=PF03193.7; Description=Protein of unknown function, DUF258
  Pfam annotation: Domain name=MMR_HSR1; Domain location=248-409; Score= 1.0; E_value=0.00081; Accession=PF01926.13; Description=GTPase of unknown function
  Pfam module annotation: Pfam domain module=DUF258::MMR_HSR1; Domain location=82-391::248-409
  Subcellular localization annotation: CTP_CleavageSite=33; ConfidenceScore=5.41e-01
MSFASSFSMLRHRAAASAAPLLLLRRFRCLRIAARHQQQNPNKQAPPSRNLLKAKQTLKEFSSLAPVLSLEASPPLTESQAIGVVAASQANFMRVIVPENDEPSGSFRGVEILCVVRALLKKIKRRVMVGDKVLVGSIDWVDRRGMIENVFHRTSEILDPPVANVDQLLVLFSLEQPKPEPFTLTRFLVEAESTGIPLTLALNKTELVDNEIISSWKARLRSWGYEPVFCSVESGHGLDLLGFKLRDQTTVIVGPSGVGKSSLINALRSNPSNAAEGENWFEPVLGSKWLEDQRVGEVSTRSGRGKHTTRHVSLLPLSEGGFLADTPGFNQPSLLKVTKQSLAQTFPEIRKMLSASEIEKCSFNNCLHLGEPGCIVKGDWERYSYYFQLLDEIRIREEFQLRTFGTKREGDVRLKMGDMGVQQAEPRLEPKKHRRQSRKRINQSILDELDDDDDNLLDEENDPILRALRNENS

SEQ ID NO: 184801 - protein, 153 aa, Glycine max
  Coding DNA Sequence Number=SeqID_68023
  Gene Ontology: Mol. function=signal peptidase activity; Cellular component=signal peptidase complex; Biological process=signal peptide processing
  Homolog annotation: Hit_ID=Q2QS62; Match level="QueryCoverage=52%, HitCoverage=53%, E-value=6e-25, Identity=60%"; Hit description =Microsomal signal peptidase 12 kDa subunit family protein
  Pfam annotation: Domain name=SPC12; Domain location=1-80; Score =138.6; E_value=1.7e-38; Accession=PF06645.4; Description=Microsomal signal peptidase 12 kDa subunit (
MDWQGQKIAEQLMQIMLLAFTVIAFATGYLMASFQMMILIYAGGVVLTTLVTVPNWPFFNHHPLKWLDPSELEKHPKPQSSLNCDANFLCSKLLFTKRETCWDVVVELVLLDQVVGNIFIAFLSPGSVMAELADSEIQAKARKGTIYNEYSGD

SEQ ID NO: 184802 - protein, 112 aa, Glycine max
  Coding DNA Sequence Number=SeqID_68024
  Gene Ontology: Mol. function=transferase activity
  Homolog annotation: Hit_ID=Q5N7V3; Match level="QueryCoverage=60%, HitCoverage=14%, E-value=1e-13, Identity=59%"; Hit description =Putative hydroxycinnamoyl transferase
MPPFGTSSPPSWESLEELPPLPPASPISAANPSSAAMSCSTCQKNWECEPKSFELGNHDDATVQIGSSLRFPMYDNDFGWGRPLAYAAAERTSLTARCLHFLGGMVAPPSIW

SEQ ID NO: 184803 - protein, 723 aa, Glycine max
  Coding DNA Sequence Number=SeqID_68025
  Homolog annotation: Hit_ID=Q940H6; Match level="QueryCoverage=15%, HitCoverage=30%, E-value=7e-54, Identity=92%"; Hit description =Protein kinase-like protein
  Pfam annotation: Domain name=Pkinase; Domain location=1-249; Score =5.7; E_value=6.7e-09; Accession=PF00069.15; Description=Protein kinase domain
  Pfam annotation: Domain name=Pkinase_Tyr; Domain location=1-249; Score=-152.6; E_value=0.0042; Accession=PF07714.7; Description =Protein tyrosine kinase
  Pfam module annotation: Pfam domain module=Pkinase::Pkinase_Tyr; Domain location=1-249::1-249
IDENVKREIINHRSLRHPNIIRFKEVILTPTHLAIVMEYASGGELFEKICNAGRFNEDEARFFFQQLISGVSYCHAMEVCHRDLKLENTLLDGSPALHLKICDFGYSKENDKLAGWLGVWGEYREMEEQWNAGSQSCCIQGFNEVFNGSGSNMGDGVTLGSGGGTSLLVKDPIDEYFMAVCKVELPLIDGMDPVGCINGVGTHFKVQSMSDEVEVKLAKLSMDGATIHLFNLLKETKEHLTWTRLKQALRVYGDCHYNNMIEDLFYLCQMGTIEEYIADIVFISWLVVIGSMLGINVIGVPFWSGLQAGKREDDLYCIHEEGEFLSLSVENTLEDFHSIISSYIQVIPLYLIITGATVCCQSAVSYNSGETRIHASPSTSQNCALTVQKGSPDLSGPYSALKSSLSLFNVSVSSIGPTVSSTVGPTVLFSGTPVITSEKLNGSKNYLSRSSSVELWFLGQGHHEHSEAVSKAKHLSDLKSAVEELRMFLDAELVEEMRRKHDNLYMVLALRAMNPDFDHIRDQVLTNEEVPSMKSLLTCLLRVPNPRKNENSLELTESSAMVSSQGRGRGRGHENRGRGGCGGGRNANVSTSKTHEPKFFEEEYQEYLQLKSNSASDHSSLFTSLSPPKILHLITLANGTKVTSKGVGKGSISPSLNLDPECGTGQLIGVGHESRGLYYLEMSSSVSCFMSLSPKLLHDRLGHPHLSKLKKMVPSLNKLQVLK

SEQ ID NO: 184804 - protein, 776 aa, Glycine max
  Coding DNA Sequence Number=SeqID_68026
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=98%, HitCoverage=98%, E-value=3e-85, Identity=30%"; Hit description=Bg55 protein
  Pfam annotation: Domain name=Arm; Domain location=465-509; Score=9.5; E_value=0.8; Accession=PF00514.13; Description=Armadillobeta-catenin -like repeat
  Pfam annotation: Domain name=Arm; Domain location=511-549; Score=3.6; E_value=4.3; Accession=PF00514.13; Description=Armadillobeta-catenin -like repeat
  Pfam annotation: Domain name=Arm; Domain location=550-591; Score=7.3; E_value=1.5; Accession=PF00514.13; Description=Armadillobeta-catenin -like repeat
  Pfam annotation: Domain name=Arm; Domain location=635-675; Score=1.4; E_value=8.2; Accession=PF00514.13; Description=Armadillobeta-catenin -like repeat
  Pfam annotation: Domain name=U-box; Domain location=291-363; Score =78.4; E_value=2.3e-20; Accession=PF04564.6; Description=U-box domain
  Pfam module annotation: Pfam domain module=Arm::Arm::Arm::Arm::U-box; Domain location=465-509::511-549::550-591::635-675::291-363
MDVAEVEESFFAASDAKLHGEMCKCLSAIYCKILSLFPSLEAARPRSKSGIQALCSLHVALEKAKNVLQHCSECSKLYLSILHITSPMTQAITGDSVLLKFEKAKCALGDSLKRVEDIVPQSIGCQIDEIVKELASTVFALDPSEKQVGDDLIALLQQGRKFSDSNDSNELECFHLAATRLGITSSRTALTERRALKKLIERARAEEDKRKESIIAFLLHLMRKYSKLFRSEFSDDNDSQGSQPCSPTVQRSLEDGIPSGHCHAFDRQLSKLSSFNFKPNNRKSGQMLLPPEELRCPISLQLMSDPVIIASGQTYERVCIEKWFRDGHNTCPKTQQKLSHLCLTPNYCVKGLVASWCEQNGVPIPEGPPESLDFNYWRLALSDTESTNSRSVNSVGSCKLKGVKVVPVEESGISEQMGGNATESFCAQEEDNEQYVSFLKVLTEGNNWKRKCKVVEQLRLLLRDDEEARIFMGANGFVEALMQFLQSAVHEANAMALEIGAMALFNLAVNNNRNKEIMISTGILSLLEEMISKTSSYGCAVALYLNLSCLDKAKHMIGTSQAVQFLIQILEAKTEVQCKIDSLHALYNLSTVPSNIPNLLSSGIMDGLQSLLVDQGDCMWTEKCIAVLINLAVYQAGREKMMLAPGLISALASTLDTGEPIEQEQAASCLLILCNRSEECCQMVLQEGVIPALVSISVNGTSRGREKAQKLLMVFREQRQRDHSPVKIDQPESESSDLSMPPPDTKPLSKTISRRKVVGKAFSFLWKSKSYSVYQC

SEQ ID NO: 184805 - protein, 835 aa, Glycine max
  Coding DNA Sequence Number=SeqID_68027
  Gene Ontology: Mol. function=protein binding; Cellular component =intracellular; Biological process=defense response
  Homolog annotation: Hit_ID=Q1S334; Match level="QueryCoverage=97%, HitCoverage=98%, E-value=0.0, Identity=46%"; Hit description=Disease resistance protein; AAA ATPase
  Pfam annotation: Domain name=LRR_1; Domain location=623-643; Score =1.2; E_value=1.7e+02; Accession=PF00560.23; Description=Leucine Rich Repeat
  Pfam annotation: Domain name=LRR_1; Domain location=670-692; Score =8.4; E_value=7.7; Accession=PF00560.23; Description=Leucine Rich Repeat
  Pfam annotation: Domain name=LRR_1; Domain location=694-716; Score =9.7; E_value=4.4; Accession=PF00560.23; Description=Leucine Rich Repeat
  Pfam annotation: Domain name=LRR_1; Domain location=718-740; Score =10.1; E_value=3.7; Accession=PF00560.23; Description=Leucine Rich Repeat
  Pfam annotation: Domain name=LRR_1; Domain location=742-764; Score =11.1; E_value=2.4; Accession=PF00560.23; Description=Leucine Rich Repeat
  Pfam annotation: Domain name=LRR_1; Domain location=766-788; Score =10.4; E_value=3.3; Accession=PF00560.23; Description=Leucine Rich Repeat
  Pfam annotation: Domain name=NACHT; Domain location=182-329; Score= -25.6; E_value=0.0056; Accession=PF05729.3; Description=NACHT domain
  Pfam annotation: Domain name=NB-ARC; Domain location=146-443; Score =84.5; E_value=3.3e-22; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=623-643::670 -692::694-716::718-740::742-764::766-788::182-329::146-443
MEDLFSGGAVGAVMGELLKGAIATINKGRDFRPTLESNIETLNSLAPQVEEMKRYNKMLDRPIEEIERLESQMRAGEELVRKCSKFGRWRMLSFPYYQSKLRSKDEALKRHFSVNVSAENKRDLMEIVASVRQILDILSKKEGFGHSFHLRGLSGAPQEPECVGMDVPMSKLRIDLLKDGVSVLVLTGLGGSGKSTLAKKICWDPQVKGKFGGNVFFVTVSKTPNLKNIVETLFEHCGCPVPKFQSDEDAINRLGFLLRLVGKNPILLVLDDVWPSSEALVEKFKLDIPDYKILVTSRVSFPRFGTPCQLDKLDHDHAVALFCHFAQLNGKSSYMPDENLVHEIVRGCKGSPLALKVTAGSLCQQPYEVWQNMKDCLQSQSILLESSSSDLLFRLQQSLDILEDKFKINEKVCFEDLGLFPEDQRIPVAALIDMWSELHNLDENGRNAMTIVHDLTIRNLINVIVTRKVAKDADMYYNNHFVMLHDLLRELAIRQSEEKPFEQRERLIIDLSGDNRPEWWVGQNQQGIIGRTFSFILGTSYRQKQLRVAARILSISTDETFTSDWCDMLPDEAEVLVLNLNSSQYPLPKFTENMSKLKVLIVTNYGFHRSELNNFELLGSLSNLKRIRLEKVSVPSLCILKNLRKLSLHMCNTRQAFENCSIQISDAMPNLVEMSIDYCNDLVKLPDGLSNITPLKKLSITNCHRLSALPQDIAKLENLEVLRLCSCSDLVEMPDSVKGLNKLSCLDISDCVSLSRLPDDIGELKKLEKLYLKGCSKLSELPYSVINFGNLKHEIYVICDEEMAALWESFPTIPKLKIEISSMEINLNWLPGVHS

SEQ ID NO: 184806 - protein, 694 aa, Glycine max
  Coding DNA Sequence Number=SeqID_68028
  Gene Ontology: Mol. function=protein binding; Cellular component =intracellular; Biological process=defense response
  Homolog annotation: Hit_ID=Q1SVX0; Match level="QueryCoverage=87%, HitCoverage=84%, E-value=1e-167, Identity=50%"; Hit description =Disease resistance protein
  Pfam annotation: Domain name=LRR_1; Domain location=483-503; Score =1.9; E_value=1.3e+02; Accession=PF00560.23; Description=Leucine Rich Repeat
  Pfam annotation: Domain name=LRR_1; Domain location=530-552; Score =4.5; E_value=41; Accession=PF00560.23; Description=Leucine Rich Repeat
  Pfam annotation: Domain name=LRR_1; Domain location=554-576; Score =9.7; E_value=4.4; Accession=PF00560.23; Description=Leucine Rich Repeat
  Pfam annotation: Domain name=LRR_1; Domain location=578-600; Score =9.7; E_value=4.3; Accession=PF00560.23; Description=Leucine Rich Repeat
  Pfam annotation: Domain name=LRR_1; Domain location=602-624; Score =11.9; E_value=1.7; Accession=PF00560.23; Description=Leucine Rich Repeat
  Pfam annotation: Domain name=LRR_1; Domain location=626-647; Score =6.4; E_value=18; Accession=PF00560.23; Description=Leucine Rich Repeat
  Pfam annotation: Domain name=NACHT; Domain location=100-249; Score= -37.1; E_value=0.045; Accession=PF05729.3; Description=NACHT domain
  Pfam annotation: Domain name=NB-ARC; Domain location=66-335; Score =35.4; E_value=1.5e-12; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=483-503::530 -552::554-576::578-600::602-624::626-647::100-249::66-335
GKELIDKYSKVTWWRFLCFPCYQCKLKASEDALTRHTTTIEPVHIRLGMMEIQSGIKIILQTLLMSGKENIGGAIEEPECIGMEQHLNKLKIELLKDGMSVLVLTGLPGSGKTTLAKKICWDTDIKGKFGVNIFVTVSKTPNLKSIVGTVFHGCRRPVPEFQSDDDAINRLSALLLSVGGNDKNPILLVLDDVWPGSEALVDKFTVQIPYYKILVTSRVAYPRFGTKILLGQLDHNQAVALFAHYAKLNDNSPYMPEEDLLHEIVRRCMGSPLVLKVTAGSLCGQPFEILDALEDEFHINEKVCFMDLGLFPEDQRIPVPALIDMWAELKVAKDEDKYYNNHFVILHDLLRELAIRQSTEKPFEQDRLIIDITGNDFPEWWVGENQQGTIGQMFPCFSRMIRQKQLKVAARILCISTDETFNSDWRDMKPYNTEVLILNLHSSQYSLPCFTKKMKKLKVLIVTNYGFHRSEIKKFELLGSLSNLKRIRLEKVSVPSLCELKNLQKLSLRMCNTRQAFENCSIQISNAMPCLEEMSIDYCNDLITLPDGLCEISPLKKLSITNCHKLSALPQGIGKLENLEVLRLCSCSDLLEMPNSFEGLNKLSCLDISDCVSLTKLPDDIGELKKLKKLYMKGSKLGELPYSVHKFEQFKHEINVICDEETVTLWENFRAFPNLKIEIFREDIDLNWLHGVHS

SEQ ID NO: 184807 - protein, 107 aa, Glycine max
  Coding DNA Sequence Number=SeqID_68029
  Gene Ontology: Mol. function=peptidase activity
  Homolog annotation: Hit_ID=Q6Z3T8; Match level="QueryCoverage=84%, HitCoverage=28%, E-value=6e-24, Identity=64%"; Hit description=Auxin- regulated protein-like
  Pfam annotation: Domain name=OTU; Domain location=22-107; Score=14.8; E_value=0.0022; Accession=PF02338.9; Description=OTU-like cysteine protease
MEEVPNKSKLQAQETRAIYGIPGDGRCLFRSVVYGACLRSGEPSPSLSRQKELADELRAKVVDEFIKRRADTEWFLEGDFDTYTVQMRKPQYEEENLDFSCPHMFYS

SEQ ID NO: 184808 - protein, 184 aa, Glycine max
  Coding DNA Sequence Number=SeqID_68030
  Gene Ontology: Cellular component=endoplasmic reticulum
  Homolog annotation: Hit_ID=Q9ZTZ3; Match level="QueryCoverage=89%, HitCoverage=90%, E-value=1e-54, Identity=63%"; Hit description=24 kDa seed maturation protein
  Pfam annotation: Domain name=Reticulon; Domain location=25-183; Score= 26.4; E_value=1.6e-08; Accession=PF02453.8; Description=Reticulon
MKVPRMLQGFHVSSESYTYVDNGIEKDVVLWRRKKINISVLVCNSSMGVDGSGLELCKYVIIVSLLEVTEETTTRIAKTVRAWIKEAIRWLFLVGAEKEWPVFVGAVAALLLLSYIGSCMDLLTLVYMGTLVGMAVPLTYVKNEDKIKRFVGWLREKHKRYYQIIDEKTIQKIKSRIAKEKKTE

SEQ ID NO: 184809 - protein, 648 aa, Glycine max
  Coding DNA Sequence Number=SeqID_68031
  Gene Ontology: Mol. function=protein binding; Cellular component=beta- galactosidase complex; Biological process=signal transduction
  Homolog annotation: Hit_ID=Q1SKB0; Match level="QueryCoverage=97%, HitCoverage=85%, E-value=0.0, Identity=59%"; Hit description=Ankyrin
  Pfam annotation: Domain name=Ank; Domain location=109-141; Score=7.2; E_value=2.9; Accession=PF00023.20; Description=Ankyrin repeat
  Pfam annotation: Domain name=Ank; Domain location=196-228; Score =21.9; E_value=0.0023; Accession=PF00023.20; Description=Ankyrin repeat
  Pfam annotation: Domain name=Ank; Domain location=233-265; Score =24.7; E_value=0.00033; Accession=PF00023.20; Description=Ankyrin repeat
  Pfam annotation: Domain name=Ank; Domain location=266-298; Score =29.4; E_value=1.2e-05; Accession=PF00023.20; Description=Ankyrin repeat
  Pfam annotation: Domain name=Ank; Domain location=336-369; Score=3.2; E_value=11; Accession=PF00023.20; Description=Ankyrin repeat
  Pfam annotation: Domain name=Ank; Domain location=370-402; Score =25.4; E_value=0.0002; Accession=PF00023.20; Description=Ankyrin repeat
  Pfam annotation: Domain name=Ank; Domain location=4-36; Score=0.4; E _value=27; Accession=PF00023.20; Description=Ankyrin repeat
  Pfam annotation: Domain name=Ank; Domain location=438-470; Score =24.2; E_value=0.00047; Accession=PF00023.20; Description=Ankyrin repeat
  Pfam annotation: Domain name=Ank; Domain location=471-503; Score =35.3; E_value=2.1e-07; Accession=PF00023.20; Description=Ankyrin repeat
  Pfam annotation: Domain name=Ank; Domain location=504-545; Score=3.4; E_value=10; Accession=PF00023.20; Description=Ankyrin repeat
  Pfam annotation: Domain name=Ank; Domain location=63-95; Score=16.5; E_value=0.096; Accession=PF00023.20; Description=Ankyrin repeat
  Pfam module annotation: Pfam domain module=Ank::Ank::Ank::Ank::Ank::An k::Ank::Ank::Ank::Ank::Ank; Domain location=109-141::196-228::233 -265::266-298::336-369::370-402::4-36::438-470::471-503::504-545::63 -95
MRLFRGYATTASVREGHLKILEVLINAGASQLACEEALMEASYLGRARFAELLMQSNMVRPQVAVHALVSACCRGFVEVIDVLIKHGVDANAIDRILLQSSKPFLHASVDCNALFAAVVSRQINVVGLLLQVGVRLDIKVKLGAWLWDTDTGEEFRVGVGLAEPYPITWCAVEYFESTGAILHMLLCQLSPNSLHTGRSLLHHAIICNNEKAVNILLKNGADAEVVVQTTEETNEHPIHMAARLGSCNILQCLINGGCNLDSQTKCGDTALMICARYKHEKCLGVLVSAGADLGMVNSSGHCATSIANCVQWTKVFQRAILDVIRAGKVVKSSNTSRFSALLFVTRANDIEGLKKLIENNNIDLDEQNANGFSAAMIAAVGGNVEAFKLLLYAGADVTNLKNKYGLTALNLIDISQNGEVFHKVMLEYALKKGGNGSIEVNPLHRAACYGDINIAHNLLKEGYDVNAFDGQGYTPLMLAARGCRGEMCELLISYGAKCDIQNERHETALLLARENGARNDAERVILDEVARKLVLHGGRVKKHTKCGKGSPHGKLLVMIGAAGILRWGKSSKRNVICKEAEVGPSAKFRWNRRRKFDVDEPGMFHVVTTKNKQVHFVCEGGVEMAELWVRGIRLATREAIFGQRADEV

SEQ ID NO: 184810 - protein, 450 aa, Glycine max
  Coding DNA Sequence Number=SeqID_68032
MPGCGQMQNALLHYSTFFHTTSQNSLMVFHFPLKIDNFHTMPFFGSLDFIKKVMAIQTEQPLPTHTPFLTSNTNQDHQHLPQENNDNDEETQTPLDDVLARLEALLTLLGFNQSSLLSFTVSWTTFAAVGVVVPLLALQVYDTDKNQIKSFEIGIVAFQTCLASVSLICLSHNLRKYGLTSLQLIHFDDYGKLLQRENDVLVFMEEHIRLRFHLSKISHRFRIYLLLQFLVVTASQFVTLLQVTGFGGALTFISGGDFAVSTLVQVVGIIIVLHAATKISHRAQGIVSLASRWHALVTCTSDSSKLRYCASTGSLEVAKHLNSMFLDYSESDLESSDYIGVPSHTQLASYMSSHNKRQAFVMYLQTNAGGISIFGWTVDRSLVNTIFFFELTLVTFVLTPINPLRPLGLLGCHNKFLERVHEFYNSSSLPSYQIGYKPWMAVSYDTRHEQ

SEQ ID NO: 184811 - protein, 123 aa, Glycine max
  Coding DNA Sequence Number=SeqID_68033
  Homolog annotation: Hit_ID=Q1SKB0; Match level="QueryCoverage=68%, HitCoverage=11%, E-value=1e-21, Identity=56%"; Hit description =Ankyrin
MMVLANSGTGLRKQVFPVDYETEISQRLVDAAHYGDTDAAFECIANPLVDVNFVGTVSFKSKTTEIVLQDESPHRVNSAYEEFKTELTALFLAAHTGNLSLLRKLLVTLLNSTLFVPCVVMNL

SEQ ID NO: 184812 - protein, 739 aa, Glycine max
  Coding DNA Sequence Number=SeqID_68034
  Gene Ontology: Mol. function=protein serine/threonine kinase activity; Biological process=protein amino acid phosphorylation
  Homolog annotation: Hit_ID=Q6K5F8; Match level="QueryCoverage=99%, HitCoverage=100%, E-value=1e-157, Identity=46%"; Hit description =Putative PITSLRE alpha 2-1
  Pfam annotation: Domain name=Pkinase; Domain location=395-684; Score =323.2; E_value=4.7e-94; Accession=PF00069.15; Description=Protein kinase domain
  Pfam annotation: Domain name=Pkinase_Tyr; Domain location=395-684; Score=46.1; E_value=2.7e-15; Accession=PF07714.7; Description =Protein tyrosine kinase
  Pfam module annotation: Pfam domain module=Pkinase::Pkinase_Tyr; Domain location=395-684::395-684
MAAGRHGGYRDNEFRDRESNFDVSRRVFNNNSRQEYDSMTNGSRDVVRVGSKDARDRIRLRQKDIREREAPNGSYLSKSDSGGSGGCSCGFGPRRCGFSVKTMDREPGELSSESGSDDDGIESGSQEKYCEVATSEGNCARSPLERKRKFSPIVWDQDDNEVNNLSKLRVVTAVTTLPPLPRVRLSPNVPDRGVETHPVKHTEAEILELPTVTNPPLLSESDQDAESESPVGLHSLLPDQEAKRPEGEDYIPTHNISSSRWAAGDNSPGDEGEINDDKEILKRRKLSPELGMRVRNRMSRLEESNIEDFVGARAKSSESKERGSRGRLSSGDYCPGNMSRKDDYMEIDGQGSRSEASGYHSDTDLEDDSRETSEPPVPPQRVANMLQGCRSVDEFERLNKIDEGTYGVVFRAKDKKTDEIVALKKVKMEKEKEGFPLTSLREINILLSFHHPSIVDVKEVVVGSNLDSIFMVMEYMEHDLKGLMEAMKQPFSQSEVKCLMLQLLEGVKYLHGNWVLHRDLKTSNLLLNNRGELKICDFGLARQYGSPLKPYTHLVVTLWYRAPELLLGTKQYSTAIDMWSLGCIMAELLSKEPLFNGRTEFEQLDKNYPESRSILSRISFQLWVVLVWLSGLSWYNLLHKKFPATSVTGSPVLSDSGFDLLNKLLTYDPVKRITAEEALNHEWFREVPLPKSKEFMPTFPAQHAQDRRMRKILKSPDPLAKQHWKEMQQGESGTGGIFG

SEQ ID NO: 184813 - protein, 432 aa, Glycine max
  Coding DNA Sequence Number=SeqID_68035
  Gene Ontology: Mol. function=oxidoreductase activity; Cellular component=mitochondrial envelope; Biological process=aromatic compound metabolic process
  Homolog annotation: Hit_ID=Q018V9; Match level="QueryCoverage=99%, HitCoverage=63%, E-value=6e-86, Identity=42%"; Hit description=[HC] KOG3855 Monooxygenase involved in coenzyme Q
  Pfam annotation: Domain name=FAD_binding_3; Domain location=1-331; Score=85.3; E_value=1.8e-22; Accession=PF01494.9; Description=FAD binding domain
MEIFHKIDGLVEEIQRSQPPVDLWRKFIYCTSLSGSILGSVDHIQPQDLEHVVSPVSVAHFSQYKLTMLLLKRLENLGFQICAPESLEGNEQSCDKKIMMGHECVSIEASSEFVTVTASSIIKGKRVEQNIHCNILIGTDGAGSIVRKLVGIEMRGEKDLQKLVSVHFFSKDLGQFLLKENPGMLFFIFNTEAIEVLVAHDLRQGEFVLQIPFYPPQQTIEDFSPKACEKLISKLVGQEFGDADVIDIKPWVMHAEVAENFICSGNRILLAGDAAHQFPPAGGFGMNTGIQDAHNLAWKIASVIKGIAPTSVLNTYEIKRKPIALFNARLSLENYKAAMFVPAALGLDPTVANTVHQFFVNGIGSILPSGLQKVALDGIFGIGRAQVSEFVLNESNPLGSSRLAKLRHIFEEGKSLQLQFPAEDLGFRYHCE

SEQ ID NO: 184814 - protein, 1156 aa, Glycine max
  Coding DNA Sequence Number=SeqID_68036
MPPSPALRYSPGREPRADGHKRGRSLESGLLFREKGDDLALFNEMQSREKDSFLLQSSDDLEDSFTTKLRHISDVNLGISIPGRGETSELLNDGDKNDYDWLLTPPDTPLFPSLDDEPPLTSFGSRGRSQSKPISISRSSTMDKNYRSSRGSASPNRLSPSPRSGTNTLQSRGRPLSVPNSSPTPSVRFATPTRRPSPPPSKSVAPTSKSTYTPRRMSTGSSGSVVSSGVRGTSPVKTNRGNSASPKIRAWQTNIPGFSSEAPPNLRTSLADRPASYVRGSSPASRNSRDSTSKFGRQSMSPTASRSSSHDRDQFSSRSKGSIASSGDEDLESLPSITVGSLDRLSSRRGEPFSTNRTPAISKKSAKIVSPSSAPKRLFDSAIRQMDRKTPQNMFRPLLSSVPSTTFYAGKANSAHRSLVSRNSSVTTSSNTSSDVGTAFALDTEGSDHNQDDMASEADKILYPDIHEEMFVFDKIDALNANIKQEINRESVDILQNETRDPKTVFCPIESEDSISHIHIVTRVNESSEISRVKGDISETGSSENTALCSHCGCCYEVTNQAEKNIGLCPECKTALLRVVIPETTLAVSENSSLITTNMPKEEKSLPGTNQLMVASELPQETNVGNLRFPHGELDAEESQTSCSELNQDHSQNRPLPNSLTEGGRQTSGNQLEMNQSGVDYKKPDNEFGDQHHHNDLPNLNMDPMEGTGISVLLKRSSSNKGPVVQGRTFTATTISYDDLSLARDSVSSFRSSTRPGSYSASSSIDLSSSRQTEFRVQRQLSGRKLDVDCGYDSRIKPPSTASSFSGASIHSRQELGLATRETSGSTECGSVEEMPRVLQELQASENTVTDLIDASSTDLVVEEDKLEHDDSCRVNNACSSEFLSQAADVQSDDSLVASFQNHEDCISYENVDDNPNNARDASDTETSAKELSSHEKQDVQNSNVIELDALVTTNCSIITESEIEGENDCENNIGVVNDDPSKSILDDFREPCNDCHSASVSEVNVSESHRIEGSTVTVECQGAGNTRSLTLEEATDTILFCSSIVHDLAYQAATIAMKKECSDPFEGSEPTVTLLGKAKSDRKDSRNRPVNKRTLKSHKTKTKQRRVETDVKTPSGKTENDENIDESFTHNVGLPNKVDSMRPPKLESKCNCIIM

SEQ ID NO: 184815 - protein, 177 aa, Glycine max
  Coding DNA Sequence Number=SeqID_68037
  Gene Ontology: Mol. function=peroxidase activity
  Homolog annotation: Hit_ID=Q2HT09; Match level="QueryCoverage=79%, HitCoverage=74%, E-value=1e-44, Identity=65%"; Hit description=Acid phosphatase/vanadium-dependent haloperoxidase related
  Pfam annotation: Domain name=DUF212; Domain location=10-172; Score =110.2; E_value=6.2e-30; Accession=PF02681.5; Description=Divergent PAP2 family
MSEAAATTSSSMMRNYPLISAIVAFAIAQFIKFFTVWYKEKRWDPKQLVGSGGMPSSHSATVTALAAAIGFHEGFGGPLFATALVLACILMGYMVGRVSDRGYCWQVMYDATGVRLQAGRQAELLNQIVYELPAEHPLAESRPLRELLGHTPPQVIAGGILGLITAAIGYLITMASS

SEQ ID NO: 184816 - protein, 496 aa, Glycine max
  Coding DNA Sequence Number=SeqID_68038
  Gene Ontology: Mol. function=hydrolase activity; Cellular component =chromosome, telomeric region; Biological process=response to DNA damage stimulus
  Homolog annotation: Hit_ID=Q9SL02; Match level="QueryCoverage=95%, HitCoverage=36%, E-value=1e-159, Identity=59%"; Hit description=DNA repair protein RAD50
  Pfam annotation: Domain name=Pox_A_type_inc; Domain location=195-217; Score=4.0; E_value=21; Accession=PF04508.3; Description=Viral A-type inclusion protein repeat
  Pfam annotation: Domain name=Pox_A_type_inc; Domain location=421-443; Score=12.8; E_value=1.1; Accession=PF04508.3; Description=Viral A -type inclusion protein repeat
  Pfam annotation: Domain name=Rad50_zn_hook; Domain location=24-77; Score=25.1; E_value=0.00024; Accession=PF04423.5; Description=Rad50 zinc hook motif
  Pfam module annotation: Pfam domain module=Pox_A_type_inc::Pox_A_type_ inc::Rad50_zn_hook; Domain location=195-217::421-443::24-77
MSKEGQFVPDIHDVIFVTISNKYNIADGMRQMFDPFERVARANHVCPCCERPFSPEEEDSFVKKQRVKATSSAGHMKVLAVESSNAESHFQQLDKLRMLYEEYVKLGKETIPNSEKELQQLKEEMDDKSQALDDVLGVLAQVKSDKDLVETLVQPVENADRIFQEIQALQKQVEDLEDKHNFRAQGVRTLEEIQLELNTLQSTKENLQSELDRLKDEQRYMEKDLSSIQMRWHTVREEKTKATNILQGVKRLEEELERLTEEKTQVDLDEKHLADALGPLSKETDKLLANHNELKIRLEREYEDLAEQKRSYQQEAQALFKMNSKIKTYSDLKKGDRLKELQEKKSSSESQLQSFDTRKQEILAELNKSKDLMRGQDQLKRNIEDNLNYRKTKAEVDELAHEIETMEENILKAGRISTVETELQKLSQERERLLSELNRCRGTMSVYQSNISKNKVDLKQAQYKDIDKRYFDQLIQLKTTEMANKDLDRYYSALDK

SEQ ID NO: 184817 - protein, 83 aa, Glycine max
  Coding DNA Sequence Number=SeqID_68039
QNLAQVQKNAMHLLVVERAVLNEFWLGRIDGDPVLRETRIWATWEYVSSVGGGQQGMETLGTSGGVLLPKTKLDQSRPNPGIV

SEQ ID NO: 184818 - protein, 118 aa, Glycine max
  Coding DNA Sequence Number=SeqID_68040
MNEKVKVYLWMNALLEPKLLNPRKTMIYWQSNLITSLESPLDSFCQKRLNLEVLKGAVALSSPFGLSVHPTLSAALARLARQKNLAEHQYQGRVLCAMVDFSQVQRITCAKLKSTYSH

SEQ ID NO: 184819 - protein, 329 aa, Glycine max
  Coding DNA Sequence Number=SeqID_68041
VEYAEKKNEKEEPLFEQRKGKAIMMEEEGVSKNSYTRVVNEENMMGSNPWKSKQKESMRGFWERQRRCFMLENVGEKVAFPVLWYSLDAETEEVVRLDKARFLVKVYEEEEGGHQNRVVKETMMEGFMHYLVDNKKDGGQIEDEGSKGVGRCNKENVLGYATKTQQNKEGGLFLTQAISEPLESGSEELGDVGHLNNEVIKVSISNNEGPHKSCKGPRKETPTDSMQDYEKMMRNRAKNQRQNNGGENTKEDHAENNGGASEAKIRDEASNEAITRVFFHQEASFSSGASQEIMERKDFEQCNMKTIAYKERDLRCPFWSYDWLLVKRT

SEQ ID NO: 184820 - protein, 388 aa, Glycine max
  Coding DNA Sequence Number=SeqID_68042
  Gene Ontology: Mol. function=transcription corepressor activity; Cellular component=nucleus; Biological process=regulation of transcription, DNA-dependent
  Homolog annotation: Hit_ID=Q1SAU7; Match level="QueryCoverage=93%, HitCoverage=41%, E-value=1e-144, Identity=70%"; Hit description =Paired amphipathic helix
  Pfam annotation: Domain name=PAH; Domain location=145-191; Score =63.5; E_value=6.9e-16; Accession=PF02671.11; Description=Paired amphipathic helix repeat
  Pfam annotation: Domain name=PAH; Domain location=338-383; Score =12.7; E_value=0.21; Accession=PF02671.11; Description=Paired amphipathic helix repeat
  Pfam annotation: Domain name=PAH; Domain location=59-105; Score=78.8; E_value=1.8e-20; Accession=PF02671.11; Description=Paired amphipathic helix repeat
  Pfam module annotation: Pfam domain module=PAH::PAH::PAH; Domain location=145-191::338-383::59-105
MKRSRDDVYMSSQLKRPMVSSRGEPSGQPQMTSGGAQKLTTDDALAYLKAVKDMFQDKREKYDDFLEVMKDFKAQRIDTSGVIARVKELFKGHKDLILGFNTFLPKGYEITLPLEDEQPPQKKPVEFAEAINFVGKIKARFHDNDRVYKSFLDILNMYRREAKSIAEVYKEVAALFQDHVDLLREFTHFLPDTSGTASNHCGLARNSLLPDRSSAMPIIRQMHVEKRERNIASHGDRDLSADHPDPELDRCLIRADKDQRRHDEKEKGSRDYDHDGISRKRKSGIRAEDSGAEPLHDTDENFGMHPISYACEDKSSLKSMYSPVLGYLDKVKEKLRNPEDYQEFLKCLNIYSKEIIARHELQSLKDLEYHYNERSLSAWLFIRVNDQD

SEQ ID NO: 184821 - protein, 623 aa, Glycine max
  Coding DNA Sequence Number=SeqID_68043
  Gene Ontology: Mol. function=protein serine/threonine kinase activity; Cellular component=integral to membrane; Biological process=protein amino acid phosphorylation
  Homolog annotation: Hit_ID=Q9ZVR7; Match level="QueryCoverage=90%, HitCoverage=62%, E-value=1e-113, Identity=33%"; Hit description =Putative phytosulfokine receptor precursor
  Pfam annotation: Domain name=LRRNT_2; Domain location=32-70; Score =29.8; E_value=9.9e-06; Accession=PF08263.3; Description=Leucine rich repeat N-terminal domain
  Pfam annotation: Domain name=LRR_1; Domain location=121-144; Score =13.6; E_value=0.74; Accession=PF00560.23; Description=Leucine Rich Repeat
  Pfam annotation: Domain name=LRR_1; Domain location=146-168; Score =15.0; E_value=0.28; Accession=PF00560.23; Description=Leucine Rich Repeat
  Pfam annotation: Domain name=LRR_1; Domain location=170-192; Score =14.6; E_value=0.35; Accession=PF00560.23; Description=Leucine Rich Repeat
  Pfam annotation: Domain name=LRR_1; Domain location=194-216; Score =11.2; E_value=2.3; Accession=PF00560.23; Description=Leucine Rich Repeat
  Pfam annotation: Domain name=LRR_1; Domain location=218-240; Score =14.3; E_value=0.44; Accession=PF00560.23; Description=Leucine Rich Repeat
  Pfam annotation: Domain name=LRR_1; Domain location=242-264; Score =2.6; E_value=91; Accession=PF00560.23; Description=Leucine Rich Repeat
  Pfam annotation: Domain name=LRR_1; Domain location=266-288; Score =9.4; E_value=4.9; Accession=PF00560.23; Description=Leucine Rich Repeat
  Pfam annotation: Domain name=LRR_1; Domain location=290-312; Score =3.8; E_value=55; Accession=PF00560.23; Description=Leucine Rich Repeat
  Pfam annotation: Domain name=LRR_1; Domain location=339-360; Score =7.7; E_value=10; Accession=PF00560.23; Description=Leucine Rich Repeat
  Pfam annotation: Domain name=LRR_1; Domain location=392-414; Score =13.6; E_value=0.72; Accession=PF00560.23; Description=Leucine Rich Repeat
  Pfam annotation: Domain name=LRR_1; Domain location=416-438; Score =18.3; E_value=0.027; Accession=PF00560.23; Description=Leucine Rich Repeat
  Pfam annotation: Domain name=LRR_1; Domain location=440-462; Score =16.6; E_value=0.09; Accession=PF00560.23; Description=Leucine Rich Repeat
  Pfam annotation: Domain name=LRR_1; Domain location=520-542; Score =13.2; E_value=0.94; Accession=PF00560.23; Description=Leucine Rich Repeat
  Pfam annotation: Domain name=LRR_1; Domain location=73-95; Score=4.0; E_value=51; Accession=PF00560.23; Description=Leucine Rich Repeat
  Pfam annotation: Domain name=LRR_1; Domain location=97-119; Score =17.6; E_value=0.046; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1; Domain location=32-70::121-144::146-168::170 -192::194-216::...
  Pfam module annotation: Domain location=218-240::242-264::266 -288::290-312::339-360::392-414::416-438::440-462::520-542::73-95::97- 119
MGFHGFFLFAILIPYISFGTSSHESQNLTSSSLNDLEGLIGFSSCLESAIPDWNSYASPDYCTWSGVTCVGTSVVRLELGSTRLMGKICESLVGLDQLRVLNLSDNLFTGSLPNTLFHLQNLEVMDLSNNHFEGPINTAICSSLPQLRVIKLSGNLFSGKIPGNLGNCSSLQHLSINENNLSGSLPGSIFQLQYLRVLLLQENKLSGQLSKGLGKLSNLVEFDISNNEFSGILPNIFGSLTRLKFFCAEANRFTGQLPASLLNSPSLQILNLRGNSLGGSVNLNCSAMKNLTTIVLGYNQFHCPVLVSLSNCLRLEGIGHGSDHLHCGEIPVNFKKLQSLTQLSLSYTGLHNLSSALEVLSHCRNLSTLLLPWNFHNEQMPQPQGQNIVFSNLKVLVLSNSQIKGSFPKWLSGCKMLQMLDLSWNHLTGSIPSWIGNLNNLYYLNLSNNSFTGKIPQSLTVVLSLQLRNLSLEQTTFAFPFKMVGNVNIYKRVSSYRPSLVLSYNKLEGPMWPGFGNLKSLHVMDLKHNSLSGPIPWQLSGMLHGEIPEKGQFDTFPPTSFQGNMDLYYSHDTSGFILSPPDETCAQPHYQKLEIIGFPFWFGGVAGFLITIAMCFTSGWLFS

SEQ ID NO: 184822 - protein, 76 aa, Glycine max
  Coding DNA Sequence Number=SeqID_68044
MDKRCEALTNDKGDRELFKEHKDLEALHELKGPMTRSRAKLLQEEMTKRIKDGLLIKGKERENHKELNWSTLQIVE

SEQ ID NO: 184823 - protein, 658 aa, Glycine max
  Coding DNA Sequence Number=SeqID_68045
  Gene Ontology: Mol. function=protein serine/threonine kinase activity; Cellular component=integral to membrane; Biological process=protein amino acid phosphorylation
  Homolog annotation: Hit_ID=Q8LPB4; Match level="QueryCoverage=88%, HitCoverage=60%, E-value=1e-150, Identity=46%"; Hit description =Phytosulfokine receptor precursor
  Pfam annotation: Domain name=LRRNT_2; Domain location=31-69; Score =32.6; E_value=1.3e-06; Accession=PF08263.3; Description=Leucine rich repeat N-terminal domain
  Pfam annotation: Domain name=LRR_1; Domain location=120-143; Score =12.2; E_value=1.5; Accession=PF00560.23; Description=Leucine Rich Repeat
  Pfam annotation: Domain name=LRR_1; Domain location=145-167; Score =13.8; E_value=0.62; Accession=PF00560.23; Description=Leucine Rich Repeat
  Pfam annotation: Domain name=LRR_1; Domain location=169-191; Score =13.9; E_value=0.58; Accession=PF00560.23; Description=Leucine Rich Repeat
  Pfam annotation: Domain name=LRR_1; Domain location=193-215; Score =15.8; E_value=0.16; Accession=PF00560.23; Description=Leucine Rich Repeat
  Pfam annotation: Domain name=LRR_1; Domain location=217-239; Score =12.9; E_value=1.1; Accession=PF00560.23; Description=Leucine Rich Repeat
  Pfam annotation: Domain name=LRR_1; Domain location=241-263; Score =6.4; E_value=18; Accession=PF00560.23; Description=Leucine Rich Repeat
  Pfam annotation: Domain name=LRR_1; Domain location=265-287; Score =5.0; E_value=34; Accession=PF00560.23; Description=Leucine Rich Repeat
  Pfam annotation: Domain name=LRR_1; Domain location=289-311; Score =7.1; E_value=13; Accession=PF00560.23; Description=Leucine Rich Repeat
  Pfam annotation: Domain name=LRR_1; Domain location=313-335; Score =10.4; E_value=3.3; Accession=PF00560.23; Description=Leucine Rich Repeat
  Pfam annotation: Domain name=LRR_1; Domain location=337-358; Score =4.3; E_value=45; Accession=PF00560.23; Description=Leucine Rich Repeat
  Pfam annotation: Domain name=LRR_1; Domain location=390-412; Score =13.6; E_value=0.72; Accession=PF00560.23; Description=Leucine Rich Repeat
  Pfam annotation: Domain name=LRR_1; Domain location=414-436; Score =16.9; E_value=0.072; Accession=PF00560.23; Description=Leucine Rich Repeat
  Pfam annotation: Domain name=LRR_1; Domain location=438-460; Score =17.2; E_value=0.061; Accession=PF00560.23; Description=Leucine Rich Repeat
  Pfam annotation: Domain name=LRR_1; Domain location=519-541; Score =11.1; E_value=2.4; Accession=PF00560.23; Description=Leucine Rich Repeat
  Pfam annotation: Domain name=LRR_1; Domain location=543-565; Score =18.3; E_value=0.028; Accession=PF00560.23; Description=Leucine Rich Repeat
  Pfam annotation: Domain name=LRR_1; Domain location=567-591; Score =2.4; E_value=1e+02; Accession=PF00560.23; Description=Leucine Rich Repeat
  Pfam annotation: Domain name=LRR_1; Domain location=96-118; Score =19.7; E_value=0.011; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=31-69::120-143::145 -167::169-191:...
  Pfam module annotation: Domain location=:193-215::217-239::241 -263::265-287::289-311::313-335::337-358::390-412::414-436::438 -460::519-541::543-565::567-591::96-118
MGFHSFFLSAILIPYISFGTSTLELQNFISSPNDLKALTGFSSCLESAIPDWNSSTSPDYCTWSGVTCVGTRVIRLELGSKRLNSKICESLAGLDQLRVLNLSHNFFTGSLPDNLFHLQNLEVIDFSNNHFEGPINTFICSSLPRLQVFKLSNNFFSGEIPGNLGNCSSLKHLSINGNDLSGSLPENIFLLQNLNELYLQGNKLSGPLSEGLGKLSNLVEFDISSNEFSGILPNIFGSLTRLKFFSAESNKFTGQLPASLVNSPSLQLLNMINNSLGGSINLNCSAMKNLTIVGLGSNQLRCPTPGSLSNCSRLEAIDLTGNHFNCGIPVNCNNLQSLTEIYLARARLHNLSSTLEVLSHCRNLSSVALTNNFHNEEMPQPQGQNLGFSNLKVLVLSNSQIKGSFPKWLSGCKMLQMLDLSWNHLSGSIPSWIGKLNNLYYLDLSNNSFTGNIPQGLTVVLTLQFRNLSLEGIIFAFPFYVNGNVRNAYKKVSSFRPSLLLSYNKLEGPIWPGFGNLKGLHVMDLKHNSLSGLIPWQLSGMTMLEILDLSHNRLSGEIPQSLIKLSFLSSFDVSYNELHGEIPEKGQFDTFPPTSFEGNRGLYYRHDTSGFMPSPPDEARAQPHHQKLEIIGFPFLFGALAGFLITIARSFASGWVFS

SEQ ID NO: 184824 - protein, 86 aa, Glycine max
  Coding DNA Sequence Number=SeqID_68046
MGAKHLTRTKEWSHVIEQRSPDEIRTQNDHNLSLRFVGHNRAWAARHRMTIICLCVPPDTIASGWRKGARNDHNLSPPTSRLTVPE

SEQ ID NO: 184825 - protein, 81 aa, Glycine max
  Coding DNA Sequence Number=SeqID_68047
MPLRKAWAIVTIQATLASNTLFVVAISEISVVPLVWATLCDLIIDKVIAAKTIHNSSKRLLTLPLLYNPSVKFTKLVCVTK

SEQ ID NO: 184826 - protein, 651 aa, Glycine max
  Coding DNA Sequence Number=SeqID_68048
  Gene Ontology: Mol. function=zinc ion binding; Cellular component =membrane; Biological process=Notch signaling pathway
  Homolog annotation: Hit_ID=Q6K5G3; Match level="QueryCoverage=98%, HitCoverage=97%, E-value=1e-150, Identity=44%"; Hit description =Ankyrin repeat-like protein
  Pfam annotation: Domain name=Ank; Domain location=17-49; Score=4.9; E_ value=6.2; Accession=PF00023.20; Description=Ankyrin repeat
  Pfam annotation: Domain name=Ank; Domain location=172-204; Score=2.2; E_value=15; Accession=PF00023.20; Description=Ankyrin repeat
  Pfam annotation: Domain name=Ank; Domain location=206-238; Score =26.9; E_value=7.2e-05; Accession=PF00023.20; Description=Ankyrin repeat
  Pfam annotation: Domain name=Ank; Domain location=239-271; Score =31.8; E_value=2.4e-06; Accession=PF00023.20; Description=Ankyrin repeat
  Pfam annotation: Domain name=Ank; Domain location=273-314; Score =13.1; E_value=0.4; Accession=PF00023.20; Description=Ankyrin repeat
  Pfam annotation: Domain name=Ank; Domain location=321-355; Score =17.1; E_value=0.063; Accession=PF00023.20; Description=Ankyrin repeat
  Pfam annotation: Domain name=Ank; Domain location=356-392; Score=1.2; E_value=21; Accession=PF00023.20; Description=Ankyrin repeat
  Pfam annotation: Domain name=Ank; Domain location=99-132; Score=1.9; E_value=17; Accession=PF00023.20; Description=Ankyrin repeat
  Pfam module annotation: Pfam domain module=Ank::Ank::Ank::Ank::Ank::An k::Ank::Ank; Domain location=17-49::172-204::206-238::239-271::273 -314::321-355::356-392::99-132
MPPYLPLRWESTGEQWWYASPIDCAAANGHYDLVVELLHLDTNLLIKLTSLRRIRRLETVWDDEKHLENVAKCRSQVARNLMLQCETGRGHNSLIRAGYGGWLLYTAASAGDLDFVRELLGKYPALVFGEGEYGVTDILYAAARSNSCEVFELLLRSALSPPQMEDVYERDMMNRAVHAAARGGNWETLKRLVGNGSGVLGFRDAQGCTALHTAAGRGQVEVVRNLLASFDVVNLTDDQGNTALHIASYRGHLAVVEILILASRSLALLTNHYGDTFLHMAVAGFRSPGFRRLDKHTELMRQLVSGKTVNLQDIINVKNNDGRTALHVSVMDNIQCELVELLMSVPSIDLNICDADGMTPLDLLKQRARSASSDILIKQMISAGGVSKCQDAVAGNALCTHDKAHVIGGSPGTSFRIPDAEIFLYTGIENSSDTTNYDQASVESYSCSNELSNSDSANSPHNKKSSSVNVRRSKFRLHWPRRRETKAAASELEDDDSLDPFSSSRNLEEFPIPLRQRYSQPCSHPNNKRTQSMRTSLPSPSSNVKFSAGLMQGVIQLKPHSAHSTPSPFQELSVASLFYIKEQKGVDIIGPSCSNGSIDDGTLLLNYKHCSFNKKLMDGYFSFGAQGLAVEDSNSCAKSNSGYKRLSSIVA

SEQ ID NO: 184827 - protein, 175 aa, Glycine max
  Coding DNA Sequence Number=SeqID_68049
  Gene Ontology: Mol. function=protein binding; Cellular component =nucleus; Biological process=jasmonic acid mediated signaling pathway
  Homolog annotation: Hit_ID=Q45FY8; Match level="QueryCoverage=81%, HitCoverage=26%, E-value=3e-53, Identity=80%"; Hit description =Coronatine-insensitive 1
VKFLAHRVPNLPLLLSSNRILDLLNAPFLAVIEDRDARRMTARRLSDVVLDCVMPYIHDSKDRDAVSQVCRRWYELDSLTRKHVTIALCYTTTPDRLRRRFPHLESLKLKGKPRAAMFNLIPEDWGVASLSAHDCEGFGSSSSSSFARSRTSSTQAGKFALDSPLMASTISVVIA

SEQ ID NO: 184828 - protein, 397 aa, Glycine max
  Coding DNA Sequence Number=SeqID_68050
  Gene Ontology: Mol. function=DNA binding; Cellular component=nucleus; Biological process=regulation of transcription
  Homolog annotation: Hit_ID=Q39116; Match level="QueryCoverage=99%, HitCoverage=99%, E-value=1e-144, Identity=64%"; Hit description=GT-1 protein
MYLSEKPRPIDFYKEEGARDMMIEVVSNGDLPPPPPPPPPPMILGESSGEDPEVEIKAPKKRAETWVQDETRSLIGLRREMDSLFNTSKSNKHLWEQISAKMREKGFDRSPTMCTDKWRNLLKEFKKAKHQDRGSGSAKMSYYKEIDEILRERSKNVQYKSPTPPPKVDSFMQFADKEKGSGSGARSGHGGEEKMLRGGIDDTSISFGPVEATGRPTLNLERSLDHDGHPLAITTADAVAASGVPPWNWRETPGNGGESQSCCGRVISVKWGDYTRRIGIDGTPEAIKEAIRAAFRLRTKRTFWLEDEDQIIRSIDREMPLGNYTLHIDEGMAIKLPLYDEPDHIPVHTEDKIFYTEDDFRDFLTRRGWICLREFDSYRNIDNMDDLRPGAIYRGVS

SEQ ID NO: 184829 - protein, 674 aa, Glycine max
  Coding DNA Sequence Number=SeqID_68051
MASRRERDLFHSDEIDPVDALNGEDFDDSSSVESATSGGSRTQVGLTERLTDILVDERDGDLLIQQTNREDRLLQWLQALDMQVMGACRADERLKPLLKMNAACGVAEDPLLAQLTQHFEPSEVGMLARCFCVPLVSIRVGKINKEGTRFCPTSIRGNLTLVLLPSSDLRLSFIGDDGRTERLFTLTNKSQCSGVMVDEIPTDSSGRSFLVRTPDSRIFYFWCSEKSKLLGIELLGKDLLKRKPSIVELSGISKSRLDCFATQLRAFLVGTTGGRSHDSSVCASTSANSMSCSNVASESSHPSSSKFPRSRNIGGQTAKGDTTLYQSILSPRSSSFKEVPPRNLSSHRIAAREKIKRRGDNHQPTVDTLTNDSTNILDSSSTSDHDKASEVTKTLEFSPSFLGSLGKLGDVPSSMGLGGEVLPGMSPVFSPYYCWCPPGVSTCPSIAAVTQFPNSSIETLPFPSGASLLPNPLSANLLDPVHPLSTSMDFPPFFPDPLVRMSLPSQQIPTFTPLMCDPIVHVPVIDVCSSGQGYLVSAGPAMSPSIPPLHPNLVKPLIPESDAVVKGARETLRLLLSGSSQGNQQMMRDTLPAILTNPDEKQNNILVAGSRGLYTGTRDINAIANSIAAMGLVSLSGVSKVESGGYSELCENYGNLEAVKNSNDSGGAILDDEG

SEQ ID NO: 184830 - protein, 63 aa, Glycine max
  Coding DNA Sequence Number=SeqID_68052
MDSGMSWGDQWDNNPASDKDKKKGKDGSGKNKFGKTMLSFKWVKELRKKTQNLWLLETKNAIM

SEQ ID NO: 184831 - protein, 236 aa, Glycine max
  Coding DNA Sequence Number=SeqID_68053
  Gene Ontology: Mol. function=metalloendopeptidase activity; Cellular component=mitochondrion; Biological process=proteolysis
  Homolog annotation: Hit_ID=Q5N6Y0; Match level="QueryCoverage=75%, HitCoverage=25%, E-value=3e-57, Identity=59%"; Hit description =Putative thimet oligopeptidase
MTESEGKCKKMGKEKRGRSFIAFTGAAAVLGIAANLAITAIKYQKAKNAKKKGSKVRVNLSASEILKLAEQIIANSNKAHNSVASVPLDKVTYANVISPLAELQAQQFPLVQSCVFQKMVSTREDVRKASAEAERRIDAHLDACSKREDVYLVIKAFAVKGEWMNAEAKRFVQILVRDFERNGLNLTASKREELQRLRAQIDELSFKYIQNLNDDSKFLLFTEAELAGLPPEFLKV

SEQ ID NO: 184832 - protein, 252 aa, Glycine max
  Coding DNA Sequence Number=SeqID_68054
  Gene Ontology: Mol. function=metalloendopeptidase activity; Cellular component=mitochondrion; Biological process=proteolysis
  Homolog annotation: Hit_ID=Q5N6Y0; Match level="QueryCoverage=94%, HitCoverage=34%, E-value=3e-79, Identity=59%"; Hit description =Putative thimet oligopeptidase
  Pfam annotation: Domain name=Peptidase_M3; Domain location=1-252; Score=-96.0; E_value=1.7e-05; Accession=PF01432.10; Description =Peptidase family M3
MKVGTTRRMVSRAYGNQCGEINVFILESLVQQRHKYARLLGYSCYAEYAIDVRMAKTPKKVFEFLKDISTSLTDLAMKELNILKDLKKKEEGEFPFGIEDLLYYVKRVEEQGYDLDFGEIKQYFPISVVLSGIFKIIQDLFGLRFEKIAGADVWHCDVCVFSVLDLGSSELLGYCYFDLFSREGKYGHTCVLALQNSALTSNGAQQIPVALLISQCQKDADGSSGLLRFSEVVSLFHEFGHVVLVWVWGKGK

SEQ ID NO: 184833 - protein, 62 aa, Glycine max
  Coding DNA Sequence Number=SeqID_68055
MYLGISRVAHSSGPTIELDSCQVCDSAILPRNYYTSSSAPQDQDMCEVTLKMLRWNTHNTII

SEQ ID NO: 184834 - protein, 478 aa, Glycine max
  Coding DNA Sequence Number=SeqID_68056
  Gene Ontology: Mol. function=acyltransferase activity; Cellular component=nucleus; Biological process=regulation of transcription, DNA-dependent
  Homolog annotation: Hit_ID=O04201; Match level="QueryCoverage=97%, HitCoverage=97%, E-value=0.0, Identity=68%"; Hit description =Putative anthocyanin 5-aromatic acyltransferase
  Pfam annotation: Domain name=Transferase; Domain location=7-471; Score=420.9; E_value=1.8e-123; Accession=PF02458.6; Description =Transferase family
MPSPVPTLLSKCTVFPDQKSTLGNLKLSVSDLPMLSCHYIQKGCLFTHPNLPLHSLIPLLKSSLSRTLSLFPPLAGRLITDSDSYVYIACNDAGVDFIHANATALRICDLLSQLDVPESFKEFFAFDRKVSYTGHFSPILAVQVTELADGVFIGCAVNHAVTDGTSFWNFFNTFAQLSRGASNCIRNIPDFHRESVLISDAVLRLPEGGPQVTFDANAPLRERIFSFSREAIQKLKAIANNRRWPENNNFAGELLRKKSNDNLLKENKATTILENWFKVNSNSISKPQTVEISSFQSVCALLWRGVTRARKFPSSKTTTFRMAVNCRHRLEPKLEAYYFGNAIQSVPTYASAGEVLSRDLRWCAEQLNKNVKAHDDTMVRRFVEDWERNPRCFPLGNPDGASITMGSSPRFPMYDNNFGWGRPLAVRSGRANKFDGKISAFPGRDGTGTVDLEVVLAPETMEALESDPEFMKYATCQL

SEQ ID NO: 184835 - protein, 103 aa, Glycine max
  Coding DNA Sequence Number=SeqID_68057
  Gene Ontology: Biological process=cell adhesion
MMLDMLPQDLAFTVLVPSEDAFKRDLRLSVNDSFKPDKFNDTYAIVSRILGFSAVPGTLSLANVQLEIVDVRKKEILVHVMDGVIMDAEFEESILAEDDTEED

SEQ ID NO: 184836 - protein, 490 aa, Glycine max
  Coding DNA Sequence Number=SeqID_68058
  Homolog annotation: Hit_ID=Q1T3Y0; Match level="QueryCoverage=95%, HitCoverage=76%, E-value=1e-126, Identity=50%"; Hit description =Targeting for Xklp2
MDSFAKVLKISIIQTHVVFVEDSNHAWVSMSLGNPIRALGESISFGRFMTEGLDWEKWSTFSHNRYVEEAEKYSKPGSVAAKKAYFEAHYKRAAAERAAALIPEANAQANGTFEAQVHEGNCADSSFGTSSNVANVVAANEQLDNETANYQVVECADTDQHKCDAGQSHLDISNVKGAEDVPHPRTDTDLNVESCTFVANSYSNQLHHVEDNTYIAVPAEEKTPDHGAVGQEVLTLSVKGREANSSPKLSTKTVVAKHSRSPDERKAAVLPRSGINSGPKGKKSVGDSVEKKRLIAQSVRMSINLPSGTGETRKRTATASQSRNGTNNFSTSKKSVRGLVEKKRITAPSLRMSINLPSGAGMTSKTDTVAAKPRNGINFAAKSMKSVGNSVEKRPTKRSLHMSINLPSGAGETSKTASVLEQNGIKKNHSNISKNNPGVLRTSTKVSHGLLNQASANPPSQGRRTERPLNKSVSGALTANAKPSSSISFE

SEQ ID NO: 184837 - protein, 65 aa, Glycine max
  Coding DNA Sequence Number=SeqID_68059
MSRQFQRNSPPPLPKIEDDGNPKFVIFIRMANDEKEVQKSACKQYRVLRSATDFRYGYKLLVMLL

SEQ ID NO: 184838 - protein, 171 aa, Glycine max
  Coding DNA Sequence Number=SeqID_68060
  Gene Ontology: Cellular component=chloroplast; Biological process =response to high light intensity
  Homolog annotation: Hit_ID=Q1T3Y4; Match level="QueryCoverage=95%, HitCoverage=70%, E-value=1e-61, Identity=75%"; Hit description=Heat shock protein Hsp20
  Pfam annotation: Domain name=HSP20; Domain location=63-171; Score =86.0; E_value=1.2e-22; Accession=PF00011.11; Description=Hsp20alpha crystallin family
MGNCIKAGLRDRFPTARTVQEMMETMERMMEDPFAFSTLEWPSSPLPSEGVGGYRRRGRAPWEIEECEGEYKMRFDMPGMNKEDVKVWVEEKMLVVKAEKAPKKKQENEIVELQQEEEEWSAKSYGRYSSRIALPDNVQFENIKAEVKDGVLYITIPKAISYSCILDIQVQ

SEQ ID NO: 184839 - protein, 98 aa, Glycine max
  Coding DNA Sequence Number=SeqID_68061
  Homolog annotation: Hit_ID=Q1SAS4; Match level="QueryCoverage=61%, HitCoverage=4%, E-value=3e-10, Identity=57%"; Hit description=RNase H, putative
MKKMRTGGFPPELSRMVKQEDQEIKPHQEEMEIVNLGIGEEKKEVAFESRLFPGETKTKKDEARDVLKEKEEVKKQLDAGFLAVAVRSWQVHRITQVV

SEQ ID NO: 184840 - protein, 209 aa, Glycine max
  Coding DNA Sequence Number=SeqID_68062
MIGQWNKQVDFRVDGYPRQEGLLNFNSNYMVFASEHQFPAQEFHILQSSVETQGIDRRRVVVEAEEYSQQMAERGHGMYYTPPTFSQYPTQMYQYPFKGHHTDISASKHSFGGVAETHLHFSWPTMTPSQQHDAPIPTPNAPLGTQWNVPRAIPDIGDLLGADLHHQFSVEADQVETGRHRDRRNPDRQAQRWDRSCDTSSRHHGYHNE

SEQ ID NO: 184841 - protein, 323 aa, Glycine max
  Coding DNA Sequence Number=SeqID_68063
  Gene Ontology: Mol. function=DNA binding; Biological process =regulation of transcription, DNA-dependent
  Homolog annotation: Hit_ID=Q2HUJ5; Match level="QueryCoverage=55%, HitCoverage=57%, E-value=9e-86, Identity=85%"; Hit description =Transcriptional factor B3
  Pfam annotation: Domain name=B3; Domain location=1-103; Score=78.2; E_ value=2.6e-20; Accession=PF02362.12; Description=B3 DNA binding domain
KELKNSDVSSLRRMILPKKAAEAFLPALESKEGIVISMDDIDGLHVWSFKYRFWPNNNSRMYVLENTGDFVNTHGLRFGDSIMVYQDSENNNYVIQAKKASDQDEFMEETSDTINDIFLNDYEVNKPGCFNVTNPAVNDTGMSFIYETTFSNDSPLDFLGGSMTNFSRIGPVETFGSVENFGSNCLESTAKATTASRLAAPREDITNCIAHFSIEHERGEEDRENLERLRELEPHERHESGNRMVEELKENELTTSDSSQGGNIAATGAGLVALPEPPRLFDFSGGGDQEVGEYGDGDDGHREAVEHGNGSQRNGSATSKKQG

SEQ ID NO: 184842 - protein, 459 aa, Glycine max
  Coding DNA Sequence Number=SeqID_68064
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q2HUJ7; Match level="QueryCoverage=99%, HitCoverage=99%, E-value=1e-167, Identity=69%"; Hit description=V -ATPase subunit C
  Pfam annotation: Domain name=V-ATPase_C; Domain location=2-458; Score= 737.0; E_value=1.2e-218; Accession=PF03223.5; Description=V-ATPase subunit C
MASRYWAVSLPVHNSASSQLWNQLQERISKHSFDTPLYRFNIPNLRVGTLDSLLSLSDDLAKSNNFVEGVTHKIRRQIEELERVSGIDSGALTVDGVPVDSYLTRFVWDEAKYPTMSPLKEIVDGIHSQVAKIEDDLKKLWTNEASVNATVVDTPKSFMLQPKSWSWTFFKTLGIRLKLVRVSEYNNIRSQLNAINRKQTGSLAVRDLSNLVKPEDIVTSENLTTLLAIVSKYSQKDWLSSYETLTNYVVPRSSKKLYEDNEYALYTVTLFSRVADNFRTSAREKGFQIRDFEYSPETHENRKQELDKLVQDQERLRTSLLQWCYTSYGEVFSSWMHFCAVRLFAESILRYGLPPSFLVIYSSKIKVQSNGPWDFQILFTDHWVFQACVLAPSVKSEKKVRSILEGLSDSTNRQVYDVRFRIYGPCAYWKNEDEVGAGMAGLAGDADGHPYVSFTINLA

SEQ ID NO: 184843 - protein, 236 aa, Glycine max
  Coding DNA Sequence Number=SeqID_68065
  Gene Ontology: Mol. function=two-component response regulator activity; Cellular component=intracellular; Biological process=two -component signal transduction system (phosphorelay)
  Homolog annotation: Hit_ID=Q7W1T4; Match level="QueryCoverage=68%, HitCoverage=77%, E-value=4e-59, Identity=80%"; Hit description =Putative two-component response regulator
MDDAQVEVFLQVLQLGRIRIDHRDVVLFGHQVFSHAGAYATSADDQDLHAPRLRADSMPNCLSLRYRWVRSRPVVFEVDALEFIARLAQRLVQRNAAQLAVGGDGDLVGGGRRQRRRIEFVFERHGGAGRDRRHHGRRMRHPATGQAGRHGLEQALQRDGLFKEVHGADAGGLDRRVDGGMAAHHDDRHVQQALRAPFLEQADAIGVRHPDVQQHQIGTHAKTRGARLRRVFGQLD

SEQ ID NO: 184844 - protein, 247 aa, Glycine max
  Coding DNA Sequence Number=SeqID_68066
  Homolog annotation: Hit_ID=Q1SP02; Match level="QueryCoverage=77%, HitCoverage=40%, E-value=2e-22, Identity=35%"; Hit description=IMP dehydrogenase/GMP reductase
MYDQMNDASISSSRQLDSYITLLQCWIYEHFPSVAESTADQDYYEDSPRACRWIATKKTMKSICTPAYRERLDQLWILDVCWIPYGEHRLVWDFHLISFYSGLLGWGPVAVYYRPERVVRQVGYTQTIPAPPVDSWVSYDDIHDRWIHYSDHMVPAGEVCTVSGQCVSDYMDWFFRISHPFMTSDQASDPLPDGHAPQPRVIPQAPQTDIPHVPEPGAPSTSARPVVEEPKHAVKFAMGLLRGWSAI

SEQ ID NO: 184845 - protein, 54 aa, Glycine max
  Coding DNA Sequence Number=SeqID_68067
MTTSGTRHNYTMRHSSHTKVQGLWLWAILRPPPKCLVWVHHKMPAPQWHIRGEA

SEQ ID NO: 184846 - protein, 109 aa, Glycine max
  Coding DNA Sequence Number=SeqID_68068
MAKGGRQYSWQRLQTRKECATGVIVEGRCKTHLQSLKKTRPRGQLIVTEHPLKPAEGWPVKVERGDLELFVVRGTMVVKKLTNLEYPRHGINPVEARNLKVHTGRWGPQ

SEQ ID NO: 184847 - protein, 160 aa, Glycine max
  Coding DNA Sequence Number=SeqID_68069
MEQSMLTIIGQYKEELNQSVAHKQKLVEDFAQVYAKKEARGRVIDALHQEATMWMDRFALTLNGSQDLPRLLAKAKAMAEDKATATASSTVREAEPVLQPALNPGRDRNTAVFCRRYSPQAYPYGLPPDFTPRATPEDLSQAPTFEGQLPAYDDYPGQDE

SEQ ID NO: 184848 - protein, 398 aa, Glycine max
  Coding DNA Sequence Number=SeqID_68070
  Gene Ontology: Mol. function=binding; Cellular component =intracellular; Biological process=metabolic process
  Homolog annotation: Hit_ID=Q2HUK9; Match level="QueryCoverage=89%, HitCoverage=96%, E-value=9e-82, Identity=35%"; Hit description =Tetratricopeptide-like helical
  Pfam annotation: Domain name=PPR; Domain location=178-212; Score =24.1; E_value=0.00049; Accession=PF01535.11; Description=PPR repeat
  Pfam annotation: Domain name=PPR; Domain location=262-296; Score =44.8; E_value=2.8e-10; Accession=PF01535.11; Description=PPR repeat
  Pfam annotation: Domain name=PPR; Domain location=69-102; Score=18.7; E_value=0.021; Accession=PF01535.11; Description=PPR repeat
  Pfam module annotation: Pfam domain module=PPR::PPR::PPR; Domain location=178-212::262-296::69-102
MVSSMRLATFCTSSTGKRDASEVTDPFFGNDTYLGPSHATAVPLTLSAFKNYGSDSRHLFDEIPDRSVVSWTSIIAGCVQNDRARDAVRVFKELLVEESGSVESEDGVFVDSVLLGCVVSAFSKLGWRGVTEGVHGLVIKRGFERCVGVGNTLMDAYAKFGEMGVAKVFDGMNESDHYFWNSVIAEYAQNGLSAEAFSVFGDMVKSGNFRYNAVIMDWSFRSFAAGEVHTSSGTSIVDIYCKCERVEMARKAFDCMKVKNVKSWTAMVAGYGMHGRAKEAMEIFYKMIRSGVKPNYITFVSVLAACSHAVERMRILMKSRGLLKAPGFSIVELKAARTWVYAKCNMVLHDVDEEEKGMVLRVHSEKLAVAFGIMNSVPGGFIISRKGRVHVGTIGDSN

SEQ ID NO: 184849 - protein, 101 aa, Glycine max
  Coding DNA Sequence Number=SeqID_68071
  Homolog annotation: Hit_ID=Q1S1U7; Match level="QueryCoverage=44%, HitCoverage=6%, E-value=2e-07, Identity=55%"; Hit description=AAA ATPase, central region; DEAD/DEAH box helicase, N-terminal
MTEGYTGSDLKNLCTNATYRPVRELIHQERLKSLTVLTSVPSLKVRILRRCLHQQRLRMSIFKDVAKVNTVLECDTFKDGAYLNNVFESRHLKTMLTSATS

SEQ ID NO: 184850 - protein, 302 aa, Glycine max
  Coding DNA Sequence Number=SeqID_68072
  Pfam annotation: Domain name=KIP1; Domain location=7-76; Score=36.3; E_value=1e-07; Accession=PF07765.3; Description=KIP1-like protein
MENKDPKSWSSAHIYQSQWLQTTISDLDEKLDAMKTILNGDNSPNQESMDCKWRGDLIQMLDEFGQSYRVLALAYNQLKFNTSNGTFNSGSLSSSGTSNTICAICNKRPTGNLEDKKLNEGWNHHPKYSAEHSNIKFDGSNLGFDQFNKQGDECREFLSADPCNMKFKSELECRDTQMEDRMNKISTTENVLMKIEDSELNQRNEDPSMINFKFDNMWSTLKYQITKLTEDNMHQLVELVQRNDEKRETIRRLQFEVETLKCENKALQTSLRHSNADSECDQPQISRAGGRSMGNLFRGCSP

SEQ ID NO: 184851 - protein, 578 aa, Glycine max
  Coding DNA Sequence Number=SeqID_68073
  Gene Ontology: Mol. function=translation initiation factor activity
  Homolog annotation: Hit_ID=Q2HUL1; Match level="QueryCoverage=99%, HitCoverage=50%, E-value=1e-167, Identity=77%"; Hit description =Initiation factor eIF-4 gamma, middle
  Pfam annotation: Domain name=MIF4G_like_2; Domain location=188-485; Score=151.2; E_value=2.8e-42; Accession=PF09090.1; Description=MIF4G like
MLPKLSNFQFIWPWEEWAYVLDLPRWAPQRVFVQEVLEREVRLSYWDKVKQLPCKATHHQNLVSVELWWNLELEHKIVSLEWLTQFHQKWVSGWILILVLVSAFSHPLCFYKPPTKAIIRAEKGEPTVLFSYPHALVCQALWSLQQRGDKQTVELAAEERSFSSITSSSIENAPGLEELLPPKGGPNFSFGAEDGKESNEHVLSGQLNNMVKGKAPVREIISWIDESVFPSNGLEVTLRVVVQTFLNIGSKSFTHLMTVLERYGQVFAKVCPDQDKQVMLIAEVSAFWKSNTQMTAIAIDRMMGYRLVSNLAIVRWVFSAENIEQFHTSDRPWEILRNAVSKTHNRISDLRKEILSLKKNFSSAEETAKEAKAELDAAESKLTLVDGEPVLGDNPTRLNRLKLHAEKTKNEVVSLQKSSEAKEALLAQAMEENETVLHIKHMFKVLALFLLLYKSFSNVLIERLPEGARTLHELKSAQVDVVMAVDPEEPSSMELDNESQRPQNSQTNGEKKGGAYNVGEKEQWCIITLGYVKAFSRQYAAEIWPHVEKLDAEVLTEDAPLLFRSSVYSGLRRPIHDA

SEQ ID NO: 184852 - protein, 120 aa, Glycine max
  Coding DNA Sequence Number=SeqID_68074
  Gene Ontology: Mol. function=zinc ion binding
MTSEEPIIRDNASDFSDDEQQHDVHEHGEPNNQSTIVRYKTSSSMEDGEDESPKVILNRVFWTFKSCIEGFQYCKSIVQVDGTFLTGKYRGILLTTIGQDGSKNNFSLAFAIVESETKEA

SEQ ID NO: 184853 - protein, 74 aa, Glycine max
  Coding DNA Sequence Number=SeqID_68075
  Subcellular localization annotation: CTP_CleavageSite=53; ConfidenceScore=5.66e-01
MESPPTTKITLFAFYSSSSSPFRSESHAPNVSSLLFSSAFDFSGYVLWRPSPRARPLSIRDYGVEVLLSVMACI

SEQ ID NO: 184854 - protein, 285 aa, Glycine max
  Coding DNA Sequence Number=SeqID_68076
  Gene Ontology: Mol. function=translation initiation factor activity
  Homolog annotation: Hit_ID=Q2HUL1; Match level="QueryCoverage=77%, HitCoverage=23%, E-value=7e-37, Identity=44%"; Hit description =Initiation factor eIF-4 gamma, middle
  Pfam annotation: Domain name=MIF4G_like; Domain location=157-276; Score=-16.2; E_value=2.7e-07; Accession=PF09088.1; Description=MIF4G like
MSGHGIDLESVTLLTPYGAVLYFLANPSILFHLLGSCPHIPRSHLSFEAQLVAGKSHEFGPICCPRLPSPPSVPSGVSIGKQKHEAELKYPQRIHRLNIFPPGSTAYRQICYGRVSPRCASVLKWLLVERNVLLSWLVCQFPSDMSTSWLKQYSLRDSWVNRSLQAMSVLEKARQIVGVAGEQSWCCEHWVIVWVETELLMLPQPPFKPVYYTLVIIDLCKALPGAFPAVVAGAVRTLFERIADLDMECRTRLILWFSHHLYVRNLSNCITPCIIQDNIFCACSA

SEQ ID NO: 184855 - protein, 91 aa, Glycine max
  Coding DNA Sequence Number=SeqID_68077
MGAKHLTRTKEWSHVIEQRSPDEIREQKVQKTMSAPACYQAFCLTDSKRMGANNHKNDQTWSLRAIGHNCVYLAKGGADNRKVSPRIMGAE

SEQ ID NO: 184856 - protein, 107 aa, Glycine max
  Coding DNA Sequence Number=SeqID_68078
  Homolog annotation: Hit_ID=Q1T3Y0; Match level="QueryCoverage=98%, HitCoverage=14%, E-value=1e-26, Identity=63%"; Hit description =Targeting for Xklp2
  Subcellular localization annotation: CTP_CleavageSite=73; ConfidenceScore=5.21e-01
GKTEHDHKKLRQRSGSISKLNEDKPGGSQSPSNQTRKISLTLPQSPKLGRKASSSSSTVQDRSLGNSWKPPISTSKRTAEKNYRTAWRPVTSSSNTTRENASPNIQQ

SEQ ID NO: 184857 - protein, 539 aa, Glycine max
  Coding DNA Sequence Number=SeqID_68079
  Gene Ontology: Mol. function=two-component response regulator activity; Cellular component=nucleus; Biological process=two -component signal transduction system (phosphorelay)
  Homolog annotation: Hit_ID=Q1T3X9; Match level="QueryCoverage=99%, HitCoverage=100%, E-value=0.0, Identity=73%"; Hit description =Response regulator, RegA/PrrA/ActR type
  Pfam annotation: Domain name=Myb_DNA-binding; Domain location=198 -248; Score=44.4; E_value=3.9e-10; Accession=PF00249.21; Description =Myb-like DNA-binding domain
  Pfam annotation: Domain name=Response_reg; Domain location=17-130; Score=103.9; E_value=4.7e-28; Accession=PF00072.14; Description =Response regulator receiver domain
  Pfam module annotation: Pfam domain module=Myb_DNA-binding::Response _reg; Domain location=198-248::17-130
MDNGCFSSPKRDFPAGLRVLVVDDDPTWLKILEKMLKKCNYEVTTCCLARHALSLLRERKDGYDIVISDVNMPDMDGFKLLEHVGLEMDLPVIMMSVDGETSKVMKGVQHGACDYLLKPIRMKELRNIWQHVFRKKIHEAKEFESFESIHLMRNGSELSDDGNLFAVEDVTSSKKRKDADSKHDDKECLDPSSTKKARVVWSVDLHQKFVKAVNQIGFDKVGPKKILDLMNVPWLTRENVASHLQKYRLYLSRIQKENDQRSSSSGMKHSDFPSKDMGSFGFQNSVIKQQNDVAIDNYNHSDGSLQLQNVETKSHEADPKGIVSQSTIAKKGRILTGNIADTNMRESLRVGLNQTFPPLESEGNHAVFDCSMPTPYSWTEVPHMQLKEEHKSLVYLEDSFNQLPLHDYNNDYASSVSSIGNAVATFPIQPGSLIMNGQSSERISTTTSGLKTQEYNNLSSISDQEIYQRNLLGCEAASASLDEDLHFYWLEGECYNNMNFGLQNIGMSEYYDPGLISEAPIHLYDSADYSVMDQGLFIA

SEQ ID NO: 184858 - protein, 97 aa, Glycine max
  Coding DNA Sequence Number=SeqID_68080
  Gene Ontology: Mol. function=zinc ion binding; Cellular component =integral to membrane
  Homolog annotation: Hit_ID=Q7EYM0; Match level="QueryCoverage=74%, HitCoverage=33%, E-value=7e-09, Identity=46%"; Hit description=Zinc finger protein family-like
MQQYKAVQLTMKLMKKERKGKVYADGMPSISSKERKATIKEFYAVIYPSLRLLQGEFNNDQRNSCAEVSRKRLAKVLNKDLEGDEECGICMENGMKM

SEQ ID NO: 184859 - protein, 516 aa, Glycine max
  Coding DNA Sequence Number=SeqID_68081
  Gene Ontology: Mol. function=phosphoprotein binding; Cellular component=membrane; Biological process=signal transduction
  Homolog annotation: Hit_ID=Q1T2L0; Match level="QueryCoverage=82%, HitCoverage=67%, E-value=1e-118, Identity=56%"; Hit description =Serine/threonine dehydratase, pyridoxal-phosphate-binding site; t- snare
  Pfam annotation: Domain name=Pox_A_type_inc; Domain location=159-178; Score=1.8; E_value=44; Accession=PF04508.3; Description=Viral A-type inclusion protein repeat
  Pfam annotation: Domain name=Pox_A_type_inc; Domain location=297-319; Score=6.1; E_value=11; Accession=PF04508.3; Description=Viral A-type inclusion protein repeat
  Pfam annotation: Domain name=Pox_A_type_inc; Domain location=474-496; Score=8.9; E_value=4.1; Accession=PF04508.3; Description=Viral A-type inclusion protein repeat
  Pfam module annotation: Pfam domain module=Pox_A_type_inc::Pox_A_type_ inc::Pox_A_type_inc; Domain location=159-178::297-319::474-496
MGGSGVSLLGVSLKGLCAVCLLGFLLNADPRKCGSGALKERFFSLPFLSTQILLKYADTKSKLFGETPNESILRCFFICMLIGLCLSVSRTGTSEVPQRKSPASPQNARKLKTPGSDTDSVSSSPKPGSKTPKNRSPKVTERKSPRSPISEKKRPGRVQELESQLAQLEEDLKRTKDQLNSSESWKRKAQQEAEEANKQLLAVSKELEESQQQLLELSASEEERLQELRKISQDRDRAWQSELEAVQKQHSMDSTALVSAMNEIQKLKIQLERVRECEAVHISNAESDNAEIEDLRMELDEALTLVEKLKSEVIDCKESESRALEVVGKTQMQLEAANKTVETLQLEGEKASEAYKSLALELEQSRAQVKSLEELVSKLQADLVGGGNKNMLGPVNEAELELAPKNVQNEEINHLKAELVSAKSEAVQLKSALDVSEVRYQEEYIRSTLQIRSAFEQLEHAKSESSQRQGELNEELKRARADIEELREKMMDKESQLQGLSDENEMLVSRIRQNQC

SEQ ID NO: 184860 - protein, 1761 aa, Glycine max
  Coding DNA Sequence Number=SeqID_68082
  Gene Ontology: Mol. function=kinase activity; Cellular component =chromosome; Biological process=DNA topological change
  Homolog annotation: Hit_ID=Q1T3X4; Match level="QueryCoverage=99%, HitCoverage=100%, E-value=0.0, Identity=47%"; Hit description =Prefoldin; t-snare; Protein kinase PKN/PRK1, effector
MSENHVAGQVSEADSDSGHGVVHDESNVDTESNTDTYQDQGERVDLRDPEDGKSTEDSARDDMFVDCPDELTTFDGRQKEEEVAAAKNEDDGSEENEVMHQQQSHFDKLGNGVGDGYSSGQLEKVVAQKEIILKEYQEERQTVTQGVLDLCCQLKTLTGQQNEAEVGDREVTDVSLREMIKECLEFVKTASEEQSNSETTINNLREHLSTKDREIEDLNAKLAQLMVSNESMQVSSEAQLEKDRNVEIVIDKMISSLATVVTREQVLDDSISGKIVYIEEGTIHLIEKYNQILSEIYQLGQSFSEVGLDTNEHEYGNILADARGGLLELKKKETELVEKLAHLEDENQKMVDELDKGKVMIRTLNTELGNLKIELEQEKVKCANTKEKLSMAVTKGKALVQQRDSLKKSLADKSGELDKCLIELQEKSVALQAAELAKEELSQSENMVASLQNSLLEKNAVIDQVEEILSQAKPDEPEMFDMPEKLRWLVDDRNTLKEAFLELCKLKKALSLADLPEPVSSSDLESQMKWLTDSLLRAHDNMHTLQEEISTIKESSRNYIDQLSVSLLLALQEKDYLLSELTDLRFKYDELVSKNHQISLEKDQIVHMLVDLCGLNLEDEGIDQISSSTYTIINLCFKVIKGQSGPLSRASHIDAELFERIQSLLYVRDQGLILYEDILEEEMLIRSDVNKLSNELKVVSEEIIALKEERSSLLQDLERSEEKTSMLRDKLSMAVKKGKGLVQDRDNLKGLLNEKNSEIEQLKADLQKQESAVSEYRDEINRLSNDVESIPKLEADLLEMKRDKNQFEQFLMESNNMLQKVMECIDGVALPVVPVFDEPIEKVKWLAGYVNECQDAKVHREQELQLVKENASILEIKLAEAQATVKSLEQELSSSDDNVSQLAEEKIELEHGKVKVEEELQKVKDKVAEVCNTTKSLEDALSQAEKEISILSEEKEQAQVSRVAAERELEIFKDEAARQTSILAEASKTIKDLEDKLSQVEGNANLLTEKYNADQVAKIDMGNELKKLQDEASNHASKLVGASGTIKSLEDALLKAQDDISALEDANKIAKQEISSLGFKLNSCMDELAGKSGSLENKSLQLIGLLNDLQVLMKDTTPFPGIKQCFESKCETLKNMNLILNKIRDNVAMTAKDSKGQPVMVENPLVRETFLDSPENYEVELDNTEIDGADIDTIISSFGKIVKGFQSRNKHIADKFYEFSDFMDEFISPLHEKLLETETMSTTIVENMEIMKKEANTMEKLKEEQENTIATLENNVSVLLSACTDSTIALQSEVDKNLGQPGSISEVEQLNLEAGAQTEHHKNSKYVEATHKLMNASRKAQTLIAQFGCRSEQVDATIEDLRNKLKETTVAFELVTDERDLNKNRVSQLESDIQSLQSACSELKDKLEDYHALEEKLEEKEAEISSMHNALLAKEENSLFPASQMRDLFDKIDRIKIPIVESKEDDLEPHTSAPMRKLFYIIDSVPRLHDQINSLSHDKEKLQSILETRDLDIKDLKDEVKQLNRICEDSKMIKNELSELTYVLEKIMDILGAGEWVVDRKSKGSKELIPALEKHIIAILSESENSKSKAQELDIKLVGSQKVIDELTTKVKLLEDSLQDRTSQPDIVQERSIYEAPSLPAESEIIEVEEGSSLSKKAISPVPSAAHVRNMRKGSTDHLALDISGESDNLINRVDKDDDKGHVFKSLSTTGFVPKQGKLIADRIDGLWVSGGRVLMSHPRARLGLIGYLFVLHIWLLGTIL

SEQ ID NO: 184861 - protein, 148 aa, Glycine max
  Coding DNA Sequence Number=SeqID_68083
  Gene Ontology: Mol. function=oxidoreductase activity; Cellular component=extracellular space; Biological process=metabolic process
  Homolog annotation: Hit_ID=Q0VH87; Match level="QueryCoverage=95%, HitCoverage=64%, E-value=2e-34, Identity=40%"; Hit description=3 -ketoacyl-CoA reductase 2
  Pfam annotation: Domain name=adh_short; Domain location=46-148; Score= -50.4; E_value=0.012; Accession=PF00106.15; Description=short chain dehydrogenase
MEGLDLFLVATNTIGFICVCSALIKFLKWVWVVFLRPPKNLKEYGSWAIITGSTDGIGKAMAFELASKGLNLLLVGLAYPYARFFHEVDLELMDAIIKVNLEGATWITKAVLPTMIKKKKGAIVNIGSGSTVVLPSYPLVTLYAATKA

SEQ ID NO: 184862 - protein, 323 aa, Glycine max
  Coding DNA Sequence Number=SeqID_68084
  Gene Ontology: Mol. function=signal transducer activity
  Homolog annotation: Hit_ID=Q1T3X1; Match level="QueryCoverage=60%, HitCoverage=98%, E-value=2e-78, Identity=74%"; Hit description =Regulator of G protein signalling
  Pfam annotation: Domain name=RGS; Domain location=150-271; Score=6.5; E_value=6.7e-05; Accession=PF00615.9; Description=Regulator of G protein signaling domain
MKPLSSRCHMKAQWTIPVVSLHSLYIAILVGVTAAVHHIEFRFDELKDLWRGILVSAVSIAVWVTAYILNEIYDNISWLEVASRFLLLVVASILVVAFFSISSSQPLLSQISLRRRESREFRTMSQALGIPDSGVLAQSEPISRIDPNEPLDKLLLNKRFRLSFMAFADSCLAGESVHFFDEVYELSKIPEDDCGFLLLSLVFSMMPRFCHIQNCVAMEVNISHRSRQEILSTSSLTRPDLFHNALNEIIQLMKTNLARDYWSSMFFLKFQEDTNVRSNEYELEQMTGWNFSPRLSSVHGIDDPFHQDHLLKSSGCSNDTTDL

SEQ ID NO: 184863 - protein, 788 aa, Glycine max
  Coding DNA Sequence Number=SeqID_68085
  Gene Ontology: Mol. function=DNA binding; Cellular component =chromatin; Biological process=chromosome organization and biogenesis (sensu Eukaryota)
  Homolog annotation: Hit_ID=Q53QK3; Match level="QueryCoverage=64%, HitCoverage=87%, E-value=3e-36, Identity=32%"; Hit description=PWWP domain, putative
  Pfam annotation: Domain name=PWWP; Domain location=252-325; Score =57.8; E_value=3.5e-14; Accession=PF00855.8; Description=PWWP domain
FDEEPDLVGVGSGLEEGVKVVDGGCDEKEREVSCGTVKNEDEKSGIECSDGVLFDYGGLFIEFNDGFQSELGCEKASDVAENGLPSIVSNNVTQGGDNDAVECAQEEVKNDGLVNLSMVVEADGERNDADSLVTKNGLEDLHATEVATYQLRDGIPCMEGVDVIAEESLHVKDLSRNCLELEPSCELKQPAFQVDADVDVMQNQTMVVDVSEELFENIQSECHGFNLVVDLNSYRSTQKVGMYWGSVSSEMNFRVSDLVWGKVTGHPWWPGQIFDASAASAKAKRHLKEGCHLVAYFGDQTFAWNDVSMIKPFQMHFSQMNKQSNSENFHHAVDCALDEVSRRVEFGLSCPCMPGDVISKIKTQVISNAGINNQLCRRNGGDRIMNPMSFEPMKLVNFVKSLAQSPLVESDRLDFVIARSQLSAFYCSKGYSQLPEFPVLGGLFENDMETLFLKGKEQCDYQTHVGYTQQEHKHISGDEKRRSKKKKLLSDLMSEKGFCISNGEGTSEQEAKSVPRRRGRKRKSAYNISEDYFHNSLNRRLFQFQHASTNDMRSQLCLAAKDPIGESCSSDMVHFFAEFRKSISIDYSASLDQEMSLEQMHDGETGVTSITALTSEMEPCSDSYWPDRIIQSIPEDQSLTKYQNERAIFLPETLTEANDRNLGSESSKLVEHLVGSSQEGFCPTALTLKFTNLDSVPSTTDLNKIFARFGSLIESKTELLERTNRARVVFQRRSDAEAAFSSAGKYSIFGPSLVSYRLKILPRKPQQKGTVKRGRKRRETSSVDGAAV

SEQ ID NO: 184864 - protein, 1080 aa, Glycine max
  Coding DNA Sequence Number=SeqID_68086
  Homolog annotation: Hit_ID=Q1T3W7; Match level="QueryCoverage=97%, HitCoverage=93%, E-value=3e-94, Identity=36%"; Hit description =Mature parasite-infected erythrocyte surface antigen
MATPNPNVVFIDTNLDTHLALVVSDLDTVSDLKKSILSEHPLCFPKIGQVQIHGIKVERKGYFYHLTDSMPVRSAFRGINGSWFLSVDVSVLRECSQNEQLFSHGSPNQVATLGIANNALIVGSPSKRVSTFDHFKLPQLENRQNEEIHVASPCVSKHTGKGVKSSADNDMETPLPGSVHETEDHCFVNRELPSLNIECEVDGSGKGIKDDHNVCEETPVSSAKKKRKNKRKKEDTAQDDTAVDNALSFPSKRASGANNELPGSRIEHEVDGTIEGIKDACIVHEEGNCKSVSNVKKKLKGKRKKLGTLQHDTSKVNDASVVGSGDYTIQQDIEVIANPSEDADKEVTKETEILKEHQHTDCNNNNTKNDIDVAASANKKHRKRKRSLAVDSKEMFKVETAIQQDEVHKSNEAHKEKKESKEQFELKNEKSRDDVEYKQDQVTEDILNTGPPAKKKRNGKEKSVEVILSKAKLINHFNGDNASHHILEDQQKIKNSNADQSAKHFDDTDPPRTSVQGRRKKGKINSSNPHETPVVTSSRKGEEADCSSIQRGVQEEISEDALSSKDNSMSKATIDNMETGTDACKEGFQYTERATGYYKNHSDIETNAHIADVDEPMELTENSENVVLDQCHKNEAGQIEGAEEGRELSPQNDSKLALLEKSTSSSQDKTDANIRELNVTSKGVDANGMTEPIKSEKEKRRMRKAKSSGGGSALREGIGLVDASESETVIMKSLSAKNCDPMSGNTETEDNPLNQTEGEKIHQEKVQGTSDKEDDFGVDNAGSLEQITTKSNERMDKRQRKKSNDKQTSTSKIISSMLTKDKVLDSKKPSPSSDSGTHGKPSVAVTKKSKSTSTKSTNKSSKTNLELVEESVRLELSDSRFNTGGKDAAQQSTRSGEKDDDNLEAINGQAHAEDLSSSQQLLSKEELDVRSHPCKKVPNVHRAGQDSKLSGRSDRAMSLFGENRKAHVNASGKSMDLEKRRKHVPVSNSKPEGSIKMVQNKAGKASGNNIHGVASKIQQKKSLLSGAIFKDDSSGTSVDEVDNSDASTRTPSYNPLLSDFSDGDSSSGLDSQVDGICNIF

SEQ ID NO: 184865 - protein, 62 aa, Glycine max
  Coding DNA Sequence Number=SeqID_68087
MGDQATSIFHQLQCFKDSLTFQILKARLARVSDFWLSELGVLSARRDKQLVGRAGGTLGACI

SEQ ID NO: 184866 - protein, 546 aa, Glycine max
  Coding DNA Sequence Number=SeqID_68088
  Gene Ontology: Mol. function=guanyl-nucleotide exchange factor activity; Cellular component=cellular_component; Biological process =intracellular protein transport
  Homolog annotation: Hit_ID=Q2QTS8; Match level="QueryCoverage=99%, HitCoverage=99%, E-value=0.0, Identity=69%"; Hit description =Regulator of chromosome condensation, putative, expressed
  Pfam annotation: Domain name=RCC1; Domain location=174-223; Score =22.7; E_value=0.0013; Accession=PF00415.9; Description=Regulator of chromosome condensation (RCC1)
  Pfam annotation: Domain name=RCC1; Domain location=226-277; Score =7.7; E_value=0.1; Accession=PF00415.9; Description=Regulator of chromosome condensation (RCC1)
  Pfam annotation: Domain name=RCC1; Domain location=280-330; Score =12.2; E_value=0.034; Accession=PF00415.9; Description=Regulator of chromosome condensation (RCC1)
  Pfam annotation: Domain name=RCC1; Domain location=335-387; Score =8.2; E_value=0.093; Accession=PF00415.9; Description=Regulator of chromosome condensation (RCC1)
  Pfam annotation: Domain name=RCC1; Domain location=390-439; Score =34.1; E_value=4.9e-07; Accession=PF00415.9; Description=Regulator of chromosome condensation (RCC1)
  Pfam annotation: Domain name=RCC1; Domain location=442-507; Score =16.6; E_value=0.011; Accession=PF00415.9; Description=Regulator of chromosome condensation (RCC1)
  Pfam module annotation: Pfam domain module=RCC1::RCC1::RCC1::RCC1::RCC 1::RCC1; Domain location=174-223::226-277::280-330::335-387::390 -439::442-507
MDATTSGTPTVQYHNIPDQPITAIIATPLPTFQRQQRHCFGDSTPGEFPLSANPSIVLHVLTACNLEPQDLAKLEASDTMFCLCELATCSFFRQPANFAPDLDLSLSELAALDMCQKRAIFKPMTTEQRQDLKLRCGGSWKLALRYLMAGEACCRREKSQAIAGPGHSIAVTSKGVVYSFGSNSSGQLGHGTTDEEWRPRPIRTLQGIRIIQAAAGAGRTMLVSDSGQVYAFGKDSFGEAEYGVQGSKTVAAPQIVESLKNIFVVQAAIGNFFTAVLSREGRVYTFSWGSDGKLGHHTDQSDVEPHPLLGALENIPVVQIAAGYCYLLCLACQPSGMSVYSVGCGLGGKLGHGSRTDEKYPRLIEQFGLLNLQPMVVAAGAWHAAVVGRDGRVCTWGWGRYGCLGHGNEECESVPKVVEALSNVKAVHVATGDYTTFVVSDDGDVYSFGCGESASLGHNAAGNDEQGNRHANVLSPELVTSLKQINERVVQISLTNSIYWNAHTFALTESGKLYAFGAGDKGQLGIELVANQTERGNPERVEIDLG

SEQ ID NO: 184867 - protein, 155 aa, Glycine max
  Coding DNA Sequence Number=SeqID_68089
  Subcellular localization annotation: CTP_CleavageSite=86; ConfidenceScore=5.05e-01
MLYITQTIAGVTTISKSCPLLSLAAASAITAISLADASEPKSMPDAPSPSPSPMMTPLAATHAVQLQFATQPRLRHSLRVRENIAPAMAVPAVEVETLERESVGFEGGSLGLFDLGDDPVIGFKHLEFIIAIVAAMVAAIAEHERAECRVPRQRQ

SEQ ID NO: 184868 - protein, 534 aa, Glycine max
  Coding DNA Sequence Number=SeqID_68090
  Gene Ontology: Mol. function=nucleotide binding; Cellular component =integral to membrane; Biological process=protein insertion into membrane
  Homolog annotation: Hit_ID=Q1T3W5; Match level="QueryCoverage=99%, HitCoverage=98%, E-value=0.0, Identity=69%"; Hit description=60 kDa inner membrane insertion protein
  Pfam annotation: Domain name=60KD_IMP; Domain location=133-350; Score= 339.8; E_value=4.6e-99; Accession=PF02096.11; Description=60Kd inner membrane protein
  Subcellular localization annotation: CTP_CleavageSite=43; ConfidenceScore=5.57e-01
MAALLPCAPNVVSAPLGNRSTCHFPHRPYSHAFSGSTARHFLRGSLTVARFGFQPGFLPEPDEAEGVLRELFGRAEGLLYTIADAAVSSSDTVAASTTAKQSNDWLSGIANYMETVLKVLKDGLSALHVPYAYGFAIILLTVLVKAATFPLTKKQVESALAMRTLQPQVKAIQQQYAGDQERIQLETARLYKLANINPLAGCLPTLATIPVWIGLYRALSNVADEGLLTEGFFWIPSLAGPTTVAARQNGSGISWIFPFVDGHPPLGWSDTLAYLVLPVLLIVSQYISVQIMQSSQPNDPNMKSSQALTKVLPLMIGYFALSVPSGLSLYWLTNNILSTAQQVWLQKLGGAKNPVRQVPDDIMKNDLTQVQKSISKLNSTKAEEARQSEKTSEGPQPGERFKLIKEQEARRRQRKEEERKALEAAARKAKIDETFEKTVEEGNQTGGDLVVEKSRFVASDTDPSISGVVNGNPLSKDLEGNQNSTSISETENNDGSAHFNNVEINEKNLDKEPREVLTTTTATNKQPPAEETKD

SEQ ID NO: 184869 - protein, 341 aa, Glycine max
  Coding DNA Sequence Number=SeqID_68091
  Gene Ontology: Mol. function=oxidoreductase activity; Cellular component=endoplasmic reticulum; Biological process=metabolic process
  Homolog annotation: Hit_ID=Q1T3W8; Match level="QueryCoverage=99%, HitCoverage=100%, E-value=1e-147, Identity=75%"; Hit description =Short-chain dehydrogenase/reductase SDR
  Pfam annotation: Domain name=KR; Domain location=54-230; Score=-92.9; E_value=0.057; Accession=PF08659.1; Description=KR domain
  Pfam annotation: Domain name=adh_short; Domain location=54-227; Score= 49.3; E_value=1.3e-11; Accession=PF00106.15; Description=short chain dehydrogenase
  Pfam module annotation: Pfam domain module=KR::adh_short; Domain location=54-230::54-227
MECCIIARLKTQPLWFALLFVVGLLTILKLAFVVFRWVYVNFLRPPKNLKKYGSWAVVTGPTDGIGKSFAFELARKGLNLVLVGRNPDKLKDVSDSIAAKFRRTEVKTVVVDFSGDLDEGVKKISEAIEGLEVGVLVNNVGVSYPYARFFHEVDEGLLNNLIKVNVVGTTKVTQAVLPGMLRRKKGAIVNIGSGAAIVIPSDPLYAVYAATKAYIDQFSRCLYVEYKKSGIDVQCQTKLNGKESPLLYHSMLFQLRQIPLYVATKMASIRKSSFFVPSTDGYAKAGVKWIGYEPRCTPYWPHTLLWAVAFSLPEFVVDAWRLWFCLGIRKRGQRKESMKKE

SEQ ID NO: 184870 - protein, 97 aa, Glycine max
  Coding DNA Sequence Number=SeqID_68092
  Subcellular localization annotation: CTP_CleavageSite=55; ConfidenceScore=5.17e-01
MGHRPHHRLPFTKSEISSRTTTSPPPLSASQPLPWHGASRGALAFCILFHQKWVCATMLMVKMPKLPLAMFTEIPPSEIPSGGGEQWLTAEVLGEKV

SEQ ID NO: 184871 - protein, 405 aa, Glycine max
  Coding DNA Sequence Number=SeqID_68093
  Gene Ontology: Mol. function=lyase activity; Cellular component =anchored to membrane; Biological process=pathogenesis
  Homolog annotation: Hit_ID=Q93XJ1; Match level="QueryCoverage=93%, HitCoverage=93%, E-value=0.0, Identity=77%"; Hit description=Pectate lyase
  Pfam annotation: Domain name=Pec_lyase_C; Domain location=137-322; Score=327.4; E_value=2.5e-95; Accession=PF00544.9; Description =Pectate lyase
MEIPIPIPLSSMLLFLLLVPCCICSSPLQDPELVVEDVQKSINASRRNLAFLSCGTGNPIDDCWRCDPNWEKNRKRLADCSIGFGKHAVGGRDGKLYVVTDPGDHPVNPKPGTLRYGVIQEEPLWIIFKRDMVIKLKQELMMNSFKTIDGRGVSVHIAGGPCITIQYVTNIIIHGINIHDCKQGGNAYVRDSPTHYGWRTLSDGDGVSIFGGSHVWVDHCSLSNCRDGLIDAIHGSTAITISNNYMTHHNKVMLLGHSDTFTRDKNMQVTIAFNHFGEGLVQRMPRCRHGYFHVVNNDYTHWRMYAIGGSAAPTINSQGNRFLAPNDNTFKEVTKRENSPQSKWKNWNWRSNGDLMLNGAFFTASGAGASSSYARASSLAAKSSSLVSSITASAGSLRCRKGSRC

SEQ ID NO: 184872 - protein, 707 aa, Glycine max
  Coding DNA Sequence Number=SeqID_68094
  Gene Ontology: Mol. function=protein serine/threonine kinase activity; Cellular component=mitochondrion; Biological process =protein amino acid phosphorylation
  Homolog annotation: Hit_ID=Q8RVE5; Match level="QueryCoverage=96%, HitCoverage=91%, E-value=3e-39, Identity=24%"; Hit description =Pentatricopeptide (PPR) repeat-containing protein-like
  Pfam annotation: Domain name=PPR; Domain location=180-214; Score =20.2; E_value=0.0076; Accession=PF01535.11; Description=PPR repeat
  Pfam annotation: Domain name=PPR; Domain location=215-249; Score =13.2; E_value=0.21; Accession=PF01535.11; Description=PPR repeat
  Pfam annotation: Domain name=PPR; Domain location=250-284; Score =12.9; E_value=0.22; Accession=PF01535.11; Description=PPR repeat
  Pfam annotation: Domain name=PPR; Domain location=348-382; Score =19.6; E_value=0.011; Accession=PF01535.11; Description=PPR repeat
  Pfam annotation: Domain name=PPR; Domain location=386-420; Score =31.9; E_value=2.2e-06; Accession=PF01535.11; Description=PPR repeat
  Pfam annotation: Domain name=PPR; Domain location=421-455; Score =30.4; E_value=6.2e-06; Accession=PF01535.11; Description=PPR repeat
  Pfam annotation: Domain name=PPR; Domain location=457-491; Score =36.2; E_value=1.1e-07; Accession=PF01535.11; Description=PPR repeat
  Pfam annotation: Domain name=PPR; Domain location=492-525; Score =18.9; E_value=0.018; Accession=PF01535.11; Description=PPR repeat
  Pfam annotation: Domain name=PPR; Domain location=528-562; Score =50.3; E_value=6.3e-12; Accession=PF01535.11; Description=PPR repeat
  Pfam annotation: Domain name=PPR; Domain location=563-597; Score=5.7; E_value=1.6; Accession=PF01535.11; Description=PPR repeat
  Pfam annotation: Domain name=PPR; Domain location=613-647; Score =14.0; E_value=0.17; Accession=PF01535.11; Description=PPR repeat
  Pfam module annotation: Pfam domain module=PPR::PPR::PPR::PPR::PPR::PP R::PPR::PPR::PPR::PPR::PPR; Domain location=180-214::215-249::250 -284::348-382::386-420::421-455::457-491::492-525::528-562::563 -597::613-647
MNATLLQPPLSPFQRATTTNSPEPRDQKLLSLLRDRKTEEAWLAYSHSTHLPNPTCLSRLVSQLSYQNTLSSLTRAQSIVTRLRNERQLHRLDANCLGLLAVSATKANHTLYAASLLRSMLRSGYLPHVKAWTAVVACLASSPDRGDGPAEALQLFRSVTRRLRRLPDPAMAAASRPDTAAVNAALNACANLGDPRAFLQVFDEMPQFNVAPDALSYNTMIKLCCRIGRKDLLVFVLERVLQLEIPFCVTTLQSLVSAYVEFGDLETAEKLVQAMREERRDICRVLKECSNLEYSSGNESSDDDDDDDDDDDDDNDCIFEKLLPNLVDQSGNEVEPPLLPKGYAPNTRTYTTLMKGYMNAGRVSDTVRMLEAMRRLDDKGSQPDHVSYTTVVSALVKVGAMDRARQVLAEMTRIGVPANLITYNVLLKGYCKQLQIDKARELLKEMVDDAGIQPDVVSYNILIDGCILVDDSAGALSFFNEMRARGIAPTKISYTTLMKAFAYSGQPKLAHRVFNEMDSDPRVKVDLIAWNMLVEGYCRLGLVEEAKKVVQKMKESGFHPDVGTYGSLANGIALARKPGEALLLWNEVKERCEVGKEGGKSDSSVPPLKPDGALLDTIADICVRAAFFRKALEIVACMEENGIPPNKTKFTRIYVEMHSRMFTSKHASRARQDRRVERKRAAEAFKFWLGLPNSYYDGSEWRLEPME

SEQ ID NO: 184873 - protein, 728 aa, Glycine max
  Coding DNA Sequence Number=SeqID_68095
  Gene Ontology: Mol. function=ubiquitin-protein ligase activity; Cellular component=intracellular; Biological process=protein modification process
  Homolog annotation: Hit_ID=Q1T683; Match level="QueryCoverage=94%, HitCoverage=39%, E-value=1e-162, Identity=45%"; Hit description=HECT
  Pfam annotation: Domain name=HECT; Domain location=378-728; Score =360.4; E_value=3e-105; Accession=PF00632.15; Description=HECT-domain (ubiquitin-transferase)
MTTLRIFILLTHFLLCIPLKDIYGQRTSDMMTDLPETQMEEAKLSQPRPGQAVNENAGESSSSGTQGYAEQELQMNTEPNSKLEKQHPASCSNEAGQKLDFYLEGQHLDHKLTLYQAILHHIIKKNADSFSSAKLWSQVHIITYRRDVESEDVIPPECHSSPQHFSDEKVLAYYQHTPFFSDMFSCELVSDLEMSSPIYDILFLLKSLESMNRIIFHLMSRERICAFAQGKVDNLDSLKITVPSVPQIEFVSSKLTEKLEQQMRDSLAVSICGMPLWCNQLMASCPFLFSFEARCKYFRLAAFGQPQVQPSHNGSGTVSDRRLSPGGLPRKKFLVHRDRILESAAQMMDLHASNKVVLEVEYDEEVGTGLGPTLEFYTLVCQEFQKSGLAMWREDDSSFTLKTNLQAEEIGVHSFYGLFPRPWSSMQDTSGGIQFSEVTKNFFLLGQVVAKALQDGRILDLHFSKAFYKLILGKELSLYDIQSFDPGLGKVLQEFQALVMRKKFMESVSGGNSELQYGLSFRDMSIEDLCLDFTLPGFPDIVLASGTDHTMVNMRNLEDYVSLIVDATVRSGVSRQVEAFKSGFNQVFSIDHLRIFNEEELERMLCGEYDSWAVNEFGDHIKFDHGYTASSPPIVNLLEIVREFDNGQRRAFLQFVTGAPRLPPGGLASLNPKLTIVRKHCSNRADTDLPSVMTCANYLKLPPYSSKERMKEKLLYAITEGQGSFHLS

SEQ ID NO: 184874 - protein, 687 aa, Glycine max
  Coding DNA Sequence Number=SeqID_68096
  Gene Ontology: Mol. function=ubiquitin-protein ligase activity; Cellular component=intracellular; Biological process=protein modification process
  Homolog annotation: Hit_ID=Q6WWW4; Match level="QueryCoverage=81%, HitCoverage=34%, E-value=1e-87, Identity=35%"; Hit description=HECT ubiquitin-protein ligase 3
MGSRGQKRPEMVDELPADKRACSSLDFRPSTSNSSVQTQMNSTVEAHDHDMDTSSSASASSQSEGEPEKDSAYGSCDSDDMEQHHSTLHEYHRQRLSSDHGKFKTIISSLSGLTEPSLQLAVLTELCEVLSFCTEGSISSMTSDLLSPLLVKLAQHESNPDIMLFSIRAITYICDLYPRSAAFLVRHDAVTTLCQRLLAIEYQDVAEQCLQALEKISREQPLACLQAGTIMAVLNYIDFFSTSTQRVALATVVNICKKLPSESPSPFMEAVPILCNLLQYEDRQVTHLLSLNGQTSLSPLIYNGLIGLLVKLSSGSLVAFRTLYELNISSILREILSTFDLSHGVSTSLLVGGHCNRVYEALKLLNELLPVRAKDENDQLMLDKESFLDNSPDLLRRLGMDVFPMLIQVFNSGASLYVCYGSLSVMYKLVSLSKSDMLVALLKNANISSFLAGVFTRKDHHMLMLALQIAEIILQNFSDDFLKLFVKEGVFFAIEALLTPERSSKLMYPAFGGIQLSLDSSQKSSSRDALKCLCFAFSTGQSPTSLEARNCKLDKDSLYNLATHIKNKFLAPELFDSEKGLTGILQNLRALSNDLLSMSTDSGALAVHEEKINNILYQIMDKLTGKEQVSTFEFIESGVVKSLVNCLSHGQYIRKKREYMVFVLYLVIEKRFEALASVCLCALSSLR

SEQ ID NO: 184875 - protein, 319 aa, Glycine max
  Coding DNA Sequence Number=SeqID_68097
  Gene Ontology: Mol. function=pectate lyase activity; Cellular component=anchored to membrane
  Homolog annotation: Hit_ID=O24554; Match level="QueryCoverage=87%, HitCoverage=96%, E-value=2e-66, Identity=40%"; Hit description =Pectate lyase precursor
  Pfam annotation: Domain name=Pec_lyase_C; Domain location=94-275; Score=88.2; E_value=2.5e-23; Accession=PF00544.9; Description =Pectate lyase
MGLLIIQSNSITIRGLHVVQEIMAFSFTFMFQFLLLAPSVIYASPVQDPELVIQEVQKSINGSRRNLGYLSCGTGNPIDDCWRCDPNWERNRKRLASCAIGFGKHAIGGKDGKIYVVTDPSDNPVNPKPGTLRHGVIQQEPFWSARSDGDGITIFGGSHVWVDHCSLSNCFDGLIDVVHGSTAITISNNNMTHHNKVMLLGHSDSYKADKNMQVTIAFNHFGVGLGGRMPRQQLDLISYTNLQMQVTKHFKSSKSEWRKWNWRSEGDLMLNGAFFTASGAGATARYDKASSMAARPPMLVVSMTAGAGALRCNKGNLCH

SEQ ID NO: 184876 - protein, 539 aa, Glycine max
  Coding DNA Sequence Number=SeqID_68098
  Gene Ontology: Mol. function=nucleic acid binding; Cellular component= nucleus; Biological process=multicellular organismal development
  Homolog annotation: Hit_ID=Q9LJG1; Match level="QueryCoverage=81%, HitCoverage=61%, E-value=1e-104, Identity=46%"; Hit description =Similarity to terminal ear1
  Pfam annotation: Domain name=RRM_1; Domain location=138-204; Score =54.2; E_value=4.3e-13; Accession=PF00076.12; Description=RNA recognition motif. (a.k.a. RRM, R
  Pfam annotation: Domain name=RRM_2; Domain location=356-467; Score =143.2; E_value=7.2e-40; Accession=PF04059.3; Description=RNA recognition motif 2
  Pfam module annotation: Pfam domain module=RRM_1::RRM_2; Domain location=138-204::356-467
MGETGIIVSFQGNLDPRAEEFRPLNLQCQWYPLPLPTPLSTSSTRSLLLTPLPFTSHSALRAELQAFGDIRALQTDSLRHGILTVHFFDLRHAESAFAAIRSMHLHFPQFLLSAHPISAHYVLPSSNAFPDAHNQGTLVIFNLHPNLSTVQLRRLFQPFGPIKELRDTPWKKNQRFVEFFDIRDAAKALKHMNGKEIHGKQVVIEFSRPGGHTRKFFHHSPPSETTPFNVPPPPPPFPPSPRRRFAAPRLHSSQKKSPGSHKSTGSIDAEMGSMSLTGEVEVQHSSHGPTQRNLSRKHNCDTTVVVGTTTKQQQQQQQQQQVPRSRHWKGKQAKKQETRFLIKEGAIVESGPKDTRTTVMIKNIPNKYSQKLLLNMLDNHCRHCNEQIADGDEQQPLSSYDFVYLPIDFNNKCNVGYGFVNMTSTEATLRLHKAFHLQHWEVFNSRKICEVTYARVQGLEALKEHFKNSKFPCEMEHYLPVVFSPPRDGKELTEPLPIVGNKQQQQAISSGGGGSGSVGDDDETNEEVGSSVVILKDSI

SEQ ID NO: 184877 - protein, 35 aa, Glycine max
  Coding DNA Sequence Number=SeqID_68099
MAPVASTTGKEMETAEGNCSNGEKELWNKVRGNCG

SEQ ID NO: 184878 - protein, 99 aa, Glycine max
  Coding DNA Sequence Number=SeqID_68100
MVNLAVAKYERAVGSNEGGGGGKKRKAEINDVPMWKTIKDFSLPDISVNVEGKGQDLEGRVNSKGECGNGGLRINAPGDAVLRHDAKNDLVEMSLELDK

SEQ ID NO: 184879 - protein, 34 aa, Glycine max
  Coding DNA Sequence Number=SeqID_68101
MDSMWKGLPRTSLSDMEELKSEVMKGEDSEEKLP

SEQ ID NO: 184880 - protein, 149 aa, Glycine max
  Coding DNA Sequence Number=SeqID_68102
MIDGQYKIKKDGLDKYPKTCNSSNLSTTFCLMSNKTSDEATLAAGVGTLTAGEDRMDCYCFLFAHYFFLFIVNLFKCSHHHLPPSRCIFFLLANSSEAASRHRASATIAVTLWQPHAARPCAQCRQGPRLLHGGASPLLHRDVANAPRI

SEQ ID NO: 184881 - protein, 81 aa, Glycine max
  Coding DNA Sequence Number=SeqID_68103
MTQWWRNLDGEVWRNIDLAEEGEGAMMMAKLLWSELREATTTNSIRNKGKGGAVPLEAKLLCNDPLEVGFGWGRVVWHHES

SEQ ID NO: 184882 - protein, 74 aa, Glycine max
  Coding DNA Sequence Number=SeqID_68104
  Homolog annotation: Hit_ID=Q6I666; Match level="QueryCoverage=37%, HitCoverage=35%, E-value=1e-07, Identity=100%"; Hit description =Cytochrome P450 like_TBP
  Subcellular localization annotation: CTP_CleavageSite=7; ConfidenceScore=5.04e-01
PDPVGCRCTARAASSARAGCRVPTGGRIGNGPFGASSPGVEQSTQICETTAKGTGLAESAGKEDPVELDSSPTL

SEQ ID NO: 184883 - protein, 170 aa, Glycine max
  Coding DNA Sequence Number=SeqID_68105
  Gene Ontology: Mol. function=chitin binding; Cellular component =extracellular region; Biological process=chitin metabolic process
  Homolog annotation: Hit_ID=Q86AI8; Match level="QueryCoverage=73%, HitCoverage=36%, E-value=3e-18, Identity=38%"; Hit description =Similar to Homo sapiens (Human). Mucin 2
MTGPLDESISCFFIKVDPWVLVPITFRGLYVLAIRGPHVLTFRGLHALAIRGLHVLTFRGLHALAIKGLHVLTFVGLHALTFRGLHVLANRGLHALTFRGLHVLANRGLHALTFRGLHVLANRGLHTLTSRGLHILALRGLHAFTFRGLRVLIFSVLHIYTLREFKVLCP

SEQ ID NO: 184884 - protein, 79 aa, Glycine max
  Coding DNA Sequence Number=SeqID_68106
MVAKRKNDMGWWNWSLLHGRGDGANQHRPFGVSGSYLKAYSETGRLGNDRALEMALLVEKTSSGREYNDASRFRKIKIV

SEQ ID NO: 184885 - protein, 402 aa, Glycine max
  Coding DNA Sequence Number=SeqID_68107
MKGKYSRDAKVVLVLAAFALYRGNTLAALISSIKQLPYNLKPPKLQIKALSLLVKTMMDLAMCIIKFEYLPLQHVEPGNVSQSPNIRSCILDHQKLFSMYSDSTIIAAWELSSLAYRLGGICCNPRRQTDLSQRTRLLFSFLILLIMIERNLYDRLLDLAREEHIDNHKDSHFIFSFQELLAIEGFLNRSKGIMLFDSAEKYFAFFFGRDRSIGYDLLIYLSSLSNLLILILCRLQIGVSELKNKTVLLLISKPQLLNPIDIFLLVQQTCDHPLNERLRESYKIVWIPLPFSDTWTEAEESSFNFLSDSLAWNAVQKPRLLSSAVVKYTREQWNYKDEPIMVALDSKGKVTNYNALDMIKIWGPQAYPFSASKVEELWQDQNLTMQLLLDGINPFLAYWVGV

SEQ ID NO: 184886 - protein, 308 aa, Glycine max
  Coding DNA Sequence Number=SeqID_68108
  Gene Ontology: Mol. function=hydrolase activity, hydrolyzing O -glycosyl compounds; Biological process=carbohydrate metabolic process
  Homolog annotation: Hit_ID=Q2HU62; Match level="QueryCoverage=59%, HitCoverage=35%, E-value=3e-40, Identity=46%"; Hit description =Glycoside hydrolase, clan GH-D; Ricin B lectin
MLIKEGRTKPLIQGRLSRFCVLGEESGYAPVSFSLDTNETKMSCSHNDNEAVLETRPHVRKKTNLIQLSHEVLVTTIHGSYTPLPTAERQMFNFLGVIWYEGEKRGGGGKRRKEKRSRTEEWFGKNEEEDFPYITSVNSEDQDLGKQMRRSSKEIKTTYTHSLGLTSCTESKASGLASGSLNQYLERICWKRSLGNKHLAPFCVHKRELYFPLNCDFDTDTVVKWMWGLNPNGTLVKSYSGLCATVESSEDTINSGGLHSWIATGRKGEVYVAFFNRSEKKAVISAQTSDLAETSVLVSAVKCGEEML

SEQ ID NO: 184887 - protein, 609 aa, Glycine max
  Coding DNA Sequence Number=SeqID_68109
  Homolog annotation: Hit_ID=Q2QTN6; Match level="QueryCoverage=55%, HitCoverage=63%, E-value=6e-44, Identity=34%"; Hit description =Expressed protein
MAETVRLRVVFEDRGMLSKSKKKQGLKRCWFLLKPQHTTISDVASHLLNTFRLHRTCPHGIVLSMDGFVLPSFEFTCILKDKDIVWLLSFRNFSKIEGLQEEESGAEETMSQKDDDDQLEDAVYVESKSDGNVVFKKRKASKKLKSPSQKKIKLSTAENLSVTPKVHEKENGSSEGHEEENGSFDGYIHHQLSLVKKDKKKSSNLSSQPNKSSNLNKQKNDKSDPTSDETRSARRKKAKRRWLRELKLEKEKEKLHQTPVLEKGGQELPINDNNCVVSDVHQQPDEESEEEDDIAPVEIRPGHIRINCFHDLIYVHGLFDADQDQAVPQNQFPVETFQWNGITNKKKGQKWGKERMPFRKQDGYEDSGQDCPTVQNAEKEQTSNVIDFDKLKHYTSLPKEGDVIAYRLIELTASWTPELSSFRVGKISRYDAKSNRIWLEPVLEYPFDFKKKIDEDASSVQYDPSPYQEDGSLEIEYTLLADVRMVKHGIPDLKSDALVNPTKATNDITNEKLAAKAINGSTGEKLAGDQTTVGSCHPERGHITAKENGEVNVWDKINEALKAKKAKLSQEDCWSRGGESSSTRSWSHRAMRCSALGPTMALLRSNNGL

SEQ ID NO: 184888 - protein, 96 aa, Glycine max
  Coding DNA Sequence Number=SeqID_68110
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=98%, HitCoverage=13%, E-value=4e-27, Identity=68%"; Hit description=NADP -dependent malic protein
MSGTIRVHDDLLLAASEALASQVTQEDYDKGLIYPPFSNIRKKISAHIAANVAAKAYELGEPEFSFNSLATRLPQPKDLVKFAESSVYSPVYRGYR

SEQ ID NO: 184889 - protein, 273 aa, Glycine max
  Coding DNA Sequence Number=SeqID_68111
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=99%, HitCoverage=54%, E-value=1e-103, Identity=59%"; Hit description=NADP- dependent malic protein
  Pfam annotation: Domain name=Malic_M; Domain location=139-273; Score =70.3; E_value=6.2e-18; Accession=PF03949.5; Description=Malic enzyme, NAD binding domain
  Pfam annotation: Domain name=malic; Domain location=4-137; Score =188.4; E_value=1.7e-53; Accession=PF00390.9; Description=Malic enzyme, N-terminal domain
  Pfam module annotation: Pfam domain module=Malic_M::malic; Domain location=139-273::4-137
MQLQERNERLFYKLLLDHAEELLPVVYTPTVGEACQKYGSIFVHPQDLYLSLNEKKCLLITIDVGTNNEKLLNDELYFGLRHKRATGQEYAELLHEFMNAVKQNYGERILVQFEDFANHNAFDLLERYRSTHLVFNDDIQGTAQVVLAGLVAALKLVGGDLTDHRFLFLGAGEAGTGIAELIALETSKRGLIVSSRKESLQHFKKPWAHEHEPVKELVNVVKQIKPTVLIGTSGQGRTFTKDVVEAMASINEKPIILSLSNPTSQSECTAEEA

SEQ ID NO: 184890 - protein, 118 aa, Glycine max
  Coding DNA Sequence Number=SeqID_68112
MATGISHRTPHYQSSIQIQRNQIDRGKTLAPLFKGKSKERKKRVKAKTRKFRCVIAYRARSKNQVLAGVGYIVGDNWGLDSSEYRWHDVEVWWGKIGYGDAHHNSGFEVGPIPTGLMC

SEQ ID NO: 184891 - protein, 190 aa, Glycine max
  Coding DNA Sequence Number=SeqID_68113
  Gene Ontology: Mol. function=zinc ion binding
  Homolog annotation: Hit_ID=Q1SDL8; Match level="QueryCoverage=37%, HitCoverage=30%, E-value=2e-20, Identity=55%"; Hit description=Zinc finger, RING-type; RINGv
  Pfam annotation: Domain name=zf-C3HC4; Domain location=95-136; Score =34.9; E_value=2.8e-07; Accession=PF00097.15; Description=Zinc finger, C3HC4 type (RING finger)
MKVSQYMLLVVLVWHSSLCANAQWNNPINYSPFDETNKGGNYSKLRACCCCCYSSSSSQRHNTKLVAATEAIEKCPIFEYSTAKELKVGNGAEECSVCLVEFEDSDTIKMLPKCQHVFHQNCIDTWLPSRMTCPICRQKLTSQDTVIDINDDDVVPMEQLEHDIGTEITESEVAVTDETDTGTVVEQVLV

SEQ ID NO: 184892 - protein, 412 aa, Glycine max
  Coding DNA Sequence Number=SeqID_68114
  Gene Ontology: Mol. function=hydrolase activity; Cellular component =chitin- and beta-glucan-containing cell wall; Biological process =carbohydrate metabolic process
  Homolog annotation: Hit_ID=Q1SDL5; Match level="QueryCoverage=57%, HitCoverage=100%, E-value=1e-113, Identity=81%"; Hit description =Glycoside hydrolase, family 5
  Pfam annotation: Domain name=Cellulase; Domain location=84-372; Score= 10.7; E_value=6e-08; Accession=PF00150.8; Description=Cellulase (glycosyl hydrolase family 5
MGMCILTLLLSHLFWGIFRLGGDSYFGRNWNCRHYSRLTEEFFQNFNFVPPKANFLHVVVEAALSLQQRNLLHHQRHGIERDGKNRIHLKIKGGAYLQRHRNSFITIEDFKFLYKHGINTVRIPVGWWIAYDPDPPSPFIGGSLEALDNAFSWAQEYDIKCIIDLHAAPGSQNGMEHSASRDGFTGWPTSPDYISDSLYVIEFLVSRYARNPALLGIELLNEPSAATVSLDVLISYYKQGYQIVRKYSSSAYVIICQRIGVADPMELYQANIGSHNLVLDLHFYNLFDTFFNNMSAMDNIQYIYKSREGQLQALNNSNGPLILVGEWVNEWNVTNGSQKDYQDFARAQLDVYNAASFGWCYWTLKNDEKHWDFEWSIRNNYLQLGNSPSKRSLNILGLLGLACTWFCLLPFL

SEQ ID NO: 184893 - protein, 676 aa, Glycine max
  Coding DNA Sequence Number=SeqID_68115
  Gene Ontology: Mol. function=protein serine/threonine kinase activity; Biological process=protein amino acid phosphorylation
  Homolog annotation: Hit_ID=Q1T4M8; Match level="QueryCoverage=96%, HitCoverage=90%, E-value=0.0, Identity=72%"; Hit description=Protein kinase-like
  Pfam annotation: Domain name=Pkinase; Domain location=10-295; Score =37.1; E_value=9e-11; Accession=PF00069.15; Description=Protein kinase domain
  Pfam annotation: Domain name=Pkinase_Tyr; Domain location=10-277; Score=-157.1; E_value=0.0078; Accession=PF07714.7; Description =Protein tyrosine kinase
  Pfam module annotation: Pfam domain module=Pkinase::Pkinase_Tyr; Domain location=10-295::10-277
MIQVGNSPWYKVERKLGKGGFGQVYVGRRTGGNLNERTGSGAVEVALKLEHRTSKGCTYGPPYEWQVYNTLGGSHGVPQVHYKGRQGDYYVMVMDMLGPSLWDVWNNSNHHMTTEMVACIAIEAISILEKMHSRGYVHGDVKPENFLLGAPGTPDEKKLFLVDLGLATKWRDSTTGSHVEYDQRPDVFRGTVRYASVHAHLGRTASRRDDLESLAYTLIFLLRGRLPWQGFQNCWSLTLFSQGENKGFLVCKKKMGTSPETLCCFSPLPFKQFVEHVVNLKFDEEPNYAKYISLFDGIVGPNPDIRPINTEGAQKLIGHKRGRLAMEEEDDDQPKKKIRIGLPASQWISVYNARRPMKQRHFKLIHRVIGMIIAHFPILEIKGGEGDSSSHTISWNLFYNLLYHYNVSDTRLSQHIEKGNEDGLYISGVASCQNLWALIMDAGTGFTAQVYELSPFFLHKKTCLLHTFQPTYNSPNNEEEWIMEHWEKNYYISAIAGAVNGSSLVVMSKGTQYLQQSYKVSDSFPFKWINKKWREGFYVTSMATSGSRWGVVMSRGAGFSDQVVELDFLYPSEGIHKRWDCGYRITATAATWDQAAFVLSVPRRKPLDETQETLRTSAFPSTHVKLIRSLLRCHTLLYRRSGQRTSTLLPFATDVQFLNPANVAAAEKHDPGPKKF

SEQ ID NO: 184894 - protein, 1821 aa, Glycine max
  Coding DNA Sequence Number=SeqID_68116
  Gene Ontology: Mol. function=ATP-dependent helicase activity; Cellular component=intracellular; Biological process=SRP-dependent cotranslational protein targeting to membrane
  Homolog annotation: Hit_ID=Q1SDL2; Match level="QueryCoverage=96%, HitCoverage=98%, E-value=0.0, Identity=71%"; Hit description=Von Willebrand factor, type C; Zinc finger, RING-type; Zinc finger, C6HC- type; Zinc finger, ...
  Homolog annotation: Hit description=C2H2-type; ATP-dependent helicase HrpA
  Pfam annotation: Domain name=3H; Domain location=122-206; Score= -31.1; E_value=0.093; Accession=PF02829.5; Description=3H domain
  Pfam annotation: Domain name=DEAD; Domain location=351-506; Score= -25.4; E_value=0.00079; Accession=PF00270.19; Description=DEADDEAH box helicase
  Pfam annotation: Domain name=DUF1605; Domain location=864-977; Score =64.1; E_value=4.5e-16; Accession=PF07717.6; Description=Domain of unknown function (DUF1605)
  Pfam annotation: Domain name=HA2; Domain location=732-828; Score =73.9; E_value=5.1e-19; Accession=PF04408.13; Description=Helicase associated domain (HA2)
  Pfam annotation: Domain name=Helicase_C; Domain location=579-672; Score=67.9; E_value=3.2e-17; Accession=PF00271.21; Description =Helicase conserved C-terminal domain
  Pfam annotation: Domain name=IBR; Domain location=1663-1728; Score =44.9; E_value=2.7e-10; Accession=PF01485.11; Description=IBR domain
  Pfam annotation: Domain name=zf-C3HC4; Domain location=1596-1638; Score=30.1; E_value=7.9e-06; Accession=PF00097.15; Description=Zinc finger, C3HC4 type (RING finger)
  Pfam module annotation: Pfam domain module=3H::DEAD::DUF1605::HA2::Hel icase_C::IBR::zf-C3HC4; Domain location=122-206::351-506::864 -977::732-828::579-672::1663-1728::1596-1638
MKKSSYPNPTPRRHDFHRPPPPTHGCGWAPRPAYHRPYHQWRPRFHPHAARIDRPPEPYFRVELRLGSSPLHRDDVEALIDECHSRHDTFTFYPVDDVAAVLSYRSWEQARDAVVWFWEARLAEKHDFTPTLDSNVVVVKDDVDCRLRPVFARHVKGLTEGKEVKRWMEESERLSKEISRLSSSLSKPLRLGVHNELVEKKKGLVDEKNLVERRLKEFESAMQCLLKYLEGGVDVEGVTVFRFDGGFDWKRIHCLIKRECRRLEDGLPIYAYRSDILQEIHYQQCNYIFPFLLVGKCQLLGEIVDKCHRNCGREDSKILDIAREIGPNVAAIVAAKNLKTEGIFPVSLGLSGICGVYMQIMVLIGETGSGKSTQLVQFLADSGIGTDESIVCTQPRKIAAKSVAQRVQEESIGCYEGQSIKCCSTFSSSREFDSRIAFMTDHCLLQHYMSDNNLSGVSCIIIDEAHERSLNTDLLLTLLKSLLCRRVEMRLIIMSATADAKQLSDYFFACGIFRVLGRSFPVDIKYVPSDYAGDSGSAVVASYVSDVVRMATEVHKTEKEGTILAFLTSQIEVEWACEKFQAPSAVALPLHGKLSSDEQFRVFQNYTGKRKVIFSTNLAETSLTIPGVRYVIDSGLVKDSRFDPGSGMNVLKVCWISQSSADQRAGRAGRTEPGVCYRLYTEADYQSMDLNQEPEIRRVHLGVAVLRILALGVKDVQGFDFVDAPSPSSIDMAIRNLIQLGAIELNNDVHDLTSEGWCLVRMGIEPRLGKLILGCFKHGLGREGIILAAVMANASSIFCRVGNEFDKQRSDCLKVQFCHCDGDLFTLLSVYKEWEALPRERKNKWCWENSINAKSMRRCQDTILELETCLEREHDVVTPSYWRWDPCMPSNHDKNLKRVILFSLAENVAMYSGCNQLGYEVAQTGQHVQLHPSCSLLVFAQKPSWVVFGELLSISNQYLVCVSAFDFQSLYDLCPAPLFDVSKMEERKLLMKTLSGLGCILLKRFCGKANCNLLALVSRIRKACMDERIFIEVNVDNNEIHLYASSNDMDIALGLVNDVLEYERKWLRTECMDKFLYHGSGFSPPVALFGSGAEIKHLELEKRSLSVDVCHPNINEIDDKELLMFFEKNTSGCICAVHKFTGNTRDEDRDKWGRITFMSPDIVRRAAELDGREFCGSSLKVVPSQLGGDKTFSFPAVKARISWPRRLSRGFAIVKCDIKDVDYILRDFYNLAVGGRYVRCEVGKKSMDSVVINGLDKELSEAEISDVLRTATTRRILDFFLVRGEAVGNPPCSALEEALLKEIYPFLPKRNPHISPCRVQVFAPEPKDAFMRALITFDGRLHLEAAKALEQIEGKVLPGCLSWQKIKCQQLFHSSLTFPTPVYRVIKEQLDEVLASFRNLKGLECNLDRTFNGSHRVKITANATRTVAEVRRPLEELLRGKTIEHDSLTPAVLQLMLSRDGFSLKNSLQQETGTYILFDRHNLNLRVFGSPNMVALAQEKVIQSLLSLHEEKQLEIHLRGRDLPPDLMKQMIKNFGPDLHGLKERVPGVDLTLNIRRHIIILHGSKELKPRVEEIVFEIARSSHHLVERFGNGPSCPICLCEVEDGYRLEGCGHLFCRMCLVEQFESAIKNQGTFPVCCTHRDCGDPILLTDLRSLLFGDKLEDLFRASLGAFVATSGGTYRFCPSPDCPSIYRVADPGSAGEPFVCRACYSETCTRCHLEYHPYLSCERYKEFKEDPDSSLIEWCRGKEQVKCCSACGYVIEKVDGCNHVECKCGKHVCWVVTFLLCKLYIMCSKAVQYGCIYPLNEPEERIDYKSISTN

SEQ ID NO: 184895 - protein, 250 aa, Glycine max
  Coding DNA Sequence Number=SeqID_68117
  Gene Ontology: Mol. function=sequence-specific DNA binding; Cellular component=nucleus; Biological process=regulation of transcription, DNA-dependent
MGGKVLNRKSCLEIAKRFSSSSNGAGKTSLSWQQVRLWFKNNQRMLLGKDISSSDLLKISADLAESPLLGNGKGKQAAALDDLGFEARSTKDIAWHDVSMFLNYRVLSTGELEVRVRYAGFGKEQDEWMNVKLGVRERSIPLEPSECHKVKDGDLVLCFLEREDYALYCDARIVKIHRKIHDPTECTCTFIVRFVHDNTEVKSSILTLSDVVSYAHARKEFLLTGYAVGLHKRNLLATQILPLIPPQVPP

SEQ ID NO: 184896 - protein, 121 aa, Glycine max
  Coding DNA Sequence Number=SeqID_68118
MIKDSEIFNSMSLYAKCNEINYSQSASQVEQPSTNLGITPTPNVESALAQIPTTTQSVPTPSVETIFILPSMLTAFRLAPVRPPTPIRIIFPDKASYNKNQPNYTSFILIPRLPSHRDSKK

SEQ ID NO: 184897 - protein, 358 aa, Glycine max
  Coding DNA Sequence Number=SeqID_68119
  Gene Ontology: Mol. function=catalytic activity; Biological process =carbohydrate metabolic process
  Homolog annotation: Hit_ID=Q1SGA9; Match level="QueryCoverage=40%, HitCoverage=40%, E-value=9e-32, Identity=45%"; Hit description=Zinc finger, RING-type; RINGv
  Pfam annotation: Domain name=PHD; Domain location=199-244; Score= -2.4; E_value=0.099; Accession=PF00628.19; Description=PHD-finger
  Pfam annotation: Domain name=zf-C3HC4; Domain location=200-241; Score= 31.2; E_value=3.6e-06; Accession=PF00097.15; Description=Zinc finger, C3HC4 type (RING finger)
  Pfam module annotation: Pfam domain module=PHD::zf-C3HC4; Domain location=199-244::200-241
MALSVICSSKGNVLSESNILVVSCVVLNGLASFVIVEGLHDGSKARDVNLGGWLVIEGWMIKPSLFGGTANGDMLVQFKSGTLQKYVSAENGGEMNNLTICVFIIVIASTACVIMFLITLSKILSYYYARRYNVSRSNPPILFDIRGDFPFSDDEEQEQAIRHPIWFIPTEGLQQSIIDSITVCKYRKDEGLAKETLTECLVCLGEFQQEESLRVLPKCNHAFHISCIDTWLRSHKSCPLCRAPIVLDAASLLRYGWDLFLLNGHVHSYYAVVSSLLGYIQGLHGGSKVRGVNLGGWLVIEGWIKPSLFDGIANGDMLDGTEVQFKSVTLHKYVSAENGGGMNVTVDRDVPSSWETFR

SEQ ID NO: 184898 - protein, 50 aa, Glycine max
  Coding DNA Sequence Number=SeqID_68120
MWDRHRLKGVLIPGVFTPKAYTPKSPSGPLSPDSDTAHKLYNTHDLTLVF

SEQ ID NO: 184899 - protein, 105 aa, Glycine max
  Coding DNA Sequence Number=SeqID_68121
GLRHRSSPHPQGSVAGSASVQLCSSWHWRARCDVGEGGGERERKSVNFNSIAKRVVANTNNNNDENLEKKTSEFQKFLQVSAKEHDRVQRIQVINRAIAAARQLL

SEQ ID NO: 184900 - protein, 320 aa, Glycine max
  Coding DNA Sequence Number=SeqID_68122
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=75%, E-value=1e-104, Identity=58%"; Hit description =Integrase, catalytic region
  Pfam annotation: Domain name=rve; Domain location=56-212; Score=85.1; E_value=2.1e-22; Accession=PF00665.16; Description=Integrase core domain
MSGHMGDTNTMRRLKDQFFWDNMSRDIHQLISECRVCQQTKTECRKPVGLLQPLPIPTGIWEDLSMDFVTGLPPFHGFTTILVVVDRFSKGTHLGALPPKYSAHKVVGLFIDIVCKLHGFPRSLVSDIDLLFLNAFWRELFPISGTKLRYSTAYHPESDGQIEVLNRTLEQYLCSFVHDRPALWFSFLSLVEWNYNTSTHSGTGLSPYEVTYGKPPPTLPQYIPGTSCIEAADSIITTKQAVHSKLQQRLLKAQTLMKTYVDRHRWDVQFQVGDWVYVRLRPYRQLSLRPHYSKLAKRFYGPYLVVEKIGTVAYRLQLSA

SEQ ID NO: 184901 - protein, 164 aa, Glycine max
  Coding DNA Sequence Number=SeqID_68123
MPVLRSGARKGRAAAKQQQQEQQQQQQKQQQQQHSPVVEGEAIATRTRRRRAAAAAAAAVPESNNNNNNNNTNNQQQQPEQVAVVNENVAIAVREEENNRVAEEGVVGGGGAEREGVAEKEMGGCDSGGPSNDKANAAGEDDANAPQVPEKCSGLIFSLAFSSL

SEQ ID NO: 184902 - protein, 522 aa, Glycine max
  Coding DNA Sequence Number=SeqID_68124
  Gene Ontology: Mol. function=transferase activity, transferring glycosyl groups; Cellular component=membrane
  Homolog annotation: Hit_ID=Q7XJ98; Match level="QueryCoverage=82%, HitCoverage=69%, E-value=1e-142, Identity=54%"; Hit description =Xyloglucan galactosyltransferase KATAMARI1
  Pfam annotation: Domain name=Exostosin; Domain location=60-410; Score= 534.9; E_value=8.7e-158; Accession=PF03016.6; Description=Exostosin family
MEKWCVISPSCYDNHHLCFAIFLSFLFSSLLLSFHGPNLPFLVKPSKTISVTDSCIGRYVYIHQLPSRFNNYFLKNCQFLTRGTDKPNMCPYMLNMGLGPQIPNSQGLFSNNTCYATNQFLLEVIFHNRMSQYACLTNDSSLASAIFVPFYAGLDVSRFLWLSNLTERDSSGRDLLQWLAKRPEWKKMRGRDHFLVSGRIAWDFRRQYDDESYWGSKFRFLPESMNMSMLAVEASSWNNDYAIPYPTSFHPSEDTHVFQWQRKIRHQKRPYLFTFTGAPRPELEGSIRGKIIDQCRASSVCKFVDCSYGVQRCDDPISVIKVFGSSVFCLQPPGDSYTRRSIFDSMLAGCVPVFFHPGTAYSQYKWHLPKNRTKYSVYIPVKDVKQWNVNVEQVLRGIPEGEVFAMREEVIKLVPNIIYADPRSKLDCFTDAFDLAVKGMVERIEKVREEMRSGRDPSIGFADEDHYNVTGIERHGHGMHVRLMKFPVITFRHSHSQSHKRSRPHLIPSPVSPPAIKVPFHH

SEQ ID NO: 184903 - protein, 257 aa, Glycine max
  Coding DNA Sequence Number=SeqID_68125
  Gene Ontology: Mol. function=protein methyltransferase activity; Cellular component=cytoplasm; Biological process=protein amino acid methylation
  Homolog annotation: Hit_ID=Q2KIJ2; Match level="QueryCoverage=52%, HitCoverage=36%, E-value=2e-18, Identity=38%"; Hit description =Uncharacterized protein C1orf156 homolog
MAAAANSEGNAQKPSSETFQLFSSSASAFGIFDDAAQQVPPIPPPPCVEVLASEVPSSLKHNVDSVNLDGVILLKFPGNMKVLPFSVYSPIPISFMTKSVAATLVSFGLGGLKLWEGSLDLIKALRSDIKNGLISFAGKRVLEVGCGHGLPGIFAFLEGAAAVHFQDFNAEVLRCLTIPNLKANLSGESQPSSSNSTICDEAEVRFFAGDWSGIDKLLPHVTTDAKHNQGDGYDFILMAETVYSINSLQNLYNLIKK

SEQ ID NO: 184904 - protein, 55 aa, Glycine max
  Coding DNA Sequence Number=SeqID_68126
MAAWRGVGDGRLIITTLDRAAGGYVWFMRVNVEQELEVILSESCEKECLVGVKCM

SEQ ID NO: 184905 - protein, 420 aa, Glycine max
  Coding DNA Sequence Number=SeqID_68127
  Homolog annotation: Hit_ID=Q9LK76; Match level="QueryCoverage=95%, HitCoverage=92%, E-value=5e-58, Identity=38%"; Hit description =Arabidopsis thaliana genomic DNA, chromosome 3, P1 clone: MDC8
  Pfam annotation: Domain name=IQ; Domain location=121-141; Score=30.5; E_value=5.7e-06; Accession=PF00612.17; Description=IQ calmodulin -binding motif
  Pfam annotation: Domain name=IQ; Domain location=143-163; Score=16.9; E_value=0.075; Accession=PF00612.17; Description=IQ calmodulin -binding motif
  Pfam module annotation: Pfam domain module=IQ::IQ; Domain location =121-141::143-163
MGRATRWVKSLFGIRREKEKKLNFRCGEAKSMELCCSESTSNSTVLCHNSGTIPPNLSQAEAAWLQSFCTEKEQNKHAIAVAAATAAAADAAVAAAQAAVAVVRLTSQGRGRTMFGVGPEMWAAIKIQTVFRGFLARKALRALKGLVKLQALVRGYLVRKLATATLHSMQALVRAQARMRSHKSLRPMTTKNEAYKPHNRARRSMERFDDTKSECAVPIHSRRVSSSFDATINNSVDGSPKIVEVDTFRPKSRSRRAISDFGDEPSLEALSSPLPVPYRTPTRLSIPDQRNIQDSEWGLTGEECRFSTAHSTPRFTNSCTCGSVAPLTPKSVCTDNYLFLRQYGNFPNYMTSTQSFKAKLRSHSAPKQRPEPGPRKRISLNEMMESRNSLSGVRMQRSCSQVQEVINFKNVVMGKLQKST

SEQ ID NO: 184906 - protein, 114 aa, Glycine max
  Coding DNA Sequence Number=SeqID_68128
MGNARFLKEVKFEREENMRNVVFEEEPIIYSDQVLIPIPTQDINLVIENNVQTIIDDILLEQDNNEDDVGLIEDPINFYQAMHNSYSQNWINAMKDEMKSMKDNNVWDLVELSE

SEQ ID NO: 184907 - protein, 59 aa, Glycine max
  Coding DNA Sequence Number=SeqID_68129
MMYQYSFRTLKLVIASLSPTTTSDLFALLTSSVALQGANADKNKIQIKERGDKGNNSNK

SEQ ID NO: 184908 - protein, 222 aa, Glycine max
  Coding DNA Sequence Number=SeqID_68130
MTTESGGNNWRHQQRVVNGTRRSETQRRRGRTNNIIEIKRRHGNLQRKKRELMMEVTKDEAATPGSGGAQPPNPISNGNPNPNPNPNPNMPHTPRGSKGKSCKGCTYYTSLHKAKSKNPTCVGFSRALQQVPPFVVGETELEASKEGRSLANFKYACIGYSVYLDNKDSSAGSQDKTAKLPFCVGLEVVLVEKASNSDAGHVPATHKTDGIEILGFYFYLQF

SEQ ID NO: 184909 - protein, 146 aa, Glycine max
  Coding DNA Sequence Number=SeqID_68131
  Homolog annotation: Hit_ID=Q1SDK5; Match level="QueryCoverage=40%, HitCoverage=8%, E-value=1e-27, Identity=98%"; Hit description=LMBR1 -like conserved region
MWVFYLISLPLTTGMVLFTLRYFAGPDVPRYVLFTVGYTWFCSLSIIILVPADIWAEIAVVMWLRSVDCFLKPQALPEKQCLVGRVNCFYDTCRQCLLTKRMELFHSSGAGPIGVHFYLLGMLQCYMFASLSHPFVYFKVQTYCIV

SEQ ID NO: 184910 - protein, 478 aa, Glycine max
  Coding DNA Sequence Number=SeqID_68132
  Gene Ontology: Mol. function=peptidase activity; Cellular component =integral to membrane; Biological process=proteolysis
  Homolog annotation: Hit_ID=Q5JKV3; Match level="QueryCoverage=93%, HitCoverage=65%, E-value=1e-138, Identity=54%"; Hit description =Putative glutamate carboxypeptidase
  Pfam annotation: Domain name=PA; Domain location=137-241; Score=49.1; E_value=1.5e-11; Accession=PF02225.12; Description=PA domain
  Pfam annotation: Domain name=Peptidase_M28; Domain location=340-473; Score=-44.5; E_value=0.0082; Accession=PF04389.7; Description =Peptidase family M28
  Pfam module annotation: Pfam domain module=PA::Peptidase_M28; Domain location=137-241::340-473
MKTSTTTTTTILAIATSYLFLLITPTQKSTYHSLFISDSLSDNASIYNHLKTLTRRPHVAGSKANAEAASYVVSVFTSSYIPSHIVSYEVSLTYPLSRSLVLITNPSTTFTLHQETYEGDPYADVADEVVPTFHAYAKSGTVAAPVCYVNYGRVEDYLTLKDKNGVNVSGTVVLARHGKIYRGDIVKNAYEEGAVGVVIYSDRKDYGGEEKWFPDEKWLPPSGVQVGTVYGGLGDPTTPGWASSSSGDGECERLNKDEVEKGGDVPLIPSLPVSAADGEKIMRSIGGPVAEDDWQGSKDAPIYRLGPGPGILNLSYKGQDVIATIQNVIGVIEGAEEPDRFVILGNHRDAWTFGAVDPNSGTAALLEIGSTEWVEENREILASKAVAYLNADCVVGGPGFNVRATPQLDELIKRATQEVKDPDNSSQSIYESWTSSGSSPLFGRLGGGGSDYASFLQHVGIPAADIAFGGGNRQNSLF

SEQ ID NO: 184911 - protein, 923 aa, Glycine max
  Coding DNA Sequence Number=SeqID_68133
  Homolog annotation: Hit_ID=Q9LKK8; Match level="QueryCoverage=39%, HitCoverage=91%, E-value=1e-148, Identity=69%"; Hit description =Putative 7-transmembrane G-protein-coupled receptor
  Pfam annotation: Domain name=LANC_like; Domain location=62-403; Score= 312.5; E_value=7.3e-91; Accession=PF05147.3; Description=Lanthionine synthetase C-like protein
MTSSVVEGGRDEGKHEPSDLITETMNLTAPNLSLPSETETFLSAAISLKDKVVEETWNRRDQVVDPTVYTGLLGTAFTCLRSYQVTGCRNDLILSSEIIDTCVTAARASLRGGVYALGAVVANYMGDLQKRDLFLGLFIEVAKERALPVGPEEGGFGMSYDLLYGRAGFLWGALFVNKHLGEDAVPKDILMLIIDAVLAGGRAGASDIKDCPLMYRWHGTRYLGAANGLAGILHVLLHFPLPSEDAEDVKGTLWYLMSKRFPHSGNYPSSEGNPRDKLVQWGHGATGMAITLSKAAEVFPNDRELRDAAIEAGEVVWKSGLVKKVGLADGVSGNAYAFLSLYRLTKESIYEERAKSFASFLYDNAKSLAAANGYSLFQGLAGTACLWFDLLAPDNSRFPVRLQHDGERKRRERAFPAEQRECVDMETSRESLSIKHVMSRNGYIDCLTHGKVEHDSYFWSLGGNNAFIAYDYESNYLNFLVSSERVLKESCVSGAVYVSSLPHPLGFKVVVQQYAFASEGVSLDVQVCDKGKWFVSCKDVPMSLRNVVFPSMFPNGGNYQDVVDTENPVMHEFTEEVSDFPLERFMRLLPHDQNTGAFFIAVLQKVSPLPDNEDAQELQVNPLESTPEEISEANINDNGPNTDLKVSSATFEEVDFKAAQDPCNVENITKNTPGKRKLQIQGKWRGIDPVVFFKDEVVINSIKEFYAIDEQFPFNGHLVTRNSDTSHMKRIYYISKSVKDVLELNFSVGQQLKITSVGLKIFERQTSCEGRSAPCAFRITSEGLPLILPHISKQILSSSAIDFKHLLQYRAVKFADFVDAKFGERAANLMPGCCVVVLGSRGAAWPLQVDESTIAIGCWKGRASLTVMVGALECQELLERLIMRLEKVTEKDSSMHKNRPSDNKGDEAQESNGKNEDVEITGC

SEQ ID NO: 184912 - protein, 100 aa, Glycine max
  Coding DNA Sequence Number=SeqID_68134
  Gene Ontology: Mol. function=DNA binding; Cellular component=nucleus; Biological process=regulation of transcription
  Homolog annotation: Hit_ID=Q0GYP2; Match level="QueryCoverage=99%, HitCoverage=25%, E-value=7e-33, Identity=75%"; Hit description=LEAFY- like protein
  Pfam annotation: Domain name=FLO_LFY; Domain location=1-100; Score= -255.3; E_value=0.036; Accession=PF01698.7; Description=Floricaula Leafy protein
MDLDAFTASLFKWDPCTVLPPTAPPRPLLLEYAIAPSLVTLAFHPARAAAPRELRGLEELFQAYEICYYTAAKIAELGFTVSTLVDMKDEELDDMMNNLS

SEQ ID NO: 184913 - protein, 85 aa, Glycine max
  Coding DNA Sequence Number=SeqID_68135
  Homolog annotation: Hit_ID=O65510; Match level="QueryCoverage=80%, HitCoverage=6%, E-value=1e-10, Identity=52%"; Hit description =Putative receptor protein kinase
MVNESEIVIFLKQARGNLARELVVGKVYQLKLREVCNGAQNLVKESVRRDVEGSEAEGEFVKDVAKDVVLHGAKNLKADEVRDLH

SEQ ID NO: 184914 - protein, 355 aa, Glycine max
  Coding DNA Sequence Number=SeqID_68136
  Gene Ontology: Mol. function=nucleoside-triphosphatase activity; Cellular component=membrane; Biological process=defense response
  Homolog annotation: Hit_ID=Q19PJ3; Match level="QueryCoverage=45%, HitCoverage=9%, E-value=4e-41, Identity=52%"; Hit description=TIR -NBS-LRR type disease resistance protein
  Pfam annotation: Domain name=TIR; Domain location=34-170; Score =141.9; E_value=1.7e-39; Accession=PF01582.10; Description=TIR domain
MSSFPRYDFDLHDDEMEMDFLRERYQEDNRNYDVFLSFRGEDTRASFTSHLYTALHNEGVFVFKNDETLPRGNQISPSLRLAIEESRISVVVFSTNYAESRWCLKMLENIMECQRTTGQVVVPVFYGVYPSKVRHQTGDFGKAFRNLEENRLLKVKEEKLLPWWKTLAEAAGISGLSVVRNCNGREALRDKIDLLVEHWREALREAAGILGGSVSELGKMDIANLIDYFVGHWKDGLRVAARFPRGNKACPGDKPPREALEGGTLGALWHIRGVEEGIRKDFEVHVSSVEEVIIKDFEVLVIHWTEALHEAAAILRAFAYYCGGGCVIVKVFVAGGYCDGRITCEGEEDQKGGNE

SEQ ID NO: 184915 - protein, 88 aa, Glycine max
  Coding DNA Sequence Number=SeqID_68137
  Homolog annotation: Hit_ID=Q1S7S0; Match level="QueryCoverage=50%, HitCoverage=3%, E-value=8e-11, Identity=68%"; Hit description =Integrase, catalytic region; Peptidase aspartic, catalytic
MAKLTIIQFKLLALASINNWFIHQLDVNNAFLHGNLKEDVYVQVPQLSGKNKLIPLLLVYVDDIVIVGNSMDMITSFKQILDNQFGHS

SEQ ID NO: 184916 - protein, 81 aa, Glycine max
  Coding DNA Sequence Number=SeqID_68138
  Subcellular localization annotation: CTP_CleavageSite=35; ConfidenceScore=5.51e-01
MWDDPTVTFRGPSKARGKRSKVPTTSTPPEIVAPSSSTAPVPPIQTPVIPAPSTQIPLPAPFPFQLPAPLSAGPSDFSFTQ

SEQ ID NO: 184917 - protein, 76 aa, Glycine max
  Coding DNA Sequence Number=SeqID_68139
MSNSEFQAKCIGEAEDKYASLLKSLDPHLSLSYQKRCAEATKEGGKVSEHPLGTWSIPTVIQDEELYRLKLKSDIS

SEQ ID NO: 184918 - protein, 1377 aa, Glycine max
  Coding DNA Sequence Number=SeqID_68140
  Gene Ontology: Mol. function=protein kinase activity; Cellular component=cellular_component; Biological process=protein amino acid phosphorylation
  Homolog annotation: Hit_ID=Q6KAK1; Match level="QueryCoverage=98%, HitCoverage=89%, E-value=0.0, Identity=49%"; Hit description=Protein kinase-like
  Pfam annotation: Domain name=HEAT; Domain location=520-556; Score =29.6; E_value=1.1e-05; Accession=PF02985.12; Description=HEAT repeat
  Pfam annotation: Domain name=HEAT; Domain location=565-601; Score =11.2; E_value=1.8; Accession=PF02985.12; Description=HEAT repeat
  Pfam annotation: Domain name=HEAT; Domain location=688-724; Score =6.0; E_value=7.9; Accession=PF02985.12; Description=HEAT repeat
  Pfam annotation: Domain name=HEAT; Domain location=727-763; Score =17.3; E_value=0.056; Accession=PF02985.12; Description=HEAT repeat
  Pfam annotation: Domain name=HEAT; Domain location=768-803; Score =6.9; E_value=6.2; Accession=PF02985.12; Description=HEAT repeat
  Pfam annotation: Domain name=Pkinase; Domain location=27-293; Score =11.6; E_value=3e-09; Accession=PF00069.15; Description=Protein kinase domain
  Pfam annotation: Domain name=Pkinase_Tyr; Domain location=27-291; Score=-122.8; E_value=6.2e-05; Accession=PF07714.7; Description =Protein tyrosine kinase
  Pfam annotation: Domain name=WD40; Domain location=1111-1149; Score =43.7; E_value=6.5e-10; Accession=PF00400.22; Description=WD domain, G-beta repeat
  Pfam annotation: Domain name=WD40; Domain location=1159-1197; Score =7.4; E_value=5; Accession=PF00400.22; Description=WD domain, G-beta repeat
  Pfam annotation: Domain name=WD40; Domain location=1262-1298; Score =7.9; E_value=4.4; Accession=PF00400.22; Description=WD domain, G -beta repeat
  Pfam module annotation: Pfam domain module=HEAT::HEAT::HEAT::HEAT::HEA T::Pkinase::Pkinase_Tyr::WD40::WD40::WD40; Domain location=520 -556::565-601::688-724::727-763::768-803::27-293::27-291::1111 -1149::1159-1197::1262-1298
MGNKIARTTQVSASEYYLHELPSTYNLVLKEVLGRGRFFKSIQCKHDEGLVLVKVYFKRGDFLDLSDYERRLSQIKHIFTSIDHPHVWPFQFWQETDKAAYLLRQFFFHNLHDRLSTRPFLSLVEKKWLAFQLLVAVKQCHENGVCHGDIKCENVLITSSNWLYLADFASFKPTYIPYDDPSDFSFFFDTGGRRLCYLAPERFYEHGGEMQVAQDTPLKPYMDIFAVGCVVAELFLEGQPLFELSQLLAYRRGQYDPSQHLEKIPDLGIRKMILHMIQLEPESRFSAERYLKEYAAVVFPIYFSPFLHDFYRCWSPLHSDMRVLLCQSAFPEILKQMMNNKSYDDAGVNSGELLENMVAKESVSFMNDSLMKREDIGKGLVHDHYELLGDINSLLRDAKKNNNQSHVAENAHNSTFPENLKNLQTGKLLQTISNAFRGNDHPFLKSVTMNDLNSLMSEYDSQSDTFGMPFLPLPKDSMRCEGMVLITSLLCSCIRNVKLPHLRRAAVLLLKASALYIDDEDRLQRVIPYVIVMLSDSAAIVRCAALETLCDILPLVRDFPPSDAKIFPEYILPMLSMLPDDPEESVRICYASNIAKLALTAYGFLIHSICLSEAGVLDELSSPQKPLTSSTHSSGRLKRINGDAQLLQLRKSIAEVVQELVMGPKQTPNIRRALLQDIGKLCCFFGVRQSNDSLLPILPAFLNDRDEQLRTVFYEKIVYVCFFVGQRSVEEYLLPYIEQALSDVTEAVIVKAVECMTILCKSGFFRKRILLQMIERAFPLLCYPSEWVRRSVVSFIAASSENLGAVDSYVFLAPVIRPFLRRQPVSLASEKALLSCLKPPVSRQVFFEVLENSRSSDMLERQRKIWYSSSQSKLWEIDLLKKGIDELDSLKNWSDKQQGHGVQQTVGTAFQQPGITGCDKAEAKLRDMGAFMHNDSNNVVHRDTQCSEKLQFSGFMSPHFSGMNSLTYEKPSEGIPLYSFSVDRRGMGIPPAASDPPLPMNSLGVSSSAMPWVNPLSKSFNLANSVPAPKLFSGSFSISNGSKQFHRVVHEPEARENETAYVNNTFQDVGLSANIKGTSIALEDATSQTDLSGFPSFARASIPDSGWRPRGVLVAHLQEHLSAVNDIAISADHSFFVSASDDSTVKIWDSRKLEKDISFRSKLTYHMEGSRVLCATMLPGSAQVIIGASDGFIHMFSVDHISRGLGNVVEKYSGIADITKKDIKEGAILNLLNCPVDNYTIMYSTQNCGIHLWDTRSNSNTWTLKATPEEGYASSLASGPCGNWFVSGSSRGVITLWDLRFLIPVNSWQYSLACPIEKMRLFLPPSNASVSSAARPLVYVAAGCNEVSLWNAENASCHQIIKAICGRTKCSTNKYSS

SEQ ID NO: 184919 - protein, 125 aa, Glycine max
  Coding DNA Sequence Number=SeqID_68141
MASFNSIQNSTTPILLITILITFLLHHLLCPVSCFNQPQHAIPPPDPLCEEKNRLGSMPPTCHNKCNRCHPCMAVQVPASPSHERVHPGLAPTAAMEVFFLQGNRYSNYKPLSWKCHCGDHFFNP

SEQ ID NO: 184920 - protein, 739 aa, Glycine max
  Coding DNA Sequence Number=SeqID_68142
  Gene Ontology: Mol. function=DNA-directed RNA polymerase activity; Cellular component=membrane; Biological process=transcription
  Homolog annotation: Hit_ID=Q9FKF1; Match level="QueryCoverage=84%, HitCoverage=54%, E-value=0.0, Identity=74%"; Hit description=DNA -directed RNA polymerase subunit
  Pfam annotation: Domain name=RNA_pol_Rpb2_3; Domain location=17-82; Score=96.6; E_value=7.6e-26; Accession=PF04565.7; Description=RNA polymerase Rpb2, domain 3
  Pfam annotation: Domain name=RNA_pol_Rpb2_4; Domain location=118-180; Score=81.7; E_value=2.2e-21; Accession=PF04566.3; Description=RNA polymerase Rpb2, domain 4
  Pfam annotation: Domain name=RNA_pol_Rpb2_5; Domain location=200-240; Score=62.2; E_value=1.7e-15; Accession=PF04567.7; Description=RNA polymerase Rpb2, domain 5
  Pfam annotation: Domain name=RNA_pol_Rpb2_6; Domain location=245-594; Score=478.0; E_value=1.2e-140; Accession=PF00562.18; Description=RNA polymerase Rpb2, domain 6
  Pfam annotation: Domain name=RNA_pol_Rpb2_7; Domain location=596-663; Score=38.2; E_value=8.5e-09; Accession=PF04560.10; Description=RNA polymerase Rpb2, domain 7
  Pfam module annotation: Pfam domain module=RNA_pol_Rpb2_3::RNA_pol _Rpb2_4::RNA_pol_Rpb2_5::RNA_pol_Rpb2_6::RNA_pol_Rpb2_7; Domain location=17-82::118-180::200-240::245-594::596-663
  Subcellular localization annotation: CTP_CleavageSite=48; ConfidenceScore=5.13e-01
MDRFSIAAIAAAIAAVQVLQRLSFIGALGHMTRVSPQFEKSRKVSGPRALQPSQWGMLCPCDTPEGESCGLVKNLALMTHVTTDEEEKPLISLFYSLDVARIEHLFAEELHTPDSFLVIFNGLILGKHRRPLHFATRIRKLRRAGEIGEFVSVYVNEKQHCVYLASDGGRVCRPLVIADKGISRIKQHHMKELMDGVCTFDDFLRDGLLEYLDVNEENNALIALYEGDATSETTHIEIEPFTILGVIAGLIPYPHHNQSPRNTYQCAMGKQAMGNIAFNQVGYDKLGAGQNATVAVMSYSGYDIEDAIVMNKASLDRGFGRCIVMKKYNAIIQKHSNDTSDRILRPNRTADTAGRMQILDDDGIAAPGEILRPYDIYINKQSPIDTRTPKTGSAANLPDSAYRSNAQSFKGNGGEVVDRVVLCSDKDNNMCIKFLIRHTRRPELGDKFSSRHGQKGVCGTIVPQEDFPFSEKGICPDLIMNPHGFPSRMTVGKMIELLGGKAGVSCGRFHYGSAFGERSGHADKVETISETLVSKGFNYSGKDFIYSGLSSRNLPVYKFTSNSCGVEQVLDKMHARGSGPRVMLTRQPTEGRARNGGLRVGEMERDCLIAYGASMLIYERLMLSSDPFEVQASYIIGFIIDYHLVDVETMFYGLGSGREESGDIEEGDIGMAPIEEKMTENRVSGLACLRRPMEAPMRNINYMVFSPVKRGRGRPRRTLEEVVKKDFMDILELDIYSYM

SEQ ID NO: 184921 - protein, 409 aa, Glycine max
  Coding DNA Sequence Number=SeqID_68143
  Gene Ontology: Mol. function=selenium binding
  Homolog annotation: Hit_ID=Q93WS1; Match level="QueryCoverage=98%, HitCoverage=89%, E-value=0.0, Identity=82%"; Hit description =Selenium binding protein
  Pfam annotation: Domain name=SBP56; Domain location=1-409; Score =1037.1; E_value=0; Accession=PF05694.2; Description=56kDa selenium binding protein (SBP56)
MIEYNTGTGIEKPDYLATVDVDPNSPTYSKVIHRLPVPYLGDELHHTGWNSCSSCHGDPSADRRFLIVPALVSGRVYVVDVKTNPRAPSLHKVVEPADIIQKTGLAYPHTSHCLASGDIMISCLGDKDGNAAGNGFLLLDSEFNVKGRWEKPGHSPLFGYDFWYQPRHNTMISTSWGAPSAFTKGFNLQHLSDGLYGRHLHVYSWPGGELRQTMDLGDSGLIPLEVAISVKPLKVQNWILPEMPGLITDFLISLDDRFLYFVNWLHGDIRQYNIEDVKNPKLTGQVWVGGLIQKGSPVVAITDDGETWQAEVPEIQGNKLRGGPQMIQLSLDGKRLYATNSLFSTWDKQFYPELVQKGSHIIQIDVDTEKGGLKINPNFFVDFGTEPDGPSLAHEMRYPGGDCTSDIWI

SEQ ID NO: 184922 - protein, 95 aa, Glycine max
  Coding DNA Sequence Number=SeqID_68144
  Gene Ontology: Mol. function=aminoacyl-tRNA ligase activity
  Homolog annotation: Hit_ID=Q7XJM9; Match level="QueryCoverage=69%, HitCoverage=17%, E-value=4e-12, Identity=55%"; Hit description =Putative methionyl-tRNA synthetase
  Pfam annotation: Domain name=tRNA_bind; Domain location=2-78; Score= -18.8; E_value=0.012; Accession=PF01588.10; Description=Putative tRNA binding domain
MEHPSADSLLVEEDKVRQNRCVVLITNVKPGKLRDVMSQGLVLMLHLLNCFAVLCASNEGPTIVEPLLLHKDHKLGRYFFFWLDVGNDQVKVETD

SEQ ID NO: 184923 - protein, 160 aa, Glycine max
  Coding DNA Sequence Number=SeqID_68145
  Gene Ontology: Mol. function=heat shock protein binding; Cellular component=chloroplast thylakoid membrane; Biological process =response to heat
  Homolog annotation: Hit_ID=Q9SJZ7; Match level="QueryCoverage=63%, HitCoverage=23%, E-value=4e-14, Identity=47%"; Hit description =Putative DnaJ protein
  Subcellular localization annotation: CTP_CleavageSite=80; ConfidenceScore=5.54e-01
MAIAPFGNTSATQWGIHPQIFAGSTGLGKIASSRNNVTSRIRFMVAPCSSFFSCHSLHALFDKGSSQTLQHRRGSRLIVRADADYYSVLGVSRNSSKSEIKNGTVSLGGAVTTVNPTSTAAYMCAICRSLKLRMGNINDQEDDDRGLSEAARSYHPDVNK

SEQ ID NO: 184924 - protein, 160 aa, Glycine max
  Coding DNA Sequence Number=SeqID_68146
MEDWGNFLHQVLEEDYEDSTSIKVFLLVWGLGVKQWQLAATTGGRGCWRRSELFSLSRSPLFTLRATIRASRNSLCTRVHLEGQKSLSATPFWVGIALSAPLLAHHNSLSGCYRKSVSLAIQAKVNVQRREGLSLTGGRSLTGQKEHPNVKPNQPMKASV

SEQ ID NO: 184925 - protein, 140 aa, Glycine max
  Coding DNA Sequence Number=SeqID_68147
MSFSTSETPLPVRTLDFVSECLTVSMSKALAFLALLFLHRKMKRDRAIEKVVGDVELVEDEFVQVRDWVGELVVFEKQSFLAGEAIEGGGKGPEEVVETHVQANQYAKESDTGEVKLNNVVRLRTKAATMNDVEAYVYSD

SEQ ID NO: 184926 - protein, 78 aa, Glycine max
  Coding DNA Sequence Number=SeqID_68148
MNNVTCRGFCVGAEGLVDEVNDNDVVRVGGCGGGCGGGEGVWGSEVGSEIVEGDREKRSDRCRRSWGRGGGWFCRQRR

SEQ ID NO: 184927 - protein, 302 aa, Glycine max
  Coding DNA Sequence Number=SeqID_68149
  Gene Ontology: Mol. function=nucleic acid binding; Cellular component= intracellular; Biological process=chromatin modification
  Homolog annotation: Hit_ID=Q6YXC5; Match level="QueryCoverage=73%, HitCoverage=61%, E-value=2e-49, Identity=50%"; Hit description =Putative zinc finger protein ID1
  Pfam annotation: Domain name=zf-C2H2; Domain location=144-166; Score =31.9; E_value=2.2e-06; Accession=PF00096.16; Description=Zinc finger, C2H2 type
  Subcellular localization annotation: CTP_CleavageSite=63; ConfidenceScore=5.33e-01
MSNSISDPTRIIHSQDPNTTADPQVPLRNLSQVRNRMDSLQHFLSQSINTNTPLTVDQIAMVSSQILSSIHQVIVNGAALVSYSQNSIAAGAPDPPPYPKKPKPEPSVADKAKQTLDSKLEPLEGDDSEIVELDAVEILAEHMHFCEICGKGFRRDANLRMHMRAHGEQFKTAEALAKPSEKASLQPEQAPPAVPAAEIGDLREEPLQAKPLPEDVHVRAVSQEALLGALGFEEPLEALRRRGQGHAPALACDSEGKGKQMVEDDEDPMLMSESGFELDDCFLDQEFPEGFFDDFGSIDDYC

SEQ ID NO: 184928 - protein, 157 aa, Glycine max
  Coding DNA Sequence Number=SeqID_68150
  Homolog annotation: Hit_ID=O24454; Match level="QueryCoverage=27%, HitCoverage=11%, E-value=1e-16, Identity=88%"; Hit description =Ubiquitin carboxyl-terminal hydrolase 3
MAAMADFLPTAIGNLRREARHGRAIDHNGVFIWPNFGLPPLITLFDRLLMSKHNSSGLEVLFTQLKDLQNAVAVTSIAKILEAKVTLSFGELVAESLLELGARSTHERVEPITATQIFIRFNSASRIAQHQIARVCRAKENADGGRKNGENGKKNGV

SEQ ID NO: 184929 - protein, 234 aa, Glycine max
  Coding DNA Sequence Number=SeqID_68151
MWNNFPALMEKKGWKSLNESHKEHQIREFVDGNGNVAVGLKLHNKPSNDGLNRQFPLEIPPILFEETSLPAGLHGSHTKDVYSISVLPEEDENANCASPLPFLSILGVPNQVKSPMCLDDPINCQNCIDFQMKNEGVYSQCIIDIPSVNGNSVSPESYEEAVEGFKTGNSPTSVLWRESSFKAGKLMQSLVNVSNPRDKPVSEKLHDLPSNRWRKYKRAASFDSRKVALLFSIL

SEQ ID NO: 184930 - protein, 207 aa, Glycine max
  Coding DNA Sequence Number=SeqID_68152
  Gene Ontology: Mol. function=nucleotide binding; Cellular component =membrane; Biological process=small GTPase mediated signal transduction
  Homolog annotation: Hit_ID=Q9LFT9; Match level="QueryCoverage=99%, HitCoverage=100%, E-value=2e-94, Identity=85%"; Hit description=GTP -binding protein
  Pfam annotation: Domain name=Arf; Domain location=6-170; Score=-51.9; E_value=9e-06; Accession=PF00025.11; Description=ADP-ribosylation factor family
  Pfam annotation: Domain name=MMR_HSR1; Domain location=10-125; Score=- 10.5; E_value=0.0091; Accession=PF01926.13; Description=GTPase of unknown function
  Pfam annotation: Domain name=Miro; Domain location=11-125; Score =68.9; E_value=1.6e-17; Accession=PF08477.3; Description=Miro-like protein
  Pfam annotation: Domain name=Ras; Domain location=11-172; Score =272.9; E_value=6.2e-79; Accession=PF00071.12; Description=Ras family
  Pfam module annotation: Pfam domain module=Arf::MMR_HSR1::Miro::Ras; Domain location=6-170::10-125::11-125::11-172
MATVSPLAKYKLVFLGDQSVGKTSIITRFMYDKFDINYQATIGIDFLSKTMYLEDRTVRLQLWDTAGQERFRSLIPSYIRDSSVAVVVYDVANRQSFLNTNKWIEEVRTERGSDVIIVLVGNKTDLVEKRQVSIEEGDAKSRESGIMFIETSAKAGFNIKPLFRKIAAALPGMETLSSTKQEDMVDVNLKPTVNSSQAEQQGGGCSC

SEQ ID NO: 184931 - protein, 62 aa, Glycine max
  Coding DNA Sequence Number=SeqID_68153
MMNMMILEVCMHPMHMRMHGVRLIHGVGVEDTWRDGIGGGEGEWGSNAIGSTILGFFQQQTT

SEQ ID NO: 184932 - protein, 75 aa, Glycine max
  Coding DNA Sequence Number=SeqID_68154
EPVQVIEVTSSEEDPEEEPEELPPEPAVDALDFLEGDEDPLPEVDSPEDVMSASEADSTEESGPGGIATSRGSSS

SEQ ID NO: 184933 - protein, 108 aa, Glycine max
  Coding DNA Sequence Number=SeqID_68155
MTCDHSLVLVRCLAPIIRQFVKFQDMPKNQRDIDAQSHPGPLGPSGIFLQKAVASGGSNPARLGELGGNHLPYFAINRGGRQEGRGSAPLALLSLSNLLGKIVSVKKI

SEQ ID NO: 184934 - protein, 133 aa, Glycine max
  Coding DNA Sequence Number=SeqID_68156
MANQLQRYLNRAKEGSDEYQKLTEIKDALIQHGGKWPPAPVFIFWGTMDALAVAIYCAQSVRHDRVPFVSDIFSFIATGNGPSGGGMVLSDREAFCEQTGALPGSFPPDLFPVFGDPFSAVVEPHGGPERLAE

SEQ ID NO: 184935 - protein, 74 aa, Glycine max
  Coding DNA Sequence Number=SeqID_68157
MVAITPARFPQPPFFRGYDSNAMCAYHGGAPGHSIEHCRALKHKVVKTKMDASEPYTGGMRGIVHEPQLNLGAD

SEQ ID NO: 184936 - protein, 82 aa, Glycine max
  Coding DNA Sequence Number=SeqID_68158
MQQCHYTSISSLQRPFRKDWANCSRIMMTKILMANIMVGEWLLMRSLSGDVYIEVTGGSGPTVNYWYSSWTGLGWLKLELSE

SEQ ID NO: 184937 - protein, 133 aa, Glycine max
  Coding DNA Sequence Number=SeqID_68159
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=94%, HitCoverage=14%, E-value=1e-44, Identity=71%"; Hit description =Aspartokinase-homoserine dehydrogenase
MVCIVQILEKIYSAVGDAVILKTLSYQEAWEMSYFGANVLHPRTIIPVIRYGIPIIIRNVFNLSSSGTKICHPSIIGDEDKQIFKNYVKGFTTIDNLALVNVEGTGMAGVPGTASAIFGAVKDVGANVIMISQ

SEQ ID NO: 184938 - protein, 96 aa, Glycine max
  Coding DNA Sequence Number=SeqID_68160
  Homolog annotation: Hit_ID=Q6AVF2; Match level="QueryCoverage=67%, HitCoverage=23%, E-value=3e-10, Identity=48%"; Hit description =Expressed protein
MQRGTPVRKPHTNTSDLLTWSETPPPESAATVASATRSGQPSDRISKVLHGGQLTDEEAQTLAKRYDTTFISYLLSVRFTTQIRSTSAFLFSISSI

SEQ ID NO: 184939 - protein, 688 aa, Glycine max
  Coding DNA Sequence Number=SeqID_68161
  Gene Ontology: Mol. function=zinc ion binding; Cellular component =nucleus; Biological process=transcription
  Homolog annotation: Hit_ID=Q9LIE5; Match level="QueryCoverage=94%, HitCoverage=81%, E-value=1e-171, Identity=45%"; Hit description=Far -red impaired response protein; Mutator-like transposase-like protein; phytochrome A ...
  Homolog annotation: Hit description=signaling protein-like
  Pfam annotation: Domain name=FAR1; Domain location=31-196; Score =234.4; E_value=2.5e-67; Accession=PF03101.5; Description=FAR1 family
  Pfam annotation: Domain name=SWIM; Domain location=475-511; Score =25.9; E_value=0.00014; Accession=PF04434.8; Description=SWIM zinc finger
  Pfam module annotation: Pfam domain module=FAR1::SWIM; Domain location=31-196::475-511
SQIQMEPEPEPKLEPEPEPGPEFSSKEEAFSYYQTYAKSVGFSAIIKASRRSRISGNFIDAKFACTRYGTPPNPQKPKPKRARTSPKTDCKASMHVKRTPHGTWIISSFIKHHNHQTNSNNNASPSRKPKIKKTLHHLVFAEGDLQFLLDTFMSMQNENPNFFYAVDFNEEQRLRTVFWVDAKARLDYRHFSDVVLLDTMHVKNECKLPFVPFVGVNHHFQVFLLGLAFVSDESESTFSWLMRSWLRAMGGCAPKVMLTDCDEALKKAVAEVAPESWHCFCLWHVLSKVPEKLGRVMQRHGGEFLTRFNECVLRSRTKEQFEKRWGKMVGKFELGDESWLWDIYEDRERWVPAFMKGRVLAGLSTVQRSEAMNCLFDKYVQRKTTLKEFVEQYRVVLQDKCEEEAKADFVTLHRQPALKSPSPYGKQMVELYTNEVFKKFQSEVLGAVACHPRKEREDGPTKVFRVQDFEDNEDFVVTWNESTLEVLCACYLFEFNGFLCRHVMIVLQISAVHSIPPRYILKRWTKDAKSRQTAGDLSMSDAVVSDSRAKRYNNLCQQAFQLGDVGSLSQESYIAAINALEAALRKCKSLNDSIHSVKEPNLPCSGSQEGILISNSVGHSNKRDSTLGKRKVCPEPETVAIGVNSNWQQVENSNTQAAGLDCSYESQQSIQEMGQLNSSSEPGWLFFF

SEQ ID NO: 184940 - protein, 126 aa, Glycine max
  Coding DNA Sequence Number=SeqID_68162
MKTRVCQSRENHRNKEGHRTKWVTGGLTHREGFVQLGFDLKRNTTYNLIATDDDLQVTNQRLSVGMTPKTLRLPKPGEMSMDHLWVLTRKPCMNQRKVECHLNQLSSKNKLHKSFCHHSRYGLLEN

SEQ ID NO: 184941 - protein, 459 aa, Glycine max
  Coding DNA Sequence Number=SeqID_68163
  Homolog annotation: Hit_ID=Q5DMX1; Match level="QueryCoverage=77%, HitCoverage=60%, E-value=1e-113, Identity=61%"; Hit description =Membrane protein-like
  Pfam annotation: Domain name=Sad1_UNC; Domain location=154-278; Score= 188.8; E_value=1.3e-53; Accession=PF07738.3; Description=Sad1  UNC -like C-terminal
MQRSREALLQRRRAKTQLSLSLLFVLWPLIFLFSRAHGYTPTPSVRLSNWKEDKHRQCKTSNSANKCLLKETHDYILPNYKEDCDTPTVVDAQMSDHLPWAVPLGLDEFKSRAISSKIKSGTSGSSGSVMHRVEPGGAEYNYASASMGAKLLGSNKEAKGASNILSRDKDKYLRNPCSAEDKFVIIELSEETLVDTIEIANFEHHSSNLKAFELLGSLSFPTDVWVFLGNFTASNVRHAQRFVLQQPKWVRYLKLNLQSHYGSEFYCTLSVVEVYGVDAVERMLEDLIHTQDNLLAPGDGNADKMTVSPHPNPPESEDAHQNTFGGINSYPASDISSANHEKLNSNVPDPVEEIRQQVGRMPGDTVLKILMQKVRTLDLNLFVLERYMEDLNTRYVNIFKEYSKDIGGKDILIQNIKEDIRNLVDQQDAITKDGSDLKSWKSHISMQFGHLLRDNAVLR

SEQ ID NO: 184942 - protein, 321 aa, Glycine max
  Coding DNA Sequence Number=SeqID_68164
  Gene Ontology: Mol. function=nucleotide binding; Cellular component =microtubule
  Homolog annotation: Hit_ID=Q9SDX4; Match level="QueryCoverage=93%, HitCoverage=32%, E-value=8e-93, Identity=65%"; Hit description =Dynamin homolog
  Pfam annotation: Domain name=GED; Domain location=117-210; Score =11.8; E_value=0.00026; Accession=PF02212.8; Description=Dynamin GTPase effector domain
MQECNIEEVADEEDPPSKSSKDKKSNGPDSGKVNLLFKITSRVPYKTVLKAHSAVVLKAESAADKVEWIKKISQVIQAKGGQIRTSDGGPTMRHSLSDGSLVSFCGLKDTMARRPADPEEELRWMSQEVRGYVEAVLNSLAANVPKAVVLCQVEKAKEDMLNQLYSSVSAQSTAKIEELLLEDQNVKRRRDRIQKQSSLLSKLTRQLSIHDTRAAAASGWSNGSAESSPRSSSGPGDDWRSAFDAAANGPVSRSGSSRSGSNGHSRHSSDAAQNGDVNSGSNSSSRRTPNRLPPAPPGSSGCSHPISYGHPQFFVSAGIFR

SEQ ID NO: 184943 - protein, 368 aa, Glycine max
  Coding DNA Sequence Number=SeqID_68165
  Gene Ontology: Mol. function=DNA binding; Cellular component=nucleus; Biological process=regulation of transcription, DNA-dependent
  Homolog annotation: Hit_ID=Q8H0H3; Match level="QueryCoverage=54%, HitCoverage=65%, E-value=1e-55, Identity=56%"; Hit description =Hypothetical protein B25
  Pfam annotation: Domain name=Myb_DNA-binding; Domain location=127 -172; Score=49.5; E_value=1.1e-11; Accession=PF00249.21; Description =Myb-like DNA-binding domain
  Pfam annotation: Domain name=Myb_DNA-binding; Domain location=73-120; Score=35.6; E_value=1.8e-07; Accession=PF00249.21; Description=Myb -like DNA-binding domain
  Pfam module annotation: Pfam domain module=Myb_DNA-binding::Myb_DNA -binding; Domain location=127-172::73-120
MAGLCMFPTNRQNRRKRKVGSKNPLHCVHVDQKPNHVTCCHATNIRKQNFRNVPRVRRKERGMEIRELEMIKKGPWSSEEDEVLLRHVSKYGPREWSSIRSKGLLPRTGKSCRLRWVNKLRPNLKTGCKFTAEEERLVIELQAQYGNKWAKIATYLQGRTDNDVKNFWSSRRKRLERMLQKPPASKPKKNKGKAHLNQVQQVEEMVPPCSSNQVEEILSYATSYMGNTLVFEMINLQDLIKPNYQQLENDYLSAVEVDATPLHTVPSFESSSGYNFPLLPEPEPLLDFPLFPECQDLVPEPFDPNFVYGFEEKKCLQCACSSSQKLGTRLPTFGLEGNSQSASSNGFFKDFPSEIFEYFEHIPTSSDQ

SEQ ID NO: 184944 - protein, 56 aa, Glycine max
  Coding DNA Sequence Number=SeqID_68166
  Homolog annotation: Hit_ID=Q1RUW9; Match level="QueryCoverage=67%, HitCoverage=10%, E-value=1e-07, Identity=73%"; Hit description=Zinc finger, RING-type; RINGv
MAIIIVILIFAQFLMGFFSIYIRHCSDSPSTNIHNHPGSSKRSRRSSRKLDQTVID

SEQ ID NO: 184945 - protein, 103 aa, Glycine max
  Coding DNA Sequence Number=SeqID_68167
  Homolog annotation: Hit_ID=Q5DMX3; Match level="QueryCoverage=39%, HitCoverage=4%, E-value=6e-08, Identity=68%"; Hit description=DRP
MGAMLKYMNLEVTMCQRFLLKKSAKTNGWSRRWFVLNEKTGKSALKHCNVLQDSEKYQLYYYKPSLVRLIPFDTDLLSLKPSFLLIKPVNFRQEKGTGQTAPG

SEQ ID NO: 184946 - protein, 300 aa, Glycine max
  Coding DNA Sequence Number=SeqID_68168
MGTGHSTHTNLGSECTSYDAGATGTIARWGESFEVSMGNSKENNDHTEVWGVKYKPSQKNYTCGFHLRASRDNNKSVESIYFGLGDFSNNKTEFALKITRIGRDSLRGGITGIDSSTAPMYFTRAKQDHTIETTIVPYGCSFRDGLFVMEMKKKVNAENAYMVTMGHYYVTKDVGLSVEAKILRSKNCFVVQVEGPFSHPGDELRKVLAKTHRTGIWSRSACSHCNNNGTKASTSKKSGESDSPLKAQPSHQKGHGTVGEIVSHAFSSSVKEQYNKGLINSSGYTTGSLNNSIVFIDCNF

SEQ ID NO: 184947 - protein, 242 aa, Glycine max
  Coding DNA Sequence Number=SeqID_68169
  Gene Ontology: Mol. function=zinc ion binding
  Homolog annotation: Hit_ID=Q9SN28; Match level="QueryCoverage=20%, HitCoverage=21%, E-value=6e-19, Identity=76%"; Hit description=RING -H2 finger protein ATL4E
  Pfam annotation: Domain name=PHD; Domain location=173-218; Score=1.5; E_value=0.04; Accession=PF00628.19; Description=PHD-finger
  Pfam annotation: Domain name=zf-C3HC4; Domain location=174-215; Score= 26.9; E_value=7.2e-05; Accession=PF00097.15; Description=Zinc finger, C3HC4 type (RING finger)
  Pfam module annotation: Pfam domain module=PHD::zf-C3HC4; Domain location=173-218::174-215
MSECGCSESDPSCGCWSSSSSRSVASTELKLYRAFIFCVPIFFTLILLFLFYLFYLRPRTRLHWISHFRLPSNNNRNNAISTLGLGLNKELREMLPIIVYKESFSVKDTQIFNTTPSCPEASVIAGLTSHTTTNRIGFDIILEFGLDPNSAHEMRDVKNIPLTSKIGHFKDCRCSVCLLDYQAEDRLQQIPACGHTFHMSCIDLWLATHTTCPLCRFSLLTTAKSSTQASDMQVTTLSYMVL

SEQ ID NO: 184948 - protein, 108 aa, Glycine max
  Coding DNA Sequence Number=SeqID_68170
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=26%, E-value=7e-14, Identity=40%"; Hit description =Integrase, catalytic region
MEKIGVVVYRLQLLAGAKLHPVFHCSLLRPHHDPIPIADPKQLPLEVIDNQSVLTPLSILDSKLDESTHPTTKLVLVQWAHYHLEDKVDFERGGITSNTHTAWPNKNT

SEQ ID NO: 184949 - protein, 787 aa, Glycine max
  Coding DNA Sequence Number=SeqID_68171
  Gene Ontology: Mol. function=transporter activity; Cellular component= integral to membrane; Biological process=transport
  Homolog annotation: Hit_ID=Q6ZF47; Match level="QueryCoverage=52%, HitCoverage=79%, E-value=1e-93, Identity=39%"; Hit description =Putative organic cation transporter
  Pfam annotation: Domain name=MFS_1; Domain location=385-786; Score =27.3; E_value=1.8e-05; Accession=PF07690.6; Description=Major Facilitator Superfamily
  Pfam annotation: Domain name=Sugar_tr; Domain location=425-787; Score= -97.4; E_value=0.0008; Accession=PF00083.14; Description=Sugar (and other) transporter
  Pfam module annotation: Pfam domain module=MFS_1::Sugar_tr; Domain location=385-786::425-787
MGSVWGRRGWWVFEVGVGRVQGRREVQQGDGCIGVEEGTVEDDVVTYQNAKGGCGCGGETKEIGEAGLQEVVSTATVDEDSDLGVVDVAKEAEGLRGREVGQGVETDMRVGDGRSRSEMGLGSEGMARSMVVGSEGFSGFLGSRSRQKAISVGVRWMKGGLGRGDGEGEQEDESVWYGGDRAACPLAISQGPQLPARKWVGGPRLRGEFPALGRRQSSLRGMDEGLEQGTLGIVIVRGCEARLQSLKEAEPGCDETISEHPLVPTERGTVQLGVVERQTRDGFLKFVRGGLTGVVVRSVDRGGNREPCFEDKGLALGCDIVFQVIGTLSVPVGPGCVEAEKEMEDSVPILRNSDCIVQEKLIPSWDEAIENGLRELGWSGMAQCILVSIAMCFDAQQSFMAIYSDDYPTWHCTETACTSSRSDICKLPKSSWAWDGPSSKTIISQFGLECAGSFITGLPQSSFFAGCLIGSFLLASLADTSLGRKNLLLLSCLSMSISSIFIVFSTNVWIYSAFKFLIGFWRSSIGTCVLVLLTEKVSTEWRFTVGIVEYFCFTLGYMILPGIAYINKNSSWKTLYVWTSIPAIFYSIIAYLFVTESPRWLLMQGREQEAMAMLNGVSSVENGANLTASLLKVPAAKQKSSIFQLYSSIAELFERSWALKRMVAIMVLGLGIGMVYFGMPLAVGNLGFDIYLAVVLNALMEIPSCVVTYFLENYRRKPSILAFSVASGICCVLCVVVGSGQQVAKVGISLVAFFSAVTAYNVFLIYIIELFPTSEGKMIFSPMAYLE

SEQ ID NO: 184950 - protein, 613 aa, Glycine max
  Coding DNA Sequence Number=SeqID_68172
  Gene Ontology: Mol. function=translation initiation factor activity; Cellular component=cytoplasm; Biological process=translational initiation
  Homolog annotation: Hit_ID=Q6YVX8; Match level="QueryCoverage=99%, HitCoverage=100%, E-value=0.0, Identity=63%"; Hit description =Putative Ligatin
  Pfam annotation: Domain name=PUA; Domain location=94-173; Score=24.7; E_value=0.00021; Accession=PF01472.10; Description=PUA domain
  Pfam annotation: Domain name=SUI1; Domain location=520-603; Score =102.7; E_value=1.1e-27; Accession=PF01253.13; Description =Translation initiation factor SUI1
  Pfam module annotation: Pfam domain module=PUA::SUI1; Domain location= 94-173::520-603
MFKKAVEAKSHQRLSGADRKKLRRSIKDKFPRVSDSDLDALLPPKAEITIAKLQNRVHVYAVEGGFPMFFDVDGRGSDIFPTVYALWMVPELLPVFVLKGGEVSRFVIGGADLMFPGITVPPEGLPSFRAGEPWAVKVPGNSAPIAVGSTTMSSAEALKAGLRGKALRITHYYRDLLWQVESAEGHCVPNAGFFEDVVFEDPSLLQASHDSDLTEAVGETSIDQHNNPKGDGPEESLDVNEFQPDSNPALTMPNGNENDTAAEVTEGVADLNLRDTASANDPDDQQTLSTADVNSLLDKCLLQALHTTVKDKDLPLPGSTLWSNHVLPCRPSGITLDIKKSSYKKLSKWLQAKSTSGLISVKEDKHKKEVMLFSVNRKHADYSSFKPEKRQVEKSEQPSVQSANEIRSSKTLEVAEIYKPSVHVNSIFSSVGADTGKLFSASEATDIVFKYVEKENLVKPTNKSVVVLDVILCDALFKGAIKKGTTYPTEIHKKDLGSTFVSRMQPHHVVTRGNESVVCKGALKTIQLLTERRQGNKKVTKLSGMESFLIDAEALASELQKKFACSTTVAELPGKKGNEVLVQGGVIDDLARHLIDQYGVPKRYIEVLDKTKK

SEQ ID NO: 184951 - protein, 229 aa, Glycine max
  Coding DNA Sequence Number=SeqID_68173
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=59%, E-value=5e-35, Identity=51%"; Hit description =Integrase, catalytic region
  Pfam annotation: Domain name=rve; Domain location=3-178; Score=11.7; E_value=0.00063; Accession=PF00665.16; Description=Integrase core domain
MVKLRQPLHRVTDHRIPLNSPRRTFGGCENYPPCQLQFLLDHSLSGCQALCPQLCHLSTVQDTHDMIEWPPATHTHSFRRLGRSFAEFHHSPVVLPWFYSDLSRGTIRLCDTRLRMSTAYHPQTDGQTKVMNRVLEQYLRSFVSSHPADWFKFLAMAEWSYNTSVHSDTGLTPYEVIYGKAPPTFPHYILGASNNEAVNEAVDSLLTSRQDIHDSLQRRLTKAQQAMKQ

SEQ ID NO: 184952 - protein, 1937 aa, Glycine max
  Coding DNA Sequence Number=SeqID_68174
  Gene Ontology: Mol. function=RNA-directed DNA polymerase activity; Cellular component=chromatin; Biological process=chromatin assembly or disassembly
  Pfam annotation: Domain name=Chromo; Domain location=1544-1595; Score= 22.1; E_value=0.002; Accession=PF00385.14; Description='chromo' (CHRromatin Organisation MOdifier
  Pfam annotation: Domain name=RVP_2; Domain location=492-625; Score= -15.3; E_value=1.6e-05; Accession=PF08284.2; Description=Retroviral aspartyl protease
  Pfam annotation: Domain name=RnaseH; Domain location=1009-1127; Score= -34.2; E_value=0.089; Accession=PF00075.14; Description=RNase H
  Pfam annotation: Domain name=rve; Domain location=1270-1442; Score =84.3; E_value=3.8e-22; Accession=PF00665.16; Description=Integrase core domain
  Pfam annotation: Domain name=zf-H2C2; Domain location=1211-1252; Score=18.1; E_value=0.0014; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1544 -1595::492-625::749-918::253-343::1009-1127::1270-1442::1211-1252
MGMQVPCILVVSHVFNVVFRTVGQPGSIGQVLMNIHYTMRNLCMVSLVACGGAIWVVFLVYPSHFTCIKSLTPLTMPPSELRFAASDVGRIAVSSALITEMGCLLFFNVMVNWRKPNHISYAWRGAMNSELAPETEPTKEEEAEIFVKETTMSSSPKMDRIEEAIAKLASSHLILTEKLDELINRVTNLENITNPSPSPSSSSAMPIPQIQSANPHRLKLDVPRFDGSDPSGWVFKITQFFEYHATPEAKRLTVASFYMDGPALAWFQWMARNHQLTTWSGFLQAIEARFAQSPYEDPTGLLFKLTQKGTVREYLAQFEALANRITGLSPASLLSCFISGLEPDVRREVQALQPSTLVHAAGLARLQEEKILEHRRAFHQRPHPSPPQHSPTPLSIVTPTPSPPLLPSPPKPPPLPIRRLTPEEIASRRERGLCFHCDEKFTRGHRCPSRFLLLLADEDPPDNPNIDNPDPLMDPNRPETPIINPITQDPTEPTQAQISLHALSGYGTPETLRVTGRINFHHVTILVDGGSTHNFVQERLVKTLGLNPQPTPTLRVLVGNGNTVECSQVCSEVTVHIQGVSFSVNLHVLPLYGADVVFGVPWLKALGPVLTDYNNLVMKFMHDDRIIELKGSSETPLTAISPPQLRRLVQTQGASEFFHIRVCPSPEHTPNNSPNTQSAILDVINQFPSLFQPPTKLPPSRATNHHIHLLPNSTPVNVRPYRYPNFQKEEIESQVNTMLQNGIICPSNSPYSSPVLLVKKRDGTWRFCVDYRALNALTVKDRFPIPTIDELLDELGGAYWYSKLDLLQGYHQILMAPEDVNKTAFRTHHGHYEFLVMPFGLCNAPSSFQATMNAIFGPCLRKFLIVFFDDILVYSKTFHDHLDHLRSTFQILSDNGFVLKKSKCSFAIQQVEYLGHVVSARGVEPVPEKVLAVQQWPPPRSVRHLRGFLGLSGFYRRFIKGYATLATPLTALLATDQFGWTPEAEDAFNRLKEALCKAPVLALPDFAAPFIIETDASGAGMGAILSQHHHPLAFFSKPFCSKLLRASAYVRELAAITAAVKKWRQYLLGHHFSIITDHRSLKELMAQAVQTPEQQVYLARLMGYDYTIHYRAGKHNSAADALSRLPEPPPNPLDTTQSQIFMLTIPNCVFLQELKRELFTNEEFQAKKKQIEEEKETPSEFIIKDEFILHQGRIWLPRNLPLLPTIITEFHATPTGGHMGIMKTMARVRENFTWASMKEDIQRHITNCITCQQIKTDHRHPPGLLCPLPVPARPWEDLSLDFISGLPPYRGNSVILVIIDRFSKGIHLGSLPSHHTAFSVAQLFMELSGKLHGMPRSLVSDRDPLFLSRFWQELFKMSGTKLRMSSAYHPQSDGQTEAMNKIVEQYLRAFTPYEVTYGKPPPSLPQYITGSSNVQAVDEWLTNRETLNACLIKKLTKAQQRMKEIADKQRRDVSYEEGDFVLVKLRPRRQTSATGETYSKLAKRYYGPFQITKKIGSAAYQLNLPTSSRIHPVFHCSLLKPFNPSTTEGSLELPAIAEDNEPLIHPLVIIDTRWDITPIGRHLLVLVQWAGLPPEDASWEKWEVLKKDYNLEDKVVLEVGGNAMNSELAPETEPTKEEEAGAKRRIIRPKYLKDYEPLVPVHNKRSANLAILILLSIGSKLGGTLIVCRYLKIPTSEGIFLGFILNTRGYADLLFIGAAAKQTYDSEAYNVLLQLSHNKWRTSYEFWLVYDPRQKENADLSDDEDYGGNDVVEINNALDTFTAETKILVQQRTCLLSHHQRIDGKLESGKEGIRITNQKVLRHAPCSVGIIVERRLARVPGFSELVASESIQNVATLFFGGPDDREAIAWSLRISGSPRVNLTIIRFLLSSSSQNEQIESGESEDKEILMSLSREETVNEIGNTFMVDFYNRYVTSGQIGYVEKFVKDGAQTLESLK

SEQ ID NO: 184953 - protein, 437 aa, Glycine max
  Coding DNA Sequence Number=SeqID_68175
  Gene Ontology: Mol. function=nucleotide binding; Cellular component =microtubule; Biological process=defense response to fungus
  Homolog annotation: Hit_ID=Q9SDX4; Match level="QueryCoverage=99%, HitCoverage=46%, E-value=0.0, Identity=89%"; Hit description=Dynamin homolog
  Pfam annotation: Domain name=Dynamin_N; Domain location=42-207; Score= 132.3; E_value=1.3e-36; Accession=PF00350.13; Description=Dynamin family
  Pfam annotation: Domain name=MMR_HSR1; Domain location=40-208; Score =8.0; E_value=0.00019; Accession=PF01926.13; Description=GTPase of unknown function
  Pfam module annotation: Pfam domain module=Dynamin_N::MMR_HSR1; Domain location=42-207::40-208
MAAIEDLSELADSMRQAAALLADEDVDESSTNSRRPSTFLNVVALGNVGAGKSAVLNSLIGHPVLPTGENGATRAPICIDLLRDTSLSSKSIILQIDNKSQQVSASALRRSLQDRLSKSSTGKGRDQIYLKLRTSTAPPLKLVDLPGLDQRIMDESLVSEYAEHNDAILLVIVPAVQAPEIASSRALKYAKEYDGEGTRTIGIISKIDQAASDQKALAAVQALLLNQGPAKTSDIPWVALIGQSVSIATAQSGSAGSENSLETAWRAESESLKSILTGAPPSKLGRIALVDALAHQIQNRMKLRLPNLLSGLQGKSQIVQDELARLGESMVTTSEGTRAIALELCREFEDKFLQHITTGEGSGWKIVSCFEGRFPDRMKQLPLDRHFDINNVKRIVLEADGYQPYLISPEKGLRSLIKGVLELAKEPSRLCVDELAS

SEQ ID NO: 184954 - protein, 299 aa, Glycine max
  Coding DNA Sequence Number=SeqID_68176
  Gene Ontology: Mol. function=RNA-directed DNA polymerase activity; Cellular component=chromatin; Biological process=chromatin assembly or disassembly
MCVDYRALNTATIHNRFPMPTIDELLDDLGHASWYSKLDLQQGLHQILMAPEDILKTAFRTHQGHYEYRVMSFGLCNTPSTRLEYLGHIISEKGVEPDPAKIQVMVAWSTPTTPKDLRAFLGITGFYRKFIQGYATIASPLTTLLCKNAFAWSPESQSAFEKLKTAMTQASVLALPDFELPFVIETDASGMAMRVVMLQQGHPLAELHAIDTAVHKWRQYLLGHPFTILIDHKSLKDLLSQVIQTTEQQHYLSKLLGYEYTIQYKAGASNVVADALSRVTHPPEGHCLLLSIPNFVFMD

SEQ ID NO: 184955 - protein, 399 aa, Glycine max
  Coding DNA Sequence Number=SeqID_68177
  Gene Ontology: Mol. function=Rho GTPase activator activity; Cellular component=intracellular; Biological process=signal transduction
  Homolog annotation: Hit_ID=Q84ZE8; Match level="QueryCoverage=94%, HitCoverage=99%, E-value=1e-112, Identity=57%"; Hit description =Auxin-regulated protein-like
  Pfam annotation: Domain name=RhoGAP; Domain location=155-299; Score =126.6; E_value=6.9e-35; Accession=PF00620.17; Description=RhoGAP domain
  Subcellular localization annotation: CTP_CleavageSite=23; ConfidenceScore=5.08e-01
MPSIMSPQWQDKAAGFFSSSGVKLKEAKESAGTFVGEVTKDTKSNVAEVAGRVGSMVKSRWALLQQPSTRHAVQDRFISAAATTGTLLRRGFSGTKDKVVVGKSKVEEVAKITAQKSKTILTDIERWQKGVASTDLFGVPIEVTAQRQDCSKPIPQILVKCGDYLIVSGLNSPNLFKSEGDKKVIHQLVSLYNQDSTASVPEGTNPVDVAALVKYYLASLPEPLTTLELYNEIRSARSSIYSMRNILKRLSSVNYMTLEFITALLLRVSQKSLLNKMDARSLAMEMAPVIMWQKERRPEFYHQYWNQVSKSLSNKTVDPTPGSYTAWDMLADDGEATDASSPIPLDDGTPVDFGAIEVVQLLTEHHNAIFTDANETLSTIITRGKMLDITGPVLVIIPI

SEQ ID NO: 184956 - protein, 354 aa, Glycine max
  Coding DNA Sequence Number=SeqID_68178
PHQPESKALSGDGSSRSRRRMLLLELDSEKEEFEQPLKKKSTKNQTKLIKPTTSLSSKNQTKTIKSNNLSSSKNQTKLAKTKATTLTDTEVVVKKLNSTTLKSKKLNSTSKGSTKSSSLDLAKTSGTSGGKNKTTKATATKDKEVTNKKTKLDQTEESDKQSNKKSNTTNNKKKKEQQGQPSWVFEDEVDDDLVSEFKDLPMKFQQTLIPDLERISTTSKAYITKANKEITRGFKPYVGNKYAPTITTLLSCAFALIPLLLASLLFNKIKAYFSLQKLLIFIQAYLAIYFSILCLSSFVTGLEPLRVVLKQPPKTNWKIHAIYATCFFLICVIARADRKKKTYLEEGGEEGKKN

SEQ ID NO: 184957 - protein, 523 aa, Glycine max
  Coding DNA Sequence Number=SeqID_68179
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=91%, HitCoverage=89%, E-value=0.0, Identity=58%"; Hit description=AAA ATPase
  Pfam annotation: Domain name=ABC_membrane_2; Domain location=70-351; Score=402.4; E_value=6.6e-118; Accession=PF06472.5; Description=ABC transporter transmembrane region
MCSGRRLELSWQKHWKTLLLASGILIAGGTAAYVQSRFRVNNHDLFGHCNGHSNDKEVAEEVVKDVSTPKNKQKKGLKSLQVLAAILLSGMGKFGASDLLGLVAIAVLRTALSNRLAKVQGFLFRAAFLRRVPLFLRLISENILLCFLLSTIHSTSKYITGTLSLHFRKILTKLIHSHYFENMVYYKISHVDGRITNPEQRIASDVPRFCSELSEIVQDDLTAVTDGLLYTWRLCSYASPKYVVWILAYVLGAGAAIRNFSPSFGKLMSKEQQLEGEYRQLHARLRTHSESIAFYGGERKEEAHIQQKFKTLVRHMYNVLHDHWWFGMIQDLLLKYLGATVAVILIIEPFFSGHLRPDSSTLGRAEMLSNLRYHTSVIISLFQSLGTLSISARRLNRLSGYADRIYELMAVSRELSLVNEKSSLQRNASRNCIREANYIEFDGVKVVTPTGNVLVDDLTLRVESGSNLLITVKPGIGSDLNKEIFYVPQRPYTAVGTLRDQLIYPLTEDQEIDFSQIVGWWSC

SEQ ID NO: 184958 - protein, 470 aa, Glycine max
  Coding DNA Sequence Number=SeqID_68180
  Gene Ontology: Mol. function=protein kinase activity; Cellular component=cytoplasm; Biological process=protein amino acid phosphorylation
  Homolog annotation: Hit_ID=Q1L881; Match level="QueryCoverage=90%, HitCoverage=40%, E-value=2e-51, Identity=32%"; Hit description=Novel protein
  Pfam annotation: Domain name=Pkinase; Domain location=39-384; Score= -6.9; E_value=3.8e-08; Accession=PF00069.15; Description=Protein kinase domain
  Pfam annotation: Domain name=Pkinase_Tyr; Domain location=39-384; Score=-167.0; E_value=0.032; Accession=PF07714.7; Description =Protein tyrosine kinase
  Pfam module annotation: Pfam domain module=Pkinase::Pkinase_Tyr; Domain location=39-384::39-384
MSLNMKTLTQALAKTAAVIEKTVQTTVQEVTGPKALQDYELLDQIGSAGPGLAWRLYSGRARDPSRQHQYPVVCVWVLDKRSLSEARMRAGLTKAAEDSFLDLIRTDAAKLVRLRHPGVVHVVQALDESKNAMAMVTEPLFASAANTLGIVDNIPNLPKDLRGMVADERAFALQEMGILEVKHGLLQIAESLDFLHNHAHLLHRAISPENILITLSGAWKLAGFGFAVSATQTSGDSSNLQPFHYATQISASSNLIYFCQQKSLHFVIIPVRLFFLEYDVEDSILPLQPSLNYTAPELARSTASSAGCSSDIFSFGCLAYHLIARKPLFDCHNNVKMYMNTLTYLSSGAFSSIPSELVPDLQRMLSPNESSRPSAMDFTGSPFFRHDTRLRALRFLDHMLERDNMQKSEFLKALSDMWKDFDSRVLRYKVLPPLCAELRNVVIQPMILPMVLTIAESQLPWCSGAALGFS

SEQ ID NO: 184959 - protein, 432 aa, Glycine max
  Coding DNA Sequence Number=SeqID_68181
  Gene Ontology: Mol. function=pyridoxal phosphate binding; Cellular component=cellular_component; Biological process=Mo-molybdopterin cofactor biosynthetic process
  Homolog annotation: Hit_ID=Q8LGM7; Match level="QueryCoverage=82%, HitCoverage=43%, E-value=1e-109, Identity=58%"; Hit description =Molybdenum cofactor sulfurase
  Pfam annotation: Domain name=Aminotran_5; Domain location=42-428; Score=-116.5; E_value=1.3e-06; Accession=PF00266.9; Description =Aminotransferase class-V
MDAAKEEFLRDFGEHYGYPNGPKSVDQIRATEFKRLQLQDLVYLDHAGATLYSDLQMESVFNDLTTNLYANPHSQSDSSSATLDIVKNARQQVLDYCNASPKEYKCIFTSGATAALKLPYPCICKEAVSGFEPMTNKSPRHNFTVAPGLALILINIDYRYALGQGAAAIAVDIEGELHPEISGETITTKISPHQVQRRKVAGSLKEEPTECNFSGLRFDLDLVKIIKEDSSKILGISSVCHGQWMVLIDAAKGCATMPPDLSKYPADFVAISFYKLFGYPTGLGALIVRNDAAKLLKKTYFSGGTVSASIADIDFIKRREGIEELFEDGTVSFLSIVSIRHGFKILNSLTVSAISRFLIDVYFGLVDCMAGLTSCLCFSTSDQGKNIDKFTHNIAVGAVVLQFCVTYPKLCQFAAVAAAVGNGTSMPFHCSL

SEQ ID NO: 184960 - protein, 190 aa, Glycine max
  Coding DNA Sequence Number=SeqID_68182
QQKVYTDNHSGISARQRDSKVSMTDLVSAEDDGAEDDISLCVLPGFSSYRQQKVYTDNHSGISARQRDSKVSMTDLVSAEDDTAKKNVYTDNHSGISARQHDSKVRAPNTTLVSACYQAFHLTDNKKFIRITTRISVSAEDDINLRVSTVSARQHDSNVKYDRSCEGWPTKSEALAPTYPPMRNADLRCS

SEQ ID NO: 184961 - protein, 34 aa, Glycine max
  Coding DNA Sequence Number=SeqID_68183
CWAIIIAAANPATAYYLFVIDGDDVQSSERAKRA

SEQ ID NO: 184962 - protein, 68 aa, Glycine max
  Coding DNA Sequence Number=SeqID_68184
MAWKHSSDGNFTCLTIISPDRDDIVLPIPENENPKGLWFTTKEGGAKALKLKKEALNGLPKMDRTPHV

SEQ ID NO: 184963 - protein, 164 aa, Glycine max
  Coding DNA Sequence Number=SeqID_68185
  Gene Ontology: Mol. function=protein translocase activity; Cellular component=mitochondrial inner membrane presequence translocase complex; Biological process=intracellular protein transport
  Homolog annotation: Hit_ID=Q1SJ29; Match level="QueryCoverage=53%, HitCoverage=39%, E-value=2e-33, Identity=76%"; Hit description =Mitochondrial import inner membrane translocase, subunit Tim44
  Pfam annotation: Domain name=Tim44; Domain location=34-157; Score =9.3; E_value=0.00021; Accession=PF04280.6; Description=Mitochondrial import inner membrane, translocase subunit TIM44
MTSTALSLSHMHWPRLCPKCLGPCLCSSCTSPCLCPGCTSPCLCPKYIGPVYVPACDIVWVDENFLCCQNFLSFFEILHVSDVEIRETKMMGSSPVIIVMFQTQQIYCVRDRNGAITEGGKDTIHTVFYFWALQQMDQEDRGEDGIYLMWRLREMQQQGIQALI

SEQ ID NO: 184964 - protein, 1411 aa, Glycine max
  Coding DNA Sequence Number=SeqID_68186
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=51%, HitCoverage=35%, E-value=1e-164, Identity=43%"; Hit description=CCHC- type integrase
  Pfam annotation: Domain name=B_lectin; Domain location=664-796; Score= 38.4; E_value=2.4e-08; Accession=PF01453.15; Description=D-mannose binding lectin
  Pfam annotation: Domain name=JmjN; Domain location=343-387; Score =84.0; E_value=4.7e-22; Accession=PF02375.7; Description=jmjN domain
  Pfam annotation: Domain name=Pkinase; Domain location=1115-1385; Score=158.6; E_value=1.7e-44; Accession=PF00069.15; Description =Protein kinase domain
  Pfam annotation: Domain name=Pkinase_Tyr; Domain location=1115-1385; Score=128.0; E_value=2.6e-35; Accession=PF07714.7; Description =Protein tyrosine kinase
  Pfam annotation: Domain name=SANTA; Domain location=21-103; Score =59.2; E_value=1.4e-14; Accession=PF09133.1; Description=SANTA (SANT Associated)
  Pfam module annotation: Pfam domain module=B_lectin::JmjN::Pkinase::Pk inase_Tyr::SANTA; Domain location=664-796::343-387::1115-1385::1115 -1385::21-103
MAASKCNSATPLIPVPPKSLIFLHEWWLVKQRKGLAVGGLASVDVIVGREETNVLHSEDGITILFRGFINTSRSSQNGVPFQVCQHFLVGFPHDWKKYSAYSFGDAFGDSSVCSKNICHGLGISSGNHSKQSQSTDNMECECNNTASQLQVGEKGISDVAVESQAGNKKSFMSMFDSNKCTSTSGKGTVKPLTSKEKMDRKEKQQIRQKIVLDASNSCNRMVTRSISKRSHTMPKEDEKATIATVVSPVRRSPRLYSLIMEADYGKDCTKFEKRENLSVPPEPIFMETIPEMNDITAYRQDPSLNAGRPKGAIHGCPNCSNCVKVTARWHPRDAIRGVLEEAPIFHPTEEEFKDTLKYIASIRSKAEPYGICRIVPPTCWKSPCSLEKKNLWEKSEFVAQIQRIDGHQVQNAQETTASARGNTKTKRKGDVKVALDSQLGIETPAFQIPRMLKNVTWEPSVKNIEGEYGRIVQNPTEEIKVLRINTLEAGVFSSGFSTLSDPVEACTYPEYLKSGWNMNNILSLSGSLLCFESSEASRNFAPKIHVGMCFSPLNWVFEHKGGKDAGTEVCRWCCAWLEWLGSNIGWRWCDSDWMGSGALSGSCADLVGVGATSSNCNVDLNSSLVTNGTWNSPSGHFAFGFQSVLFDNKEFMSVLAVWFAKDPNRTIVWYAKQKQSPAFPSGSTVNLTNKGIVVNDPKGHEMWHRPENNTTIALVSCASMLDNGSFVLLDESGKQVWESFEEPTDTILPGQNLAKPKTFRARESDTSFYNGGFELSWQNDSNLVLYYSPQSSDDQASQSPTGEAYWATGTFKTESQLFFDESGRMYIKNDTGTVISEITYSGPEEFFYMARIDPDGVFRLYRHPKAVKLCLGDLLVMGSNPETVSLHMQGSGWWSVVQQYPQDICLSFTKQTGNVICGYNSYCITINGKPECECPDHYSSFEHDNLTGCRPDFPLPSCNKDGWEQNKDLVDFKEYTNLDWPLSDYDKLVATAMDKDMCKQKCLEDCFCAVAIYGEGQCWKKKYPFSNGRKHPNVTRIALVKVPKRDLDRGGREQTTLVLVISILLGSSVFLNVLLFVALFVAFFIFYHKRLLNNPKLSAATIRSFTYKELEEATTGFKQMLGRGAFGTVYKGVLTSDTSRYVAVKRLDKVVQEGEKEFKTEVSVIGQTHHRNLVRLLGYCDEGEHRLLVYEHMSNGSLASFLFGISRPHWNQRVQIALGIARGLTYLHEECSTQIIHCDIKPQNILLDELFTPRIADFGLAKLLLAEQSKAAKTGLRGTIGYFAPEWFRKASITTKIDVYSFGVVLLEIICCKSSVAFAMANDEEALIDWAYRCYSQGKVAKLVENDEEAKNDIKRVEKHVMVAIWCIQEDPSLRPSMKKVTQMLEGVTTVSVPPRPSIFSSSSFEISFTS

SEQ ID NO: 184965 - protein, 586 aa, Glycine max
  Coding DNA Sequence Number=SeqID_68187
  Gene Ontology: Mol. function=serine-type endopeptidase activity; Cellular component=mitochondrion; Biological process=proteolysis
  Homolog annotation: Hit_ID=Q6AT72; Match level="QueryCoverage=89%, HitCoverage=76%, E-value=0.0, Identity=71%"; Hit description =Putative serine protease
  Pfam annotation: Domain name=Trypsin; Domain location=72-315; Score =33.2; E_value=7.4e-09; Accession=PF00089.16; Description=Trypsin
  Subcellular localization annotation: CTP_CleavageSite=56; ConfidenceScore=5.74e-01
MGSFVRIARNLLWSSFCSQSLSKNVSQQLFTSSASVFKSYKFRYGRTPVRKHREANATHTTAVELAFNSVVKIFTVSCSPNYLLPWQNKSQRETMGSGFVILGRKILTNAHVVADHSFVLVRKHGCPTKYRAEVKAVGHECDLAILVIENKEFWDGMNPLELGDVPFLQEAVAVVGYPQGSNRGGGSLRISYPHLYFFLLKNSPLPKRKIKSFQACYATAKLYEAYIPWESANTCGRGGDNISVTKGVVSRVEPTQYVHGASQLMAIQIDAAINPGNSGGPAIMGSKVAGVAFQNLSGAENIGYIIPVPVIEHFISGVEENGKYIGFCSLGLSCQTTENVHLRNHFSMLPDMTGVLVSKINPLSDAYKVLKKDDIILSFDGVPIANDGTVPFRNRERITFDHLVSMKKTNEKALVRILRDGQEQELSIILQPIQPLVPVHQFDKLPSYYIFAGLVFIPLTQPYLHEYGEDWYNTSPRRLCERALRELPKKANQQLVILSQVLMDDINAGYERLAELQVLKVNETEIDNLEHLRQLVESCNTEFLRLDLEDDRVIVLNYGTAKIATSRILKRHRIPSSMSVDLLDTE

SEQ ID NO: 184966 - protein, 46 aa, Glycine max
  Coding DNA Sequence Number=SeqID_68188
MWHAYWRSSVNVDLVKEYQERGCAIGGDGYATKKGEVANLQGLCKY

SEQ ID NO: 184967 - protein, 166 aa, Glycine max
  Coding DNA Sequence Number=SeqID_68189
  Gene Ontology: Mol. function=protein binding; Cellular component =apoplast; Biological process=response to biotic stimulus
  Homolog annotation: Hit_ID=Q9ZP52; Match level="QueryCoverage=98%, HitCoverage=68%, E-value=6e-62, Identity=65%"; Hit description =Thaumatin-like protein SE39b
  Pfam annotation: Domain name=Thaumatin; Domain location=2-166; Score =177.3; E_value=3.7e-50; Accession=PF00314.8; Description=Thaumatin family
MVRHGCIFDSSGSGTCITGDCGGKLKCDGVGGAPPASLAEFTLDSQEGDFYDVSLVDGYNLPVSIFPTGGSRQCKAVTCRSDLNRNCPSRLEVRNQSHIVGCKSACMAFNKPEYCCTGYFNSPKKCQPTSYSKVFKASCPQAYSYAYDDATSTFTCQGANYLIRFC

SEQ ID NO: 184968 - protein, 77 aa, Glycine max
  Coding DNA Sequence Number=SeqID_68190
  Gene Ontology: Mol. function=O-methyltransferase activity
  Homolog annotation: Hit_ID=Q1S8W2; Match level="QueryCoverage=71%, HitCoverage=15%, E-value=3e-12, Identity=64%"; Hit description=O -methyltransferase, family 2
MVPLLEGSRELLHCEQGDEECIKILKNCREAIPKENGKVIIVDQVIEEGSKESSKWKDSAHTLESIHALQFVIIAFY

SEQ ID NO: 184969 - protein, 1180 aa, Glycine max
  Coding DNA Sequence Number=SeqID_68191
  Gene Ontology: Mol. function=transferase activity; Cellular component= integral to membrane; Biological process=response to oxidative stress
  Homolog annotation: Hit_ID=Q1RSQ4; Match level="QueryCoverage=99%, HitCoverage=100%, E-value=0.0, Identity=77%"; Hit description=C2
  Pfam annotation: Domain name=C2; Domain location=3-88; Score=87.5; E _value=4.2e-23; Accession=PF00168.20; Description=C2 domain
  Pfam annotation: Domain name=C2; Domain location=441-522; Score =100.6; E_value=4.5e-27; Accession=PF00168.20; Description=C2 domain
  Pfam annotation: Domain name=C2; Domain location=604-686; Score=81.8; E_value=2.1e-21; Accession=PF00168.20; Description=C2 domain
  Pfam annotation: Domain name=C2; Domain location=768-862; Score=79.9; E_value=7.9e-21; Accession=PF00168.20; Description=C2 domain
  Pfam annotation: Domain name=PRT_C; Domain location=1025-1180; Score =434.6; E_value=1.3e-127; Accession=PF08372.1; Description=Plant phosphoribosyltransferase C-terminal
  Pfam module annotation: Pfam domain module=C2::C2::C2::C2::PRT_C; Domain location=3-88::441-522::604-686::768-862::1025-1180
MKLVVEVINAHDLMPKDGEGSASPFVEVDFENQLSRTRTVPKNLNPTWNQKLIFNLDATKPYHRQTIEVSVYNERRLTPGRNFLGRVRIPCSNIVKEGEEVYQIFPLEKKWFLSPVKGEIGLKIYIASESNSKPKPLSPVFPSEQEKLPPSTPPREPESTISDLPPPPHSIPSGLTDRTLEADLSEELPAFDTPKASTEEAEVYYVAEARSSSVDIDQEPKKENREAVVETVQQLDKHQVLQPQTISIKRRPQGTPSTMHSVDPQVQSSHHENYNHNDTNQQPRISIKRRPLAQGAPFTMHSGDPQVQPSHGEGYNHNDTNLQPRISIKRRPRGPGTPSSMHSFNPQVHASRNESYNNLMGTNPQQPRILVERQPQNTPLTVHRVSPQVPTSNDENYNLSDTNVQLGERWPSDGAYGRRGWVSGSDRFTSTYDLVEQMFYLYVRVVKAKDLPPSTITSSCDPYVEVKLGNYKGRTKHFEKKLNPEWNQVFAFSKDRIQSSVLEVFVKDKAMVGRDDYLGRVVFDLNEVPTRVPPDSPLAPQWYRLEDWREEGKVRGDIMLAVWMGTQADEAFSEAWHSDAATVYGEGVFNVRSKVYMSPKLWYLRVNVIEAQDVIPGDRNRLPDVFVKAQVGCQVLTTKICPTRTTTPFWNEDLVFVACEPFEEQLTITVEDRVHPSKDEVLGKISLPMTLFEKRLDHRPVHSRWFNLEKFGFGVLEGDRRNELKFSSRIHMRVCLEGGYHVLDESTLYTSDQRPTARQLWKQPIGILEVGILGAQGLLPMKMRDGRGSTDAYCVAKYGQKWVRTRTLLDTFSPKWNEQYTWEVYDPCTVITLGVFDNCHLGGGEKAPGDSAARDSRIGKVRIRLSTLEANRIYTNCHPLLVLHQHGVKKMGEIQLAVRFTALSLANMVHIYGQPLLPKMHYLHPFTVNQIDNLRYQAMNIVAARLGRAEPPLRKEVVEYMLDVDSHMWSMRRSKANFFRIMSLFSGMITMGKWFSDVCLWKNHVTSVLVHILFLILIWYPELILPTVFLYMFLIGLWNYRFRPRHPPHMDTKLSWAEAVHPDELDEEFDTFPTSRSQDVVRMRYDRLRTVAGRIQTVVGDIATQGERFQSLLSWRDPRATSLFVVFSFCAAVVLYATPFRVVALVTGLYFLRHPKFRSKMPSVPSNFFKRLPARTDSLL

SEQ ID NO: 184970 - protein, 579 aa, Glycine max
  Coding DNA Sequence Number=SeqID_68192
  Gene Ontology: Cellular component=endoplasmic reticulum
  Homolog annotation: Hit_ID=Q6KA74; Match level="QueryCoverage=96%, HitCoverage=95%, E-value=1e-104, Identity=39%"; Hit description =Ankyrin repeat protein-like
  Pfam annotation: Domain name=Ank; Domain location=80-112; Score=21.9; E_value=0.0022; Accession=PF00023.20; Description=Ankyrin repeat
MAKSSKNPTTSYPAIKAEQYLHSPVHYALAIRDHTKLSRIISSLPRVPDPARVITESDSLSQDRVGEKISAVLDRRDVPFRETPLHLAVRLNDVAAARAIASAGADISLHNAAGWNPLQEALCLRASDIAQVLVRLHHRAAWAKWRRRLPRLVAALRRMRDFYMEISFHFESSVIPFVGKIAPSDTYKIWKRDGNLRADTTLAGFDGLKIHRANQSFLFLGDGDAIAGVPAGSLLVLNRDDKKIFDAFENAGAPMSDSDAAGFCSQSSVYRPGMDVTKAELVGRTNWRRQEKMENVGEWKARVYEVHNVVFSFRSRKVTGGESDVAGSEQVLPLELDEDEDGFLVAENPSFGMPLGSNNSDKRRHSSFVREEREWVPIGRKSVDFPSVSVAPPRRSSAAAAAPAAPLTKEKEYLRSLRPAVWLTEQFPLKTEELLPLLDILANKVKAVRRLRELLTTKFPPGSFPVKVAIPVVPTVRVVVTFTKFVELQPVEKFYTPLSSPTHLLNADDDDPSGRSTCLRRTSTSHSWGGGSKHQQRSSSSSGALDSDPFAIPVGYTWTNNGDDSSRKLNKSKSVRKSK

SEQ ID NO: 184971 - protein, 126 aa, Glycine max
  Coding DNA Sequence Number=SeqID_68193
MTRGIANLQCWPKYHYYVTRLRINNEITEDASQSLLNQAEILKLVSRQDNIKDRLGNERKMASEAPRWADQWGAGGIGAMEDDDATRSQKDMRKNKNSGGFAKIKSGASICVTWIKNQFKRNNTSK

SEQ ID NO: 184972 - protein, 153 aa, Glycine max
  Coding DNA Sequence Number=SeqID_68194
  Subcellular localization annotation: CTP_CleavageSite=57; ConfidenceScore=5.37e-01
MPKVKRFRNPQKSAPQPQCHGPLTQAPTHSVPAMNPEISSPPSDSTQAPEVPTGNVPLSHVSTSEVPQEDETIRRHVGRESTQCWTVEAIDSKETIKKIKVKVRGVNSLPRELCIIVNFDDQGQAIGEAQTLLTGFLGTLATDCKLFPMDYDR

SEQ ID NO: 184973 - protein, 134 aa, Glycine max
  Coding DNA Sequence Number=SeqID_68195
  Gene Ontology: Mol. function=transferase activity, transferring selenium-containing groups; Biological process=selenium metabolic process
  Homolog annotation: Hit_ID=Q6LP06; Match level="QueryCoverage=99%, HitCoverage=36%, E-value=4e-46, Identity=63%"; Hit description=tRNA 2-selenouridine synthase
MARRAFQIDAVGQFVDQQRLAAAGIAAHQDHRQLRALRQYTEQIIAQRFITASDTRIIHASLVQPLLHQLRAQPAAEAVNIAFGPRCAGRQPGGGALFAQFAVHQAVAERDRRLLPMLLIAGADRLAFAVDHQR

SEQ ID NO: 184974 - protein, 255 aa, Glycine max
  Coding DNA Sequence Number=SeqID_68196
IPRKCLEEKAKALANQGEWATFINVLALLVFGTVLFPNVDGLVDLVAIDAFLAYHHSKESPIIAVLADTCDIFDLRFCLLQGHLMCSEEGKENWEELLVGMTGVSISWFPRWKEGEPGVLCSCYPMRGESSEKIITPFIERGFNEANAKILHKICKAWNRVGRKDKELRGGSNGVISDYHKWLKSRMQGIAWLPKLRSLSRKEAEILVESEEVQALKAELERTRLVKENLKTVVTRVRKECDELKDINMTTVEAL

SEQ ID NO: 184975 - protein, 158 aa, Glycine max
  Coding DNA Sequence Number=SeqID_68197
  Gene Ontology: Mol. function=chitin binding; Cellular component =extracellular region; Biological process=chitin metabolic process
  Homolog annotation: Hit_ID=UPI000044ABC7; Match level="QueryCoverage =58%, HitCoverage=47%, E-value=2e-10, Identity=33%"; Hit description =PREDICTED: similar to retinitis pigmentosa 1-like protein 1, partial
  Subcellular localization annotation: CTP_CleavageSite=12; ConfidenceScore=5.29e-01
MLVRMIRTRLFAAARVKSCPGMHSSCVIASLSGCARTVGPPPISGGGPGTVRMWSTLKMRTRSPLKVRACSPLKARTCSPLEVRACSPLMVRTCSPLKVRACSPTKVRTCSPLMARACSPLKVRTCSPLKVRVRACSPAKVKAHDPLTARTCSPLKLK

SEQ ID NO: 184976 - protein, 149 aa, Glycine max
  Coding DNA Sequence Number=SeqID_68198
MKLMSSSRCVMRESIALKRSPAKARRYLSSVRTSFNKEDEESRCGGGEGVGRLCLSPKIPKLMWSSGIGDGRLRLRTSTSFRYPKEATTLAPIANKCLTLTKENRVNNHLEEKEGLGGTGGSPVVPWRRCPTAVVVEDEPFQFLDGSVI

SEQ ID NO: 184977 - protein, 141 aa, Glycine max
  Coding DNA Sequence Number=SeqID_68199
  Gene Ontology: Mol. function=nucleic acid binding
MQFGVEKLVRSNYKYWRLCMEAFLQGQDLWDLMAKNDKKMPPDTPDTMEARRKWKVKYGKMLFVLRMTVNKELIDHIRDLDTPKDVWETLEKLFSKKNVARLQLLENELASTVLGNLTIAEYFLKIKNLCVDLSEKISEAR

SEQ ID NO: 184978 - protein, 298 aa, Glycine max
  Coding DNA Sequence Number=SeqID_68200
  Pfam annotation: Domain name=Transposase_23; Domain location=77-147; Score=-1.4; E_value=0.0016; Accession=PF03017.5; Description =TNP1ENSPM transposase
MDVPQLFLPASRRIAAANPSNQGPARGVHHRKSDATAHGILQPDAVPDSVPNAILGTCTTSRASGWSLRSSRNDPETGDSDRCGLYIEADPTRLVALRRVYEGSTVVHNTPLLPGQVKVSVEEVTDADALVPVPTDEVSLVGQALHTFLAWLTHLVKSLSQQVVVSPAKPPPKPDPEVDDPLYLMTLTIPELFLRPYQVTWDATMFGAFNPDFPLYIKHEDLSEIAHGGQCLSISVLQLWIMHLTDTSMRAGNYDIYGFLEPQSIQRFGQSQFESESYIKTWMQSSKRDVYLGAYLNG

SEQ ID NO: 184979 - protein, 91 aa, Glycine max
  Coding DNA Sequence Number=SeqID_68201
MALKTCSTADKCTGSHNGGCEGRWSTCWSSYWASDATKDVLYLTTFLCSMLSPGLLNPDVSCMFNLILAKHHPQIPLVDIPTTRLPYPDPS

SEQ ID NO: 184980 - protein, 137 aa, Glycine max
  Coding DNA Sequence Number=SeqID_68202
MAVSKLRMMQRKTKGQIRASFSTETARQVWKIPLWLKGSSRCGVSTENNGGEEMAFFQSYLDCKAQNAQVTNALRNGNVAHTPETKFREDPTVNEDWAAFLSRQLHVASLRSFIKRLPHGFFEKLDSYLPTPLYELN

SEQ ID NO: 184981 - protein, 75 aa, Glycine max
  Coding DNA Sequence Number=SeqID_68203
DDKKCGAVDKSEAFAPTFPQFEMRNSDLRSSSLHDVRITGRCLHMLPGSWVMIAKGVVIDKSGAFAPTYPQLVMR

SEQ ID NO: 184982 - protein, 118 aa, Glycine max
  Coding DNA Sequence Number=SeqID_68204
  Subcellular localization annotation: CTP_CleavageSite=28; ConfidenceScore=5.17e-01
MYPLLFSVKPKSSTCTTKDVSSNVLRQRSQAVKRLILCEWGYKRILRREKGDTKEFRRLVLRSFGKGRRETQKEFKRLVLGEFFLAKGEEMKRMNSTSFQGLENQKTLESFWRKEEEE

SEQ ID NO: 184983 - protein, 114 aa, Glycine max
  Coding DNA Sequence Number=SeqID_68205
  Subcellular localization annotation: CTP_CleavageSite=18; ConfidenceScore=5.25e-01
MFNAPAKVFHRSSSFFVRSSSFFGLQPLRGLGIRWGKNRSRVEKREERVYHTGYDSYNNILLFVHTYTYNNPMNQSHIHAQDKKTEIHTMCDLTLLPETYFQVSEIHNIHTARP

SEQ ID NO: 184984 - protein, 61 aa, Glycine max
  Coding DNA Sequence Number=SeqID_68206
  Subcellular localization annotation: CTP_CleavageSite=48; ConfidenceScore=5.17e-01
MRGYLMVIHTFGQPGANKHVDARVYHMVTRTFGQPGANEPVGARRLTSSSTPFGVLTREVR

SEQ ID NO: 184985 - protein, 272 aa, Glycine max
  Coding DNA Sequence Number=SeqID_68207
  Gene Ontology: Mol. function=aminoacyl-tRNA ligase activity; Cellular component=membrane fraction; Biological process=alanyl-tRNA aminoacylation
  Homolog annotation: Hit_ID=Q8PLQ0; Match level="QueryCoverage=61%, HitCoverage=18%, E-value=3e-88, Identity=91%"; Hit description =Alanyl-tRNA synthetase
ERRALVVTDAHDARFRNADHVAPQFVGFVIGLVDGDQQALGRQLPDLGQQFPGPGDRVLLEVVAEGPVTQHFEEGVVACGVADLVEVVVLAAGAQAALDVGRAHIATLLRTKEHVLELHHAGVGEQQGRIIARHQRRRRHDGVAFALEEFKEVAADLGSREFGGCVHWGLAVCGPAGPDHRPHWPGSRGTAENLKGIRPGAASLSHPGRSGSHGGCCRRRSRVGPADRRPCAAASGPAGRPRQSVGGPDHGHFPASRLRSCPSPRQSRHCPG

SEQ ID NO: 184986 - protein, 221 aa, Glycine max
  Coding DNA Sequence Number=SeqID_68208
MARTKKNGQMTSEASKEIADKIASQGSFVAHGHWDVLTAAIGRQEHAGRVRAAGAGPPHFFVHGSRRPGAADAKDQGPAGGANHRKSDSTTNVVLQPDAVPVGPLAARVSIKESCIDPSGNDLDTGDSEKCRLYIKENPPHLIALGRLYEGSTTVHNIPLHHDQVKVGVEEVRDANAPIPVPTQEGAVRSGKSAHRSDHHVDDPLYLMTLTIPRLFLKLLQ

SEQ ID NO: 184987 - protein, 158 aa, Glycine max
  Coding DNA Sequence Number=SeqID_68209
  Homolog annotation: Hit_ID=Q1T159; Match level="QueryCoverage=51%, HitCoverage=67%, E-value=1e-10, Identity=45%"; Hit description=Beta tubulin
  Pfam annotation: Domain name=DUF1723; Domain location=79-128; Score =56.6; E_value=8e-14; Accession=PF08330.1; Description=Protein of unknown function (DUF1723)
MTQDVPDMTEDVPDMAEDAPEMTGDVQGDDGVEGSHVDDAEGFPGGPRDPSVLTSFPGGVTRRLEWTGLSPLIGCSVVTGDPGLISAFVERWHNETSTLHLPVGQLTITLDDVSSLLHLPITGALHSFHALFADEVIFLLTKLLEVSAEEARAETARS

SEQ ID NO: 184988 - protein, 141 aa, Glycine max
  Coding DNA Sequence Number=SeqID_68210
MVTQMISTRSAAHCVHQTTMWILQHLKCYSWDAKALIAIAALSLEYGSFVHLTQFQTDDVLGNSLRQLNQVQNRNASAVGELVMYVVQVFQHINEWTTYADDGYDPEDVPDLTEAFQAILVVVYWSIASTVASTGNLIGVS

SEQ ID NO: 184989 - protein, 55 aa, Glycine max
  Coding DNA Sequence Number=SeqID_68211
MNRGASASYVEEKDSMGIMGNTHAVTKENNIIADVADRAEVVGRLKGRIESGGSI

SEQ ID NO: 184990 - protein, 138 aa, Glycine max
  Coding DNA Sequence Number=SeqID_68212
MVVCIGSELQHSISSVSICYGTQSDIRVKSYGHLYWLRASTFNFERLDMLRDSIRHPSQKLLSFVLAQSFNIQFRASRYITGLNQTSEGSTFNFERLDMLRDSIRHPSKKLLSFELAQSFNIQFRASRYITGLNQTSE

SEQ ID NO: 184991 - protein, 272 aa, Glycine max
  Coding DNA Sequence Number=SeqID_68213
  Gene Ontology: Biological process=peptidoglycan metabolic process
  Homolog annotation: Hit_ID=Q0TE35; Match level="QueryCoverage=97%, HitCoverage=31%, E-value=1e-105, Identity=70%"; Hit description =Putative VGR-related protein
  Pfam annotation: Domain name=DUF586; Domain location=102-180; Score =46.2; E_value=1.1e-10; Accession=PF04524.3; Description=Protein of unknown function, DUF586
HTPDPESGAFYARIRHERYLNQQTRLNGETNCAALAPGQQLKVSGGEEVTDVWRQGVAIAAIHCRARRDRSFVMTFQAIPCVETYCFRPAVISKPRMAGTLPARVTSTKINDLYGHIDRDGRYRVNLLFDRDRWQPGEESLWVRQARPYAGETFGLHLPLLAGTEVAIAFEQGDPDRPYIAGALHDSTHQDHVTLYNYKRNVLRTPANNKIRLDDTRGKEHVKVSTEYGGKSQLNLGHLVDHQNTPRGEGFELRTDSYGAIRGGKGIFITAR

SEQ ID NO: 184992 - protein, 313 aa, Glycine max
  Coding DNA Sequence Number=SeqID_68214
  Homolog annotation: Hit_ID=Q47522; Match level="QueryCoverage=16%, HitCoverage=70%, E-value=5e-14, Identity=70%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRYAGYEDNMVLQQGAPLTLSGRTQAGVKVEARLGKTGASAVSDGSGAFSITLPAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 184993 - protein, 245 aa, Glycine max
  Coding DNA Sequence Number=SeqID_68215
  Gene Ontology: Mol. function=glucose-1-phosphate thymidylyltransferase activity; Cellular component=cytoplasm; Biological process =extracellular polysaccharide biosynthetic process
  Homolog annotation: Hit_ID=Q0Z0Y8; Match level="QueryCoverage=58%, HitCoverage=48%, E-value=1e-71, Identity=91%"; Hit description =Glucose-1-phosphate thymidylyltransferase
  Pfam annotation: Domain name=NTP_transferase; Domain location=104 -245; Score=67.7; E_value=3.9e-17; Accession=PF00483.13; Description =Nucleotidyl transferase
MAAGQPGWRHLSPDGLRAHHLAWIGLTCRRACAPKWSNAQDRSGQHQTHCDRRISGPGGSTEELQAEYRRPDNSAETAVTSLDGPRRPHGRSTLVFGTLRMKRKGIILAGGSGTRLHPATLAISKQLLPVFDKPMIYYPLSTLMLSGIRDILVISTPQDTPRFQQLLGDGSQWGLNLQYAVQPSPDGLAQAFLIGEKFLGNDLSALVLGDNIFYGHDFHQLLANAHARTDGASVFAYHVHDPERY

SEQ ID NO: 184994 - protein, 137 aa, Glycine max
  Coding DNA Sequence Number=SeqID_68216
  Gene Ontology: Mol. function=DNA binding; Cellular component =endoplasmic reticulum membrane; Biological process=DNA integration
MGAKYLEVVKRGSHPNNRWSPDKIREELNQFERNNVWELVEKPENYPIIGTNKPELNQFSHDMQSEFEMSTMGELNFFLGLQIKKTKEGIFVNQSKYCKELIQRFGMESAKHTATPMSTGCYLDKDETGQSIDIKQY

SEQ ID NO: 184995 - protein, 76 aa, Glycine max
  Coding DNA Sequence Number=SeqID_68217
MENWRTALRNNFAGLQTRWWRMHEQRQAMTFMGLRKKVENGELTRWWRMHEQRQAMTFKGLRKKVENGELVKSATQ

SEQ ID NO: 184996 - protein, 100 aa, Glycine max
  Coding DNA Sequence Number=SeqID_68218
MINDGTYEFGDPTVMWLRMPRTLGSRGNTGSNKDRRKSLKVYQSHTGQGLTFSPWVKVYDKLGFWLKACRTTGHDICQGLASGSRIKGMPYIISMIHMQQ

SEQ ID NO: 184997 - protein, 79 aa, Glycine max
  Coding DNA Sequence Number=SeqID_68219
MPQNLERWGLCTGRKVSIPFNPINAKFQKFWNGARKVASFYYWEWRESVNDEMRRRVQVREKKAETVTPANNDTNKGAV

SEQ ID NO: 184998 - protein, 466 aa, Glycine max
  Coding DNA Sequence Number=SeqID_68220
  Gene Ontology: Mol. function=hydrolase activity; Cellular component =mitochondrial inner membrane; Biological process=metabolic process
  Homolog annotation: Hit_ID=Q9C507; Match level="QueryCoverage=83%, HitCoverage=89%, E-value=2e-91, Identity=31%"; Hit description=PPR -repeat protein, putative
  Pfam annotation: Domain name=PPR; Domain location=109-143; Score =40.3; E_value=6.7e-09; Accession=PF01535.11; Description=PPR repeat
  Pfam annotation: Domain name=PPR; Domain location=144-178; Score=0.9; E_value=5.8; Accession=PF01535.11; Description=PPR repeat
  Pfam annotation: Domain name=PPR; Domain location=211-245; Score =33.4; E_value=7.8e-07; Accession=PF01535.11; Description=PPR repeat
  Pfam annotation: Domain name=PPR; Domain location=274-308; Score =18.5; E_value=0.024; Accession=PF01535.11; Description=PPR repeat
  Pfam annotation: Domain name=PPR; Domain location=8-42; Score=27.8; E_ value=3.9e-05; Accession=PF01535.11; Description=PPR repeat
  Pfam module annotation: Pfam domain module=PPR::PPR::PPR::PPR::PPR; Domain location=109-143::144-178::211-245::274-308::8-42
MKCVRDLVSWSSVVTCYVENGRPGEGLEMLPWMVSEGIVPDSVTMLGIAEAGDKVGCLRVVRSVHGYVIRKEMAGDASVRNSLIVMYSQCGYLRGAKGVFESVADQSTACWTSMISSCNQNGRFEEAIDAFKKMQESEVEVNEVTMISVLCCCARLGCLKEGKSVHCFILRREMDGADLDLGPALMHFYSACWKISSCEKILCLIGNSTVVSWNTLIPIYALEGLNEEAMVLFACMLEKGLMLDSFSLCMYAGSIRFGQQIHGHVTKRGFVDEFVQNSLMDMYSKCGFVDLAYTIFEKMKEKSMVTWNCMICGFSQNGISVEALKLFDEKDLYIDTSLVDMYAKCGDLKTAQGVFNSKSKKSVVSWNAMIAAYGIHGFDDIKKNLFDNECHHQKGENVNHACFDDVEKKSFDNMIVIIKKEKNVNVCIHDFDYVKEESNKVASKDKHCFKINTRLFQQTKSCFKIH

SEQ ID NO: 184999 - protein, 76 aa, Glycine max
  Coding DNA Sequence Number=SeqID_68221
MEKSDKMNFKEKKEKKGYITWEDNVINYSSDSEKKIISLGILMKDYENGEEQSQYIDSNFSKHMACIKVYSYFSPR

SEQ ID NO: 185000 - protein, 71 aa, Glycine max
  Coding DNA Sequence Number=SeqID_68222
MGSGNAMWLDSHVDLNESSFPRRCNSSYFGNGKIFGARDARGGVDPYHLDLVLISLFFNKIESGSSPTRIE

SEQ ID NO: 185001 - protein, 112 aa, Glycine max
  Coding DNA Sequence Number=SeqID_68223
  Homolog annotation: Hit_ID=Q1SWX1; Match level="QueryCoverage=90%, HitCoverage=20%, E-value=2e-07, Identity=28%"; Hit description=IMP dehydrogenase/GMP reductase
MAEVSTEAIASLTQYYDQPLRCFTFGDFQLTPTVEEFEEILGCPLGGRTPYLFSGFYPSLARISKIVKISAQELDQGKQVKNGVVRVPRKCLEAKARTLASRDEWASFIDVL

SEQ ID NO: 185002 - protein, 108 aa, Glycine max
  Coding DNA Sequence Number=SeqID_68224
MEDCLEVPLLGNHGIQLQTRKWRTRERQRNSLTRLRKRMRMEDCLEGPLLDNHGTQLQTQKWRTRERQRNSLTWLRKRMRMEDCLEGPLLDNHGTQLQTQKWRTHEQP

SEQ ID NO: 185003 - protein, 90 aa, Glycine max
  Coding DNA Sequence Number=SeqID_68225
MIRGDTLRLFAPFCHPEAAGPMTSRDQVWSFCTLVSSRGGRPDDTRKYPSGYPYKHLLLSERQVMVTHDSRQPRGAKLVSYTDIRPGTFA

SEQ ID NO: 185004 - protein, 168 aa, Glycine max
  Coding DNA Sequence Number=SeqID_68226
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=32%, E-value=7e-62, Identity=81%"; Hit description =Photosystem I P700 chlorophyll a apoprotein A2
DPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHK

SEQ ID NO: 185005 - protein, 229 aa, Glycine max
  Coding DNA Sequence Number=SeqID_68227
  Gene Ontology: Mol. function=DNA binding
  Homolog annotation: Hit_ID=Q1RUD8; Match level="QueryCoverage=97%, HitCoverage=49%, E-value=9e-14, Identity=29%"; Hit description=IMP dehydrogenase/GMP reductase
MVRFGTVSQYYDQPLRCFTFEDIQLVPTVKEFEEILGCPLGGRKPYLFSGFYPSTTRVSKVVKPQHKSWTCKAKQKWRSRSTKEVFGGKGQRPWQNQGEWASFIDILALLIFGVVLFPNMEGLVDLAVIDAFLAYHNHKESPVVAILAMYDTFNRGCRPVYPLQGHRSCIEKGKANWDQLLASMERRLLIGSLAGRKEESGFYLHAKDVQMSLDGTRGCINYNPVLVIR

SEQ ID NO: 185006 - protein, 196 aa, Glycine max
  Coding DNA Sequence Number=SeqID_68228
  Homolog annotation: Hit_ID=Q877K9; Match level="QueryCoverage=72%, HitCoverage=34%, E-value=1e-09, Identity=31%"; Hit description=TraO protein
MASLIVGGVVAVVDGGYALWSYLAAPPPAVSNVNSEPGSRYRAGERAGAAGLPRKAARKQRHGGAERHGLKPELYRQHPAGAGRDRAEGTGEGRAGCGAARAAAPAGYRAHAGAGEGAGRDPTEIACRPAREDAGPAGGRRTARRSAAGRKGQRLGELARFAARELRAAGRRAQPAGCGEYAAGDRGGRSVMARAG

SEQ ID NO: 185007 - protein, 201 aa, Glycine max
  Coding DNA Sequence Number=SeqID_68229
  Gene Ontology: Mol. function=helicase activity
  Homolog annotation: Hit_ID=Q1SRJ5; Match level="QueryCoverage=98%, HitCoverage=23%, E-value=9e-57, Identity=52%"; Hit description =Probable helicase [imported]-Arabidopsis thaliana-related
MVHGPCGSLNPGSPCMKKGKCSRFYPKMFQPHTVLDADGFPVYRRRNNGNAIEKNGVIVDNRYIVPYNPRLLRKYQAHINIEWCNQNTSIKYLFKYINKGYDRVTAVLIDEDNDQTENGGTHNDEIKEYLDCRYICPCDLLGDLWISNTWQKLVVERLHFHLPGQHIVLYEDHDDIDDVLSKPSISDSKFISWMYTNQNSV

SEQ ID NO: 185008 - protein, 97 aa, Glycine max
  Coding DNA Sequence Number=SeqID_68230
MEKSDKMNFKEKKEKKGYITWEDNVLNYSSDSEKKIISLGIMMKDYENGEKQSRYIDSNFSKHMACIKVYSYFSPRKVNMRFMETTNKGHLINNLNK

SEQ ID NO: 185009 - protein, 69 aa, Glycine max
  Coding DNA Sequence Number=SeqID_68231
  Subcellular localization annotation: CTP_CleavageSite=31; ConfidenceScore=5.26e-01
MPISPYGNISWGRAHKTPSGPGEVQQGPGVSSSGYGPLSVLQGVRPPSKGSCPQDTQWTRRRPTGSWGF

SEQ ID NO: 185010 - protein, 71 aa, Glycine max
  Coding DNA Sequence Number=SeqID_68232
MTKLGLCVPTDTTVSEWQRGADNRKVSPRIIMTKLGLCVPSDTTVSEWQRGADNCKNDQTWSLRANGHDCV

SEQ ID NO: 185011 - protein, 157 aa, Glycine max
  Coding DNA Sequence Number=SeqID_68233
MTLLLSNILPSDRNANLPLQKYQLVCVVPTWGSHPHRHPVDLKKSNRALGFPALVTGLCRPYRAPVPPSKFKSSWHRDCARKTPSGPEEGQQGLGVASSKYGSLSSGPPTNRAFIKKFCAPRQAQGETPHQHWDGRQRATDALPSPLEFSSALPLKG

SEQ ID NO: 185012 - protein, 101 aa, Glycine max
  Coding DNA Sequence Number=SeqID_68234
  Homolog annotation: Hit_ID=Q1RZ53; Match level="QueryCoverage=91%, HitCoverage=24%, E-value=6e-10, Identity=39%"; Hit description =Cyclin-like F-box; F-box protein interaction domain
MFGFGYDPSSDKYKVVAIALTMLSLDVSQKTEMKVYSAGDSSWRNLKGFPVLWTLPKVGGVYLSGTLNWIVIKGKETIHSEILINSVDLEKETCTMANMFH

SEQ ID NO: 185013 - protein, 81 aa, Glycine max
  Coding DNA Sequence Number=SeqID_68235
  Homolog annotation: Hit_ID=Q1SC55; Match level="QueryCoverage=46%, HitCoverage=8%, E-value=7e-09, Identity=76%"; Hit description=TBC domain, putative
AGKTLSARKWHAAFTPEGYLDIGKTLSRIYRGDMEFSLSTIHYGVVSATGNTCLLEKPKEHEIPLPWLRLKNVQTTSIRIN

SEQ ID NO: 185014 - protein, 63 aa, Glycine max
  Coding DNA Sequence Number=SeqID_68236
MNTFKNSKEKWKNELKSSILDLDLLPRLLREEEVVTNNMHSLLLDMHETLQTNIFRVSQGCHF

SEQ ID NO: 185015 - protein, 101 aa, Glycine max
  Coding DNA Sequence Number=SeqID_68237
  Subcellular localization annotation: CTP_CleavageSite=65; ConfidenceScore=5.21e-01
MSISPCESISWSVPSRHRDRSSKTPSGPREVQQGPGVSSSGYGPLDRARKTPSGPGQVQQGLGVSSSDYGPLSVLRSACRPQQGRHRARHHSSLRMAGSGQ

SEQ ID NO: 185016 - protein, 180 aa, Glycine max
  Coding DNA Sequence Number=SeqID_68238
  Homolog annotation: Hit_ID=Q1S3Z1; Match level="QueryCoverage=37%, HitCoverage=5%, E-value=6e-08, Identity=47%"; Hit description =Integrase, catalytic region; Zinc finger, CCHC-type
VHENTKAFFSSSSSILLDPLAHGSGNWSLPREDCINSIVTGSILTVSQARSHVSNDNSLWHMCLSQMSEMVMEIRSMQRLLGNHKMDPLQFYEHCIYGKQHRMKLSKKAVASGGSNPARLGELGSKHLPYFAINRGGSEKEKAEALPKRFRNVFREEFRKGFDRSSTFFIRSSSFFDLQR

SEQ ID NO: 185017 - protein, 62 aa, Glycine max
  Coding DNA Sequence Number=SeqID_68239
MEREEKRELYRIHCSSEENNVGDDMEEGICVVCALDAPWLQVSVTEEEVETPFRFFDGKDTL

SEQ ID NO: 185018 - protein, 195 aa, Glycine max
  Coding DNA Sequence Number=SeqID_68240
  Gene Ontology: Mol. function=sodium:dicarboxylate symporter activity; Cellular component=membrane; Biological process=dicarboxylic acid transport
  Homolog annotation: Hit_ID=Q9LT83; Match level="QueryCoverage=79%, HitCoverage=30%, E-value=2e-70, Identity=83%"; Hit description =Arabidopsis thaliana genomic DNA, chromosome 3, P1 clone: MLD14
MAHLQEIDRVKNEVIRLERESVIPILKPRLIMTLANLIEHSSDRAEFLKLSKRIEYTIRAWYLLQFEDLMQLYSLFDPVHGAQKLEQQKLSSEEIDVLEQNFLTYLFQVMEKSNFKIVTDDEIDVAHSGQYLLNLPITVDESKLDKILLKKYFEEHHHDDLPDFSDKANLARPNGPGWATKAWPMRYSGQAVFTI

SEQ ID NO: 185019 - protein, 88 aa, Glycine max
  Coding DNA Sequence Number=SeqID_68241
MTNDYIYLHLWADFDREVTCTFGISLKNDDNCFVPMPLNNFGSSRGPIQSNVMKTASRGGERRNIGFVVTGTAHVFATVMRLQVALNN

SEQ ID NO: 185020 - protein, 67 aa, Glycine max
  Coding DNA Sequence Number=SeqID_68242
MQSLCGNHGDCRTDLAGEGVLPENGGPAVRVSERESEGKRCESGKAAKYVEKLCLIWSENGNVCLSL

SEQ ID NO: 185021 - protein, 1015 aa, Glycine max
  Coding DNA Sequence Number=SeqID_68243
  Gene Ontology: Mol. function=protein serine/threonine kinase activity; Cellular component=integral to membrane; Biological process=protein amino acid phosphorylation
  Homolog annotation: Hit_ID=Q1ENX0; Match level="QueryCoverage=95%, HitCoverage=93%, E-value=0.0, Identity=54%"; Hit description=Leucine- rich repeat-containing protein kinase family protein
  Pfam annotation: Domain name=LRRNT_2; Domain location=28-70; Score =42.2; E_value=1.8e-09; Accession=PF08263.3; Description=Leucine rich repeat N-terminal domain
  Pfam annotation: Domain name=LRR_1; Domain location=121-140; Score =11.2; E_value=2.3; Accession=PF00560.23; Description=Leucine Rich Repeat
  Pfam annotation: Domain name=LRR_1; Domain location=144-166; Score =11.3; E_value=2.2; Accession=PF00560.23; Description=Leucine Rich Repeat
  Pfam annotation: Domain name=LRR_1; Domain location=168-189; Score =9.2; E_value=5.4; Accession=PF00560.23; Description=Leucine Rich Repeat
  Pfam annotation: Domain name=LRR_1; Domain location=191-213; Score =14.2; E_value=0.48; Accession=PF00560.23; Description=Leucine Rich Repeat
  Pfam annotation: Domain name=LRR_1; Domain location=215-237; Score =11.6; E_value=1.9; Accession=PF00560.23; Description=Leucine Rich Repeat
  Pfam annotation: Domain name=LRR_1; Domain location=239-261; Score =16.7; E_value=0.086; Accession=PF00560.23; Description=Leucine Rich Repeat
  Pfam annotation: Domain name=LRR_1; Domain location=305-327; Score =2.2; E_value=1.1e+02; Accession=PF00560.23; Description=Leucine Rich Repeat
  Pfam annotation: Domain name=LRR_1; Domain location=329-351; Score =9.8; E_value=4.1; Accession=PF00560.23; Description=Leucine Rich Repeat
  Pfam annotation: Domain name=LRR_1; Domain location=353-376; Score =11.6; E_value=1.9; Accession=PF00560.23; Description=Leucine Rich Repeat
  Pfam annotation: Domain name=LRR_1; Domain location=377-398; Score =1.4; E_value=1.6e+02; Accession=PF00560.23; Description=Leucine Rich Repeat
  Pfam annotation: Domain name=LRR_1; Domain location=494-517; Score =1.9; E_value=1.3e+02; Accession=PF00560.23; Description=Leucine Rich Repeat
  Pfam annotation: Domain name=LRR_1; Domain location=519-541; Score =1.2; E_value=1.7e+02; Accession=PF00560.23; Description=Leucine Rich Repeat
  Pfam annotation: Domain name=LRR_1; Domain location=543-565; Score =18.7; E_value=0.02; Accession=PF00560.23; Description=Leucine Rich Repeat
  Pfam annotation: Domain name=LRR_1; Domain location=567-589; Score =10.5; E_value=3.1; Accession=PF00560.23; Description=Leucine Rich Repeat
  Pfam annotation: Domain name=LRR_1; Domain location=591-613; Score =13.8; E_value=0.63; Accession=PF00560.23; Description=Leucine Rich Repeat
  Pfam annotation: Domain name=LRR_1; Domain location=615-637; Score =17.2; E_value=0.06; Accession=PF00560.23; Description=Leucine Rich Repeat
  Pfam annotation: Domain name=LRR_1; Domain location=639-660; Score =13.8; E_value=0.62; Accession=PF00560.23; Description=Leucine Rich Repeat
  Pfam annotation: Domain name=LRR_1; Domain location=97-119; Score =15.2; E_value=0.24; Accession=PF00560.23; Description=Leucine Rich Repeat
  Pfam annotation: Domain name=Pkinase; Domain location=766-1015; Score= 126.7; E_value=6.7e-35; Accession=PF00069.15; Description=Protein kinase domain
  Pfam annotation: Domain name=Pkinase_Tyr; Domain location=766-1013; Score=60.8; E_value=3.4e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=28-70::121-140::144-166::168 -189::191-213::215-237::239-261::305-327::329-351::353-376::377 -398::494-517::519-541::543-565::567-589::591-613::615-637::639 -660::97-119::766-1015::766-1013
  Subcellular localization annotation: CTP_CleavageSite=63; ConfidenceScore=5.40e-01
MDLLFLHSLFFFFFFFTSNDANALDATIPRDALSLLSFKRFVSSDPSNLLAAWSNRTSPNLCRWRAVACGVAGRVTVLNVTGLRGGELSPSVGDMSELRVLSLAGNMFSGEIPVTLVNLQFLEVLELQGNNFSGKIPTQMSFTFLQVVNLSGNAFSGSIPSEIIGSGNVKIVDLSNNQFSGVIPVNGSCDSLKHLRLSLNFLTGEIPPQIGECRNLRTLLVDGNILEGRIPSEIGHIVELRVLDVSRNSLTGRVPKELANCVKLSVLVLTDLFEDRDEGGLEDGFRGEFNAFVGNIPHQVLLLSSLRVLWAPRANLGGRLPSGWSDLCSLRVLNLAQNYVAGVVPESLGMCRNLSFLDLSSNILVGYLPSLQLRVPCMMYFNISRNNISGTLQGFRNESCGASALDASFLELNGFNVWRFQKNALIGSGFEETNTVVVSHDFSWNSFSGSLPLFSLGDNLSGANRNVSYTLSLNNNKFNGTLLYQLVSNCNDLKTLSVNLSLNQLSSGNFQASFWGCRKLIDFEAAYNQIDGSIGPGIGDLMMLQRLDLSGNKLSGSLPSQLGNLQNMKWMLLGGNNLTGEIPSQLGLLTSLAVLNLSRNALVGTIPVSLSNAKNLETLLLDHNNLSGEIPLTFSTLANLAQLDVSFNNLSGHIPHLQHPSVCDSYKGNAHLHSCPDPYSDSPASLPFPLEIQRTHKRWKLRTMVIAVVTSASVTLCTLLVIVLVIFSRRSKFGRLSSIRRRQVVTFQDVPTELNYDTVVTATGNFSIRYLIGTGGFGSTYKAELSPGFLVAIKRLSIGRFQGIQQFETEIRTLGRIRHKNLVTLVGYYVGKAEMFLIYNYLSGGNLEAFIHDRSGKNVQWPVIYKIAKDIAEALAYLHYSCVPRIVHRDIKPSNILLDEDLNAYLSDFGLARLLEVSETHATTDVAGTFGYVAPEYATTCRVSDKADVYSFGVVLLELMSGRKSLDPSFSEYGNGFNIVPWAELLMTERRCSELFVSTLWEAGPKEKLLGLLKL

SEQ ID NO: 185022 - protein, 90 aa, Glycine max
  Coding DNA Sequence Number=SeqID_68244
MSLHVLYLYAFSRFPPRGFPGQDHLGLPSGVETKHERQKPIKVLKDERKRGWGHDRPIVALLCAKQAGNVAPRQPRILSILQLSFTICLF

SEQ ID NO: 185023 - protein, 216 aa, Glycine max
  Coding DNA Sequence Number=SeqID_68245
  Homolog annotation: Hit_ID=Q1SDS1; Match level="QueryCoverage=61%, HitCoverage=26%, E-value=6e-12, Identity=33%"; Hit description=IMP dehydrogenase/GMP reductase
KYKDCLLYSGPLCMVGFTPFPPREKKEASWDRLLASKEGVSVNWFPRWKEGRTGVLISCGGFPNVPLMGTRGCISYNLVLAIRQLGYPMRGAPLEEELAPIITRGFNNTNAEALQKVHKAWEMVQKKDKELRGSNNGPIGGYLPEEDEEVQALRAELEKALTIKEKFKSATLKIRKENAELRDVNIATTKALEQEAKRARREEHGPEQIPRGSVGQ

SEQ ID NO: 185024 - protein, 76 aa, Glycine max
  Coding DNA Sequence Number=SeqID_68246
  Subcellular localization annotation: CTP_CleavageSite=36; ConfidenceScore=5.16e-01
MAFLGETSSQTVVNSTLGFIFPNGSIVHNDSGVSFQASTPVPIRVPNGCDFQTLKTRIHNTLKLTDKQFLDEIYYW

SEQ ID NO: 185025 - protein, 67 aa, Glycine max
  Coding DNA Sequence Number=SeqID_68247
ASPGAAIKLCLDGNTSDLSAEKLTSNSPLKSDSRMQANIQSENAQVEVESAALHIHLPSNFNPFLPN

SEQ ID NO: 185026 - protein, 299 aa, Glycine max
  Coding DNA Sequence Number=SeqID_68248
  Gene Ontology: Mol. function=serine esterase activity; Cellular component=integral to membrane; Biological process=metabolic process
  Homolog annotation: Hit_ID=Q6A3R0; Match level="QueryCoverage=65%, HitCoverage=49%, E-value=5e-69, Identity=63%"; Hit description=Elip protein
  Pfam annotation: Domain name=Abhydrolase_3; Domain location=104-299; Score=-61.0; E_value=0.00097; Accession=PF07859.3; Description =alphabeta hydrolase fold
  Pfam annotation: Domain name=COesterase; Domain location=1-299; Score= 22.0; E_value=1.1e-13; Accession=PF00135.18; Description =Carboxylesterase
  Pfam annotation: Domain name=Peptidase_S15; Domain location=85-299; Score=-106.2; E_value=0.023; Accession=PF02129.9; Description=X-Pro dipeptidyl-peptidase (S15 family)
  Pfam module annotation: Pfam domain module=Abhydrolase_3::COesterase:: Peptidase_S15; Domain location=104-299::1-299::85-299
MQNPSAPVVETRQGALTGLTDENVHRWCGIPYAAPPVGDWRWRSPRPPERWDGVRDATAFSASSWQSSEYCQELGGGDPGQFSEDCLYLNVWSPVDRPGSLPVMVWLHGGGFTIGAGGLPPYHGKSLAARGVVVVTINYRLGHLGFFAHPALEGEEGRVVHNFALLDQIAALEWVRDNIAGFGGDPTNVTLFGESAGARSVLSLLASPLAAGLFHKAIVQSGYTLPDTPREQALQKGEALTAHFGLENATAGQLRAIPPEAFWPLTAPLNVAPAPIAGDCVLPEAMLDVFFAARQHPVP

SEQ ID NO: 185027 - protein, 295 aa, Glycine max
  Coding DNA Sequence Number=SeqID_68249
  Gene Ontology: Mol. function=protein serine/threonine kinase activity; Cellular component=membrane; Biological process=protein amino acid phosphorylation
  Homolog annotation: Hit_ID=Q8RYK7; Match level="QueryCoverage=98%, HitCoverage=83%, E-value=8e-84, Identity=55%"; Hit description =Putative disease resistance protein kinase
  Pfam annotation: Domain name=Pkinase; Domain location=14-264; Score =19.6; E_value=1e-09; Accession=PF00069.15; Description=Protein kinase domain
  Pfam annotation: Domain name=Pkinase_Tyr; Domain location=14-263; Score=26.6; E_value=4.2e-14; Accession=PF07714.7; Description =Protein tyrosine kinase
  Pfam module annotation: Pfam domain module=Pkinase::Pkinase_Tyr; Domain location=14-264::14-263
AVEMEELSLATKNFSDKNLIGEGKFGEVYKGLLQDGMLVAIKKRRGLASQEFVDEENNLQFLIYEYVPNGSVSSHLYGAGQQPREKLEFKHRLPIAQGAAKGLAHLHSLSPRLVHKNFKTANVLVDENFIAKVADAGLRNFLGRVDIAGSSSQVATDEIFLASEVREFRRFSEKSDVYSFGVFLLELLSGKQATESPFPDSNQNLVEWVLSNQDRGMMSYIIDRRLESSFTAEGMEEYIMLIIRCLDPSSERRPAMSYVEMELVRILDKEMNLTTIMGEGTPTVTLGSQLFKSTK

SEQ ID NO: 185028 - protein, 374 aa, Glycine max
  Coding DNA Sequence Number=SeqID_68250
  Homolog annotation: Hit_ID=Q10RR9; Match level="QueryCoverage=74%, HitCoverage=75%, E-value=3e-16, Identity=25%"; Hit description =Expressed protein
  Pfam annotation: Domain name=DUF677; Domain location=53-368; Score= -114.6; E_value=4.5e-05; Accession=PF05055.3; Description=Protein of unknown function (DUF677)
MLECVSFKSSTPTSISSPLPPPSEEYSLCFPGNSTEELEEGEGTSATSPNVSREFHRAVEAHSYNEIRSMVQAPPQVHHIDDEDSHHRHVLSQVLQPDSHSVREALAKAKPKSNLTRLVSTYFDHSETASDFCLRLSRSVHRARYLYAPLSDLLSVLPADAPLPSLSQPQCNHAYDLFLQFDREENPFALFRLHRLRDSFSDLKRDIQRDLRKCHSRIRLFRHGAAGCALCFVAAAAGTVLVASIVAVHAVVGFSALSAAPFCVPRQKKRELARLKQLEVVENGTHVVNDINTIDSLVDRLQTAVEGDKAFVRFALERGRERHPIQEVLKQLRKNQPVLEHLLGDLEQHICFCFYSVNKARYALLKEICSHQTS

SEQ ID NO: 185029 - protein, 122 aa, Glycine max
  Coding DNA Sequence Number=SeqID_68251
MDAGFQFFDQEGAVQERRGGEEEYCNPKGKKEGEGGILREQGGPPEGGGDRFWFEKYLGKYFKGNVGKTIIKLGKGGEACNTEWQKAIGWFTKCNPYGLDCYNSERFLTSCNHHGNHHHPII

SEQ ID NO: 185030 - protein, 312 aa, Glycine max
  Coding DNA Sequence Number=SeqID_68252
  Gene Ontology: Mol. function=phosphoribosyl-AMP cyclohydrolase activity; Cellular component=chloroplast; Biological process=amino acid biosynthetic process
  Homolog annotation: Hit_ID=O82768; Match level="QueryCoverage=78%, HitCoverage=89%, E-value=3e-98, Identity=72%"; Hit description =Histidine biosynthesis bifunctional protein hisIE, chloroplast precursor [Includes: ...
  Homolog annotation: Hit description=Phosphoribosyl-AMP cyclohydrolase (EC 3.5.4.19) (PRA-CH); Phosphoribosyl-ATP pyrophosphatase (EC 3.6.1.31) (PRA-PH)]
  Pfam annotation: Domain name=MazG; Domain location=231-293; Score= -6.9; E_value=0.017; Accession=PF03819.7; Description=MazG nucleotide pyrophosphohydrolase domain
  Pfam annotation: Domain name=PRA-CH; Domain location=107-181; Score =114.7; E_value=2.7e-31; Accession=PF01502.9; Description =Phosphoribosyl-AMP cyclohydrolase
  Pfam annotation: Domain name=PRA-PH; Domain location=202-294; Score =82.2; E_value=1.6e-21; Accession=PF01503.8; Description =Phosphoribosyl-ATP pyrophosphohydrolase
  Pfam module annotation: Pfam domain module=MazG::PRA-CH::PRA-PH; Domain location=231-293::107-181::202-294
MGFEDLLFKGVVPQQRQQKPKDSEVQVYFKSMAVSYVHMLQCNRGFHKGNLSYPNCSYKARRSHRLVFASMHTPEPKVDSLLDSVKWDTKGLVVAIAQNVDTGAILMQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIREEANELCQTLENNEDEKRTASEMADVLYHAMVLLAKKGVKIEDVLQVLRLRFSQSGIEEKKSRVSQKSVDD

SEQ ID NO: 185031 - protein, 186 aa, Glycine max
  Coding DNA Sequence Number=SeqID_68253
  Gene Ontology: Mol. function=DNA binding; Biological process =regulation of transcription, DNA-dependent
  Homolog annotation: Hit_ID=Q2HSK1; Match level="QueryCoverage=92%, HitCoverage=52%, E-value=3e-46, Identity=51%"; Hit description =Transcriptional factor B3
  Pfam annotation: Domain name=B3; Domain location=16-111; Score=75.7; E_value=1.5e-19; Accession=PF02362.12; Description=B3 DNA binding domain
MEAATFPHQLQVKPFHFFKIITAQNLQDGKLMIPNKFVEKYGEGLPNALFLKTPNGTEWNFNLEKHDGKIWFQKGWKEFAEYHSLAHGHLLVFRRHGTSHFQVHIFDLSSLEIDYPSKGTEGKTSPNHEGNKQPRNEENLEYLQPYQVRSHKSVKVENMMTLPEEAQPHTDTKFKGIRCQVSSSIS

SEQ ID NO: 185032 - protein, 335 aa, Glycine max
  Coding DNA Sequence Number=SeqID_68254
  Pfam annotation: Domain name=zf-CCHC; Domain location=37-54; Score =18.5; E_value=0.00088; Accession=PF00098.13; Description=Zinc knuckle
MSLWNSPSSTSRVQSPQNTPIIPASCSPKLVKRMQQETCYKCDQRGHWSYYCPYKSPKTKPISPSPKQDSTVSYKRAHGSCGYGVTEDELLNGNSNSIARLKQSRQRTLHDFWDGCQSQNDGSQEQIKRMRITDCSENPNIEGASATQNAANVKRDGFSELESAADDIEFMNSVSWETIEAEAILSLSRRSTPSRIPSRIRWRQIMFQKRIFSDDSFEIDKSKENSLTMDEQNNLFEENKMRFAQLQDEYVKTEASLEASNQHKQLLCEQVSDLKTMLDEKQNQLKCCELETLKIETRLGDLKRRMLETHFTLKERVEQTEEARKQSEERQAKLQ

SEQ ID NO: 185033 - protein, 498 aa, Glycine max
  Coding DNA Sequence Number=SeqID_68255
  Gene Ontology: Mol. function=calcium ion binding; Cellular component =mitochondrial inner membrane; Biological process=transport
  Homolog annotation: Hit_ID=Q69X19; Match level="QueryCoverage=98%, HitCoverage=91%, E-value=0.0, Identity=63%"; Hit description =Putative small calcium-binding mitochondrial carrier 2
  Pfam annotation: Domain name=Mito_carr; Domain location=200-284; Score=97.1; E_value=5.2e-26; Accession=PF00153.17; Description =Mitochondrial carrier protein
  Pfam annotation: Domain name=Mito_carr; Domain location=294-385; Score=106.3; E_value=8.8e-29; Accession=PF00153.17; Description =Mitochondrial carrier protein
  Pfam annotation: Domain name=Mito_carr; Domain location=392-497; Score=76.4; E_value=8.9e-20; Accession=PF00153.17; Description =Mitochondrial carrier protein
  Pfam annotation: Domain name=efhand; Domain location=147-175; Score =26.3; E_value=0.00011; Accession=PF00036.22; Description=EF hand
  Pfam annotation: Domain name=efhand; Domain location=25-53; Score =12.2; E_value=0.61; Accession=PF00036.22; Description=EF hand
  Pfam annotation: Domain name=efhand; Domain location=61-89; Score =26.4; E_value=0.0001; Accession=PF00036.22; Description=EF hand
  Pfam annotation: Domain name=efhand; Domain location=92-120; Score =13.7; E_value=0.4; Accession=PF00036.22; Description=EF hand
  Pfam module annotation: Pfam domain module=Mito_carr::Mito_carr::Mito_ carr::efhand::efhand::efhand::efhand; Domain location=200-284::294 -385::392-497::147-175::25-53::61-89::92-120
MGMKKATMDHVLLASQETKETREVRIRSLFDFFDRENLGFLDYSHIEAGLSALQIPSEYKYAKDLLNACDANKDGRVDFQEFRKYMDDKELELYRIFQAIDVAHNGCILPEELWEALVRAGMIVNYKFNKRKADFNRAHGIKIDDEELARFVERVDKDNNGVITFEEWRDFLLLYPHEATIENIYHYLERICVVDIGEQTVIPAGGVAGAASRTATAPLDRLKVVLQIQTTQSHIMPAIKDIWKKGGLLGFFRGNGLNVLKVAPESAIRFYSYEMLKSFITRAKGDEAKAANIGAMGRLLAGGIAGAVAQTAIYPMDLVKTRLQTHACKSGRIPSLGTLSKDIWVQEGPRAFYRGLIPSLLGIIPYAGIDLAAYETLKDMSKQYILHDGEPGPLVQLGCGTVSGTLGATCVYPLQVVRTSNLNGFSFLWKLENERHVDFRMQAQRSYKGMADVFRKTLEHEGLRGFYKGIFPNLLKVVPSASITYMVYESMKKSLDLE

SEQ ID NO: 185034 - protein, 138 aa, Glycine max
  Coding DNA Sequence Number=SeqID_68256
  Homolog annotation: Hit_ID=Q1S6A6; Match level="QueryCoverage=64%, HitCoverage=15%, E-value=1e-09, Identity=33%"; Hit description=FAR1
MDISKEEFGDGRLSRGVEMSFSVVDKVGFDGSGEKDEDVIGGMEDLYYWYGGTNEFSVRESKVLRNRKGEKMSQTFLCSRGGVRDYRGLTIENQKWEQKNETRCECKAKFRVHIDYFARRWYVSKWTDDHSRELLDES

SEQ ID NO: 185035 - protein, 396 aa, Glycine max
  Coding DNA Sequence Number=SeqID_68257
  Pfam annotation: Domain name=zf-CCHC; Domain location=53-70; Score =14.2; E_value=0.0045; Accession=PF00098.13; Description=Zinc knuckle
MDHAMKECETEANTPLPPPLSSTLCSQLTQNQNTQETYPRYSQQDLNARKKNGTCLRCKQQGHWYWECPLIKSSTTIPNTPRTYGVAVAIAVAKENLKESEKPPQGGERCNNGFVKWCDDRDVESVFLQPPPFKYPECQCGAGGQGSCGYKVWEDELLHNNKSLVQQSLSSKITLNGFGEGDQNDQDLDEDGKLLVNHSKKMRIMGNSEDPTSMVVSDAELSQSEDEVLEKKASPLSCLSESTLSTIGGQQHVFPRHIFADVGADPSFGSCPLGWLGGQFSLSQNLKSPSPQSIFCCGFPSFNPIDVPKQSSITNVPCGEHSQLDVIGLSQQTQLSSSERKLMSRTQRQRQMAFAVEQQLLIDLATLEPHEHESMKEAAQDTFAISDNLGANDTIF

SEQ ID NO: 185036 - protein, 151 aa, Glycine max
  Coding DNA Sequence Number=SeqID_68258
MMMIMLTIEIPTMVIVTINSGVSDRDGISDDCGDNDKGDINGCNNIDGVGCNGGGVVVVVAATLMVIVVAKVILLMGVTMTVTMTLMVVALPIVMILVTMMIVVVTMVTLIMVVVVIIVTMLIVIVISVMMVVMLVILVMTVTMMVMMMVM

SEQ ID NO: 185037 - protein, 139 aa, Glycine max
  Coding DNA Sequence Number=SeqID_68259
MAPRKLASKRSRKDKAAEGTSSAPEYDSHRFRSAVHQQRFEAIKGWSFLRERRVQLRDDEYTDFQEEIGRRRWTSLVTPMAKGQWIPFDADTIGQLLGYPLVLEEGQECEYGQRRNREASADHAHQHDHPDPDMDDVAA

SEQ ID NO: 185038 - protein, 248 aa, Glycine max
  Coding DNA Sequence Number=SeqID_68260
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=90%, HitCoverage=16%, E-value=9e-74, Identity=57%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
DATEFRQVVGALRYLCNTRPDIAFSVGMISRVMDRPRTSHLAAAKRILRYVKDTMAYGILLPSKCRENEKGLYGFIDADWGGDKTDRKSTAGSVFLLGSGPISWSSKKESVVALSSCEAEYIAASMGACQAIWLDNLMQELMIKKESVVELFVDNKSAISLAKHPVAHGRSKHIETRYHFLRDQVTKGRLKLSYCRTDMQVADIFTKAVKRETFKKLRNILNVVDLKHSSSNIWYPEQVVEALRVNPV

SEQ ID NO: 185039 - protein, 119 aa, Glycine max
  Coding DNA Sequence Number=SeqID_68261
MEEPSKKRKGTSSRSQRHSGAQETSMPSSIPSGSLFSSKEQRIREGVPFEGALIDDWKFDFSIHDDRRLVCTNQADMTGRLLAGSLAFESRILHYLIVHILLPRSSNLAQVSEEDLIVM

SEQ ID NO: 185040 - protein, 62 aa, Glycine max
  Coding DNA Sequence Number=SeqID_68262
RPHPIQAFFVGDAGGFSKVPTREPLHAVNVGGLVPPHCSLKSVVSDDACPGACFVQRDATTL

SEQ ID NO: 185041 - protein, 119 aa, Glycine max
  Coding DNA Sequence Number=SeqID_68263
MEAMKEQMATMMEVMISMKKIMEANAVAVAATSAIAKVNPMPPSGLNQMNHPTSARVGKYLGSTGGPHYAQIQNKHAIPPYGLLPNYTPPNVAYIPDEDVNNSAPILIESRQPNYAHVS

SEQ ID NO: 185042 - protein, 86 aa, Glycine max
  Coding DNA Sequence Number=SeqID_68264
  Homolog annotation: Hit_ID=Q8TGM5; Match level="QueryCoverage=41%, HitCoverage=53%, E-value=7e-07, Identity=75%"; Hit description =Uncharacterized protein ART3
MNQIQPTTRRVLAGGRRALGLMASGATCVQRLDGSRDSAIHTKYRISLRSSSMQEPRYPLPRVIVCKCCVVTTPAGHRLRAPGSRT

SEQ ID NO: 185043 - protein, 75 aa, Glycine max
  Coding DNA Sequence Number=SeqID_68265
  Gene Ontology: Mol. function=transcription factor activity; Cellular component=nucleus; Biological process=regulation of transcription, DNA-dependent
  Homolog annotation: Hit_ID=Q1SMR9; Match level="QueryCoverage=88%, HitCoverage=25%, E-value=2e-22, Identity=74%"; Hit description =Pathogenesis-related transcriptional factor and ERF
  Pfam annotation: Domain name=AP2; Domain location=14-75; Score=135.0; E_value=2e-37; Accession=PF00847.10; Description=AP2 domain
MTLIVETTRGNGRKRHYRGVRQRPWGKWAAEIRDPKKAARVWLGTFDTAEAAAAAYDAAALKFKGSKAKLNFPEH

SEQ ID NO: 185044 - protein, 118 aa, Glycine max
  Coding DNA Sequence Number=SeqID_68266
  Subcellular localization annotation: CTP_CleavageSite=25; ConfidenceScore=5.04e-01
MASFRELEQNMVCKGWSFVGASMVKKKKGKSNSLAFLCTRRGQFSKVGNIYIKTLRMKPRAWFRGCHSLYDVLGLFKSASGHGPFKCFMVLALGYVLIRFNKLCSSCPHHQINEQLLI

SEQ ID NO: 185045 - protein, 174 aa, Glycine max
  Coding DNA Sequence Number=SeqID_68267
  Pfam annotation: Domain name=zf-CCHC; Domain location=68-85; Score =14.8; E_value=0.0036; Accession=PF00098.13; Description=Zinc knuckle
MVGAFMQNRVTLTGLPMISLSEPTYDEFHARDGIQPPGGSSQPTNRVSQVAGRDGGGGGTPVALAMPSQCAKCGKIGYFARGCPNSDVNCFNCRGVMHSVISRVRVEKLALPVSSLRFYLIVDTPASMSVVTKTPMSDIPLVREFFGVFEEVSGLPPEREVEFSIDLCRSKASW

SEQ ID NO: 185046 - protein, 74 aa, Glycine max
  Coding DNA Sequence Number=SeqID_68268
MAPVVCAVAIAAVVDRDHTSSSNDLSNHDYRCWSKDYIAVVEEHNIYHTTLADWLPSHSIVNQWLAASQGMSTL

SEQ ID NO: 185047 - protein, 78 aa, Glycine max
  Coding DNA Sequence Number=SeqID_68269
MVPRMSSGPPPLDDKGKKVRDQMVPRMSLGPPPLDDKRTQNDHNLSLRAIGHDYVWMAKGDWNDHNLSLCVIGFAASR

SEQ ID NO: 185048 - protein, 87 aa, Glycine max
  Coding DNA Sequence Number=SeqID_68270
PTNRAFIKKYFALRQAHGDTPQQSGDGRQQATDAPPPPLEFTLAHPQKGSKIPWTRMYIAKYLTKIHICLGSKIPHGKRKREKKEKK

SEQ ID NO: 185049 - protein, 522 aa, Glycine max
  Coding DNA Sequence Number=SeqID_68271
  Gene Ontology: Mol. function=transporter activity; Cellular component= membrane; Biological process=transport
  Homolog annotation: Hit_ID=Q1GZ49; Match level="QueryCoverage=85%, HitCoverage=75%, E-value=1e-142, Identity=58%"; Hit description =Outer membrane efflux protein
  Pfam annotation: Domain name=OEP; Domain location=163-344; Score=3.8; E_value=0.0061; Accession=PF02321.8; Description=Outer membrane efflux protein
MMRWQVLAILGFAWPWMVAQAEEITDTRARQRLEKTEGRALETYSRQPGVPLHDAVKQQQNRKPAVTVDLKSALKPFDSPESDSILPQVSGTQMTIADIRQRALQNNLQLKVAKMDPELAKQSLREEQAKFDQVIFAYAKYAEKDTPAMSGDKVVIKSDNPLLDGELAKLNLDAQKKEFWDIEAGVKVPLRTGGTVTLSAPLENRQSLGKFASDQYRSALRFSFSQPLLRNAGQQVNEASIRVAELDRDSVQLKTRLQAIRIVATVDKAYWELYEAWAALDVRKNQFEYASQNLEMVKRRVQEGLTAAVEVNRAQIGVADRMEALIVAETNLKLAQRQLQFLLNDLPDDQERQSPWVPTTVPSLVKFEFDRAHLIRDALDSRIELLEQELKLSADLIQIDYLQNQTLPLFTLDYQYGALSGSGGRFGDIGQDLFDGRYRDWSVGLKFEMPVSNEARKAKLDRAIAQRMQRLTTKTLQSLTVKREIHDALDKVEQNWQRIIAARQQVLVAGINYEAELKQFNE

SEQ ID NO: 185050 - protein, 88 aa, Glycine max
  Coding DNA Sequence Number=SeqID_68272
MYNSIITYIGLHCSAHWQMVIILPKENVVIWFCSLHNRPDNYLKGIINSALKGLDDTQQSKSKPLTRWIVVKYNRQKGSTECGYYVMY

SEQ ID NO: 185051 - protein, 163 aa, Glycine max
  Coding DNA Sequence Number=SeqID_68273
MEHNGDKENFLLWNTTCIKLFGKTAGECRDELIAAGDDIKVFPMCVDEILSKTWAVRFKFRSQLRQSYVLDVSEELHHIQSLIATLGLKEQSSKGKGIAVETESSPPIFVPTPSLSQSSDYDPGNSTCLTPTKRISCQQTSSDFDSDEHTQYQFSTNKHIKAE

SEQ ID NO: 185052 - protein, 627 aa, Glycine max
  Coding DNA Sequence Number=SeqID_68274
  Gene Ontology: Mol. function=transcription factor activity; Cellular component=nucleus; Biological process=regulation of transcription
  Homolog annotation: Hit_ID=Q00LP3; Match level="QueryCoverage=92%, HitCoverage=98%, E-value=1e-169, Identity=54%"; Hit description=GRAS6
  Pfam annotation: Domain name=GRAS; Domain location=230-536; Score =497.2; E_value=1.9e-146; Accession=PF03514.5; Description=GRAS family transcription factor
MSSNVSVFSVGSQQRCLRRFNKISSESTYFTISQGRKGEGKKPELADTSYGNAKLYTLKGTDVTPDLSSHNFAPDKHRNMYMTKSHSCESYAKYFRDSPTEELIEPSSSSISGNSVHPDGASSYLLRASSGASVIVNNPFDTSIWSTRHRDAYQSNSGSDFVENGSPDGLDFDGEMRLKLQELERALLSDEEEEEEGMFETVQSMEIDPDMVEWANPLQDMLLHDSPKESSSSDSSNLTSISSTTKDTSQNSPQTPKQLLYDCARVLSEGNEEEATSMINKLRQMVSIQGDPSQRIAAYMVEGLAARVATSGKCIYQALRCKEPPSNDRLAAMQILFEVCPCFKFGYIAANGAIAEVVRDEKKVHIIDFDISQGTQYITLIQTLASMPGRPPRVRLTAVDDPESVQRSIGGINIIGQRLEKLAEELRLPFEFRAVASRTSIVSPSMLNCRPGEALVVNFAFQLHHMRDETVSTVNERDQLLRMVKSLNPKIVTVVEQDMNTNTSPFLPRFIETYNYYSAVFDTLDATLPRESQDRMNVERQCLAKDIVNIVACEGEERIERYEVAGKWRARLSMAGFTPSPMSTNVREAIRNLIIKQYCDKFKIKEEMGGLHFGWEDKNLIVASAWK

SEQ ID NO: 185053 - protein, 198 aa, Glycine max
  Coding DNA Sequence Number=SeqID_68275
  Homolog annotation: Hit_ID=Q1SRP4; Match level="QueryCoverage=49%, HitCoverage=19%, E-value=9e-09, Identity=34%"; Hit description =Integrase, catalytic region
  Subcellular localization annotation: CTP_CleavageSite=77; ConfidenceScore=5.49e-01
MVMAIFLIEVPNTVMVPPVEAVVVAVLPTFSVKMVSTVVPTSNQPSAILTNSSSHGNDSASSTWIPNSGASFHVTSESQNIKQFTHFDGLDQIVIGNGEETNKVLLQGVVGADGLYSFQNLKLQDNSPLLLSTSTSISDNGLPSIAATVNKNSSVVSNSVVSSPSPASLWHARLGHPYSHVMKLVFNHCNISPSSKFF

SEQ ID NO: 185054 - protein, 67 aa, Glycine max
  Coding DNA Sequence Number=SeqID_68276
MGPKCWVSGLIWKSALAKFLGLNSQIPAKCQRKVLIDKLVKPSNAITDYNTRAILVASNLPLEGNNE

SEQ ID NO: 185055 - protein, 1894 aa, Glycine max
  Coding DNA Sequence Number=SeqID_68277
  Gene Ontology: Mol. function=RNA-directed DNA polymerase activity; Biological process=RNA-dependent DNA replication
  Pfam annotation: Domain name=DUF1777; Domain location=165-283; Score=- 90.4; E_value=0.042; Accession=PF08648.2; Description=Protein of unknown function (DUF1777)
  Pfam annotation: Domain name=RRM_1; Domain location=239-309; Score =40.8; E_value=4.6e-09; Accession=PF00076.12; Description=RNA recognition motif. (a.k.a. RRM, R
  Pfam module annotation: Pfam domain module=DUF1777::RRM_1::RVT_1; Domain location=165-283::239-309::1232-1500
MCLEEHDTAFETGPASFRWLASGAWSSRAEMARAGGGAWRHVAGNLATRLAGVSRAPRGTLNPGFAEKNGGRDSDGRAPLHPRCCLPSWGCWSPFLACARAAVPTGARAAIPTGGSATVPSSCCATVPADVGCVQGAVCRGCRGWVQLGAGAWEGRAKLLNELPGREKDQSERIRERVTERGSEREREWTTVRKRGRGNLRVESTERKDPRQSYGGVRQRQHANHPYSNWRNRADITSFYFTRFPEDVQEAELWTHFKKWGDVREIFISKQRNKGGRRYGFVRFKGVSDVSRLERQLDNTIIGGLKLHVNIPKYARGKLEKGKINHRRQGISQKKNEGTKAIPTTTSHITAPTRTYAEILATHSRNAGQRKNTATAQVRQGGSHSSVQLDIPKEEDKWYKDAWVGRLKKLEIFERLEDEIVWILGSDMRPIYLGDNKVILLGLPDAKAEELNTEEIDKGTSLFYSLERWKPETRPGNRLVWMHCWGIPIAAWDIRYIRKIVATVGDLVDVDDEVEELRRLNRARVLIRTPWSPTIHHSVTVDIHGVSSVVYMVEETSTEEGLYERRRRHTLSPSNEISSDDSGLDTPISRLSDLSTRLTAEEHTGGCFDPRSDRVSSGCIGINGPLGKDPYGPTLEDPMKNGTKRNQTGVAPDPLSELPACSSEKETCNQQDTDKADTKLESDVSRRGRKGSTEGILQENKRACANAQNEEGIKCPPETRHLYFKTPLAPATVSIGPENNIGLTSDGCRKKGAQTSSHTNVSEDMTTLTKQQQIQMELQTSNNRGTSQQLPSDSGPEDLDSQPEKRNSIQTRNNSNNNLLEEAIAQWEMEGGSSIGKENHPTMNILSYNIRGLGRGVKWPAIRRLVSQHHVDLLCIQETKKEKIDRAVCQALWGDTALSWEIYPAINSAGGLLCVWNDSMFKGVWTQEMQKIFIVNVYAPCEAVVRRALWASIRQLKQLQTDGTCISEFNEWISKLEVEEVPRSTQYILDRNFSDHCPILLRAKNVDWGHKPFRVLDSKGMGGYSLKEKIKKLKERLKQWNKEQFGDTSKRVQQLQKELNNLEAGSSGRQLTPHELSSHKKIQEDLWTAAQAHESLLRKMARTKWIKEGDCNPRYFHKIMNYNHRHNAVKEPIIVKEEVRNFFQLRFSESNYERPAMNGARFRGIGQQQNQMLVDRFQEDEIKATVWDCGSDKSPGPDGLNFKFIKHSWELLKPDISRFLDEFHVNGHFPKGYNVSFIALIPKIKDPQSLNEYRPISLIGCIYKIVAKILANRLKKVLPNIIDERQMAFIKERHLLHAVLVANEVVEEAKRCKKPCLVFKVDYEKAYDSVSWNFLTYMMGRLGFCPKWIQWVLGCLHSASLSILINGSPTNEFYPQRGLRQGDPLAPLLFNIAAEGLTGLMREAVDKKRFSSFLVGKNKEPVSILQYADDTIFFGEATMENVKAVKTSLRCFELASGFKINFAKSKFGAICKSEQWCKEAADFLNCSMLPMPFSYLGIPIGVNPNRREIWDPIIRKVPNKIIEKLVSIQRRFLWGGGSEQKKIAWVNWETLCLPKDKGGLGIKDLRMFNTALLGKWRWEIFQHDGEDLKLLNQQQQTAALKGHIQWRVGCGDKIKFWEVTWTIEDRQLMVKYANLYQISNQQQQTISLMGNHNDEGWEWNFSWRRNLFDNEATTAAEFIQETAMLTIQQHGADSWVWRADLSGKYSTKSAYDILSEATRGDIDNGPFVELWKLRIPPKAATFAWRLIRDRLPTKVNLRRRQVGITDLMCPLCNNMEENATHLFFHCSKILPLWWESLSWVKKEAAFPQNPKEHFMQHTNGNVGRIKATRWKCWWVALTWTIWQHRNKTVFESQPFNTSKVLDDALLLLWSWLKVMEKDFTVHYNQWSSQQGDAF

SEQ ID NO: 185056 - protein, 90 aa, Glycine max
  Coding DNA Sequence Number=SeqID_68278
  Gene Ontology: Mol. function=exonuclease activity
  Homolog annotation: Hit_ID=Q8L7M4; Match level="QueryCoverage=84%, HitCoverage=25%, E-value=3e-16, Identity=57%"; Hit description =Exonuclease-like protein
MGSLEAENKTLRGAEEEEDSTSTKKRGKFYDIYGPEGKADVVFNSPEDNSTLNLSDVQGLVTWVLGEGFMPSWVFIKMNTGNARQIATVE

SEQ ID NO: 185057 - protein, 88 aa, Glycine max
  Coding DNA Sequence Number=SeqID_68279
MDEEDPRPTSSNGACIIYCSDKDTMIPLLMHEMDQVVKVIGKPKNPKWHNIAKRNNILLPLRPHPITMLIHRTRMLLAWIRLHMVKLP

SEQ ID NO: 185058 - protein, 95 aa, Glycine max
  Coding DNA Sequence Number=SeqID_68280
  Homolog annotation: Hit_ID=Q2HRX8; Match level="QueryCoverage=88%, HitCoverage=11%, E-value=9e-09, Identity=35%"; Hit description=IMP dehydrogenase/GMP reductase
MDSSRVTRAEPWVFTHLPIVGYSEVDDCAVDDPVATKWKLLKGSRNALLVRERLDDLQTNVVVWCPYEDHKAVRPFAQQSFFFGFIRCGTYVRPY

SEQ ID NO: 185059 - protein, 182 aa, Glycine max
  Coding DNA Sequence Number=SeqID_68281
  Homolog annotation: Hit_ID=Q8H8C9; Match level="QueryCoverage=36%, HitCoverage=12%, E-value=2e-17, Identity=76%"; Hit description =Putative AMP-binding protein
MLHRNSTWPWPSPREQISVSCQLMSLVDQQTPQSMEHKARQSILTKLDYLIFCSTAPLLELHKRPRCLSPIINNHQLSRTQTGAEKCTEARGVATQVTVAGRTTAAEALISEARELRRCKVTAMLHSVIEVGAARVVVECGESENGLAARITSVPSPIHFFCEGDCEEVYCEEVFSTLVFFI

SEQ ID NO: 185060 - protein, 33 aa, Glycine max
  Coding DNA Sequence Number=SeqID_68282
MVVEAMMKGYRDDDMVEVTCKLSNGSEDDKSDE

SEQ ID NO: 185061 - protein, 117 aa, Glycine max
  Coding DNA Sequence Number=SeqID_68283
MTIFFALPRQEELQLALKSLMAVATPLSLKKLPCQHAYACLRLTAPPAKQNRQFDWRFRKASPDSPAEVASSTCHQLANKSGGFPTTWALRSKLAIGNGGLAACPMHFTLKIAPYRK

SEQ ID NO: 185062 - protein, 196 aa, Glycine max
  Coding DNA Sequence Number=SeqID_68284
  Gene Ontology: Mol. function=nucleoside-triphosphatase activity; Cellular component=nucleus; Biological process=protein transport
  Homolog annotation: Hit_ID=Q9LZF6; Match level="QueryCoverage=93%, HitCoverage=48%, E-value=3e-95, Identity=69%"; Hit description=Cell division control protein 48 homolog E
  Pfam annotation: Domain name=AAA; Domain location=120-194; Score= -19.4; E_value=0.0062; Accession=PF00004.19; Description=ATPase family associated with various cellular activities (AAA)
MKLSDDVDLERIAKDTHGYVGADLAALCTEVALQCIREKMDVIDLEDESIDAEVLNSMAISNEHFHTALGTSNPSALRETVVEVPNVSWEDIGGLENVKRELQETVQYPVEHPEKFEKFGCGKTLLAKAIANECQANFISVKGPELLTMWFGESEANVREIFDKAKQSAPCVLFFDELDSIATQVYFCTSHPCRPG

SEQ ID NO: 185063 - protein, 107 aa, Glycine max
  Coding DNA Sequence Number=SeqID_68285
  Subcellular localization annotation: CTP_CleavageSite=93; ConfidenceScore=5.61e-01
MARHKGLLVIWRGGTKSSSSGPPSADRVGTGTPPLSPHSQSFSPGCSSCTPEAPMSTTCGGRHSVLRIFKGRRGRTGHHATCGALPAAGPYLRLSRFQGGQAVKQKR

SEQ ID NO: 185064 - protein, 359 aa, Glycine max
  Coding DNA Sequence Number=SeqID_68286
  Homolog annotation: Hit_ID=Q8XQP2; Match level="QueryCoverage=45%, HitCoverage=85%, E-value=4e-25, Identity=37%"; Hit description =Probable hemagglutinin/hemolysin-related protein
MNVSPVSVAVIDKKTITKAEVLRAGKDGKAVKIQAITNGKYLLTQNQDGTAPENITVKRAGKNLLVMLEGSDASKPDLIIEDFFAKSGTLVGKAEDGEMHAYVATDGNADHEAAALADGETTALALGEGSVDDNSGYALASGFEWSPALIALGGLAAIAAAAGLGYVAAKHHYDNNDGSHSGKGEGGGGSGGGDISKPTISDVIDDIGDVTGSVANGGRTDDTMPTFNGTGTPGNTIEIWDGETLLGEVLVDDEGNWTFTPDKPLAAGNHSIVTAERNAEGVVGEESDPWEFIIDLTAPAKGTIGSVMDDMQDPPVLIEKGGVTKDNTPTLTGKAEAGSTVEIWNDGVKLGTAIGGRRG

SEQ ID NO: 185065 - protein, 106 aa, Glycine max
  Coding DNA Sequence Number=SeqID_68287
  Gene Ontology: Mol. function=transcription factor activity; Biological process=regulation of transcription, DNA-dependent
  Homolog annotation: Hit_ID=Q8Y092; Match level="QueryCoverage=87%, HitCoverage=31%, E-value=8e-24, Identity=60%"; Hit description =Probable transcription regulator protein
  Subcellular localization annotation: CTP_CleavageSite=27; ConfidenceScore=5.12e-01
MSGRYGSVRASFCASNPRFARRAAKPCASWRWPARALCGYRILSAARIAPAAGWYRCWKMTRANCACRFTRCTIATSRSVPASPVFWIFYGEKFRKIICYNPVLSE

SEQ ID NO: 185066 - protein, 65 aa, Glycine max
  Coding DNA Sequence Number=SeqID_68288
  Gene Ontology: Mol. function=ATP-dependent helicase activity; Cellular component=nucleus; Biological process=rRNA processing
  Homolog annotation: Hit_ID=O65879; Match level="QueryCoverage=53%, HitCoverage=8%, E-value=2e-10, Identity=88%"; Hit description =Translation initiation factor
GEREGIEAFIPPSTCDEYFYLKDTFLKISTVILNIGDFINIQAHACVGGKSVGEDIRKLEYGVHV

SEQ ID NO: 185067 - protein, 80 aa, Glycine max
  Coding DNA Sequence Number=SeqID_68289
MWVQAIGLFAQVTCAPEFGLPRPLNKRLLVLHVGGGAVKQQGQPFPCAQESPTTRDPRSLNPFSEIRRREEEISRKRGRL

SEQ ID NO: 185068 - protein, 57 aa, Glycine max
  Coding DNA Sequence Number=SeqID_68290
ISQQSQGFAPFACPTPDQFKAKVAWSGDWPEAQAGVAPAEDEKMTYLLSFLGGSGAT

SEQ ID NO: 185069 - protein, 163 aa, Glycine max
  Coding DNA Sequence Number=SeqID_68291
MTGKLLVGSLTFDCCIMHYIIVRILLFRSSNLAQAFEEDLILMWAFLTSRQIDWAHLIRYRMHKALRANAPLPYPHLVTLFLHHFKIPLEDEPFVQVKRSFAIGVGAIILFGYRKDDDGQWVRKQDLPQPIPDERTLSPPPQRVDSSSLLNDVLSELHSLRAF

SEQ ID NO: 185070 - protein, 157 aa, Glycine max
  Coding DNA Sequence Number=SeqID_68292
EAIDKSLKVGEDEWRERERRSTNFGASKEGIRWNHGMQCYLVIEISDLDGRVPKYVHELYEGLVICLSQTGQGGRGHAVRPTSGVLHTKSFDEGVKDVYGPGFTCVKKTSRCSSGSVVPSYRLGLSGFHPKGVWFPLGVFSQGVGELLIALGKSDTM

SEQ ID NO: 185071 - protein, 244 aa, Glycine max
  Coding DNA Sequence Number=SeqID_68293
  Gene Ontology: Mol. function=calcium ion binding; Cellular component =flagellin-based flagellum; Biological process=protein amino acid phosphorylation
  Homolog annotation: Hit_ID=Q69V45; Match level="QueryCoverage=95%, HitCoverage=96%, E-value=1e-85, Identity=70%"; Hit description =Calcium-binding EF hand-like protein
  Pfam annotation: Domain name=efhand; Domain location=109-137; Score =8.4; E_value=1.7; Accession=PF00036.22; Description=EF hand
  Pfam annotation: Domain name=efhand; Domain location=164-192; Score =24.6; E_value=0.00034; Accession=PF00036.22; Description=EF hand
  Pfam annotation: Domain name=efhand; Domain location=202-230; Score =20.6; E_value=0.0058; Accession=PF00036.22; Description=EF hand
  Pfam annotation: Domain name=efhand; Domain location=73-101; Score =12.6; E_value=0.55; Accession=PF00036.22; Description=EF hand
  Pfam module annotation: Pfam domain module=efhand::efhand::efhand::efh and; Domain location=109-137::164-192::202-230::73-101
MGGALGKIESPKKGSVPETKLEAKMVEAMLRRESQGSSVKSFNTIILKFPKIDESLRKCKAIFEQFGSIMANSSVFMAFLIDEDSNGAIDQEELKKCFSKLEISFTEEEINDLFEACDINEDMVMKFSEFIVLLCVVYLLKDDPAALHAKSRIGMPKLERTFETLVDTFVFLDKNKDGYVSKNEMVQAINETTSGERSSGRIAMKRFEEMDWDKNGMVNFKEFLFAFTRWVGIDEVEDEENEEA

SEQ ID NO: 185072 - protein, 268 aa, Glycine max
  Coding DNA Sequence Number=SeqID_68294
MLNTQSSIKRENPLTDSHPHPKAMADTNTLPQLQNHITEMERRHEKELTKLKADHDQLEARVNQRKKIEESQEIARYAAIAAETDVSPLRGLGGKYTQFKCSFKPMLIPCGWSILAKQRDPDCMCDEDTTKGKDLEALEGPMTRGRLKQAQHSDEDTTKGKDHEALEGPMTRGRLKQAQHVIETRLGLVVVAKTYAFSPAPIYFILGVPVEPNSDLSRLIPCGVTVTYLPSLEVASFSVNILVSNVPSRKVHVNVNVVKMNEMCCVVL

SEQ ID NO: 185073 - protein, 184 aa, Glycine max
  Coding DNA Sequence Number=SeqID_68295
  Gene Ontology: Mol. function=hydrolase activity
  Homolog annotation: Hit_ID=Q01A81; Match level="QueryCoverage=49%, HitCoverage=18%, E-value=5e-12, Identity=42%"; Hit description=[TR] KOG0374 Serine/threonine specific protein phosphatase PP1
VLVQLGDILDRGEDEIAILSLLQSLDKQAKTKGGAVFQGNFRYVDSGGFDECNDFLEYINGFEDDWEETFTAWVDVSERWKEDRTMSKGYWGPWNLLEIRILVLDPVFPLLDLLTFIHQSATGYWEKTNSQMKMQETIAGEINFDDHSAKKVIMAAVKYAKTYPRCEENQKFFVHELTILIKYY

SEQ ID NO: 185074 - protein, 130 aa, Glycine max
  Coding DNA Sequence Number=SeqID_68296
VAELPKFEKPKVPELPKVPKIPNVLELPKPEFPKGPELLKPELPRVPDIPKVPEFPKSVMSKIELPKVPKLPKSKSSKVSKLTKLELPKISEISKVPELSKPELLKIPEFPKLELPKVLELEIQFLHRFA

SEQ ID NO: 185075 - protein, 47 aa, Glycine max
  Coding DNA Sequence Number=SeqID_68297
MGGLGPSYSHLMCSAHSVQMHVFTTRAVRLAPVLVCALSAPLDWASC

SEQ ID NO: 185076 - protein, 92 aa, Glycine max
  Coding DNA Sequence Number=SeqID_68298
MNKDESDRNEKKAQHIKLWGVFIFGLIGATVTAFSLSRLQSKGGSSFRTAFQEAWKRYNKRLQEEYEEEMERVMFNWLVNAEQRVLSLGCFL

SEQ ID NO: 185077 - protein, 124 aa, Glycine max
  Coding DNA Sequence Number=SeqID_68299
MTLSWQNKLNMHFMFKTLVMRGGQWFYTRKQLVLMLKMMIHTLILMQMATPPSSHLPPPPSLTGATSQSPSTLKRTRKATWLRSLVTRPVGAERPLVHVNLATKKADGPHRKKLRTYLGIVAHD

SEQ ID NO: 185078 - protein, 216 aa, Glycine max
  Coding DNA Sequence Number=SeqID_68300
MGEIKEVKEQMKADIEDMKEQMATMMEAMMSMKKIMEVNVAAVAATSVVAKVDPTPPSGLNQINHPTSDMVGQGGKELESMGGPHFVQVQNKHAFPPYGLPPNYTPPNEMHTPDENVNNSTPILVESQQPQSDHAHVSQPMREAHEIPHHNLDDFEPCLGYTTKGQAVGGVPLPNTLEGPQFRPQPQPLHFVAGRVPPAIAEKREIGFYRGKAQGH

SEQ ID NO: 185079 - protein, 100 aa, Glycine max; identical to SEQ ID NO: 130520
  Coding DNA Sequence Number=SeqID_68301

SEQ ID NO: 185080 - protein, 145 aa, Glycine max
  Coding DNA Sequence Number=SeqID_68302
  Homolog annotation: Hit_ID=Q1T2D5; Match level="QueryCoverage=82%, HitCoverage=7%, E-value=3e-15, Identity=36%"; Hit description=Chromo
MAKFRHYLLGHKFIIRTDQKSLKELLEQTLQTPEQQQWLPKFLGYDFTIRYKPGRENIFGDALSRSLFIACSKPTNHWLEKVATVTKEDKLQSELISRDAHWGTIDPKYDVKDGLIFRKNIYQQAKVDQAVPAGLLQPLPIPQQI

SEQ ID NO: 185081 - protein, 98 aa, Glycine max
  Coding DNA Sequence Number=SeqID_68303
MWAFLTGRQIDWAHLVRYQMHKALRANAPLPYPQLVTLFLRHFQIPLDDEPFVQVKRSFAIGAGAITSFGYRKDRDGQWLKKDALPPQDECTPSPPPQ

SEQ ID NO: 185082 - protein, 183 aa, Glycine max
  Coding DNA Sequence Number=SeqID_68304
  Gene Ontology: Mol. function=adenylate cyclase activity; Biological process=cAMP biosynthetic process
  Homolog annotation: Hit_ID=P0ADT8; Match level="QueryCoverage=41%, HitCoverage=37%, E-value=4e-26, Identity=70%"; Hit description =Hypothetical protein ygiM precursor
  Pfam annotation: Domain name=SH3_3; Domain location=119-169; Score =7.7; E_value=0.018; Accession=PF08239.2; Description=Bacterial SH3 domain
AGNVQLRLAEVDVVFRTLMQTAQRFAGGFQRHFIALIHAANPQAHIPAAQLVVIGFVIDVGQLTRGVVLMWPGGKRLHQFFGGLRVMHRKPAVSAFFAIAPAHAADEKRYISDELSTWVRSGPGDQYRLVGKLNAGEEVTLLQTNNDSQYAQIRDAEGKTNWIPLSQLSASPSLRTRVPQLEQ

SEQ ID NO: 185083 - protein, 65 aa, Glycine max
  Coding DNA Sequence Number=SeqID_68305
MHNSSTKINLRSSDQRSEKMQNYLKSKRRRNLFGLKEKAGVTDSPRGGHRGANLSSACDAYCVTA

SEQ ID NO: 185084 - protein, 68 aa, Glycine max
  Coding DNA Sequence Number=SeqID_68306
  Gene Ontology: Cellular component=membrane
  Homolog annotation: Hit_ID=Q681Q0; Match level="QueryCoverage=97%, HitCoverage=12%, E-value=3e-12, Identity=46%"; Hit description=MRNA, complete cds, clone: RAFL21-99-B01
MDIAALLTSAGINIAVRLASQHSRRIDLCLERFVPSPSWILKAWETSEDEILAIGGLDAVVFVRILVF

SEQ ID NO: 185085 - protein, 293 aa, Glycine max
  Coding DNA Sequence Number=SeqID_68307
  Gene Ontology: Mol. function=nucleic acid binding; Cellular component= beta-galactosidase complex; Biological process=DNA integration
  Homolog annotation: Hit_ID=Q1S0A6; Match level="QueryCoverage=98%, HitCoverage=19%, E-value=1e-88, Identity=54%"; Hit description=Zinc finger, CCHC-type; Peptidase aspartic, catalytic; Polynucleotidyl transferase, Ribonuclease H fold
MKRLKEFFLKRFRIKDLGDLKYFLGIEFSRSKEGIFMSQRKYALDILQDSGLTGARPDKFPMEQNLKLTPTNGVVLNDPTKYRRLVGRLIYLTVTRPDIVYSVQTLSQFMHEPRKPHWDAALRVLRYIKGTPGQGLLFSSANDLTLKAFCDSDWGGCHATRKSVTGFCFFLGNSLISWKSKKQVVVSRSSAESEYRAMANTCLELTWLRFILQDLKVPQDAPTPLFCDNQAALHIAANPVFHERTKHIEIDCHIVREKLQAGMINPSYVPTKFQLADVFTKALGKDQFVTLRN

SEQ ID NO: 185086 - protein, 342 aa, Glycine max
  Coding DNA Sequence Number=SeqID_68308
  Gene Ontology: Mol. function=DNA binding; Cellular component=nucleus; Biological process=regulation of transcription
  Homolog annotation: Hit_ID=Q0PJD7; Match level="QueryCoverage=63%, HitCoverage=100%, E-value=2e-79, Identity=68%"; Hit description=MYB transcription factor MYB161
  Pfam annotation: Domain name=Myb_DNA-bind_2; Domain location=16-70; Score=-4.1; E_value=0.028; Accession=PF08914.1; Description=Rap1 Myb domain
  Pfam annotation: Domain name=Myb_DNA-binding; Domain location=14-62; Score=51.7; E_value=2.4e-12; Accession=PF00249.21; Description=Myb -like DNA-binding domain
  Pfam annotation: Domain name=Myb_DNA-binding; Domain location=68-113; Score=40.0; E_value=8.4e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=16-70::14-62::68-113
MGRAPCCDKANVKKGPWSPEEDAKLKSYIEKHGTGGNWIALPQKIGLKRCGKSCRLRWLNYLRPNLKHGGFSEEEDNIICSLYVSIGSRWSVIAAQLPGRTDNDIKNYWNTRLKKKLLGKHRREPRNRGNYNSVKQEIDVNRGSSNDGDSSSLSLLQENGNTTQQQQQPCWPQNINNMPVLPLQVPLPYTNQGPCFNDQDSIKKLLIKLGGRFSGDYYHPTLDGLNLEFSSDGQQIYQEQVHVGSSSAAAACISSTINNNNEVQFAQTDQYSGVHNLVQGQGGNFTPSFEEMVSSSNYPDGLEFLYNEDMIDHRIIESPTTTVTATITTNWGETSTPPLSPS

SEQ ID NO: 185087 - protein, 74 aa, Glycine max
  Coding DNA Sequence Number=SeqID_68309
MKGREKCCVWSVLGPRDEWSTVEKEEAGLKVMTKLVVEKFKLIGSAEEMRELIVPTEVMVDLSGPTHLFEEWLD

SEQ ID NO: 185088 - protein, 136 aa, Glycine max
  Coding DNA Sequence Number=SeqID_68310
  Homolog annotation: Hit_ID=Q6R8G0; Match level="QueryCoverage=22%, HitCoverage=3%, E-value=1e-07, Identity=77%"; Hit description=PHO1 -like protein
MAVHSDLASLEKKSSNEASDWGFLQRHSKNCWLRDKLLIPHKSVYFAAMLNTIYQKPPHPTLRYEADVTFEDNVSATTTSRFSERHPHTTRSSGGRFGCRGEGAVRRSAGIFRRFSETHSRGRPSARQKKAFIKHG

SEQ ID NO: 185089 - protein, 325 aa, Glycine max
  Coding DNA Sequence Number=SeqID_68311
  Gene Ontology: Mol. function=DNA binding; Cellular component =chromatin; Biological process=DNA integration
  Homolog annotation: Hit_ID=Q1SAI8; Match level="QueryCoverage=98%, HitCoverage=29%, E-value=1e-106, Identity=54%"; Hit description =Integrase, catalytic region
MDCGENFTLVVKPVTIRTMLSLALSKAWPIHQLDVKNAFLHDELKETIKSNNSLFIYRNNTVMAYILLYVNDIILTASSSSTLCKSIMTLLNSEFAMKELGPLCSWKKCTEEIIERTGMFSFKPCPTLVDTKPKLCVTSSTPYEDPSHYYNLVGALQYLTFTRPNITYVGALHHVLHLYPSSINSWISYTYAEWGGCADTGRSTSGYCVFLGDNLLSWSSKCQATFSRSSAEAEYRGAVNVVSKSSWLHNLFLELHCPIHKATLVYCDNVSAIYLSRNAVQHQRTTHIKMDIHFVSEKVVRGQVCVLYMSPRAIKLQIFSQKDFL

SEQ ID NO: 185090 - protein, 329 aa, Glycine max
  Coding DNA Sequence Number=SeqID_68312
  Gene Ontology: Mol. function=transferase activity; Biological process= DNA integration
  Homolog annotation: Hit_ID=Q1SX87; Match level="QueryCoverage=99%, HitCoverage=28%, E-value=4e-44, Identity=36%"; Hit description =Polynucleotidyl transferase, Ribonuclease H fold
MIQANIFLGHPFSKFKHEFITCLITSSLLRIRRLRKRKMMQKQSIPIFGIDLMQPCYNELIDDSSEQCWKRIAAIFQDNKHSRAVHLKNQFSNTNLEDFPTVKAYCNCLKLLADQLANVDALVSNTCLGLNMIVVLTNAYAGFVTYIQQHDPWLPFETAKSRLELEESTIIQEGAREFGSSSFTTALVWWWQQGAPWIVLPCPYPIYSWAKPNATQRPQQPSLLGSRPQQETFNATTPNPTNIEVACHTLNLAQPNLSWYMDTGATSHMTSSQGNLPSYFNLSKNNGIIVENGQSIPIRGFDSANLSPPHPPLVLKNAFHAPNLIENLT

SEQ ID NO: 185091 - protein, 82 aa, Glycine max
  Coding DNA Sequence Number=SeqID_68313
  Subcellular localization annotation: CTP_CleavageSite=16; ConfidenceScore=5.18e-01
MVLPGGVDSAASPRFVASSPDSRGFSSFHHVLGKGLVVDVVLWMNWRGAVAVLVYATALWYLFDRVGYNFLSFVTKVFANKL

SEQ ID NO: 185092 - protein, 40 aa, Glycine max
  Coding DNA Sequence Number=SeqID_68314
MEGVGVFEVWEVGRVGSTIGEAAEDVSKVYQFVVIDDEMV

SEQ ID NO: 185093 - protein, 369 aa, Glycine max
  Coding DNA Sequence Number=SeqID_68315
  Gene Ontology: Mol. function=nucleic acid binding; Cellular component= membrane; Biological process=DNA integration
  Pfam annotation: Domain name=zf-CCHC; Domain location=243-260; Score =11.1; E_value=0.015; Accession=PF00098.13; Description=Zinc knuckle
  Pfam annotation: Domain name=zf-CCHC; Domain location=263-280; Score =3.8; E_value=0.23; Accession=PF00098.13; Description=Zinc knuckle
  Pfam module annotation: Pfam domain module=Retrotrans_gag::zf -CCHC::zf-CCHC; Domain location=73-180::243-260::263-280
MDSSNPYYIHPSDHPGHLLVPIKLNGTNYPSWSISMIHALTAKNKIGFINGSIKAPSAVDQSAEHALWNRCNSMILSWLTHSVEPDLAKGVIHAKTAHQVWEDFKDQFSQKNAPAIYRIQKSLASISQGTMAASTYFTKIKGLWDELETYRTLPTCNQMKAHDEQREEDRLMQFLMGLNDTYSTVRTNILMMSPLPNVRQAYSLVIQDETQRQMTSETTENFSIAAAIHSHPDSLSNKFVKDKHCEHCNRDGHTISNCRTLKFYCDFCNKNGHTEDRCRIKNGTYNTGTQSNKHIQSQQRQQGPRSTAPRTFSAANAADSSKNALELSAEQLQQLARALNMMSPNNTSGNSNAHANAAGLGYGEDDWLG

SEQ ID NO: 185094 - protein, 87 aa, Glycine max
  Coding DNA Sequence Number=SeqID_68316
MEICEDLKKGIVELIGAMKILNVRDCVEWDINRSSIYRHKIRQQHMLVCPGCCADMSHLFLNIFATKAKDECLHRFLPRRYTNHTLH

SEQ ID NO: 185095 - protein, 133 aa, Glycine max
  Coding DNA Sequence Number=SeqID_68317
  Gene Ontology: Cellular component=nucleolus
  Homolog annotation: Hit_ID=Q8LEL8; Match level="QueryCoverage=97%, HitCoverage=92%, E-value=6e-21, Identity=39%"; Hit description=Auxin- induced protein, putative
  Pfam annotation: Domain name=Auxin_inducible; Domain location=10-94; Score=31.2; E_value=1.8e-08; Accession=PF02519.5; Description=Auxin responsive protein
MAWKWQKEVTNYQMRRILWPKTQENNAAKAEKKGHFVVYSSDKRRFVLPLLYLNNNIFRELFKLAEEEFGLSSNVPLTLPCEATLIEYVITFIQRNITKDLEEAVLMFVATSRCQSYVDLHRERTNQHLLYSY

SEQ ID NO: 185096 - protein, 44 aa, Glycine max
  Coding DNA Sequence Number=SeqID_68318
  Gene Ontology: Mol. function=DNA binding; Cellular component=nucleus; Biological process=regulation of transcription, DNA-dependent
  Homolog annotation: Hit_ID=Q8S423; Match level="QueryCoverage=99%, HitCoverage=50%, E-value=8e-16, Identity=75%"; Hit description=P -type R2R3 Myb protein
MGRMPCCEKVGLKKGPWTPEEDKKLVAYVEKHDHGNWHSVPAKA

SEQ ID NO: 185097 - protein, 126 aa, Glycine max
  Coding DNA Sequence Number=SeqID_68319
  Pfam annotation: Domain name=RNase_H1_sml; Domain location=47-126; Score=-3.3; E_value=0.00052; Accession=PF08615.1; Description =Ribonuclease H1 small subunit
MVGHYGHLSLEPKSVPPPKRTGWIGRGKCHMEKATIDLKGDSKDLSGRVHQLPYCVKHDSPALFSTISNPNTKVLGEDEGLLLQEAHFRGRLLQGTTLPLPHDYSGFVLSKRSPPTSDENSFKILK

SEQ ID NO: 185098 - protein, 69 aa, Glycine max
  Coding DNA Sequence Number=SeqID_68320
  Subcellular localization annotation: CTP_CleavageSite=25; ConfidenceScore=5.05e-01
MQAVTNIVTCTFPRDVSVFQSRLTSSSAPFAIQGQRVGWQTEIPYGQPHFSSTEGNEFDGIKMILVVRC

SEQ ID NO: 185099 - protein, 245 aa, Glycine max
  Coding DNA Sequence Number=SeqID_68321
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRPAILYGTECWAVKSQHENKVGVAKMRMLRWMCGKTRQDKIKNEAIRERVGVAPIVEKMVENRLRWFGHVERRPVDSVVRKVDQMESRQTIRGRGRPKKTIREVIKKDLELNDLDRSMMNEIDVKEEVDGLDEVAEGFSGLMREAKSLNLFKGYFVGKDKGEANLLQYADDTLFVGEASLENVTTIKTIMRCFEVVPDFK

SEQ ID NO: 185100 - protein, 78 aa, Glycine max
  Coding DNA Sequence Number=SeqID_68322
MAATIGAWGTRRCNRSTMDDGRNSCWLVKVTQQSTLFTHLDFSCFQFPVDIGYSIECTCPDNFKILVAVPSLVTESLY

SEQ ID NO: 185101 - protein, 930 aa, Glycine max
  Coding DNA Sequence Number=SeqID_68323
  Gene Ontology: Mol. function=calcium ion binding; Biological process =cell cycle
  Homolog annotation: Hit_ID=O81059; Match level="QueryCoverage=99%, HitCoverage=63%, E-value=2e-68, Identity=44%"; Hit description =Putative calmodulin
  Pfam annotation: Domain name=efhand; Domain location=863-891; Score =18.5; E_value=0.025; Accession=PF00036.22; Description=EF hand
MILSSFEHDFVEEESATEPRDSSNKLLVGQPPNSLQGNTVWNAKIILMNGLSRSALEELSSDKIVDDRIPHFCNFLRFAVLKKDHSFMAVGGPWEPVDGGDPSIDNNSLIKTALRYAKDVIQLDLQNCQHWNPFLELHYDRIGKDGFFSHKEITVLYVPDLSDCLPSLDEWRDKWLAHKKAVAEKERQLSLKKEKSRDNKEVSKDKSDKRKDSTPSGKSDVKKKEKDNNTVKEEIEGKTGVNNNKITKNEGSDMGEEGKSAEKKTGVTVTGQTTGGVKSVKKKIIKRVVKQKVATKAKATAIKQTDKSGEKDVAEKVTSNVTDQDGKSPTGVETPVKNLVAEDMSIGKIDSEEGKDKEINSSEDKPQNKPNPTVNAVVSDPSVKTTKKKKIIKRVPKKKVVGEASKSLVSEPKKDENQGQDSTQSSGKQTADANTIVTEEKKPGKVVPKKKIKTPVSKKKDETADSNKTETLSDKKDEGNVVAVQAQDDTQSTGKQTANADTTVTPEVKKTGKVVPKKQSKTPTSEKRDNTADSSKTETKSDKDDKKEERVTGEKSGAKTDKLKASDKDVTNVKGKVKDGDKSKDEKVTQERDGKDESKSKSSKEVKDKRKSNEPPRHPGFILQTKWTKDSKIRSLSLSLDSLLDYTDKDVEESNLELSLFAESFYEMLQFQMGSRILTFLQKLRIKFVIKRNQKKRQREDEQEKDDVKKSPVKRQKGNDPSVKNEPTNMDTLNPTLLDDEKAVARNDNSSNKEDDVKMEDGSDEEEEDPEEDPEEYEEMENGSPQHEASNDKNAEQEANADTKSENITTNDKTADETSKEEIKVKDEVQESKADLQVKEEKEGKDEIKKETPTAKEVVVDRELLQAFRFFDRNRVGYIRVEDMRIIIHNLGMFFSHRDVKELVQSALLESNTGRDDRILYNKLVRMSDI

SEQ ID NO: 185102 - protein, 129 aa, Glycine max
  Coding DNA Sequence Number=SeqID_68324
  Gene Ontology: Mol. function=nucleic acid binding; Biological process= DNA integration
  Homolog annotation: Hit_ID=Q1S3Z1; Match level="QueryCoverage=80%, HitCoverage=8%, E-value=5e-20, Identity=48%"; Hit description =Integrase, catalytic region; Zinc finger, CCHC-type
MSTANYQNEDESAFGSTRIRGCSGRRKEIAHHTVRQEKKDILDKADSALILSLGVKVLREVSKEKNGVAIWLKLENLYMTKSLANKFYMKQKLYTFKMPIGRALEDHLDDFNKIILDLENIEIKIDDED

SEQ ID NO: 185103 - protein, 125 aa, Glycine max
  Coding DNA Sequence Number=SeqID_68325
  Gene Ontology: Mol. function=nucleic acid binding; Biological process= DNA integration
MVLALVAQDMELEQLDVRITFLHDDMLIACSSKEEIKKVKVMLESEFEMKDMGATNLGYAMSLVNRYMGKPRKLHWEVVKWIFRYVKGISEVGLLYFKHEDSDVGVTEFVDLDYVGYLDTRRSLI

SEQ ID NO: 185104 - protein, 45 aa, Glycine max
  Coding DNA Sequence Number=SeqID_68326
MYLRDQGGLDCAHELSAIMDRLAHISEFWLSACLSRLADGLKRCA

SEQ ID NO: 185105 - protein, 90 aa, Glycine max
  Coding DNA Sequence Number=SeqID_68327
MSNRKYESGYEKLKKKQKVEKLIESQRGARDKFVIIHKNDAEASSIDHTDNEENVIEQSPIDNTDNSVEQPPRDDTDNGKNVIEQSPINK

SEQ ID NO: 185106 - protein, 157 aa, Glycine max
  Coding DNA Sequence Number=SeqID_68328
  Gene Ontology: Mol. function=RNA-directed DNA polymerase activity; Biological process=RNA-dependent DNA replication
MGTTCPKNHLNMYCRKMGAYAKDEKLLMHFFQESLTGAVVTWYTNLEPSRVHSWKDLMVSFVRQYPYNSDMAPDRMQLQDMGKKGHKSFKEYAQRWRDLAAQAAPPMMEREMVTMIVDMLSVFYYEKMVGYTLSSLTDLVFAGERIEVGLKRGKWRE

SEQ ID NO: 185107 - protein, 71 aa, Glycine max
  Coding DNA Sequence Number=SeqID_68329
MKNERRTVENLREITHGNVMVASSAFWRTSWKAQMGLHVTELHELPNNGCQVPKSSQTRVASQPRMVPGRN

SEQ ID NO: 185108 - protein, 47 aa, Glycine max
  Coding DNA Sequence Number=SeqID_68330
MLSCGREDKKKLSCVTYVGLRANPQTKLAQPADYARWAQNPASPWIF

SEQ ID NO: 185109 - protein, 64 aa, Glycine max
  Coding DNA Sequence Number=SeqID_68331
MHKYSRCGVSRYKVKDNDECSSDESTKKGPLAKVLLMMQKTLHGMQMGETTMECSAIRLIPPSG

SEQ ID NO: 185110 - protein, 63 aa, Glycine max
  Coding DNA Sequence Number=SeqID_68332
MAEINQGKTMTGHDWSHIIWLLLAGSSGQTLTHKEGGDMVNVPLKKKMWQVSSPGRATPAFKI

SEQ ID NO: 185111 - protein, 94 aa, Glycine max
  Coding DNA Sequence Number=SeqID_68333
MGKKKGSIDEEALEVGKKTIQNGHDFIDYFMKFAWKYSGAPMTHKSRLLLHSFAPQEIDSRLIQGFKIKHQESNPRFKIQEKKSRSNKSRLHIG

SEQ ID NO: 185112 - protein, 63 aa, Glycine max
  Coding DNA Sequence Number=SeqID_68334
MKNGGKSSRNQPWKRLGSGKRGRWLPPSLPKRAGLLPPEGLAFCWNTLEGPSGLGCYLHTSVY

SEQ ID NO: 185113 - protein, 57 aa, Glycine max
  Coding DNA Sequence Number=SeqID_68335
MAHQNPPYLAFCTPGQNEIKKKIQGYQRETNKNIYIFLNEHQGVKGMGSPMCPKSII

SEQ ID NO: 185114 - protein, 81 aa, Glycine max
  Coding DNA Sequence Number=SeqID_68336
MKKIQGLQAPHGAYIIVDAMEKYNMHLANSIMERTEVACRDLSTTNKLEADTLVMPSYTSLEKRVTMRAFGAELILIDPAK

SEQ ID NO: 185115 - protein, 69 aa, Glycine max
  Coding DNA Sequence Number=SeqID_68337
  Homolog annotation: Hit_ID=Q6Z2U5; Match level="QueryCoverage=67%, HitCoverage=20%, E-value=2e-08, Identity=57%"; Hit description =Integral membrane family protein-like
MREPEIRSQKLLYCRQIANQLAPVFPLCAMYTMDVAAEAEAVTRPSITLTTLTQTSSESFSNVKNNGLT

SEQ ID NO: 185116 - protein, 186 aa, Glycine max
  Coding DNA Sequence Number=SeqID_68338
  Gene Ontology: Mol. function=nucleic acid binding; Biological process= apoptosis
  Homolog annotation: Hit_ID=Q0ZCD5; Match level="QueryCoverage=35%, HitCoverage=11%, E-value=6e-13, Identity=53%"; Hit description =Integrase
MRELEPTNITLHLADCSMVHPRGVIEDVLVKIDKFIFLANFVVLDIETNENIPIILGRPFLHTCDLVVVFNFPDDMKKHVSFATCNFVQATNKMKTIRAKHRPSVGKENPLKRDIILKDHHGRGIIDENIRDGITIQALGYKVDDHTEGLFHEGIVTPFEGAFGEKRLKHMPKIDEVTLTIHQGID

SEQ ID NO: 185117 - protein, 92 aa, Glycine max
  Coding DNA Sequence Number=SeqID_68339
  Homolog annotation: Hit_ID=Q67X40; Match level="QueryCoverage=74%, HitCoverage=36%, E-value=9e-15, Identity=57%"; Hit description =Integral membrane family protein-like
  Pfam annotation: Domain name=DUF588; Domain location=22-92; Score= -15.8; E_value=0.052; Accession=PF04535.3; Description=Domain of unknown function (DUF588)
MKGVSIEVGEVSKDASQRKGVARGLSIMDFILRIITAVATLGSALAMGTTNETLPFATQFIKFRAEFDDLPSLVKSVANTLDVCEHGNPGFL

SEQ ID NO: 185118 - protein, 74 aa, Glycine max
  Coding DNA Sequence Number=SeqID_68340
MIKIYNNWFINLQHSGYGVRIGEFHIEVVHSSNDCDFCPKLSISTCDILKALHFHHSMVIRMQQAYADFITYIA

SEQ ID NO: 185119 - protein, 170 aa, Glycine max
  Coding DNA Sequence Number=SeqID_68341
MKADMEAMKEQMTTMMEAMMSMRKMMEVNTAIVGVASTNTEVDPIHPSDFNRVGRPVSDVVGQGGKAAENAWGPHYVEVQSKHSFPPYGLPPNYTSPTVVYALGENVNNSAPILIENQQPQPDHSHASKPIVETHEAPQDHTLANFGPHPRYATKRHAFPGAPAPNAPGG

SEQ ID NO: 185120 - protein, 113 aa, Glycine max
  Coding DNA Sequence Number=SeqID_68342
MVGAFSQNTVTLTGLPMILPSESDLTYYCVVCLVIWLGEVLKGTLVLKDIGTQCSDRMVSHYQFSLSQQGQGFTPFACPTPEQFGAEVAWAGDWSEAQAGRCLQDPPAMQRRP

SEQ ID NO: 185121 - protein, 40 aa, Glycine max
  Coding DNA Sequence Number=SeqID_68343
MKEGHIPFELGAMFGHNTSNVVDKGSGQRWTNTKRRIIIR

SEQ ID NO: 185122 - protein, 218 aa, Glycine max
  Coding DNA Sequence Number=SeqID_68344
  Gene Ontology: Mol. function=nucleic acid binding; Biological process= DNA integration
VRSKVVPKTPYELWTGRKPSLRHLHVWGCLAEVKVYNPHEKKFGARTISGFFIGYPEKSKDYRFYCPNHSTRIVESGNARFIENGQFNGSEKSQKVDIVETHGESSSPIVSHENVFPLVVLQSNNTHRQRNNVNNPQDEHIGNEPKDNVQVTNEQVLSKEDWKCILKGCAQRAMFTKWGESTQHQGNSPSAMKNPREYKVREHRANSSPSEAFVASRA

SEQ ID NO: 185123 - protein, 179 aa, Glycine max
  Coding DNA Sequence Number=SeqID_68345
  Gene Ontology: Mol. function=nucleic acid binding; Biological process= DNA integration
  Homolog annotation: Hit_ID=Q53NL0; Match level="QueryCoverage=98%, HitCoverage=22%, E-value=4e-22, Identity=36%"; Hit description =Integrase core domain, putative
MSAISSDYVVYSLEHECELSIDEDSVSFRQAMESDYSKKWLNEMKEELKSMDDNKVWNLVELPEENTVDRCTYMKGSGNKFVILVLYVDDILLATNDIAMLHDVKKYLSNNFEIKDIGETSYVIGIEIFRDRSQELLGLFQKGYINKVLEIFRIEKYFTGLFQYKKGTSLVKCNVPEMN

SEQ ID NO: 185124 - protein, 139 aa, Glycine max
  Coding DNA Sequence Number=SeqID_68346
MQLLSFQQALCLSLVNNNQHSNILHIIRYQPPLPTDQVKAATDFDYEGVRYTCKNKDTVNASYERTRNSAPLIANDLRADFFPATGLKIEEYKPTAFGYWQFGLMVYATENESKSSSYEAVPERLKHIKYLTNMQRRFM

SEQ ID NO: 185125 - protein, 131 aa, Glycine max
  Coding DNA Sequence Number=SeqID_68347
  Gene Ontology: Mol. function=nucleic acid binding; Biological process= DNA integration
  Pfam annotation: Domain name=zf-CCHC; Domain location=106-123; Score =11.9; E_value=0.011; Accession=PF00098.13; Description=Zinc knuckle
MDNLAAKLNAIRMKVCESFLVQFILNSLPAEFGQFQVNYYILKEKWNFQEIKAMLIQEEWRLKKMKDNSIHLMAHDRASTSKSKPSKKGKGKFNLKVKDGGVCKEKKCYFYRESGHFKKDFSKRKKQFEKE

SEQ ID NO: 185126 - protein, 276 aa, Glycine max
  Coding DNA Sequence Number=SeqID_68348
  Gene Ontology: Mol. function=nucleic acid binding
  Homolog annotation: Hit_ID=Q1S567; Match level="QueryCoverage=59%, HitCoverage=37%, E-value=1e-55, Identity=61%"; Hit description =Contains similarity to RNA-binding protein from Arabidopsis thaliana gi|2129727 and ...
  Homolog annotation: Hit description=contains RNA recognition PF|00076 domain
MLVPFSISSGFGVGGRGHGRGGSLPGSGLFNINERAPVKPNSILFNGKDDGSDTGRERENRGRGGFDRGRGRGRGSEKGKGKVREKDVDEKVMDTDDFATGLYKGEDADGEKLARKIGPEIMNQLTEGFEEMTSRILPLALEDEFLDALDINYAIEFEPEYLVEFDNPDIDEKEPIPLRDALEKAKPFLMSYEGIQSQEEWEIVDHYSGPDRVTAKKQQEELDRVAKILPESAPSSVKQFTNRSVISLQLFPSYVDNLIISISANDVLLLAHAVQC

SEQ ID NO: 185127 - protein, 261 aa, Glycine max
  Coding DNA Sequence Number=SeqID_68349
  Homolog annotation: Hit_ID=Q9LIU9; Match level="QueryCoverage=51%, HitCoverage=96%, E-value=4e-30, Identity=52%"; Hit description =Putative negatively light-regulated protein
  Pfam annotation: Domain name=Lg106; Domain location=59-150; Score =181.2; E_value=2.5e-51; Accession=PF07844.2; Description=Lg106-like protein
GAMSDAKVEDLKKEEEVGDDSPRNEVDSEKSADDLKDSDNDKSDGNPMPSSQQEEAAVKKKYGGMLPKKPPLISKDHERAYFDSADWALGKQGAQKPKGPLEALRPKLQPTQQHARSRRSAYAPADDNEVDGCNSDASAEHQSATEEALLKKFHPPRPDWYEEFYASVMNSAAKDYEAEFKFGVFPSQVAMYKSQIFSNLKGKGLRILEIGIGTGPNLSYYAIGSDVEVVGIDPNQKIEKHARSSAVSAGLPPSSFEFIQV

SEQ ID NO: 185128 - protein, 56 aa, Glycine max
  Coding DNA Sequence Number=SeqID_68350
MIEVSVEAIASLAQYYDQSLRCFMFGDFQLVYQGSAWRKGPKLWQIKENGLHSLIY

SEQ ID NO: 185129 - protein, 117 aa, Glycine max
  Coding DNA Sequence Number=SeqID_68351
MRLARAPRAKRPGQPRDVFPGALSGHMRAKRARIITLSLAHRLSGNKQCEEQNEERAKPLAVTCPHQGKRPTGTFPALHPRSLGIGIQEVQMGPGADSTTREEDRCGSGERVLFEPI

SEQ ID NO: 185130 - protein, 112 aa, Glycine max
  Coding DNA Sequence Number=SeqID_68352
MEEKVKLKTNGALRSTYLKLLCSDTTCWKLTYEASMEAGSLSHGIAAKDKGEEVRGDVIHKRISHGRRSFTTKRLPWIRSLKRKLQWRKRKREREGGGGGEVWELKKIRERS

SEQ ID NO: 185131 - protein, 75 aa, Glycine max
  Coding DNA Sequence Number=SeqID_68353
  Homolog annotation: Hit_ID=Q1SW19; Match level="QueryCoverage=90%, HitCoverage=7%, E-value=6e-19, Identity=65%"; Hit description =Disease resistance protein
MTETVVSFALGEVYKILNDEAKLIRGIYKDFLDIKDQLQSLLQAFLKDADRRAADEANTNNGITTWVKQNEFPFH

SEQ ID NO: 185132 - protein, 148 aa, Glycine max
  Coding DNA Sequence Number=SeqID_68354
MVRTRGLGRALGRVIGRGLGRGDHDDSNDAPHRHDKPAVPADSPVVPAADPVVAADESMAAVDEPEGFPDGPTDPSMFTEYAEHVAASERPELKLSSHGRKVHKLVRPVPAIEGLVAGTRLSPLIACSVDTGDRGHSFFTHLILSYDC

SEQ ID NO: 185133 - protein, 73 aa, Glycine max
  Coding DNA Sequence Number=SeqID_68355
SLQVVAPPGSIPSVEQFREMVPQHVEDESSEATIPEPFVIGEEAEETQLRQVVAATPERSLEATSEPSAQGED

SEQ ID NO: 185134 - protein, 340 aa, Glycine max
  Coding DNA Sequence Number=SeqID_68356
  Gene Ontology: Mol. function=carbamoyl-phosphate synthase (ammonia) activity; Cellular component=cytoplasm; Biological process =pyrimidine base biosynthetic process
  Homolog annotation: Hit_ID=Q42601; Match level="QueryCoverage=98%, HitCoverage=75%, E-value=1e-142, Identity=59%"; Hit description =Carbamoyl phosphate synthetase large chain
  Pfam annotation: Domain name=ATP-grasp_2; Domain location=191-340; Score=-139.0; E_value=0.097; Accession=PF08442.1; Description=ATP -grasp domain
  Pfam annotation: Domain name=CPSase_L_D2; Domain location=189-340; Score=167.2; E_value=4.1e-47; Accession=PF02786.7; Description =Carbamoyl-phosphate synthase L chain, ATP binding domain
  Pfam annotation: Domain name=CPSase_L_chain; Domain location=67-187; Score=203.5; E_value=4.8e-58; Accession=PF00289.12; Description =Carbamoyl-phosphate synthase L chain, N-terminal domain
  Pfam module annotation: Pfam domain module=ATP-grasp_2::CPSase_L _D2::CPSase_L_chain; Domain location=191-340::189-340::67-187
  Subcellular localization annotation: CTP_CleavageSite=47; ConfidenceScore=5.69e-01
PLLPSFPQSQIPFRSPKTLRSQNDAVPPTTLRGCPPPTARLNPARVRCSTVAVAEPTTAPQLGKRTDIKKILILGAGPIVIGQACEFDYSGTQACKALREEGYEVVLINSNPATIMTDPETADRTYITPMTPELVERVLESERPDALLPTMGGQTALNLAVALAESGALEKYGVELIGAKLDAIKKAEDRELFKQAMQNIGIKTPPSGIGTTLDECLSIANDIGEYPLIVRPAFTLGGTGGGIAYNREDLLEICKSGIAASLTNQVLIEKSLLGWKEYELEVMRDLADNVVIICSIENIDPMGVHTGDSITVAPAQTLTDKEYQRLRDYSIAIIREIGVE

SEQ ID NO: 185135 - protein, 69 aa, Glycine max
  Coding DNA Sequence Number=SeqID_68357
MEKSNRENNKYHISQSRRSALDGEEHVGEWKNPIGKITKITFPSHEGPLLTVKNTLEIGGFNRENNNLC

SEQ ID NO: 185136 - protein, 169 aa, Glycine max
  Coding DNA Sequence Number=SeqID_68358
  Gene Ontology: Mol. function=zinc ion binding
  Homolog annotation: Hit_ID=Q10M20; Match level="QueryCoverage=60%, HitCoverage=22%, E-value=1e-13, Identity=41%"; Hit description =Expressed protein
MGPNEPYWRTNSSFSPPPTRWDFRFQSEGLSYGVNDGVQLYGSSTSENDKESRGWVRGNHLYDLHYSASDGTGIFLSSPSDLSQGPQWTPPAIQEISIDNYETSTRKAFCKFSFHHIYYLEKLDFQIEGGLQVSNVVLRVKCVIIPSYDSLQPAVFEKYWLLINWNGRQ

SEQ ID NO: 185137 - protein, 57 aa, Glycine max
  Coding DNA Sequence Number=SeqID_68359
MKLGGRRRYPSGYPYKHSFAIRQTKSPLGGRRRHPSGYPYKHTFAIRQPKSPVACRD

SEQ ID NO: 185138 - protein, 106 aa, Glycine max
  Coding DNA Sequence Number=SeqID_68360
  Pfam annotation: Domain name=zf-C2H2; Domain location=37-61; Score =13.1; E_value=0.4; Accession=PF00096.16; Description=Zinc finger, C2H2 type
  Pfam annotation: Domain name=zf-C2H2; Domain location=72-94; Score =22.2; E_value=0.0019; Accession=PF00096.16; Description=Zinc finger, C2H2 type
  Pfam module annotation: Pfam domain module=zf-C2H2::zf-C2H2; Domain location=37-61::72-94
  Subcellular localization annotation: CTP_CleavageSite=29; ConfidenceScore=5.17e-01
MDATSTLPAPAPPTLLCTPPGSSQKKTASSSYQTSHIICDKCDPPRLFKSEQGLNSHSRIHKRPIQFDILEFKCGECTDVFESQQALSGHMRLHNRVRYRPPNARP

SEQ ID NO: 185139 - protein, 324 aa, Glycine max
  Coding DNA Sequence Number=SeqID_68361
  Gene Ontology: Mol. function=metal ion binding
  Homolog annotation: Hit_ID=Q60D31; Match level="QueryCoverage=68%, HitCoverage=77%, E-value=9e-68, Identity=60%"; Hit description =Putative mandelonitrile lyase, related
  Pfam annotation: Domain name=zf-C3HC4; Domain location=170-228; Score= 3.2; E_value=0.074; Accession=PF00097.15; Description=Zinc finger, C3HC4 type (RING finger)
MMILQTSQKELFDFLPYSIRLLYPTTANKNPPQHVFVPFPIDSHVANGYEIFSQGTSVNHYCGGSTSSQSESSESESTTKSHLSSERNFANLRSFMSKPIHPMSFNDLTTTRDAFDPAVTDFTEFDTSTPLRDGQRWSSASSSQEFADVTESFELETPGRSHFLSDGFKCGLCERFLSQRSPWSSRRIVRSGDMPTIGVLPCCHAFHAECLEQATPKTRKSDPPCPVCVKLEENSPDQRSHLRLRTGFPRLKSSRDDGPSRPWGCVQVGDCVEGALHAPPGNTMLLLNRNRIKNPSLKGISSGSSADGEAVSCSKATAGPSVWR

SEQ ID NO: 185140 - protein, 105 aa, Glycine max
  Coding DNA Sequence Number=SeqID_68362
  Gene Ontology: Mol. function=ribonuclease H activity
  Homolog annotation: Hit_ID=Q1S700; Match level="QueryCoverage=97%, HitCoverage=31%, E-value=1e-15, Identity=45%"; Hit description =Ribonuclease H
MYSNIQEFQIPKAFDIKGHARKAPKILQVDMSPTCNWVEYNTDEATKGAPDSAACGGIFRDKNATFIGCFSANVANVGTNFAFNAELMDAIISIEIAYERGWTNF

SEQ ID NO: 185141 - protein, 59 aa, Glycine max
  Coding DNA Sequence Number=SeqID_68363
MAWETRPWGPIATRFGGMPGYCGTLVGPLRSFFCIDVPSSSVAKDLSYYGCMSYVQEVH

SEQ ID NO: 185142 - protein, 141 aa, Glycine max
  Coding DNA Sequence Number=SeqID_68364
MEVAMIGGDGGNGRMVTMEVITIGCDDGDNGMVTLEVIMIMTGVVAQWIFYVEYEVTTDKEGRPHLEDITSEAVRYVPFTYEEPFQWYSIFIYGWMLKEWVCSGAWYWYESRYSSIIKYTLRLRDLPKNVTSSNVKIKKRE

SEQ ID NO: 185143 - protein, 307 aa, Glycine max
  Coding DNA Sequence Number=SeqID_68365
MSLAMGGKYWRCNGVLLHTCHSSWVTRTKDIVVEGGLVVGTKLSCSRIFSGFTSNSPYKVTSLLVDGSPDFNGDHGVYAIYKLGPKDDSVSCLCLIDDLGMFDRGLNGAWTIEILRRSAPPGKVEGIFLECHPVVAGLHHFGGGHPVWFLLFSSHNFSMSMVGVWSVSWMIVLRCSAFLVLASLESSLATLSPWSSICWQPVPGQVASPCNIVRAFKDDSCPASFYVGRTVNVKVPLVWVVVISSHHPSCEFRLSQNLLDGVVHFDYHLMTLEVGLESSGQALLGVMEYTVSEMDRELVLPFLLYEG

SEQ ID NO: 185144 - protein, 670 aa, Glycine max
  Coding DNA Sequence Number=SeqID_68366
  Gene Ontology: Mol. function=RNA-directed DNA polymerase activity; Biological process=RNA-dependent DNA replication
MTSAALASPRQADDESLKNFMDTFGRTVVQIRNLNPEVALHSMLLTLRPDKFVDSLCKKPPSSMDELRERAKGYIQMKEISRFRNQVRQAGQKCDKREGNTKIDIHKSDKRHKPDKCRPLTKRVRYEPYTPLTANHTIILEESSNLEVLIRLPSTKPPRLRLDMTKYYRYHRDRTTTKQEQDLEDTEKSNKGIMMQIEEEIKQKIEVDRDTSNSGTSDKLHNNKNPPSKFEDFKGINPVNQEDPMVVSIIIANFMVSKVLIDQGNSTNILYWRTFQRLEVSIDTDHRHTSPLLGFEGERVETKGYVDLMTTFDQGQLCRSFTIRYLLIDADTSYFALIDNKTLNELGAIVSTSHLKMKFPTLTREIVIIKADQKQARQCYAEILKLAPYPPTREPAKLHPAAPEGTQVMSMDEGSSIRALTVYQPSLDDEFDIDPCDNTSDRGPKPIEELVKLQLRPKPGLNKDLTRNEHRNIIDTNRYNRRKGRCEKNDAKLSKKKWTNSSMQTSLEKSHIPPSLPTSSWLVDGASEFQVLRFLDAYSRYNQIRIYTSNEEKITFITEDANFCYKIGRNVKVYVDNMVVKSQSIAQHVPNLEEVFEELHKYDMRINPEKCTFGVGRGKFLKKCTVVLEMRSPTNVQEVRKLNDRLASLSRFLPKFAEKAKLFYKMLKKT

SEQ ID NO: 185145 - protein, 118 aa, Glycine max
  Coding DNA Sequence Number=SeqID_68367
EDDYEYDSESDYDESSDYSEDGFGDDLESDYGGSNSSGSSSECDDVVLESHHGYEHGHGYGYNDDLLEYHNGYWSGHDYYSSDIECGYNCPYDFESDYGYSEYGYEDDLCGWDGSHDD

SEQ ID NO: 185146 - protein, 575 aa, Glycine max
  Coding DNA Sequence Number=SeqID_68368
MGTLLALAGGHGFCCFWGACPGYCDPPSSAFGRIDHAGSPSSSPNIVGYKWVKGDVMKYKSFSHLCDDCPCSSTPGEVGKPSELMQLTGKIGWVSLNNVSKKLFEFDSNIFHLFKDRFFNVLATDVMTDGHSVSSLDERPPRYLGRPLMKQIGLAGRTVPSSAAASVLGEGGQPTGKVTFGALSSILAKRKQDESVGSSDCEKLKSPMSLRALRQAAGLMPGAGFPSSVQDVPLAPPAFEALAANVVVTVTSAPPPPLVVPVQEATPTVDVNMSTTSASPVVVTSSTIIAPLLSVGMATASAPVMSPPPSLAPSVPSSTILVMASPPLSSWPHVSLDHMYTSNNVHSLWAASYRPKQKTPTGFENGQQHQKALHKVASLEAEVPKWRVIARTLYRVECHKVANATITFAEAISTRLDGDELFACYKSFQDEKKNLDGKMEGIATERDELAKESELLAAREREDSKELKEELLIYKMEAMEQHEKGFNKAVRQAGFFAKDLDLGLLDLFKDVKDGVLLDEEYFAVEEEVVDEEQGHHDDESGIFDDVDLVDEELSLTLVRSMFDLPLVEGLANQSG

SEQ ID NO: 185147 - protein, 90 aa, Glycine max
  Coding DNA Sequence Number=SeqID_68369
MRLAMTVMNMGMSMDMKRRGALNFEIITVRVNLIMVARVEMTLNLIVVAPVKMPMNMTLNLIMMARVTMTKILINSKIYLKKDKDDLMRN

SEQ ID NO: 185148 - protein, 206 aa, Glycine max
  Coding DNA Sequence Number=SeqID_68370
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=96%, HitCoverage=60%, E-value=2e-64, Identity=58%"; Hit description=Ser -thr protein kinase
  Pfam annotation: Domain name=Pkinase_Tyr; Domain location=1-175; Score=-172.3; E_value=0.067; Accession=PF07714.7; Description =Protein tyrosine kinase
MAASAENIREGEELNWIMRMRIAMGIAYCLEYMHELKPPIAHRNLQSSFIYLTEDYAAKISDLSLWNDMCDTKNGSATTQFLETSSADTKDNVYSFQIVLFELITRRIPLVGNKELLADWAAEYVRWGKSLRYVVDPRLKSLQEEEIDEWSEVIRNCVQPDLEKRPTMKEVTSRLKEITAMGPDGANPKASPLWWAEMTIISTDSS

SEQ ID NO: 185149 - protein, 48 aa, Glycine max
  Coding DNA Sequence Number=SeqID_68371
MVTNNTHEAMKINGCSNQDLIIMEKKVNSISRNGCLSLFFGRNLLIAI

SEQ ID NO: 185150 - protein, 139 aa, Glycine max
  Coding DNA Sequence Number=SeqID_68372
  Gene Ontology: Mol. function=identical protein binding; Biological process=negative regulation of enzyme activity
  Homolog annotation: Hit_ID=Q9ZTT3; Match level="QueryCoverage=90%, HitCoverage=17%, E-value=4e-15, Identity=41%"; Hit description =Subtilisin-like protease C1
  Pfam annotation: Domain name=PA; Domain location=38-135; Score=18.5; E_value=0.004; Accession=PF02225.12; Description=PA domain
MHHGYFLWLLGCTFDRKIVTKVQLGNGAIYGGVSINTFDLKKKFYPLVYGGELVIYLILLEDITAPHPEDSLDKHSVKGKIVLCDLIQASDDVGILSGPAGVIFGLNYPQDLRGTYALPALQIAQRDQRLIHSYITSTR

SEQ ID NO: 185151 - protein, 139 aa, Glycine max
  Coding DNA Sequence Number=SeqID_68373
MVVGSRGGIVCFGGGYLGFGLGKIMFERKNNVEDEEEGEEDEAEEEEKEKEKGEVSGKAQVIQVKGEWDAGNLKLSLPPQNDGIIRTVQSITDQSPGSKKEGRGIKQLQKSISCKYKNMENYVSVDQGFEGERDNYVIY

SEQ ID NO: 185152 - protein, 198 aa, Glycine max
  Coding DNA Sequence Number=SeqID_68374
FPEDVFRKSSGRSVLPEDVWLLPEEHFFRKLSGKGSSGTSGRTPNGSSGRLLRQPFPPFFPAYSRLLPSRLLPKGSIVMLRFHCYANSDAHYKLRVRGRGTNLFAEKKKKALARLAEKKLHGEEKKKQVPGEEEVVPGEKKLCSGREEESVFRERRRICSKKSLPEMICVFYNFILKGKMLNRGPSPIGKVCNMGGFI

SEQ ID NO: 185153 - protein, 83 aa, Glycine max
  Coding DNA Sequence Number=SeqID_68375
MAKSNGSDNSFGDSTNAEVALMSRKFKQMMKKKGKFQHSSRRKDNDSSTDDEEDIPYDVLLLNHHMTLLQRKKYKENYKAFVF

SEQ ID NO: 185154 - protein, 151 aa, Glycine max
  Coding DNA Sequence Number=SeqID_68376
  Homolog annotation: Hit_ID=Q1RZ71; Match level="QueryCoverage=44%, HitCoverage=5%, E-value=2e-08, Identity=46%"; Hit description =Peptidase aspartic, catalytic; Polynucleotidyl transferase, Ribonuclease H fold
MSYKRLWEVFGNLKHINHAFKIPSTPHDKSGLGLEKRPSSSMSQSDSDNCDLCGKSGHSNFSCIHKKKQMSKGTNAYGPKNIWISLVGKGKNLRWHFDSGCSRHMVRERSMFLDLKLIERGTVVFGGMGKGKITDICKVGIPSIASIDNVL

SEQ ID NO: 185155 - protein, 53 aa, Glycine max
  Coding DNA Sequence Number=SeqID_68377
GGDDDNSSDSDTYGGGDCIVHGGSDNNDYGDSGHDVHGGGGCDAHGDGDSNGQ

SEQ ID NO: 185156 - protein, 106 aa, Glycine max
  Coding DNA Sequence Number=SeqID_68378
MPISICGSASWDRAHKTPNGPGEVQQGPGVSSSGYESLSVLPGARPPSKVMPSCIGIAPARHPVDPKKSNRVLGFPALITGLCQFYGVPIAPSKVIRPPTNRASIK

SEQ ID NO: 185157 - protein, 100 aa, Glycine max
  Coding DNA Sequence Number=SeqID_68379
  Subcellular localization annotation: CTP_CleavageSite=60; ConfidenceScore=5.12e-01
GVVPDFLTFESLSPAINLAYIRKNCWNPVDPTITFPRSRKARAWGLSDASTSAPTSTPALAPALTTPSGLSTSSTNMIVLMLQSLHHGLCLVMQSIHDLA

SEQ ID NO: 185158 - protein, 145 aa, Glycine max
  Coding DNA Sequence Number=SeqID_68380
MAIKVRKECDKLRDVNQQQAQASKDRERPVEGMILEDKLKAYQRSKRSLSEQLSRMEENMWAIIDLYKEKLNLASTHEQRLEDEYAKVSILQAEREARERVIDSLHREAMMWMDRFAFTLNGSQELLRLLAKAKAMTDVYLDPEE

SEQ ID NO: 185159 - protein, 50 aa, Glycine max
  Coding DNA Sequence Number=SeqID_68381
MAILIANTSSTFHRDEGLGNTHAMHGKLKWVYDPNMVGSWYRIYATKNAA

SEQ ID NO: 185160 - protein, 187 aa, Glycine max
  Coding DNA Sequence Number=SeqID_68382
  Gene Ontology: Mol. function=DNA binding; Cellular component=nucleus; Biological process=regulation of transcription, DNA-dependent
  Homolog annotation: Hit_ID=Q38739; Match level="QueryCoverage=32%, HitCoverage=18%, E-value=3e-15, Identity=59%"; Hit description=Mixta protein
NEIKNYWNTNVKKRFIRMSLDPITHKPMKSNTFEAHDEFKDITNIGHVSQWESARLEAEARGSMLQVGSGSLHLPRLILSKIPTQPCPSSNLLSTEHKRVYNMYALVLATNHDLQSSVSTLSVPKLPAVSTNIGQFTDMENLLSYNGDGNVVEISSHIPKVMEGCASNLQDDDIIMAVEAFRTPRNT

SEQ ID NO: 185161 - protein, 421 aa, Glycine max
  Coding DNA Sequence Number=SeqID_68383
  Gene Ontology: Mol. function=ribonucleoside-diphosphate reductase activity; Cellular component=ribonucleoside-diphosphate reductase complex; Biological process=DNA replication
  Homolog annotation: Hit_ID=Q8D117; Match level="QueryCoverage=68%, HitCoverage=40%, E-value=1e-137, Identity=83%"; Hit description =Ribonucleoside-diphosphate reductase 2, alpha subunit
  Pfam annotation: Domain name=Flavodoxin_NdrI; Domain location=33-133; Score=147.1; E_value=4.7e-41; Accession=PF07972.2; Description=NrdI Flavodoxin like
  Pfam annotation: Domain name=RNR_N; Domain location=147-228; Score =168.7; E_value=1.4e-47; Accession=PF08343.1; Description =Ribonucleotide reductase N-terminal
  Pfam annotation: Domain name=Ribonuc_red_lgN; Domain location=229 -303; Score=104.0; E_value=4.3e-28; Accession=PF00317.11; Description= Ribonucleotide reductase, all-alpha d
  Pfam module annotation: Pfam domain module=Flavodoxin_NdrI::RNR _N::Ribonuc_red_lgN; Domain location=33-133::147-228::229-303
VVDLTQDQQALNHVKSLGYQQVPVIIAGDDHCSENTHRFVEKLGLPAIRIPIAGARSKLLMEHPFILIVPSYGGGSAVGAVPIQVIRFLNVPQNRSYLRGVIAAGNTNFGAAYGIAGDIIAKKCQTGSNRILATTELTRPETGALDYHSLNAMLNLYDAEGRIQFDKDRLAARHYFLQHVNQNTVFFHNLEEKLRYLVEEGYYEPQVLAQYEFPFIKQLFQQAYAKKFRFETFLGAFKYYTSYTLKTFDGKRYLERYEDRVCMVALTLAAGDTALAQDLVEEMISGRFQPATPTFLNCGKRQRGELVSCFLLRIEDNMESIGRAVNSALQLSKRGGGVAFMLSNIREVGAPIKRIENQSSGVIPIMKMLEDAFSYANQLGARQGAGAVYLNAHHPDILRFLDTKRENADEKIRIKTLSLGV

SEQ ID NO: 185162 - protein, 103 aa, Glycine max
  Coding DNA Sequence Number=SeqID_68384
MSEKNLTGRLGVQDKPHNRRLVRVTLFCENSPTIWDRHRLTGALKSGVFTPKAYTLKSLSGPLPPNSGPTQKTFQNTDSIYELYKTHDSSIVLKIILSHCACD

SEQ ID NO: 185163 - protein, 337 aa, Glycine max
  Coding DNA Sequence Number=SeqID_68385
  Gene Ontology: Mol. function=metal ion binding; Cellular component =integral to membrane; Biological process=defense response to bacterium
  Homolog annotation: Hit_ID=Q4VG19; Match level="QueryCoverage=93%, HitCoverage=59%, E-value=1e-117, Identity=65%"; Hit description =Pollen ankyrin-like protein
  Pfam annotation: Domain name=Ank; Domain location=111-144; Score =11.3; E_value=0.73; Accession=PF00023.20; Description=Ankyrin repeat
  Pfam annotation: Domain name=Ank; Domain location=177-209; Score =40.9; E_value=4.4e-09; Accession=PF00023.20; Description=Ankyrin repeat
  Pfam annotation: Domain name=Ank; Domain location=220-265; Score =13.8; E_value=0.32; Accession=PF00023.20; Description=Ankyrin repeat
  Pfam annotation: Domain name=Ank; Domain location=44-76; Score=39.2; E_value=1.4e-08; Accession=PF00023.20; Description=Ankyrin repeat
  Pfam annotation: Domain name=Ank; Domain location=77-109; Score=27.2; E_value=5.7e-05; Accession=PF00023.20; Description=Ankyrin repeat
  Pfam module annotation: Pfam domain module=Ank::Ank::Ank::Ank::Ank; Domain location=111-144::177-209::220-265::44-76::77-109
MGNSFGCSASGERLVSAARDGDLVEAKMLLNCNPCLAKYSTFGGLNSPLHFAAAKGHNEIVALLLENGADVNSRNYCGQTALMQACRYGHWEVAQTLLLFRCNVIRADYLSGRTALHFAAVHGHVRCIRLVVADFVPSAPYQAIHAGTAVDRGGGSNVKGKHEHSALSKFVNKTADGGITALHMAALNGYFDCVQLLLDLNANVNAVTYNYGTSMDLIGAGSTPLHYAACGGNLKCCQARIALVLIVIYLMILVAHGASRLALNCNGWLPLDIARMWGRHWLEQLLAPSSDATMPTFSHSNYLSLPLMSVLNIARYFAILYFCFSKSTQLFFMWQSI

SEQ ID NO: 185164 - protein, 1129 aa, Glycine max
  Coding DNA Sequence Number=SeqID_68386
  Gene Ontology: Cellular component=nucleus; Biological process=snRNA processing
  Homolog annotation: Hit_ID=UPI0000519BDE; Match level="QueryCoverage =75%, HitCoverage=77%, E-value=2e-23, Identity=22%"; Hit description =PREDICTED: similar to integrator complex subunit 7 isoform 1
MEPTSVALAMEWSIQLEMGLRSTKPGVPVKAISEMEPRLQRWSREPEFGIAPYAMFGLVPGEDKVFANTILLRLADAFRGGDIETKLSVVRVFLSERKHRDKEKKKQCKGLLSEARVANHLELLKRVKSVFDSGDLKSKGLTLVLFGCWADFVKDNAQIRYMIFSSLVSPHDCEVRASLYATGCICEISDDFASISVEMLFNIMNSSSVSLPVKLVAARVLAKCKSSYSVAHKAYKIGMELVLNSSDEDFLVAMLLSLSKLACILIPFISYQVDFLLSFLNRERTSHVQDMALKCLHFLFRRGLYEHSDNLGLIRGLFSIMEEPEISLAMQYKALRVLHKVLLSIPPSSLHMELREFVRLLTVVENASQYPASRKSYLAIRILADLCCRTKDIADINNVFCCSFPSHVISLIKDHIKLLLMPLLEGCQNDLTICQELQGLLKILLNIVERHPNLGSLVLDSLKQVIQYLVTVASANCAVTSTLSAINFIGKERNSFILKLLHKIYRFLIVFQENLYIVGAINTKLSSEVNILVELVCQCSLIDCYTYSLYHLLFHSQPICDGLVHENDETHLASCCTTFVNKVLIGTNGWTAYKVGAHAACQGEWLLATNIFRTLIEKVKSDSCCSWLKALFHYAHSEGKIQLLSQPKQGTTSMELMETIKFPLKSCDYKGDTCPRLARSINDSNYYDQLTQSHVAVCSSLKFLEASVTSSQAFCFQRWFLSLRARVLENLVGVLKALREVSLNVDQNFNQVEIESSDKLQCLKSYQDITQVSSQLFRLVEEFDLLRASFIGMDSESSAVLAAHGLSCSILAFATAFGVSNIDQHSQRIFIGNKTSNLQALTIQNLRRLFWSVDHETRASFSSLLNYFDPNKNCLSPLPSYQNLNIGYKDKEVLNVCSYAVSGAVRLFEKIAPQFTENALSLTSNTLIKWMHIHFRLPKYFFKVRPFIGSELFVHNKDSSNGVDISVSQGSHLTLNICLQLKNVPPKLLVKSTKLYCILHCSTVFHVPCGQRKAPENSLFGYEAWKDDEIVELNQKLFCHVLDSAAGQRRIGRHSRGHGNSRAVETFMDFRPNEKGQGFSHCSLDVSNFPLGSYRIKWHSCLVDSQDSYWSLLPLNSGPVFFVIKPRVG

SEQ ID NO: 185165 - protein, 617 aa, Glycine max
  Coding DNA Sequence Number=SeqID_68387
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=96%, HitCoverage=94%, E-value=1e-146, Identity=43%"; Hit description =Receptor protein kinase, putative
  Pfam annotation: Domain name=B_lectin; Domain location=11-124; Score =52.4; E_value=1.5e-12; Accession=PF01453.15; Description=D-mannose binding lectin
  Pfam annotation: Domain name=Pkinase; Domain location=325-579; Score =172.0; E_value=1.5e-48; Accession=PF00069.15; Description=Protein kinase domain
  Pfam annotation: Domain name=Pkinase_Tyr; Domain location=325-601; Score=131.3; E_value=2.6e-36; Accession=PF07714.7; Description =Protein tyrosine kinase
  Pfam module annotation: Pfam domain module=B_lectin::Pkinase::Pkinase_ Tyr; Domain location=11-124::325-579::325-601
CYLQIVRKRGDSWSVWFANRNEPVDAESAVLLLDHSGVLKIESKHRELPIILYFSPQPANNTMATLLDTGNFVLQQLHPNGTKSVLWQSFDYPTDNLLPGMKLGVSYKTSHNWSLVSWLTSEIPNLGAFSLEWQPRTRELIIKRREQLCWTSGELRNKEGFMHNTHYRIVSNENESYFTITTSNEELTRWVLLETGQLINRNGGDDVARADMCYGYNTDGGCQKWDEIPICRHRGDAFEDSCIAYSDYDGNNETGCTFYHWNSTKGTNLASGGMKFRLLVKNTDRKDLATANRFYDVKDLEDEFKKRQDLKVLNYTSVLSATDDFSTENKLGQGGFGPVYKGILPTGQEVAIKRLSKTSTQGIVEFKNELMLISELQHTNLVQLLGFCIHEEERILIYEYMPNKSLDFYLFDCTRSMLLDWKKRFNIIEGISQGILYLHKYSRLKIIHRDLKASNILLDENMNPKISDFGLARMFMQQESTGTTSRIVGTYGYMSPEYAMEGTFSTKSDVYSFGVLLLEIVSGRKNTSFYDVDHLLNLIGHAWELWNQGESLQLLDPSLNDSFDPDEVKRCIHVGLLCVEHYANDRPTMSNVISMGGNNELEDWDRNREEVLLVLVE

SEQ ID NO: 185166 - protein, 52 aa, Glycine max
  Coding DNA Sequence Number=SeqID_68388
MKPGWEEFAQVVGMFGNKGSGCFVYSQAKSELGKRVGVILLYAAEEVCRGTT

SEQ ID NO: 185167 - protein, 287 aa, Glycine max
  Coding DNA Sequence Number=SeqID_68389
MENPLFDLPHTIYINILRNLKGLGGLDDIYYATFINKLLWDQGVYHFFNNMDGDSKHTLIVKGLVVAKQQKFSKTNLKAMKVALEQTLKEALEMDAEALNKRKQKKLAKSIADEDHRLENFGTTKKIKRSGLNNNRRRKPRNSPKWMKKKRRCWQRRNIPKEGMSLPCLLLLTRATKAKPKIGDKEWVVSFTANKEDLACSLSKNESIDDTSHTPLHKFAPIPQPHSSLSSLHIDKFRRVAPREPLTDEQRFSLAYTHGNHAPLSPYFEVSFIEPMVRKTTFAETPI

SEQ ID NO: 185168 - protein, 80 aa, Glycine max
  Coding DNA Sequence Number=SeqID_68390
MASTNTLAIKAISTMKIATIHIDNEPSIHVEHFFDIQELEKIFNEPDVAPCEAYRPWIFFINEVLCFLKINGSRMEKEKR

SEQ ID NO: 185169 - protein, 880 aa, Glycine max
  Coding DNA Sequence Number=SeqID_68391
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=94%, HitCoverage=87%, E-value=1e-166, Identity=45%"; Hit description =Protein kinase family protein, putative, expressed
  Pfam annotation: Domain name=Pkinase; Domain location=496-770; Score =112.3; E_value=1.4e-30; Accession=PF00069.15; Description=Protein kinase domain
  Pfam annotation: Domain name=Pkinase_Tyr; Domain location=496-770; Score=122.9; E_value=9.2e-34; Accession=PF07714.7; Description =Protein tyrosine kinase
  Pfam module annotation: Pfam domain module=Pkinase::Pkinase_Tyr; Domain location=496-770::496-770
MRFNSITSVTTLFLFLSLFTHLHAYTPVDNFTISCGTTGKSYDGERTWTGDTGSTFLSHQDGTVSANATTQSPSTNQVPYTAARLSRSRFSYSFPVSPGPKFLRLFFYPAEYASFPSSNASFTDQSNQFTLLHVFNASLKAENTKTIFREYVVNVDGDSERLNLTFTPSQPNSYAFINGIEVLSMPSNLYYTSANDNGLKLVGTDTLFPIRTNTALETEYRIKVGGQGISPRNDTGLFRNWAGQDEDYLIKQKNPQNSAITGNTNGKMNITVNPDYVAPKELYRTARVMGTNTSMNKSLKLTWEFPVDSGFHYMIRFHFCQLDPNITNIGDRVFSLYIGSEFLDVMRWSQKQKGVAVYKDYAILIPKSDTQKQVNLSLQMMNPYESAKDKENNDPFLNGLEIFKISEFNNLAGPNLQNNNMLVQEGKNSSRTLKIVVAGVVSGVVVFFIFLWGSCKFGPLLPSQDDDMLNYSQRWPFNLLCQRFSLMDIKAATNNFNNESLVGVGGFGHVYMGYIDGISIPVAIKRLKPGSKQGSEEFLTEIKMLSQIRHRHLVPLIGYCNNNKEMILVYDFMTRGNLRDHLYNTDKSPLSWKQRLQICIGAAHGLYYLHKCAGKYMIIHGDVKTTNILLDDDWVAKVSDFGLSRFGPTDSSHAYGSTTAVRGSFGYIDPEYYKRHHLTDKSDVYAFGVVLFEVLCARPPLIRNEDPKQESLAKWVRYCYQSGTMDQIVDPTLKGRIAPECFRRFCHIGVSCLSEVGTQRPSMKDVVFMLESTLQIRMPVYRNQLASISCERRQVQGCVYFGLSRIGPTGKYKTHVSTDVKGSFWYLDPDYCIRNTLTEKSDMYSFEVVLFEILCARPPLIHNAWRCNMCRLLTGPSTIT

SEQ ID NO: 185170 - protein, 844 aa, Glycine max
  Coding DNA Sequence Number=SeqID_68392
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=93%, HitCoverage=86%, E-value=0.0, Identity=49%"; Hit description =Receptor-protein kinase-like protein
  Pfam annotation: Domain name=Pkinase; Domain location=542-814; Score =104.0; E_value=4.6e-28; Accession=PF00069.15; Description=Protein kinase domain
  Pfam annotation: Domain name=Pkinase_Tyr; Domain location=542-814; Score=133.0; E_value=8.1e-37; Accession=PF07714.7; Description =Protein tyrosine kinase
  Pfam module annotation: Pfam domain module=Pkinase::Pkinase_Tyr; Domain location=542-814::542-814
MRLLSIITTSLTLFFLLLFLSIHLQAYTPEDNFTISCGTTGIVFDGQRTWTGDEDTKYLSGGQGSTVLTQAATQDPSVNQVPYTTARLSPSQFNYSFPVSAGPKFVRLFFYPADYPSFPRTHASFSVQSNGFTFLKGFNASLNADAEATKTIFREYVVNVNDGEILILSFSPSQPNSYAFINGIEVLPMPSDLYYTSATNSTGFMFLGSTTLYSVETRFALQAEYRIKMGGQEISPLNDTGLFRKWAGDEKDYLIKQNPENNDLPADTDGKMNITVNPDYVAPKELYRTARNMGTNATLNKISNLTWEFPVDSGFTYVLRLHFCELDPNINKDGDRVFFIYIASQLAENHADVMQWSHNQKGLALQRNYAVLIPIDNTQKKVNLSLQMHPYATNDKTTYSDAFLNGLEIFKISEAGSNNLAGPNPDPVQTPHNNIPAPKGDRSSKTAAATYPVQSPHNNIPVLTGKISSESRGTIIGVVVGVVSGVVLILLVVFFVFLSATSRCAGLLFSMTKSTKTHNSSLPLDLCRRFSLLEILDATQNFDDVLIVGVGGFGQVYKGYIDDGSTPVAIKRLKPGSQQGAHEFLNEIEMLSQLRHRHLVSLIGYSNDNKEMILVYDFMTRGNLRDHLYNTDNPTLPWKQRLQICIGAARGLHYLHTGAKHMIIHRDVKTTNILLDDKWVAKVSDFGLSRIGPTGTSKSHVSTNVKGSFGYLDPEYYKRYRLTEKSDVYSFGVVLFEILCARPPLIRNAEMEQVSLANWARRCYQNGTMAQIVDPSLKGTIAPECFEKFCEIGMSCLLEDGMHRPSINDIVWLLELALQLQEDAEQRENADIVTDESNEIKRGN

SEQ ID NO: 185171 - protein, 819 aa, Glycine max
  Coding DNA Sequence Number=SeqID_68393
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=92%, E-value=0.0, Identity=48%"; Hit description =Receptor-protein kinase-like protein
  Pfam annotation: Domain name=Pkinase; Domain location=517-789; Score =105.6; E_value=1.4e-28; Accession=PF00069.15; Description=Protein kinase domain
  Pfam annotation: Domain name=Pkinase_Tyr; Domain location=517-789; Score=144.8; E_value=2.2e-40; Accession=PF07714.7; Description =Protein tyrosine kinase
  Pfam module annotation: Pfam domain module=Pkinase::Pkinase_Tyr; Domain location=517-789::517-789
MISTVRFYSVTSFVLAFLFFSIELQAYTPEDNFTISCGTTGIVFDGQRTWTGDADTKYLSGGQGSTVLTEAATQDPSVNQAPYTTARLSRFQFNYSFPVSAGPKFVRLFFYPADYPSFPRTHASFSVQSNGFTFLKGFNASLNADAEATNTIFREYVINVNDGEILILSFTPSQPNSYAFINGIEVLSMPSDLYYTSATHSTGFKFVGNTTLYSVETRFALQVEYRIKIIGQEISPLNDTGLFRKWAGDEEDYLIKQNPQNNDLSADLDGKMNITVNPDYVAPKELYRTARNMGTNATLNKISNLTWEFPVDSGFTYVLRLHFCEIDPNINKDGDRVFFIYIASQLAEDNADVMQWSHNQKGLAVQRNYAVLMPKDNTQKKVNLSLQMHPYATPDKTIYTDAFLNGLEIFKISQDESNNLAGPNPDPVQTPHSNKSVPTGKISRGSGETIIGMIVGVVSGVVLISLVVFFVFLSPISRCGPLLFSMTKSTKTHNSSLPLDLCRRFSLLEILAATQNFDDVLIVGVGGFGHVYKGYIDDGSTPVAIKRLKPGSQQGAHEFLNEIEMLSQLRHRHLVSLIGYCNDNKEMILVYDFMTRGNLRDHLYNTDNPTLPWKQRLQICIGAARGLHYLHTGAKHMIIHRDVKTTNILLDDKWVAKVSDFGLSRIGPTDTSKSHVSTNVKGSFGYLDPEYYKRYRLTEKSDVYSFGVVLFEILCARPPLIRNAETEQVSLANWARRCYQNGTMAQIVDPSLKGTIAPECFEKFCEIGMSCLLEDGTHRPSINDVVWLLEFALQLQEDADRSENADIVTDESNEIKRGN

SEQ ID NO: 185172 - protein, 80 aa, Glycine max
  Coding DNA Sequence Number=SeqID_68394
MEVCKEAEKEEECCYGGDTVEPHVLVDDARKQLREEGSEYLLGKLEGNCGVKRKNSYLTRLDQSNILIHLSMHLIADIKS

SEQ ID NO: 185173 - protein, 355 aa, Glycine max
  Coding DNA Sequence Number=SeqID_68395
  Gene Ontology: Mol. function=solute:hydrogen antiporter activity; Cellular component=integral to membrane; Biological process =regulation of pH
  Homolog annotation: Hit_ID=O22920; Match level="QueryCoverage=95%, HitCoverage=41%, E-value=1e-70, Identity=41%"; Hit description =Putative Na/H antiporter
MVAITGLASIVVHYIYDPSRRYKAYIRKTIKDGQHEPDIKILVCVHNEENVYPMINLLQASNPTNVTPISIFVLHLIELSGRAISTLTKNKSTNKSSQHIKNAFDQFQMHNRGCVMLQYFNAITPYLSMHDDICYMAMDSKSNIVIMPFHKQWSINGNVEYSNASIRILNQNVLRKAPCSVGIFIDRSQMNGKLLVIYEKSFCEIAMVFLGGGDDQEALAYSLRIAQHPNVRLTVFWITFKIQGNKRKTKNPYIDLMEHIRYSSYHEGKVTFKEEIVEDGEGTTQVIRSIEGQYKLVVVGRHYIKDSPCTLGLTEWCELPELGPLGNLLATSDFTFSVLVVQQQPPFNHEYRYIR

SEQ ID NO: 185174 - protein, 341 aa, Glycine max
  Coding DNA Sequence Number=SeqID_68396
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=90%, HitCoverage=33%, E-value=3e-54, Identity=40%"; Hit description =Protein kinase family protein, putative, expressed
  Pfam annotation: Domain name=Pkinase; Domain location=42-329; Score =58.2; E_value=2.7e-14; Accession=PF00069.15; Description=Protein kinase domain
  Pfam annotation: Domain name=Pkinase_Tyr; Domain location=54-324; Score=70.4; E_value=5.7e-18; Accession=PF07714.7; Description =Protein tyrosine kinase
  Pfam module annotation: Pfam domain module=Pkinase::Pkinase_Tyr; Domain location=42-329::54-324
MVPFPCLPCFTTKSNTTNHFTPIEQLCHRFSLAQLQAATNGFNPSLFLGGEGPCQVYKAHLKAHGDVVIKRFKTRSPAGEIEFRAEVKILCQLHHPNIVPLIGFCEHKNDKFVVFNYVPNGSLYDCLHGTNNNNVLVPLSWKQRLHICIGVARGLHYIHFGTKIPIMHRAVTSSNILLDHNLVPKVADFGLCKKQPEGKGESRPKPPRVELRENLELSLEYLEPEYRITGRLSHKSDVYSFGVVMLEILCRKEACFSTPGRDCCEYLVKWAFDDERKGVPEKIVDPSLTGKIAPACWEMFIEIVQRCLASVEERPRMGEVEVVLENALLLQERADAVKELV

SEQ ID NO: 185175 - protein, 156 aa, Glycine max
  Coding DNA Sequence Number=SeqID_68397
  Homolog annotation: Hit_ID=Q1RW49; Match level="QueryCoverage=49%, HitCoverage=15%, E-value=1e-12, Identity=44%"; Hit description=IMP dehydrogenase/GMP reductase
MGSCYWHPYICGLFLVLHNVIADSCVAVNEWIQYLTAHTAMDDIFPCVDNATAQETLSRSKEVTSELVNLIKQVISNVSNLNFASNFTTLYYNQSSAAFSSVRGKEKRLESQFHGYRTRGISPSTYSILQIPTNGNVCKWVSKVNESKILVLLGQV

SEQ ID NO: 185176 - protein, 348 aa, Glycine max
  Coding DNA Sequence Number=SeqID_68398
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=92%, HitCoverage=39%, E-value=3e-44, Identity=29%"; Hit description =Putative Na/H antiporter
  Pfam annotation: Domain name=Na_H_Exchanger; Domain location=49-348; Score=-14.6; E_value=0.0012; Accession=PF00999.11; Description =Sodiumhydrogen exchanger family
MDIERKDQLSSYGMIGNEKFVCQYVLKHTSRGVWYGDNPLHHDTSVLFIEIIVMYIVGRITYLLLRPCHQTFLISQIVAGIILGPLFLGQHNSSYEMIFPTASKMTLTTFAEFGMIIHFFQIGVQINPMLILKIEKQAIAIGLIGNISSIALGGIIFNIVKGMYPEGMENTGIHVLVISSSVSTFPVISGFLAEMNILNSEIGRMAISISMISDLCMWVMYFVVINSAKAVEQQTYKPITEIAVTICYFSILFFFLRPLVIWISNRNPQGKPMTESHFLSIICILLFVGFSASMLGQPPFLVAFCFGLILPDGPPLGSVLAERLDTVGSTFMVPSYCTITGLRLMFLH

SEQ ID NO: 185177 - protein, 536 aa, Glycine max
  Coding DNA Sequence Number=SeqID_68399
  Gene Ontology: Mol. function=protein serine/threonine kinase activity; Cellular component=integral to membrane; Biological process=protein amino acid phosphorylation
  Homolog annotation: Hit_ID=Q9LYN8; Match level="QueryCoverage=98%, HitCoverage=62%, E-value=1e-159, Identity=39%"; Hit description =Leucine-rich repeat receptor protein kinase EXS precursor
  Pfam annotation: Domain name=LRR_1; Domain location=108-130; Score =9.2; E_value=5.5; Accession=PF00560.23; Description=Leucine Rich Repeat
  Pfam annotation: Domain name=LRR_1; Domain location=13-35; Score =15.0; E_value=0.27; Accession=PF00560.23; Description=Leucine Rich Repeat
  Pfam annotation: Domain name=LRR_1; Domain location=132-154; Score =10.2; E_value=3.6; Accession=PF00560.23; Description=Leucine Rich Repeat
  Pfam annotation: Domain name=LRR_1; Domain location=155-177; Score =8.4; E_value=7.5; Accession=PF00560.23; Description=Leucine Rich Repeat
  Pfam annotation: Domain name=LRR_1; Domain location=179-201; Score =3.7; E_value=59; Accession=PF00560.23; Description=Leucine Rich Repeat
  Pfam annotation: Domain name=LRR_1; Domain location=203-225; Score =16.1; E_value=0.13; Accession=PF00560.23; Description=Leucine Rich Repeat
  Pfam annotation: Domain name=LRR_1; Domain location=227-249; Score =16.3; E_value=0.11; Accession=PF00560.23; Description=Leucine Rich Repeat
  Pfam annotation: Domain name=LRR_1; Domain location=251-273; Score =13.2; E_value=0.96; Accession=PF00560.23; Description=Leucine Rich Repeat
  Pfam annotation: Domain name=LRR_1; Domain location=275-298; Score =11.8; E_value=1.8; Accession=PF00560.23; Description=Leucine Rich Repeat
  Pfam annotation: Domain name=LRR_1; Domain location=311-333; Score =12.2; E_value=1.5; Accession=PF00560.23; Description=Leucine Rich Repeat
  Pfam annotation: Domain name=LRR_1; Domain location=335-357; Score =6.9; E_value=14; Accession=PF00560.23; Description=Leucine Rich Repeat
  Pfam annotation: Domain name=LRR_1; Domain location=359-381; Score =19.0; E_value=0.017; Accession=PF00560.23; Description=Leucine Rich Repeat
  Pfam annotation: Domain name=LRR_1; Domain location=383-405; Score =15.3; E_value=0.22; Accession=PF00560.23; Description=Leucine Rich Repeat
  Pfam annotation: Domain name=LRR_1; Domain location=407-429; Score =18.3; E_value=0.028; Accession=PF00560.23; Description=Leucine Rich Repeat
  Pfam annotation: Domain name=LRR_1; Domain location=431-453; Score =16.7; E_value=0.083; Accession=PF00560.23; Description=Leucine Rich Repeat
  Pfam annotation: Domain name=LRR_1; Domain location=455-477; Score =6.1; E_value=20; Accession=PF00560.23; Description=Leucine Rich Repeat
  Pfam annotation: Domain name=LRR_1; Domain location=481-503; Score =13.8; E_value=0.63; Accession=PF00560.23; Description=Leucine Rich Repeat
  Pfam annotation: Domain name=LRR_1; Domain location=505-527; Score =17.2; E_value=0.061; Accession=PF00560.23; Description=Leucine Rich Repeat
  Pfam annotation: Domain name=LRR_1; Domain location=60-82; Score =11.9; E_value=1.7; Accession=PF00560.23; Description=Leucine Rich Repeat
  Pfam annotation: Domain name=LRR_1; Domain location=84-106; Score =14.6; E_value=0.37; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =108-130::13-35::...
  Pfam module annotation: Domain location=132-154::155-177::179 -201::203-225::227-249::251-273::275-298::311-333::335-357::359 -381::383-405::407-429::431-453::455-477::481-503::505-527::60-82::84- 106
MVRFRLSLGNCKNLRSVMLSFNSLSGSLPEELSELPMLAFSAEKNQLHGHLPSWLGKWSNVDSLLLSANRFSGMIPPELGNCSALEHLSLSSNLLTGPIPEELCNAASLLEVDLDDNFLSGAIDNVFVKCKNLTQLVLLNNRIVGSIPEYLSELPLMVLDLDSNNFSGKMPSGLWNSSTLMEFSAANNRLEGSLPVEIGSAVMLERLVLSNNRLTGTIPKEIGSLKSLSVLNLNGNMLEGSIPTELGDCTSLTTMDLGNNKLNGSIPEKLVELSQLQCLVLSHNKLSGSIPAKKSSYFRQLSIPDLSFVQHLGVFDLSHNRLSGPIPDELGSCVVVVDLLVSNNMLSGSIPRSLSRLTNLTTLDLSGNLLSGSIPQELGGVLKLQGLYLGQNQLSGTIPESFGKLSSLVKLNLTGNKLSGPIPVSFQNMKGLTHLDLSSNELSGELPSSLSGVQSLVGIYVQNNRISGQVGDLFSNSMTWRIETVNLSNNCFNGNLPQSLGNLSYLTNLDLHGNMLTGEIPLDLGDLMQLEYFDVS

SEQ ID NO: 185178 - protein, 183 aa, Glycine max
  Coding DNA Sequence Number=SeqID_68400
  Gene Ontology: Mol. function=nucleic acid binding; Cellular component= nucleus; Biological process=DNA integration
MSAMDMIKSLSSKPEKFTGENFFCWQQQMKFWLTELDLYSVISKREINTSTSSTDIVQTDATIKHDVSDKDILCHGRILSALADNIYKIFCHTKTSVELWEALELKYGSTEKGLSRYSCEKMIEFQMIDGKSISDQIHEFENIVYDMKLKGIVLPDIMLVAFMISKLPPSWTDFAQSLKHKHE

SEQ ID NO: 185179 - protein, 138 aa, Glycine max
  Coding DNA Sequence Number=SeqID_68401
MNRWMTMKNLMLEDTGTQRSDRITTFNTPPSAYNPPPLNSCYRPSLPTQMCDMGHEDEKNDDDNNNTNNGDDDNDDDNGGDHVSQQQHTIICEHPRTRGGKGCRTRRQQTHANLVQQDERLRHMSRITSCGTSSLLIF

SEQ ID NO: 185180 - protein, 894 aa, Glycine max
  Coding DNA Sequence Number=SeqID_68402
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=97%, HitCoverage=96%, E-value=0.0, Identity=47%"; Hit description =Receptor-protein kinase-like protein
  Pfam annotation: Domain name=Pkinase; Domain location=533-805; Score =118.1; E_value=2.5e-32; Accession=PF00069.15; Description=Protein kinase domain
  Pfam annotation: Domain name=Pkinase_Tyr; Domain location=538-805; Score=137.6; E_value=3.3e-38; Accession=PF07714.7; Description =Protein tyrosine kinase
  Pfam module annotation: Pfam domain module=Pkinase::Pkinase_Tyr; Domain location=533-805::538-805
MTFLSITSLTLFFLLLFLSIELQAYTPEDNFTISCGTTGIVFDGQRTWTGDADTKYLSGGQGSTVLTQAATQDPSVNQVPYTTARLSPSQFNYSFPVSAGPKFVRLFFYPADYPSFPRTDASFSVQSNGFTFLKGFNASLNADAEATKTIFREYVVNVNDGETLILSFTPSQPNSYAFINGIEVLSMPSDLYYTSATDSTGFKFLGSTTLYSVETRFALQAEYRIKMGGQEISPLNDTGLFRKWAGDEEDYLIKQNPQNNDLSSNTDGKMNITVNPDYVAPKELYRTARNMGTNATLNKISNLTWEFPVDSGFTYVLRLHFCELDPNINKDGDRVFFIYIASQLAENHADVMQWSHNQKGLAVQRNYAVLIPKDNTQKKVNLSLRMDPYATNDKTTYSDAFLNGLEIFKISEAGSNNLAGPNPDPVQTPHNNIPAPKGNRSSKSGTSIIGIVAGVVSGVVLISLIILFLIVFFRRKTITTPKDYNKSKSSATSKWGPLSFTTTKSTTTTKSSLPSDLCRHFSLPEIKSATNNFDDVFIVGVGGFGHVYKGYIDNGSTPVAIKRLKPGSQQGAHEFMNEIEMLSQLRHLHLVSLIGYCNENNEMILVYDFMARGTLRDHLYNTDNPPLTWKQRLQICIGAARGLHYLHTGAKHTIIHRDVKTTNILLDDKWVAKVSDFGLSRIGPTGNAKAHVSTVVKGSIGYLDPEYYKRQRLTEKSDVYSFGVVLFELLCARPPLIRTAEKKQVSLADWARHCCQNGTIGQIVDPTLKGRMAPECLRKFCEVAVSCLLDDGTLRPSMNDVVWMLEFALQLQESAEQRENTNIVDNEINERREEEASDDLFSTGTSVGQVSDFNKSSGVVSVSTDSEELSSSYKESDKLMSGTVFSEIVDPKPR

SEQ ID NO: 185181 - protein, 819 aa, Glycine max
  Coding DNA Sequence Number=SeqID_68403
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=92%, E-value=0.0, Identity=49%"; Hit description =Receptor-protein kinase-like protein
  Pfam annotation: Domain name=Pkinase; Domain location=517-789; Score =108.4; E_value=2.1e-29; Accession=PF00069.15; Description=Protein kinase domain
  Pfam annotation: Domain name=Pkinase_Tyr; Domain location=517-789; Score=141.7; E_value=2e-39; Accession=PF07714.7; Description=Protein tyrosine kinase
  Pfam module annotation: Pfam domain module=Pkinase::Pkinase_Tyr; Domain location=517-789::517-789
MISTVRFYSVTSFVLAFLFFSIDLQAYTPEDNFTISCGTTGIVFDGQRTWTGDADTKYLSGGQGSTVLTQAATQDPSVNQAPYTTARLSPSQFNYSFPVSAGPKFVRLFFYPADYPSFPRTHASFSVQSNGFTFLKGFNASLNADAESTKTIFREYVVNVNDGDILILSFTPSQTNSYAFINGIEVLSMPSDLYYTSATDSTGFKLVGNTTLYSVETRFALQAEYRIKMGGQEISPLNDTGLFRKWAGDEEDYLIKQNPQNNDLPADTDGEMNITVNPDYVAPKELYRTARNMGPNATLNKISYLTWEFPVDSGFTYVLRLHFCELDPNITKDGDRVFLIYIASQLAEDHADVMQWSRNQKGQAVQRNYAVSIPKDNTQKKVNLSLQMHPYATWDITKYSDAFLNGLEIFKISEAESNNLAGPNPDQVQIPHNNKPVPTGKISRGSGATTIDVVVGVVSGVVLILLVVFFVFLSPTSRCGPLLFSMTKSTKTHNSSLPLDLCRRFSLLEILAATQNFDDVLIVGVGGFGHVYKGYIDDGSTPVAIKRLKPGSQQGAHEFLNEIEMLSQLRHRHLVSLIGYCNDNKEMILVYDFMTRGNLRDHLYNTDNPTLPWKQRLQICIGAARGLHYLHTGAKHMIIHRDVKTTNILLDDKWVAKVSDFGLSRIGPTGTSKSHVSTNVKGSFGYLDPEYYKRNRLTEKSDVYSFGVVLFEILCARPPLIHNAETEQVSLANWARCCYQNGTMAQIVDPSLKGTIAPECFEKFCEIGMSCLLEDGMHRPSINDIVWLLEFALQLQEDADQRENGDIVTDESNEIKRGN

SEQ ID NO: 185182 - protein, 683 aa, Glycine max
  Coding DNA Sequence Number=SeqID_68404
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=98%, HitCoverage=59%, E-value=3e-68, Identity=36%"; Hit description =Protein kinase family protein, putative, expressed
  Pfam annotation: Domain name=Pkinase_Tyr; Domain location=405-683; Score=-142.0; E_value=0.00092; Accession=PF07714.7; Description =Protein tyrosine kinase
  Subcellular localization annotation: CTP_CleavageSite=78; ConfidenceScore=5.59e-01
MNRWMTMKNLMLQDTGTPCSGCHTVSANATTQSPSTNQVPYTAARLSRSRFSYSFPVSPGPKFLRLFFYPAEYASFPRSNASFTVQSNQFTLLHVFNASLKAENTKTIFREYVVNVDYGSERLNLTFTPSQPNSYAFINGIEFPIRTNTALETKYRIKVGGQGISPRNDTGNTNGKMNITVNPDYVAPKELYRTARVMGTNTSMNKSLKLTWEFPVDSGFHYMIRFHFCQLDPNITSIGDRVFSLYIGIEFLDVMRWSQKQKGVAVYKDYAILIPKSDTQKQVNLSLQMMNPYESAKDKENNDPFLNGLEIFKISEFNNLAGPNLQNNNMLVEEGKNSSRTLKIVVAGVVSCVVVFFIFLWGSCKFSPLLLSQDDDMLNCRQRWPFNLLCQRFSLMDIKAATNNFNNESLVGVGGFGHVYMGYIDGISIPVAIKRLKPGSKQGSEEFLTEIKMLSQIRHRHLDNTQKKVNLSLQMHPYATNDKTTYSDAILNGLEIFKISQDESNNLAGPNPDPVQTPHNNIPAPKGNRSSKSGTSIIGIVAGVVSGVVLISLIILFLIVYFRRKTITTPKDYNKSKSSATSKWGPLSFTTTKSTTTTKSSLPSDLCRHFSLPEIKSATNNFDDVLIIGVGGFGHVYKGYIDGGFTPVAIKRLKPDSQQGANEFMNEIEMLSQLRHLHLVSLI

SEQ ID NO: 185183 - protein, 151 aa, Glycine max
  Coding DNA Sequence Number=SeqID_68405
MALKCHDDPTVNESEIVIFLKKIWWAASKRKGFERRRRKNENEGKKRHRQFSGSAAADGKVVHWNVRLEVCKEAEKEEECCYGGDTVEPHALQCLLVDDARKQLREEGSEYLLGKLEGNCGVKRKNSYLTRLDQSNILIHLSMHLIADIKS

SEQ ID NO: 185184 - protein, 299 aa, Glycine max
  Coding DNA Sequence Number=SeqID_68406
  Gene Ontology: Mol. function=protein serine/threonine kinase activity; Cellular component=integral to membrane; Biological process=protein amino acid phosphorylation
  Homolog annotation: Hit_ID=Q9LYN8; Match level="QueryCoverage=98%, HitCoverage=24%, E-value=1e-132, Identity=78%"; Hit description =Leucine-rich repeat receptor protein kinase EXS precursor
  Pfam annotation: Domain name=Pkinase; Domain location=21-293; Score =137.8; E_value=2.9e-38; Accession=PF00069.15; Description=Protein kinase domain
  Pfam annotation: Domain name=Pkinase_Tyr; Domain location=21-293; Score=125.8; E_value=1.2e-34; Accession=PF07714.7; Description =Protein tyrosine kinase
  Pfam module annotation: Pfam domain module=Pkinase::Pkinase_Tyr; Domain location=21-293::21-293
MFEQPLLKLTLVDILEATDNFSKTNIIGDGGFGTVYKATLPNGKTVAVKKLSEAKTQGHREFMAEMETLGKVKHQNLVALLGYCSIGEEKLLVYEYMVNGSLDLWLRNRTGALEILDWNKRYKIATGAARGLAFLHHGFTPHIIHRDVKASNILLSGDFEPKVADFGLARLISACETHITTDIAGTFGYIPPEYGQSGRSTTRGDVYSFGVILLELVTGKEPTGPDFKEIEGGNLVGWVCQKIKKGQAADVLDPTVLDADSKQMMLQMLQIAGVCISDNPANRPTMLQVHKFLKGMKGE

SEQ ID NO: 185185 - protein, 465 aa, Glycine max
  Coding DNA Sequence Number=SeqID_68407
NSVTTMLELVLLYKNPLLHTSLTLILAFTFAFFKIPLFFLHGLQTYIHPDSQPQSNNGLRAAIRRPGSIDSYQPLSSKTAAELKKRNKSNNKSDFDENNAQIFRITLDHAHLQSRLFIDQYCVAFTLSFAALSTLFLHTFLDSPQNRGFFSNGVFVPVLLSILSLYSWGSLLAKTTFERSASRRFEKQLSVVLGGLGFFLGLLFVPEGLALVLEFRFGVQFDGFWRVFVAALMGCLSGFLFIPASRSARCFWLGTDQIRCNLSMITCGRFTCAILYVNQMLVIFVALLWITPLAEIFVNKGNGVAKSGFGNAEKLVGNVGFLPSDFGSFRKWCLLGSGLLQIVALRPNLQMYLNEALLSWYQRLHASKVPDLDYSRAKMFLHNHYLCLVVLQFLGPPVLVLLFLGLSQIDDGVSFGNFAMLNDLLPGFAFFKEVAFFLAWWATFLWALFSSVILMLHRHCVLYVS

SEQ ID NO: 185186 - protein, 161 aa, Glycine max
  Coding DNA Sequence Number=SeqID_68408
  Homolog annotation: Hit_ID=Q9SIT5; Match level="QueryCoverage=48%, HitCoverage=9%, E-value=3e-07, Identity=39%"; Hit description =Putative Na/H antiporter
MKRRARGFIGKRDVPGGPPLVDAPDRLPLVIAPGAPPLLIAPGRPPLVVAPGRPPLPPLSHRPVKSRHVSRSGGTRPSGTQFGDFAEDKDNHFGKSKRNKNKVNETGKDEHEENLEQEDREIICKWVISKPNSLGVYLINCAVAYERTNVSALVIPACMTL

SEQ ID NO: 185187 - protein, 99 aa, Glycine max
  Coding DNA Sequence Number=SeqID_68409
  Subcellular localization annotation: CTP_CleavageSite=80; ConfidenceScore=5.50e-01
LPSLVTDVWGANTFPARKYNSRAFHLKVRRSRLFRFFRRFPQINVGGDSARIPFVEHASRESRVALPPKGRLRQCARFFSARQGQSSSIACGNVMVIPF

SEQ ID NO: 185188 - protein, 111 aa, Glycine max
  Coding DNA Sequence Number=SeqID_68410
MEASFVRTMLHHYVVVSPQPLRLDRYLPDTSESTLDSRTKKHAPADSVGRSRGRRRKRRSSKNQVQNSSAVEEQGVTGDLRMSPQGVSDLENGRESVACGEGGDDKEPIEN

SEQ ID NO: 185189 - protein, 154 aa, Glycine max
  Coding DNA Sequence Number=SeqID_68411
MSFPKPQANVVTIGVTSNSPSDRNQMYCEHREWEYVTSVRRRLGHVHLNSIRIMMFLNLIPKSSIDLKQKYETFIQAKQPRKGFTTCIERETVATYPSAGGRRETRGMRVPRKECARSRHQRLFEENVGKTGKDAIYELLSERFGSCIYARGRC

SEQ ID NO: 185190 - protein, 72 aa, Glycine max
  Coding DNA Sequence Number=SeqID_68412
MFVNARKQISTSLIKFKGCKLVARCDVMPKVKDRREWVETLRAKWGREREGWCRERRRGVKIAKVGVNRNPP

SEQ ID NO: 185191 - protein, 156 aa, Glycine max
  Coding DNA Sequence Number=SeqID_68413
  Gene Ontology: Mol. function=protein phosphatase inhibitor activity; Biological process=regulation of signal transduction
  Homolog annotation: Hit_ID=Q9LTK0; Match level="QueryCoverage=94%, HitCoverage=82%, E-value=3e-24, Identity=43%"; Hit description =Arabidopsis thaliana genomic DNA, chromosome 5, BAC clone:F17P19
  Pfam annotation: Domain name=IPP-2; Domain location=2-138; Score= -13.8; E_value=6.9e-05; Accession=PF04979.4; Description=Protein phosphatase inhibitor 2 (IPP-2)
MKGRVRWNEDNIGEIEANKPVRQKITEPKTPYHPMIDDDSSPSPVQGDFDEYNGDKDHSANAEQTGFKNGACCNRKGTRQSDGWTSSEDEAEETEEDEEDRSLSFKEHRKAHYDEFLKVKELQQKASLEDGSDEDDNAELTIEEKKNDSSSPISAT

SEQ ID NO: 185192 - protein, 69 aa, Glycine max
  Coding DNA Sequence Number=SeqID_68414
MANKGGSLWSPVVSGGGGGDVRGGFRGRGGGRRWLFYTAGRICRLQHSPSSHRFLYKTDVNLYITIDFL

SEQ ID NO: 185193 - protein, 174 aa, Glycine max
  Coding DNA Sequence Number=SeqID_68415
MVASNPASTSSNVNFTNKPLISCEKLIETTNYNTWATIGQLWFQDQGHADHLTTQVPYSILYPKQALYTVPLGVFGYTCYVHDLTLEVHPGIPPIVPTSTVAPTTPPLMVYHRHPQSPTAMSSPDPPASSPTPTSPPPTLFVPGLPIALRKVMADPRWQQAMLEEMVALGARGT

SEQ ID NO: 185194 - protein, 258 aa, Glycine max
  Coding DNA Sequence Number=SeqID_68416
  Gene Ontology: Mol. function=RNA-directed DNA polymerase activity; Cellular component=chromatin; Biological process=RNA-dependent DNA replication
MSGICDEAGGISLARISLVDYVDILTPYCFPRMIYNDGRSTRVTNAPTMFMDYMMNQIFHEYLDKFVVVFIKDILVYSKNKEEHEEHLKIMLTLPLTKLTHKEQPFWWAEKYEHSFQELKKRLTTTPILILVNPTKKQLKTLEVNYPTHDLEGKFGGIISMAQGSRKPLHASMMMVKEIELINKFRDMNLAVKETQKSMFVGMLKISNDFLKMLNENTNFCKETWKGNEKENLFTKDLTESFIFKNEFVYLITRSLES

SEQ ID NO: 185195 - protein, 145 aa, Glycine max
  Coding DNA Sequence Number=SeqID_68417
  Subcellular localization annotation: CTP_CleavageSite=49; ConfidenceScore=5.15e-01
MKQLPQQGQWTNQVQLQQTNSALPRVDIMSNDIRRTQSQTKFNCNKLIQLMLNQSKESYFRLSRLLPNDVSHVSTAPQGSLGYLDPKGELQNELKPIYSSTTSTLSNFTRSCCRAKGPTSNSYFLGDISNLKQAFEEREEETQLS

SEQ ID NO: 185196 - protein, 123 aa, Glycine max
  Coding DNA Sequence Number=SeqID_68418
MGRRQCNIRFMAANIPEGRGTHVRPFVKLNIDGSSSGNSSTTNFWGVICDHMGNWISGFSRKRGCRHWIFFINGIYCFLKINGSGMEKSQYASSHLSDLAEEAKPKGDLVAIEVVKAEAKRME

SEQ ID NO: 185197 - protein, 441 aa, Glycine max
  Coding DNA Sequence Number=SeqID_68419
  Gene Ontology: Mol. function=mismatched DNA binding; Cellular component=integral to membrane; Biological process=mismatch repair
  Homolog annotation: Hit_ID=Q6DQL5; Match level="QueryCoverage=82%, HitCoverage=47%, E-value=4e-87, Identity=50%"; Hit description=DNA mismatch repair protein
  Pfam annotation: Domain name=MutS_V; Domain location=54-287; Score =214.0; E_value=3.4e-61; Accession=PF00488.12; Description=MutS domain V
SLAKEELTVACRAAWNNFLTDFSKHYAEFQAAVQALAALDCLHSLAILSRNKGYVCPVFVDDHEPVQIQISSGRHPCTEPEYSTLNFWGCYTFDFDSVDSSSSLLIGNRRLIIVGSFVPASSAKLHVLDRIYTRMGASDSIQLGRSTFLEELSETSHILNSCTEHSLVIIDELGRGTSTHDGMAIAHATLHYLLKQKRSMVLFVTHYPKIASLATEFPGSVAAYHVSHLISHDASKNSNLDHDVTYLYKLVPGVSERSFGFKVAQLAQLPSHCISRAIVMASKLEALVNSRIHGRSTKELLLDTLVIGQEKEQLMAQSLDRPHKEFDMAYKDFYLNLKAATEDDDWAKSFHLLEHARSIAKKLIGRLPWSFCAAYGRPQAQGDPRSVSLGFVKYFLEFNWSLIGLIELLVGKMSISPKINWLKGPTVAHAKEASTQSFERC

SEQ ID NO: 185198 - protein, 55 aa, Glycine max
  Coding DNA Sequence Number=SeqID_68420
MVSSQVVNTYPLSSYTFGTKEPKMEKDTSVADRLARMKVKEGNSDPKGKELSLES

SEQ ID NO: 185199 - protein, 371 aa, Glycine max
  Coding DNA Sequence Number=SeqID_68421
  Gene Ontology: Mol. function=mismatched DNA binding; Cellular component=integral to membrane; Biological process=mismatch repair
  Homolog annotation: Hit_ID=Q6DQL5; Match level="QueryCoverage=99%, HitCoverage=43%, E-value=1e-105, Identity=57%"; Hit description=DNA mismatch repair protein
  Pfam annotation: Domain name=MutS_III; Domain location=105-358; Score= -15.5; E_value=7.3e-07; Accession=PF05192.9; Description=MutS domain III
MLLLDFAGPASNVRVERFSRDCFIDGGALAEVMTLYENMHIDSPSDSIQSNDLTENRSQKLIIKEVMNMPDLAVQALALTIRHLKEFGFERILCSGASIRPFSSNTEMTLSANALQQLEVLKNNSDGSEIGSLLQIMNRTLTIFGSRLLRHWVSHPLCDQTLISARLHAVSEIAQSMGSCNSVKNLVRVEEDPDVAIVQPELAYTLSLVLTTLGRAPDIQRGITRIFHCTATPSEFVAVIQAILSAGKQLQQLNIGEGNNNTLRPNLLKKLILTASSDSVIGNAAKMLSSLNIDSADLGDLTKLIIASEGQFPEVIRAREAFKLAVEQLDSMIDFYRKQLGMKNLEFISISGTTHLIELSTDVKVPSNWVK

SEQ ID NO: 185200 - protein, 231 aa, Glycine max
  Coding DNA Sequence Number=SeqID_68422
  Gene Ontology: Mol. function=DNA-directed RNA polymerase activity; Biological process=transcription
  Homolog annotation: Hit_ID=Q5QM91; Match level="QueryCoverage=58%, HitCoverage=25%, E-value=9e-27, Identity=48%"; Hit description=RNA polymerase III subunit-like protein
  Pfam annotation: Domain name=HTH_9; Domain location=8-69; Score=82.6; E_value=1.3e-21; Accession=PF08221.2; Description=N-terminal HTH domain of molybdenum-binding protein
MVTEHGIKFGVHLITKHFGKIVAKVCEKLFSHGPLTLDQLVRYTDFTKDQVRNSLLVLVQHNCAQAFVSAPQDDDDDADRLRVRTQYLVLFDNIIHRLRFPKFLDIVSRKLDEECVKLLVGLLRDGRLTLKQMVDRESQGKGKCFVMHKTTTRKPGAKSAKIAASTLVEKRKASKFLKELWKDNYLHKKTVPVTGGRPSNICMWKVNKPLLWKYVLDEMYHAALNLSLRMT

SEQ ID NO: 185201 - protein, 165 aa, Glycine max
  Coding DNA Sequence Number=SeqID_68423
  Gene Ontology: Mol. function=hydrolase activity; Cellular component =paraspeckles; Biological process=mRNA processing
  Homolog annotation: Hit_ID=UPI0000D9F167; Match level="QueryCoverage =84%, HitCoverage=60%, E-value=1e-46, Identity=64%"; Hit description =PREDICTED: similar to nudix (nucleoside diphosphate linked moiety X)- type motif 21
MYEGVTIRLLTFDLVVMTCEVQEHNHPHILLLQIGNTFCKLPGGRLKPGENENEGLKRKLTSKLGANSPALVPDWQIGECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 185202 - protein, 49 aa, Glycine max
  Coding DNA Sequence Number=SeqID_68424
  Homolog annotation: Hit_ID=Q0KIN0; Match level="QueryCoverage=82%, HitCoverage=2%, E-value=4e-09, Identity=60%"; Hit description =Integrase core domain containing protein
MATIQHWPLDQLDIKNTFLHGELQEEAYMDQTPSFTASNSTYRSSVTQS

SEQ ID NO: 185203 - protein, 103 aa, Glycine max
  Coding DNA Sequence Number=SeqID_68425
MEKLMRMSCIGYNEMTKMEKCIGGYEMIVYRGKIGVAPIEENIMENQLRWFGHAQRKPQEVPMRRVDCRVFSPMKRRRERLRTLEKVVKRDFVVNNIAETLVF

SEQ ID NO: 185204 - protein, 219 aa, Glycine max
  Coding DNA Sequence Number=SeqID_68426
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-23, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHVLTIRGLHVLTIRGLHVLTFRGLHVLTIRGLHALAFIGLHALTFRGLHTLIFRGLYVLPMRELHVLAFGGLHALAFRGLYVLAIRGLHVLAFRGLHILTFRGLHTLIFRGLYVLPFSGLRALAFRGLHRITSPHHQRTLRPHLQRSSRPRLKRAAHPRLQRTTRPHLQWTTRPHLQRAPRHRLQRTTRPPLQRTTRPRLQRATRSRLQ

SEQ ID NO: 185205 - protein, 221 aa, Glycine max
  Coding DNA Sequence Number=SeqID_68427
MARTKKTGEMTTEAAKEITEKIDVLTAAIGRPEHLGRVRAVGAGVTIKQYFRLAPRMSHSSSFLPPEELKQPDAVPVSVLDAISETSTAFGASGNNPETGDSDRCGLYIEANPARLVAQGRVYERSTIVHKTPLLPGQVKVGNSHLPCLTDTSGQVFITTAKPPQKPDPEVDDPLYLMTLTIPVLFLRPYQVTWDATVFGVFNLDFPLYIKHEDLSEIAHS

SEQ ID NO: 185206 - protein, 283 aa, Glycine max
  Coding DNA Sequence Number=SeqID_68428
  Gene Ontology: Mol. function=DNA binding; Cellular component=nucleus; Biological process=regulation of transcription, DNA-dependent
  Homolog annotation: Hit_ID=Q0PJC8; Match level="QueryCoverage=46%, HitCoverage=95%, E-value=3e-76, Identity=100%"; Hit description=MYB transcription factor MYB94
  Pfam annotation: Domain name=Myb_DNA-binding; Domain location=15-62; Score=48.9; E_value=1.7e-11; Accession=PF00249.21; Description=Myb -like DNA-binding domain
  Pfam annotation: Domain name=Myb_DNA-binding; Domain location=68-113; Score=53.5; E_value=7.2e-13; Accession=PF00249.21; Description=Myb -like DNA-binding domain
  Pfam module annotation: Pfam domain module=Myb_DNA-binding::Myb_DNA -binding; Domain location=15-62::68-113
MGYQPLEKGKPKHKKGLWSPEEDNKLRNHILKHGHGCWSSVPIKAGLQRNGKSCRLRWINYLRPGLKRGKFSKQEEETILTLHHMLGNKWSRISQHLPGRTDNEIKNYWHSYLKKRVAKAKEMESHNQIKYASSSSDTMDSSHSLQNLATQCPLNYNFTKEASQSSLPKLLFAEWLSLDHLNSANSVDSLGLRNGFDQNSSFHEAAIHDMSEVPFGGEYNRCVSNISAPEMFNSQLKYGNQMVENGYIHCMPGVDLSSNFSISNDAIIAATTDGCKMLKVHAT

SEQ ID NO: 185207 - protein, 128 aa, Glycine max
  Coding DNA Sequence Number=SeqID_68429
  Gene Ontology: Mol. function=DNA binding; Cellular component=oxygen evolving complex; Biological process=DNA integration
  Homolog annotation: Hit_ID=Q0KIN0; Match level="QueryCoverage=99%, HitCoverage=9%, E-value=9e-31, Identity=47%"; Hit description =Integrase core domain containing protein
MFDGRPSHTLMDPNVKLLPSQGEPLEDLERYCCLVAKLNYLTVTRLDIIFAVVVLKKGKVKVVCYSDVDWARSPSDRSSTSRYCVLIRGNLISWRRKKQKTIARSSAKVEYHAMEVATCEITWLRKLL

SEQ ID NO: 185208 - protein, 138 aa, Glycine max
  Coding DNA Sequence Number=SeqID_68430
  Homolog annotation: Hit_ID=Q9LTJ4; Match level="QueryCoverage=53%, HitCoverage=30%, E-value=3e-08, Identity=46%"; Hit description =Arabidopsis thaliana genomic DNA, chromosome 5, BAC clone:F17P19
MFLPYFLAKKVTISLSDGIIANISRQYIDTRTQANLSKLNANRKQDLDIATEDIYKILERKRNSETMRRLPVTPQPESTIWCSPQLEMVSISGVRGKNKGMEWPIAIPSPAHNPGKTEKERYRLKKNSDLSRNFYSLP

SEQ ID NO: 185209 - protein, 60 aa, Glycine max
  Coding DNA Sequence Number=SeqID_68431
MVKRPAFVDAACMFAVLLTVKKPVFVLFLWLMYAVDEINGSNSEPDKREESTSGCMLKLL

SEQ ID NO: 185210 - protein, 137 aa, Glycine max
  Coding DNA Sequence Number=SeqID_68432
  Gene Ontology: Mol. function=protein binding; Cellular component =integral to membrane; Biological process=vesicle-mediated transport
  Homolog annotation: Hit_ID=Q9LTJ4; Match level="QueryCoverage=85%, HitCoverage=56%, E-value=3e-29, Identity=54%"; Hit description =Arabidopsis thaliana genomic DNA, chromosome 5, BAC clone:F17P19
MVKVTIVGRVSDGLPLAQGLRYMNEEYGYLSCYRQQAEFILREFSRGALTAPKMTIHIDNFCFNYLVENGVVFIVLCESTYPRKLAFHYLQDIQKEFEKFDKTLIGKITRPYSFVKFGNSLEPLVCHNDISLSSNWC

SEQ ID NO: 185211 - protein, 53 aa, Glycine max
  Coding DNA Sequence Number=SeqID_68433
  Gene Ontology: Mol. function=DNA binding; Cellular component=nucleus; Biological process=regulation of transcription
  Homolog annotation: Hit_ID=Q84PP2; Match level="QueryCoverage=68%, HitCoverage=10%, E-value=4e-12, Identity=75%"; Hit description =Transcription factor MYB101
MGSEGELGHPKKTKLWLTTSRNMAMEVGVHSPNMQVLVSENFELALESTSISM

SEQ ID NO: 185212 - protein, 311 aa, Glycine max
  Coding DNA Sequence Number=SeqID_68434
  Gene Ontology: Mol. function=kinase activity; Biological process =protein amino acid phosphorylation
  Homolog annotation: Hit_ID=Q1STE7; Match level="QueryCoverage=74%, HitCoverage=73%, E-value=1e-89, Identity=70%"; Hit description =Uncharacterized plant-specific domain 01627
  Pfam annotation: Domain name=DUF579; Domain location=51-298; Score =423.0; E_value=4e-124; Accession=PF04669.4; Description=Protein of unknown function (DUF579)
  Subcellular localization annotation: CTP_CleavageSite=81; ConfidenceScore=5.61e-01
MKNNNNTKLILLHKQTLTPNTAASTLFSSHRLWLFFFFLLFSTLLFTWTLISTTISSTSTSSSAVTSPLPPSVTKALLHYAAAANSSTKPMSPAEISAVSTSLLRLPPRPNLLVFGLTHESLLWAALNHRGGRTVFLDENEYAISKFESSNPGVEAYDIQFTTKVSEYPKLLSQAQSQAQNDCRPVQNLLFSECKLAINDLPNHIYQVAWDVILVDGPKGYFPAAPGRMAPIFTAAVLARSKISGGETHVFVHDFGREVERVFSEEFLCKENLVELVDSLGHFVVKSEAHDGESAVFCKNSSSKVVGDEED

SEQ ID NO: 185213 - protein, 378 aa, Glycine max
  Coding DNA Sequence Number=SeqID_68435
  Gene Ontology: Mol. function=receptor activity
  Homolog annotation: Hit_ID=Q9FHD1; Match level="QueryCoverage=99%, HitCoverage=43%, E-value=4e-82, Identity=47%"; Hit description =Hyaluronan mediated motility receptor-like protein
MVSLVPDDVGKPTVKLEKTAVQDGTCSWENPVFESVKLVRDSKSGKIHEKIYHFIVSTGSSKSGFLGEASIDFADFVAETEPMTISLPLKFANSGIVLHVTIQNVEGYAAERNGEDNEAEGLYSEGSLKHQLSYGSTDHESYNVDENGDAARTRSEYSEQDASNGISAVAASWEDPYSFRQNSIPSRGTVKAIATETQVHKRSNTNWSTGSASDGSLGDWTNSLEESIPRERLQEPSNNSTDSLQSEIASLKRQAEVSEIELQSLRRQVEKESNRGQNLSRQIISLREERDLLKTKYEQLKSQQNFNNESKTTKTLKSEIEDTRLQLEAIKDELVYEKDMKANLQLQLRKTQNSNSELLLAVTDLEAMLEQKNNEILD

SEQ ID NO: 185214 - protein, 366 aa, Glycine max
  Coding DNA Sequence Number=SeqID_68436
  Gene Ontology: Mol. function=receptor activity; Cellular component =chromosome; Biological process=DNA topological change
  Homolog annotation: Hit_ID=Q9FLL5; Match level="QueryCoverage=96%, HitCoverage=35%, E-value=2e-64, Identity=41%"; Hit description =Similarity to myosin heavy chain
EHDDATELDLLRRKIADQDDEIDNYYKQHEELSEQIKELTLEYDLLKKENVDISLRLKQDEAQHIKLQNEHSSSLVTIQQLESQVERLEEKLKVQEDEFSASLLCIKELENEVKSLEKELKLQAEKFEEDHHAMQCAKTEQEQRVIQAEEALRKTRHNNAVASERFQEEYRLLSVEMSQKVEENEKMTIKAVAEADELRHQNKLIEEMLHKCNEELRLITDQNELKMKELLNQMDSKAETIEQMSQELEVKSKQLEDAQRQKDEKNASFSKQIQMLGSQIKMLMADGSLSETKLTKNTTETQKGQRFMTSNDEEKMLVTLLSEVETFKNQHNEIKQSLRKEQVEKENMKKQISQLEGELKKKEAEL

SEQ ID NO: 185215 - protein, 538 aa, Glycine max
  Coding DNA Sequence Number=SeqID_68437
  Homolog annotation: Hit_ID=Q8H0I1; Match level="QueryCoverage=66%, HitCoverage=56%, E-value=4e-22, Identity=27%"; Hit description =Hypothetical protein B57
MDSRVVQSVVHENDEHYPHIVALEQVTHGAEEDHFDHEKKSVLNKVKAKAKKIKDTIKKHGHQVLDRGHEYNNEDQHTLDDHDLDEDDEMAEDPQVHKTPIHESEDVKTATPTSEQVENLGKSGIDSGGTRGTTVMGEEPRHDALLGGVSSTTEIDQNIATDSAKTFSVEEKAGPPKDNLEKSIGLDLEEEPHAPGSRPEAYPPTNYQTKITDPSVIGKDEIEEITPVEESFAKMNMHDEPKPTPEPNIQATVVDSEYPPVGNHDQFVPHLSAATQTQYPSAESHDQFNQETTSTNINRNLVNPTETGQTFNTITTTIEEKPLYEAKTDEVISPKDVIASEAGSGEKDAIKDKVVTNKEQQKIGDASNMSGSTAQHGKNIAHSLTEKLAPVYDKVAVVGSAVKSKVTGTSTGGVGTETKNEVSVKDYLAEKLKPGEEDKALSELISEALHKKKEEPVKNEDGNLDDGNDKMCEEISVKSPGKGVVGKLKGVVGSWFGKAEEKGGEDLSKNTNSGAEVEQVHQVVGEIKSGPIEEQGTG

SEQ ID NO: 185216 - protein, 467 aa, Glycine max
  Coding DNA Sequence Number=SeqID_68438
  Gene Ontology: Mol. function=helicase activity; Cellular component =intracellular; Biological process=metabolic process
  Homolog annotation: Hit_ID=Q7G2B3; Match level="QueryCoverage=84%, HitCoverage=80%, E-value=1e-137, Identity=56%"; Hit description =Pentatricopeptide, putative
  Pfam annotation: Domain name=PPR; Domain location=144-178; Score =13.3; E_value=0.2; Accession=PF01535.11; Description=PPR repeat
  Pfam annotation: Domain name=PPR; Domain location=179-213; Score=7.1; E_value=1.1; Accession=PF01535.11; Description=PPR repeat
  Pfam annotation: Domain name=PPR; Domain location=214-248; Score =16.1; E_value=0.093; Accession=PF01535.11; Description=PPR repeat
  Pfam annotation: Domain name=PPR; Domain location=249-283; Score =24.0; E_value=0.00054; Accession=PF01535.11; Description=PPR repeat
  Pfam annotation: Domain name=PPR; Domain location=284-318; Score =32.5; E_value=1.5e-06; Accession=PF01535.11; Description=PPR repeat
  Pfam annotation: Domain name=PPR; Domain location=319-353; Score =39.6; E_value=1.1e-08; Accession=PF01535.11; Description=PPR repeat
  Pfam annotation: Domain name=PPR; Domain location=354-388; Score =43.1; E_value=9.6e-10; Accession=PF01535.11; Description=PPR repeat
  Pfam annotation: Domain name=PPR; Domain location=389-423; Score =54.5; E_value=3.6e-13; Accession=PF01535.11; Description=PPR repeat
  Pfam annotation: Domain name=PPR; Domain location=424-458; Score =18.1; E_value=0.033; Accession=PF01535.11; Description=PPR repeat
  Pfam module annotation: Pfam domain module=PPR::PPR::PPR::PPR::PPR::PP R::PPR::PPR::PPR; Domain location=144-178::179-213::214-248::249 -283::284-318::319-353::354-388::389-423::424-458
MNSVTLLGSKRVHKCSHSLIILRRLCNHPFDGDGFEFIEEPLKKLGSDYDSTVDERLHVNEDWGFKQKQFSLRKGFLETVKLDAKRVLEVLRQDGPGLDARLVLGELHVRPSGLLVREVLFGILKNINCQNKTSQQEGYQHTVNAYHLVMSIYAECEEFKALWRLVDEMIEKGLPATARTFNILIRTCGEAGLAKNLVERFIKSKTFNFRPFKHSYNAILHGLLVLNQYKLIEWVYQQMLLDGFPSDILTYNIVMYAKYRLGKLDQFHRLLDEMGRNGFSPDFHTFNILLHVLGKGDKPLAALNLLNHMREMGIEPTVLHFTTLIDGLSRAGNLDACKYFFDEMIKNECRPDVVAYTVMITGYVVAGEIEKALEMYQDMISREQVPNVFTYNSIIRGLCMAGKFDEACSMLKEMETKGCSPNSVVYNTLASCLRNAGKTADAHEVIRQMTEKVKHADIHSRFKGHKA

SEQ ID NO: 185217 - protein, 130 aa, Glycine max
  Coding DNA Sequence Number=SeqID_68439
  Gene Ontology: Mol. function=actin binding; Cellular component =intracellular; Biological process=cell division
  Homolog annotation: Hit_ID=Q8H2B6; Match level="QueryCoverage=99%, HitCoverage=94%, E-value=3e-61, Identity=88%"; Hit description =Pollen specific actin-depolymerizing factor 2
  Pfam annotation: Domain name=Cofilin_ADF; Domain location=5-130; Score=207.2; E_value=3.9e-59; Accession=PF00241.10; Description =Cofilintropomyosin-type actin-binding pr
MAVIDECKLKFLELKAKRNYRFIVFKIENYEVVVEKLGSPEETYDDFSASLPANECRYAVFDFDFTTNENCQKSKIFFIAWAPDTSKVREKMVYASSKDKFKRELDGIQVELQATDPSEMSFDIIKARAL

SEQ ID NO: 185218 - protein, 200 aa, Glycine max
  Coding DNA Sequence Number=SeqID_68440
  Gene Ontology: Mol. function=protein binding; Cellular component =integral to membrane; Biological process=xylan catabolic process
  Homolog annotation: Hit_ID=Q1S5Q1; Match level="QueryCoverage=98%, HitCoverage=23%, E-value=2e-41, Identity=46%"; Hit description =Leucine-rich repeat; Leucine-rich repeat, cysteine-containing type
  Pfam annotation: Domain name=LRR_1; Domain location=101-128; Score =6.1; E_value=21; Accession=PF00560.23; Description=Leucine Rich Repeat
  Pfam annotation: Domain name=LRR_1; Domain location=29-51; Score=0.6; E_value=2.2e+02; Accession=PF00560.23; Description=Leucine Rich Repeat
  Pfam annotation: Domain name=LRR_1; Domain location=53-75; Score =12.7; E_value=1.2; Accession=PF00560.23; Description=Leucine Rich Repeat
  Pfam annotation: Domain name=LRR_1; Domain location=77-99; Score=1.6; E_value=1.4e+02; Accession=PF00560.23; Description=Leucine Rich Repeat
  Pfam module annotation: Pfam domain module=LRR_1::LRR_1::LRR_1::LRR _1; Domain location=101-128::29-51::53-75::77-99
MLSDSTYASTYKISIPFEAAGPELHHKSWMYVIDLSSNSLSGTVPLEIFMLTRLQSMNLSLNQLVRTIPKEIGNLKQLESIDHSSNNLWGEIPQSMPGLSFLSALNLSFNNFGGENPSRTQIQGFTNLSYIGNHQLCGPLTKICSKDENSHNTKPIVEDEEDDDTSAFCSLFYMDLGIGFAVGFWGVLGAILFNRKCRLA

SEQ ID NO: 185219 - protein, 335 aa, Glycine max
  Coding DNA Sequence Number=SeqID_68441
  Gene Ontology: Mol. function=protein binding; Cellular component =cellulose and pectin-containing cell wall; Biological process =protein amino acid phosphorylation
  Homolog annotation: Hit_ID=Q2HTP6; Match level="QueryCoverage=93%, HitCoverage=89%, E-value=1e-102, Identity=56%"; Hit description =Leucine-rich repeat, plant specific
  Pfam annotation: Domain name=LRR_1; Domain location=103-125; Score =0.4; E_value=2.3e+02; Accession=PF00560.23; Description=Leucine Rich Repeat
  Pfam annotation: Domain name=LRR_1; Domain location=127-149; Score =9.3; E_value=5.2; Accession=PF00560.23; Description=Leucine Rich Repeat
  Pfam annotation: Domain name=LRR_1; Domain location=151-173; Score =8.5; E_value=7.3; Accession=PF00560.23; Description=Leucine Rich Repeat
  Pfam annotation: Domain name=LRR_1; Domain location=174-196; Score =5.4; E_value=28; Accession=PF00560.23; Description=Leucine Rich Repeat
  Pfam annotation: Domain name=LRR_1; Domain location=197-219; Score =6.2; E_value=20; Accession=PF00560.23; Description=Leucine Rich Repeat
  Pfam annotation: Domain name=LRR_1; Domain location=222-244; Score =3.0; E_value=77; Accession=PF00560.23; Description=Leucine Rich Repeat
  Pfam annotation: Domain name=LRR_1; Domain location=246-268; Score =14.3; E_value=0.44; Accession=PF00560.23; Description=Leucine Rich Repeat
  Pfam annotation: Domain name=LRR_1; Domain location=270-289; Score =3.9; E_value=54; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=103-125::127-149::151- 173::174-196::197-219::222-244::246-268::270-289
DSQILETPSPPPDPTSLVPNILNFIDQRLAQVFPIIQTFKNTITSDPRGVTSTWVGPNICNYTGFYCDNPPDNLTATTIASIDFNGFQLTAPTLDGFIDQLPDLALFHANSNKFSGIVSPKIAGLKFLYELDLSNNLFSGAFPTSVLNIPTLSFLDIRFNSFSGTLPPQIFMQTLDVLFLNDNNFMLTLPNNLGNAPVVYLTLANNKFTGPIPRSIGKASSTLIEVLLLNNLLTGCLPYEIGFLKNLTLFDVGGNLLTGPIPWSFGCLKKVEQLNLARNFLYGQVPEVMLIQRGVLDVRKNCIFGLPDQRSVRECMAFFLIPKSCSHPALFNFVP

SEQ ID NO: 185220 - protein, 420 aa, Glycine max
  Coding DNA Sequence Number=SeqID_68442
  Gene Ontology: Mol. function=structural molecule activity; Cellular component=protein complex; Biological process=microtubule-based movement
  Homolog annotation: Hit_ID=P29512; Match level="QueryCoverage=95%, HitCoverage=95%, E-value=0.0, Identity=83%"; Hit description=Tubulin beta-2/beta-3 chain
  Pfam annotation: Domain name=Tubulin; Domain location=45-244; Score =372.3; E_value=7.5e-109; Accession=PF00091.15; Description =TubulinFtsZ family, GTPase domain
  Pfam annotation: Domain name=Tubulin_C; Domain location=246-355; Score=102.4; E_value=1.3e-27; Accession=PF03953.7; Description =TubulinFtsZ family, C-terminal domain
  Pfam module annotation: Pfam domain module=Tubulin::Tubulin_C; Domain location=45-244::246-355
MREILHIQGGQCGNQIGAKFWEVVCAEHGIDSTGRYQGDNELQLERVNVYYNEASCGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVDLPHSLPAVPNSTGLSLFCDVPWKMSTKEVDEQMINVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADDEGYEYEDEEEPQEDEA

SEQ ID NO: 185221 - protein, 514 aa, Glycine max
  Coding DNA Sequence Number=SeqID_68443
  Gene Ontology: Mol. function=catalytic activity; Cellular component =peroxisome; Biological process=metabolic process
  Homolog annotation: Hit_ID=Q946Z2; Match level="QueryCoverage=98%, HitCoverage=97%, E-value=0.0, Identity=69%"; Hit description =Putative acyl-CoA synthetase
  Pfam annotation: Domain name=AMP-binding; Domain location=34-441; Score=414.7; E_value=1.3e-121; Accession=PF00501.18; Description=AMP- binding enzyme
MQQAPTTLTGLLHRVAGIFPSRRAVSVSGKFDLTHSRLHHLVELAASRLLSAGIKPGDVVALTFPNTVEFIITFLAVIRARATAAPLNAAYTAEEFEFYLSDSDSKLLLTSKEGNEPAQAAASKLNIPHATAWLAEAEELSLSLSSTESAIDSVSEIANDASDVALFLHTSGTTSRPKGVPLTQHNLASSVENIKSVYRLTESDSTVIVLPLFHVHGLLAALLSSLAAGAAVVLPEAGRFSASTFWSDMARYDATWYTAVPTVHQIVLERHLKNAEPVYPKLRFIRSCSASLAPAILERLEEAFGAPVLEAYAMTEASHLMSSNPLPEDGPHRAGSVGKPVGQEMVILNENGEIQKNEVKGEVCIRGPNVTKGYKNNPDANDSAFQFGWFHTGDIGFFDSDGYLHLVGRIKELINRGGEKISPIEVDAVLLSHPDIAQAVAFGVPDDKYGEEINCAIIPKEGSNIDEAEVQRFSKKNLAAFKVPKKVFFTDSLPKTATGKILRRLVAEHFVSQT

SEQ ID NO: 185222 - protein, 61 aa, Glycine max
  Coding DNA Sequence Number=SeqID_68444
MSLNNFLFFVAQGLNARRGMAELKSSGIVAPGPVHGVQFTATPPINPVELTIEPAVAPSPN

SEQ ID NO: 185223 - protein, 162 aa, Glycine max
  Coding DNA Sequence Number=SeqID_68445
  Homolog annotation: Hit_ID=Q43589; Match level="QueryCoverage=82%, HitCoverage=73%, E-value=3e-51, Identity=71%"; Hit description=PAR -1c protein
  Pfam annotation: Domain name=PAR1; Domain location=2-162; Score =256.9; E_value=4.1e-74; Accession=PF06521.2; Description=PAR1 protein
MASNFSLRTLMIFALAFSLALQGTLGGIECESLSHDTCSFAVTSAGKRCVLEKQVKRTGEEAYTCRTSEIEADKLKDHIETEQCIKACGLDRKSLGISSDSLLQSSFTQKLCSPICYQCCPNVVDLYFNLAAGEGTRILIHSPILNIRKNHTIFLISNIRKV

SEQ ID NO: 185224 - protein, 291 aa, Glycine max
  Coding DNA Sequence Number=SeqID_68446
  Gene Ontology: Mol. function=oxidoreductase activity; Biological process=electron transport
  Homolog annotation: Hit_ID=Q1SFG5; Match level="QueryCoverage=88%, HitCoverage=59%, E-value=4e-96, Identity=70%"; Hit description =Peptidase, cysteine peptidase active site; ; Aromatic-ring hydroxylase
MVGEGKPRAVIVGGSIAGILSAHVLTLAGWNVTVLEKTNAPHRGSPTGAGLGLDPLSQRIRVMASIATTLPQHHCTANYRSGATLFNQAIDNEKKVSWTLARDESFNFRAVHWSDLHGLLYNALPSNVFLWGHLFLSFHVAHDKGSVIVKAKVLETGKVIEIVGDLLVAADGCLSSIRQKYLPDFKLRYLGYCAWRGVFELSEAEALETIKVIKKAYPDLGKCLYSDLGSCTHSGFYELLNKKINWIWYVNQPQPEVKKSRNKEYRERVTIFRLLKAKKIQKDRNILELGS

SEQ ID NO: 185225 - protein, 276 aa, Glycine max
  Coding DNA Sequence Number=SeqID_68447
MDTELSYYPDSEVNPNATGPRESLIQEEKGKNRWGQGETMPPRKNIASGEPAAKKHGDMRVEFVAGEGQPSTKTGKSGGNPRLKPVEGDDLTKFCQLMKKIELPSFYGDDPAEWIARAKIYFNVQEMREAVRVSLAQLCMEGVMIHFFHSLLNEYENLSWEDLKREMLESYGGRGEGSVYDQLASLKQSGSMEDYIRSFECLIAQGLKDEIRARMRILHVVNPLSRGRMMNIARAIDVEISGQSKVWQGRGEICGDGRAQPGNRPISSILGKTGPR

SEQ ID NO: 185226 - protein, 853 aa, Glycine max
  Coding DNA Sequence Number=SeqID_68448
  Gene Ontology: Mol. function=RNA-directed DNA polymerase activity; Cellular component=chromatin; Biological process=chromatin assembly or disassembly
  Pfam annotation: Domain name=Chromo; Domain location=769-807; Score =9.3; E_value=0.078; Accession=PF00385.14; Description='chromo' (CHRromatin Organisation MOdifier
  Pfam annotation: Domain name=RVP; Domain location=46-150; Score= -13.3; E_value=0.078; Accession=PF00077.10; Description=Retroviral aspartyl protease
  Pfam annotation: Domain name=RVP_2; Domain location=51-165; Score =8.0; E_value=2.4e-07; Accession=PF08284.2; Description=Retroviral aspartyl protease
  Pfam module annotation: Pfam domain module=Chromo::RVP::RVP_2::RVT_1; Domain location=769-807::46-150::51-165::217-481
MINEEIRVECKENKENIEGDATEDDSDVERACTTLSLCSMKKEKEEQPRTRKLRGKVGGIPMLFLVDSGATHNFISRKLIEALGWKWERTKQMRILMGDGHKSETQGVCRGIKVEFDEREFVIDAFLFELEDMDVILGMSWLTTLGETMVDWKNQVMKIKTDQGERWLKGVPREDSLLVSMFGLLEEKGESEENGLIQEQRCVLDEVLQNFVDVFAEPKGLPLVCAKEHRIILQPRQGPINVRPYRALNKATIPDKFPLLVIAELLDELHGARFFSKLDLCSGYHQVRMREEDIPKMTFRTHEGHYEYLVMPFGLMNAPSTFQALMNKVFRALLRQGVLVANMFANKEKCTFGQEIIEYLGHTISIQGVAVDPIKDYSKIAKPLTELTKKDGFGWNEKAQAAFEEPKRKITTAPMLQLPNFDEDFSLECDASETGIGAILMQNKKPVAYYNKVLSPRNLTKSAYERELMANWLAKLLGYNFEIIYKPGKENRGAYALSRSRDEMELNNMIYFPVWLHWQEINAEVHADEKLRKIIEEVKKGQGEKINAGYVYKQGGDVQQFVQACDTCQRQKYVTSALSGLLQQLPIPERFWEDISIDFITGLPRSRGFEAILVVVDRLTKYFHFVPLKHPYTAKALAEIFVREDLIERDEALRQLKSHLLRAKDRMRAQANKHRKERYFVVGDFVFLKLKQNRQQSVMNRVNPKLSAKYYGPSEVVEKIGEVAYRLKLPPSLKIHPVFHVSLLKKVVGKYKVEEVLPIELGDDRAELMTPEAILATRIGQVVDEATWEDEVTIHSQFPEFGLEDKALFQEEGIDTDPNATRPRESLIQEEKGKNRWGRVYVRKRPRNDDVAH

SEQ ID NO: 185227 - protein, 148 aa, Glycine max
  Coding DNA Sequence Number=SeqID_68449
  Gene Ontology: Mol. function=oxidoreductase activity; Biological process=electron transport
  Homolog annotation: Hit_ID=Q1SFG5; Match level="QueryCoverage=81%, HitCoverage=28%, E-value=2e-49, Identity=77%"; Hit description =Peptidase, cysteine peptidase active site; ; Aromatic-ring hydroxylase
  Subcellular localization annotation: CTP_CleavageSite=37; ConfidenceScore=5.15e-01
MYTLFTFPFIAKPASADCIFAFGTKTFQGTSVTMKVSSDMIQKMHQEAEKVWTPELFKVLKETKKPFLNVIYDGEPLGETFWDNVVLVGDVAHPTTPHCLRSTNMSILDVAVLGKCLEKFGAEKLRLALEEYQFIRLPVTSKQVLHAR

SEQ ID NO: 185228 - protein, 214 aa, Glycine max
  Coding DNA Sequence Number=SeqID_68450
  Gene Ontology: Mol. function=DNA-directed RNA polymerase activity; Biological process=transcription
  Homolog annotation: Hit_ID=Q9SMT8; Match level="QueryCoverage=99%, HitCoverage=35%, E-value=4e-32, Identity=37%"; Hit description=RNA polymerase III subunit-like protein
  Pfam annotation: Domain name=HTH_9; Domain location=8-69; Score=82.6; E_value=1.3e-21; Accession=PF08221.2; Description=N-terminal HTH domain of molybdenum-binding protein
MVTEHGIKFGVHLITKHFGKIVAKVCEKLFSHGPLTLDQLVRYTDFTKDQVRNSLLVLVQHNCAQAFVSAPQDDDDDADRLRVRTQYLVLFDNIIHRLRFPKFLDIVSRKLDEECVKLLVGLLRDGRLTLKQMVDRESQGKGKCFVMHMTFETMKTKSIFGVGQENAVPTKVVRETLCKLWTARFVERCPAPEPFVSTSFKDTTTKKRGAKSAK

SEQ ID NO: 185229 - protein, 85 aa, Glycine max
  Coding DNA Sequence Number=SeqID_68451
MTKPPQIGGTSTWIILEGKWGRHMKGSGEDIILEGPDNVTLEKALKLNFKASNNQAEYKTLIACLKLAKKVGAKKLRCYTDSQLV

SEQ ID NO: 185230 - protein, 148 aa, Glycine max
  Coding DNA Sequence Number=SeqID_68452
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=56%, HitCoverage=38%, E-value=1e-35, Identity=62%"; Hit description =Photosystem II D2 protein (Photosystem Q(A) protein)
MGVAGVLGAALLCAIHGATVENTLFEDVTGLWMSALGVVGLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKP

SEQ ID NO: 185231 - protein, 75 aa, Glycine max
  Coding DNA Sequence Number=SeqID_68453
MTNKAKGKGKEVAGKGSTGKRKGAFDDDKTGGGRKRNKRGPVRMNRSLMLFFLDSLTCKHETGHLWRLSRLSQII

SEQ ID NO: 185232 - protein, 106 aa, Glycine max
  Coding DNA Sequence Number=SeqID_68454
MAYGGDEFVHPDNAVPVSLTRSGYPRIIPSHHRRMILKKDEKADMLIITLAKKVDKSTFSSIISPPDNIDEVVGLVGSIKENFNRLISRYAPWIKRIPLEQTRVTV

SEQ ID NO: 185233 - protein, 100 aa, Glycine max
  Coding DNA Sequence Number=SeqID_68455
PSSLGVWGVSYPNFVRGPLLDDMRPFFGPCEKAVASGGSNLARLGELGGNHLPYFAINRGGSEEEKAEALPKRFRNVFREDFAKVSTVLRRSSLVIRSST

SEQ ID NO: 185234 - protein, 123 aa, Glycine max
  Coding DNA Sequence Number=SeqID_68456
  Pfam annotation: Domain name=zf-CCHC; Domain location=10-27; Score =22.6; E_value=0.00018; Accession=PF00098.13; Description=Zinc knuckle
ASMQEKTSSVKCFKCLGRGHITSQCPTKKTMIMRGQDIYSSQDEVTTSPYSSESKEAKREESSDEIYPQEEGQPLMVKEKCKETLVSIATPLRLEFIPQVKELLDEGLVRKSLNPCALLVPKI

SEQ ID NO: 185235 - protein, 187 aa, Glycine max
  Coding DNA Sequence Number=SeqID_68457
MASRKRKATTSQPREPYDTTRFVSEVASERYSQNVHSRNILPERDVNLFVTVYHEFRRELIRRNWHKALTQHIDGHIDVALVKEFYSNLYDPEDKSPKQVRGMLIKFDATSLNAFLETPPLIQPGEQYPSYSIFCRTRTDPQELASKLCILGRMFVLNAEGAPWKLLRKDLNTLAQTWSVLSYSNLF

SEQ ID NO: 185236 - protein, 116 aa, Glycine max
  Coding DNA Sequence Number=SeqID_68458
  Gene Ontology: Cellular component=mitochondrion
MGIGCTVWYGFVPGDGINMPIEGLNTLFSPIENYDTIFTNPDAHVIPGFNKMTLIEGVNNPAASLSQAFAQDRPFMDMDIEIPDSNKSIIIGVSLGLAVAILFTFGINPCCGEVIV

SEQ ID NO: 185237 - protein, 134 aa, Glycine max
  Coding DNA Sequence Number=SeqID_68459
  Gene Ontology: Mol. function=transcription factor activity; Cellular component=intracellular; Biological process=regulation of transcription, DNA-dependent
  Homolog annotation: Hit_ID=Q0TGC6; Match level="QueryCoverage=84%, HitCoverage=27%, E-value=5e-17, Identity=43%"; Hit description =Putative carbohydrate kinase
MQLTGIKVPDFASAQRAAEVLHRKGARQVIITLGTAGALLSSTEQQLRIPLFPAQPLDTTGAGDAFNGALAARLASGDALPQAALFAAAFASLCVERSGAANSMPSYAEALARIQAHPECEVTPLNAPEITHMA

SEQ ID NO: 185238 - protein, 218 aa, Glycine max
  Coding DNA Sequence Number=SeqID_68460
MAPPVLVQARPERVRDLKCFALLSYQLHNLRLQHHPPHQRPSILVSHKPWWRLYNIGTVRSELKTEVLEGTRAYGGGTEGTGARERAGVEEEGAEESSPLVLALRAPRIVIVGLSRSEVGVGKDTPCLCKSGEGLHASDRRGNMRYTAPLAPEWGASLGMCSVRVEFLDQGHVSVTIHVLGQGLVPVPPNELPTELIILRDEKVNIPLRKNVPGVNVL

SEQ ID NO: 185239 - protein, 94 aa, Glycine max
  Coding DNA Sequence Number=SeqID_68461
MVFSPHPAKKRILSYNCKSAQHKFREAKQKVDRKKWNKCTSATISKLFLEPSDHLMQSYPARALDRKLQVDWARDAREGPRVLLSLRVDFGPMG

SEQ ID NO: 185240 - protein, 192 aa, Glycine max
  Coding DNA Sequence Number=SeqID_68462
MYGLLALYLLLCLSVSLLSLLYSCEILLLFQCNREFVCRMCSDLLGSRFKSCGCWLGFTSVFDSNIFLYEQVGGCSICGGAHESRLCIPLDDTAQEVNYMGNQNRPGFNARGYSGYQQGANYNQNQGQWRSHPGNQFNKDRGGPSNRPQNQGPSLYDRTTKLEEILAQFMQVSMSNHKSTEFAIKNLEIQVG

SEQ ID NO: 185241 - protein, 73 aa, Glycine max
  Coding DNA Sequence Number=SeqID_68463
MARTKKTGQMTSEATKEIAEKIDSLEEQASQGSFVPHGRQDVLTVAIGRPEHPCRVRAAGADVTIKQYFGFAP

SEQ ID NO: 185242 - protein, 72 aa, Glycine max
  Coding DNA Sequence Number=SeqID_68464
MASYGGELLDLSSPLSGVSNHLSSISNSAAIDLQEAKDFIDEEDPRPTSSNGATSPYFHYFHIFFIPVIPLF

SEQ ID NO: 185243 - protein, 70 aa, Glycine max
  Coding DNA Sequence Number=SeqID_68465
MADITMMVKEIFAQPIGKEYVLPSPCNEIHTPILEGYADDVSDGEKDPFVDVRNVRESSGIQEDPYEDSS

SEQ ID NO: 185244 - protein, 105 aa, Glycine max
  Coding DNA Sequence Number=SeqID_68466
METEQHSLDPKKDLAKYVMPTIECGGSMETLSTLCGSLNNDCALEGATNRSFKLEEPRAYALIIMSLYESLNSIRNVFEEEASLAKSGDKKVPKLVSEWVDTVDT

SEQ ID NO: 185245 - protein, 360 aa, Glycine max
  Coding DNA Sequence Number=SeqID_68467
  Gene Ontology: Mol. function=chromatin binding; Cellular component =chromatin; Biological process=chromatin assembly or disassembly
  Homolog annotation: Hit_ID=Q1SAV4; Match level="QueryCoverage=80%, HitCoverage=98%, E-value=1e-64, Identity=38%"; Hit description =Integrase, catalytic region
  Pfam annotation: Domain name=rve; Domain location=52-190; Score=25.0; E_value=4.9e-05; Accession=PF00665.16; Description=Integrase core domain
  Pfam annotation: Domain name=zf-H2C2; Domain location=1-34; Score =7.7; E_value=0.035; Accession=PF09337.1; Description=His(2)-Cys(2) zinc finger
  Pfam module annotation: Pfam domain module=rve::zf-H2C2; Domain location=52-190::1-34
MGVTKTLARVNENFTWIGIKDDVCQFVATCVNFQQTKYDHCKQPGLLFPLPVPSRPWEDLSLEFIGGLPAFRGHTAILVVIDRFSKGLHLGMLQPHYTASTVAHLFMDIVGKIHGMPRNLVSDRDPLSVSRFWQELFKFSGMKLRMSSACHPQSDGLTKYLAGTSNIEAIDDFLVNHEEIFRSLGKKIIKAQQSMKHFTDSNRHEVNFQKGDWVLVKLRSRHQTSVTGATYSKLAKHFYGPFQILQRIGLVAYQLQLPPESHIHLVFHYSLLKPYHQSPDLGMSPDNTSWESWDKLKVEYHLEDKVLLEGQRDVMTEINQQQCTQQAGTSNIRQQSDKVLDTNQRPKRKITKPQHLKDFV

SEQ ID NO: 185246 - protein, 315 aa, Glycine max
  Coding DNA Sequence Number=SeqID_68468
  Gene Ontology: Mol. function=NEDD8 activating enzyme activity; Cellular component=signalosome complex; Biological process=red or far red light signaling pathway
  Homolog annotation: Hit_ID=Q94JU3; Match level="QueryCoverage=69%, HitCoverage=79%, E-value=5e-78, Identity=70%"; Hit description=COP9 signalosome complex subunit 7
  Pfam annotation: Domain name=PCI; Domain location=61-169; Score=36.9; E_value=7.1e-08; Accession=PF01399.17; Description=PCI domain
MDIEQKQSELIDHFVKRASAASDAAALASVLVEATSHPSLFAFSEILALPNLLQLEATENSAYLDMLRLFAHGTWSDYKSNADRLPQLISDQILKLKQLTVLTLAETYKKRGDIPVRVAHQVLPYDQLMQELDVTNVRELEDFLINECMYAGIVRGKLDQLRRCFEVQFAAGRDLRPDQLGNMIQTLSSWLTTSENLLVSIQEKIKWADAMSEIDKKHRKEVEEKVEEVKKSIFKVIICEDLEWYQIEVSALIIYTHNCLLFFMVGIYWSTCLTYFVAEVTHCKQADIDFRGHEEICSESGGVMDYEEDRSRPKR

SEQ ID NO: 185247 - protein, 153 aa, Glycine max
  Coding DNA Sequence Number=SeqID_68469
  Subcellular localization annotation: CTP_CleavageSite=32; ConfidenceScore=5.13e-01
MGQDGKKCGAVDKNGAFAPTYSQFEMRNSDLRSSSESNMTTLASACQSNLGSPNDEVQITIRCLRMLPNSWVMIAKGGVVDKSGAFAPTYPQFVMRNSDLRSSFKSETKIVSGKDRHSHPGSRFMVTWDSSSKLVERLDMIYVRVLVWPAVQG

SEQ ID NO: 185248 - protein, 104 aa, Glycine max
  Coding DNA Sequence Number=SeqID_68470
MLSYNLRQGRWGLQFIGSGLKSINQTFSSTWVQGIIYSCPRKINESLANNHPEQQWAHPELVQARHEARDPRYSTPPVDLLHSRCPWLLGCGSLTSPQRRRLNS

SEQ ID NO: 185249 - protein, 76 aa, Glycine max
  Coding DNA Sequence Number=SeqID_68471
MMVEGGGGEEASDSGKDGGRGGGSSVVIVNGVVHGHLDVNGVVHVFGHTNSNKDSNRIQTRMTLPSLEESSIIERE

SEQ ID NO: 185250 - protein, 199 aa, Glycine max
  Coding DNA Sequence Number=SeqID_68472
MSPYSPSCYAYDLHQTTTQPKPLCNLQIYLFALASIASSDASARVGFHKGVVSLDEGGVWGFGVMGEGGRTGKEEKRGRMKGKKMAASKWPHTIYHGQAWNFSEKFTTIVVTSPRLWENSIVRELVAMKERGDCNREEDRGDEVHHFKDTEHCDVKSSETKVLLRDGGCLQQSYEVVEAVAEECMTKMRYNLESNNMVS

SEQ ID NO: 185251 - protein, 398 aa, Glycine max
  Coding DNA Sequence Number=SeqID_68473
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=18%, E-value=2e-86, Identity=61%"; Hit description=Chromo
  Pfam annotation: Domain name=rve; Domain location=112-257; Score =39.5; E_value=1.1e-08; Accession=PF00665.16; Description=Integrase core domain
MDFITGLPNSSGFTVIVVVIDGLTHYSHFVAMKSDYTSNTCGSNSFKGYFDDAKEFKNQKKDSREVSSFKFSRIKNNQEQHSRLKIHESREDLIKKSMKRWYIYLGLAENKRGYISSGSVLVEGTSTRFKENKGEYIPCGSLLATRSNNTVAEAFMCHIVKLHGVPKSIVLDRDKVFTSNFLLHLFKIQGTTLAMSSAYHPQMYGQSKALNKCLEMYLWCFTFDNPKAWAKLLVWVEFWYNTSFHNSLGMTPFQTLYRKEPPVLLRYNGNFQDPPTVREIYIKKQMLLDMLKGNLIKEQTTTKIQADKKRLDRKFQVGDELLVKLQPYRQHSTALRENKKLPMLYFGPFTRLEKIGEVAYKLQLLDATKIYLVFHVSQFKQFQGVATKPYVSLPLTTF

SEQ ID NO: 185252 - protein, 170 aa, Glycine max
  Coding DNA Sequence Number=SeqID_68474
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=41%, HitCoverage=4%, E-value=8e-14, Identity=53%"; Hit description=Chromo
MLQLTDDSDLYEETKPPDIDITLAEMPHGAHHLSLNAMKGFQRVGTLWFTGYIGNISVQILLMQHDSPDDSLIELHVDIAPGIATLLHTYSVVFQTPMGFPSTRDQSHAIPFHPNAKSVKVRPYWYPHSQKENIEKMVEYLGHKVSGAGVALDAGKVQAVLDWPKPTNVK

SEQ ID NO: 185253 - protein, 91 aa, Glycine max
  Coding DNA Sequence Number=SeqID_68475
  Subcellular localization annotation: CTP_CleavageSite=46; ConfidenceScore=5.24e-01
MWVQAIGLFAQATCAPEFGLPRPFNQRLLVLHVGGGAVKQRPLPVPTSSPQATHLRFSTLLVKLLLQSLNYTGTTLPLCSRILYNKRPTVS

SEQ ID NO: 185254 - protein, 40 aa, Glycine max
  Coding DNA Sequence Number=SeqID_68476
MTVAEYAAKFEELVKQAVNYQGVRQFPLLVNMCRIWDEDS

SEQ ID NO: 185255 - protein, 254 aa, Glycine max
  Coding DNA Sequence Number=SeqID_68477
  Gene Ontology: Mol. function=diaminopimelate epimerase activity; Biological process=lysine biosynthetic process via diaminopimelate
  Homolog annotation: Hit_ID=Q47JN0; Match level="QueryCoverage=99%, HitCoverage=92%, E-value=2e-75, Identity=58%"; Hit description =Diaminopimelate epimerase
  Pfam annotation: Domain name=DAP_epimerase; Domain location=1-119; Score=144.8; E_value=2.3e-40; Accession=PF01678.10; Description =Diaminopimelate epimerase
  Pfam annotation: Domain name=DAP_epimerase; Domain location=146-252; Score=92.4; E_value=1.3e-24; Accession=PF01678.10; Description =Diaminopimelate epimerase
  Pfam annotation: Domain name=PhzC-PhzF; Domain location=5-254; Score=- 113.9; E_value=0.04; Accession=PF02567.7; Description=Phenazine biosynthesis-like protein
  Pfam module annotation: Pfam domain module=DAP_epimerase::DAP _epimerase::PhzC-PhzF; Domain location=1-119::146-252::5-254
MQGAGNDFVVIDATHAPVHLSHTQIQQIANRYFGIGCDQLLMVENTDTPGVDFRYRIFNADGSEVEQCGNGARCFVRFVVDKGLTDKREIRVETASGIITLTLQEDGQVTVNMGAPRFVPAQIPFDVGTQATVYELPLQGETVTISAVSMGNPHAVMLVENVHTAEVATLGPQIESHPRFPQRVNAGFMQVLNAHEINLRVYERGSGETLACGTGACAAAVSGIQLGSLQKPGKKSIRAVASSPSSGKVATIRS

SEQ ID NO: 185256 - protein, 117 aa, Glycine max
  Coding DNA Sequence Number=SeqID_68478
  Homolog annotation: Hit_ID=Q1SM49; Match level="QueryCoverage=73%, HitCoverage=37%, E-value=2e-07, Identity=36%"; Hit description =Peptidase S1 and S6, chymotrypsin/Hap
MKGITGAPYRAHCDALTVTDVCWLPYSDHRGVRGFELISSFQGQLRWGPIVVTVRPERVVSADYIEWFFQISHPFIIPTQAGDEPRHPPAPEHDDYIQLDIPEVPMAFNPPGHALVR

SEQ ID NO: 185257 - protein, 216 aa, Glycine max
  Coding DNA Sequence Number=SeqID_68479
MDRLFTMILGFTSKLQLRCPFEYQIGNQIRFECIKLINDDDVNTMLMCNDQFSCVGPIELLCTVGRTPDGIINLLERTMPRIHDAILYYNGKWNMPPQNKFVGCAFTGKNPKKFQIPSTCTIDELKNLIKQVAPKGIPPLGIHESQTVRRLFFRQPARFEYSDTVIKYEINELITNEELLKVLVQSNYWKKYGPIEILAVFTKYVEDEVSGTSLKN

SEQ ID NO: 185258 - protein, 68 aa, Glycine max
  Coding DNA Sequence Number=SeqID_68480
  Subcellular localization annotation: CTP_CleavageSite=7; ConfidenceScore=5.00e-01
MCPPPSKVNTKGAPKKPMNRNQRSTKRDLSYWEYVDAFHFVQNSNSSMKCSASSSDPPKPTRIIPLLD

SEQ ID NO: 185259 - protein, 35 aa, Glycine max
  Coding DNA Sequence Number=SeqID_68481
MVIQDRVMSTGHSAFKLAKSQLFGTRMGTGVEVWK

SEQ ID NO: 185260 - protein, 148 aa, Glycine max
  Coding DNA Sequence Number=SeqID_68482
  Subcellular localization annotation: CTP_CleavageSite=51; ConfidenceScore=5.03e-01
MKLGGRQRYPSGYPYKHYFAIRQTQSPSGGRRRYRMVILIFRQQGANEPVDAQRLTSSSARFVIQGQGVRWQAEIPYGRLHLSSTKANEFDGIRMMSFTLIVWRHSSPMTHEILLCWAGTIKFDCVWKRCGPAGWDIGWPNDVPLERN

SEQ ID NO: 185261 - protein, 85 aa, Glycine max
  Coding DNA Sequence Number=SeqID_68483
  Gene Ontology: Mol. function=catalytic activity; Biological process =cellular metabolic process
  Homolog annotation: Hit_ID=Q1T6L3; Match level="QueryCoverage=73%, HitCoverage=21%, E-value=3e-27, Identity=92%"; Hit description =Ribosome-binding factor A
MADVEVRAAHNVLEACAQTETIDKVIFTSSATAVVWREDRKTMELDLDERHWSDVNFCRKFKVLLLTPVSNTKKKKNLFTLVKKN

SEQ ID NO: 185262 - protein, 120 aa, Glycine max
  Coding DNA Sequence Number=SeqID_68484
MRLLLHLPLLKVKKQKGKNLLKKSTPIKMDNHYWLTRTDRRNNQHKNTEKGTLYCITFLNFLNSDQGVPTDPKRIKVIPDWPPPPSVEGMSLEYEEPRDLRSNPFQGGGDDAILPPKGIG

SEQ ID NO: 185263 - protein, 112 aa, Glycine max
  Coding DNA Sequence Number=SeqID_68485
MAAMMEAMMSMKKIMEANAVAVAATSAVAKVNPTSPSGINQMNHPTLDVVGKDLGSTGHDVQIQKERAFPPYDLPLNYTPPNVAYTPNKNVNNSTPIPIESQQPQTDHAHVS

SEQ ID NO: 185264 - protein, 142 aa, Glycine max
  Coding DNA Sequence Number=SeqID_68486
RDSKVSMTDLVSAEDDAFRLTDSKKVYMDNHSGISAGQRDSKVSMTDLVSAKDDIEKKNVYTDNHSGISARQRDSNVSMTDLVSAEDDTGKKNVYTDNHSGISARQRDSNVSMTDLVSAEDDVNLRVSTGLSAAIDEGRRRR

SEQ ID NO: 185265 - protein, 106 aa, Glycine max
  Coding DNA Sequence Number=SeqID_68487
MENCTRQSFAWLETHWWRMHERQSIHEAPNKSGEWRIALGNHFAWLKTHWWRMHERQSIHGTPNKSGEWRIALGNHSPGSTLIGGGCMTHNQFMGLQIKVENGELH

SEQ ID NO: 185266 - protein, 117 aa, Glycine max
  Coding DNA Sequence Number=SeqID_68488
MDPAPFIIQEQQAEWVNAQRQIMCPLSFRNNKLSGFRWQGGSLAEWCFAQTKLVSYFYFPFISNKRQVKRGNCHTLISSGDHPLLGCDPCLTTSRYLAPIVRQSVKFRDMPEIKRKC

SEQ ID NO: 185267 - protein, 49 aa, Glycine max
  Coding DNA Sequence Number=SeqID_68489
MSKVGRFGNGGTSQGGRGCAGVSEKRGGGSLLVIDYMKAIIDYRPSVLV

SEQ ID NO: 185268 - protein, 112 aa, Glycine max
  Coding DNA Sequence Number=SeqID_68490
MDIEEDSYIPFILGRPFMSTASCMVDMGKKMLQMGIEDQKISFDLFHEDKDPPDQNVCLKVHLMDEKRPEKKVLEVGTLGGAKRMSLKPKRHVVALSACRNLPFGGRAREAH

SEQ ID NO: 185269 - protein, 116 aa, Glycine max
  Coding DNA Sequence Number=SeqID_68491
MTGLPPSKHSFNVISLTHLPVIQGLTRFLLPEPFSQHLLSHVYHAACGRHEWASKYKRNIRILFNIHYNMSQPTLQREGDAGLTGVSSKGERHVELPPTFIRGKHQKNQKCVVYEL

SEQ ID NO: 185270 - protein, 266 aa, Glycine max
  Coding DNA Sequence Number=SeqID_68492
  Homolog annotation: Hit_ID=Q8TGM6; Match level="QueryCoverage=45%, HitCoverage=97%, E-value=1e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSRGGRRALGLMASGATCVQRLDGSRDSAIHTKYRISLRSSSMQEPRYPLPRVIVCKCCVVTTPAGHRLRAPGSRT

SEQ ID NO: 185271 - protein, 138 aa, Glycine max
  Coding DNA Sequence Number=SeqID_68493
  Gene Ontology: Mol. function=RNA-directed DNA polymerase activity; Cellular component=chromatin; Biological process=RNA-dependent DNA replication
MAPEDMEKTTFVTLWGTFCYKVMSFGLKNAGATYQRAMVALFHNMMHQEIEVFVDDIIAKSKTEEEHLVNLWKLFERLRKYHLRLNPAKCTFGVKSGKLLGFIVSQKGIEVDPEKVKAILENAGTPYSRGRFKVSWDV

SEQ ID NO: 185272 - protein, 89 aa, Glycine max
  Coding DNA Sequence Number=SeqID_68494
MVEASGNRLPACVIDYTEEWVTGNRLPASGNRLPRLCNRLLEMKCLKIPVLLACSGYETYFAAAQLDSCERVCPFLFFLVYRDGGAANP

SEQ ID NO: 185273 - protein, 73 aa, Glycine max
  Coding DNA Sequence Number=SeqID_68495
MTKARQKGHAKQMRTSKGTWNELKSSISGTYRLKTEERTKNVEERLKIFAKSPTETLRKRIGLDFLHGNNFSH

SEQ ID NO: 185274 - protein, 70 aa, Glycine max
  Coding DNA Sequence Number=SeqID_68496
MAPPKEIATIIYQNGHIVDDPVQGSTYTSQLFDNDDLRGAMETILLNPQLNSAEFYVVTELIPQPQTSSP

SEQ ID NO: 185275 - protein, 163 aa, Glycine max
  Coding DNA Sequence Number=SeqID_68497
VTPFQMGGRGVSVISTTKGFTRPAMTEVVLVESDGQFLPYDWLACGYVFNMSSLHIRYLLPKHSYGFTMIFTEIWRWGDGVLTLGVYSIISCGAACCASAIDLVATMLFSGQERILPKPYGGCQMHLHESRHAGEYPGIRPGRILVMEAYLWGFYGGWIFELQ

SEQ ID NO: 185276 - protein, 168 aa, Glycine max
  Coding DNA Sequence Number=SeqID_68498
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=81%, HitCoverage=25%, E-value=5e-71, Identity=95%"; Hit description=NADH -plastoquinone oxidoreductase subunit 2
  Pfam annotation: Domain name=Oxidored_q1; Domain location=23-160; Score=-42.8; E_value=4.3e-05; Accession=PF00361.10; Description=NADH- Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRDYEYNRSIRQQKDHPKMIISWLLRTNRGIL

SEQ ID NO: 185277 - protein, 53 aa, Glycine max
  Coding DNA Sequence Number=SeqID_68499
MADQQATKSKAKGECCENFLGRPKWTWMNAQMDKRTYFGNIGLTKIEEMNPEP

SEQ ID NO: 185278 - protein, 320 aa, Glycine max
  Coding DNA Sequence Number=SeqID_68500
  Gene Ontology: Mol. function=RNA-directed DNA polymerase activity; Cellular component=chromatin; Biological process=chromatin assembly or disassembly
MAESTRSKTSLEHMEEATTKLASNQLHTTTNFDELLQCITALETNYQNPPTPSSSSANPQPSSPHPSLPRMKLEVPRFDGSNPSGWTFKISQFFDYHATPEPDRLVIASFTMEGPALAWFQWLTRNGQISSWSALLHALEAQFSPSQYKDSTREVQALHPLTLVQAVGLARLQEEKLADQCRGVSRGFRSRAQLALGFSLPPAPLPPPIPPLLPSPAKPPPLNVRRLSPEEITMRREKGLCFNCNKRFSRGHKCSSRFSLLFAAAEEEDEPSCTNPNITPNISDPPDPGPNKPLCSCASFGARNAAFDGPCHPTLCFHPH

SEQ ID NO: 185279 - protein, 452 aa, Glycine max
  Coding DNA Sequence Number=SeqID_68501
  Gene Ontology: Mol. function=RNA-directed DNA polymerase activity; Cellular component=chromatin; Biological process=chromatin assembly or disassembly
  Pfam annotation: Domain name=Chromo; Domain location=358-415; Score =18.4; E_value=0.0066; Accession=PF00385.14; Description='chromo' (CHRromatin Organisation MOdifier
  Pfam annotation: Domain name=zf-H2C2; Domain location=162-199; Score =8.3; E_value=0.028; Accession=PF09337.1; Description=His(2)-Cys(2) zinc finger
  Pfam module annotation: Pfam domain module=Chromo::zf-H2C2; Domain location=358-415::162-199
MKEEDIGKNAFCMHHGHYEFCVMPFGLCNAPSSFQATMNCIFGPYLCKFIIVFFDNILIYNKTFPEHLDHLAKDFTVLLEGNFFLKLSKCTFAQQQVEYLGHMGYASIVAPLTRLLVKDQFQWSPEAQIAFDTLKDTIYRASVLRLPDFSQTFIVETDASGVGGHMGISKTLARINQNFMWHGMRDDVCHFVTTCLLCPLSVPSRPWEDLSLDFIGGLLAFQGHTVILVVVDRFSKGVHLGLTPFEITFGKKPPTIPHYLTDTSTIDVVDDFLVHRDAAFISFKKKLLKAQQTMKKFANNNRREVHFQEVAYRLKLPPDSKIHPIFHCALLKPFHHSSDTDTCAVDLPPQSKDNDPLITPLVILNTKWATTDTGPELQVVVQWQGLPPEDTSWEPWTELKEAYHLEDKVLLNVQGDVMKQPSDKPNQEETSTNLRSKRQSVRPQHLRDFITE

SEQ ID NO: 185280 - protein, 61 aa, Glycine max
  Coding DNA Sequence Number=SeqID_68502
MEENTSTVSLSYATKLVGGNGMKPLNAKDQIDTAKRKDVKINYERLVLNVKLNTWTELMTS

SEQ ID NO: 185281 - protein, 117 aa, Glycine max
  Coding DNA Sequence Number=SeqID_68503
  Homolog annotation: Hit_ID=Q1S6A4; Match level="QueryCoverage=73%, HitCoverage=20%, E-value=9e-07, Identity=33%"; Hit description =Peptidase C48, SUMO/Sentrin/Ubl1
AKANNTKCEPIVNEVSLKKELFEHIIVGKDFGLFSNVEPLHYATYDGMTTTIDIPMWLPMTFRSPPKMILDEVHSLVAIYIFGRNKDDKDSGKEILVMTMAKTFADMKALRSLEPKG

SEQ ID NO: 185282 - protein, 77 aa, Glycine max
  Coding DNA Sequence Number=SeqID_68504
MTENVSQFVRLIVKECIGRIPWFLHESLKYGLVAMCPFAGVRGEAYGCAFQRRKDARSRHQRLFMENVGKTEGNRSK

SEQ ID NO: 185283 - protein, 354 aa, Glycine max
  Coding DNA Sequence Number=SeqID_68505
  Gene Ontology: Mol. function=RNA-directed DNA polymerase activity; Biological process=RNA-dependent DNA replication
MATEQKELPEVSSLISILSKMLKEVLGGIWYLWNERHWEVEVTTSSSQFVDIKVARGQDIPWFLTIVFGSLYFSRRQSLLKEFAKITSEIDKAWAMARDFNSECDLIDVGFQGYPFTWQQGDQKDRLDKILISPNGFQAWFYQNQWEVVGDTLTRLVVNMFFILQRVALSRIHNSENIIIAQEVFNSMRSKKRKVGWMTIKIDLEEAYDRLSWSFIQDILIDIGLSTSFVELVWYCISSPKMKVLQNGKALEEFLQARGICQGDSLSPYLFVLCFERLLHVINVVVDNGFWQPIQLAREGGQKVNEAKTRVYFSANVPSQVKEELSQALGFQKTEDMGKYLGIPIQGCARRKAN

SEQ ID NO: 185284 - protein, 66 aa, Glycine max
  Coding DNA Sequence Number=SeqID_68506
MGAKYLKAVRQRLHAIKQWSLDEIRDARTALGNQFMGLRIRFNGGGCTISARQSIRGAPDSMAEDA

SEQ ID NO: 185285 - protein, 289 aa, Glycine max
  Coding DNA Sequence Number=SeqID_68507
  Homolog annotation: Hit_ID=Q1RYI2; Match level="QueryCoverage=40%, HitCoverage=20%, E-value=4e-15, Identity=36%"; Hit description =Ribonuclease H
VPKCLYTEGEAIVRRGYCPILHKNVNHNTYQFAVDKSSTKFVLQALSSYVMQTTVIPKAVCDTIDRRWREFVSGGTSQRRRINTTFGPSLCLPNDQGGLRLREMRKVNQVDMMRVVWKLISNKEDLWVKTASGVHGWQGFPIHWTSTFAVALDSIWRSRNDFIFNNRQEEAAGLVGEIQMKIEQVLESLELFKKVNIDAALCTMYGRAACGGLLRDHDAHFVACNLLCDRGFVQIEVEGSLYLFLMYFEKPIMNVANALAKHGLAISVDMRLFDVQLSFISLYLLAESA

SEQ ID NO: 185286 - protein, 143 aa, Glycine max
  Coding DNA Sequence Number=SeqID_68508
  Subcellular localization annotation: CTP_CleavageSite=59; ConfidenceScore=5.50e-01
MATIIDCSSSPFRHSQLNTNPKLRPDKSTGKSRRACHFRFHKRKESMSKGISREVRGCSEDMKLVLILGSSIRLQSSSMERMYGSKTSKVVSGLKGSIKEKDELFMVKGKGMKILPSIFSSCAGKMGTGGIKAIEKIVVVVDS

SEQ ID NO: 185287 - protein, 173 aa, Glycine max
  Coding DNA Sequence Number=SeqID_68509
  Homolog annotation: Hit_ID=Q9XES3; Match level="QueryCoverage=54%, HitCoverage=97%, E-value=3e-17, Identity=45%"; Hit description=Wound- induced protein WI12
  Pfam annotation: Domain name=WI12; Domain location=79-173; Score =93.6; E_value=5.9e-25; Accession=PF07107.2; Description=Wound -induced protein WI12
MWQLLRESVNGGGAMHGLHLANSRECLEEYVEHNTRVVTELYKALTSKDPETLHGIVAQDLEWWFHGPSCHRHHLVPWLTGSSPSSKALVPQHVVGFGPLVIAEGFDEAHLVWWVHAWTIRTSDGLITQVKEYVNTSVSVTRLSQMLPNASNCQCIWQSRLCDESVPGLVLAI

SEQ ID NO: 185288 - protein, 163 aa, Glycine max
  Coding DNA Sequence Number=SeqID_68510
  Homolog annotation: Hit_ID=Q1S2Y9; Match level="QueryCoverage=86%, HitCoverage=96%, E-value=9e-33, Identity=52%"; Hit description=Wound- induced protein WI12, putative
  Pfam annotation: Domain name=WI12; Domain location=67-163; Score =81.4; E_value=2.8e-21; Accession=PF07107.2; Description=Wound -induced protein WI12
MKTIPGSKAEPEKLSGTAADHENRNRETVKMVYKALRDGDTEKLAKVVRVELEWWYHGPPHCQHMKKVLTGESTATQKAFKFRPRRIRAVGDRVMVEGWEGAGEYWVHVWRLKHGIIAQLREYFNTLITVVLRVLEDGDEARLWRSTDRVRVQGSLPDIVLSI

SEQ ID NO: 185289 - protein, 193 aa, Glycine max
  Coding DNA Sequence Number=SeqID_68511
MSEEEDKVQERIKVDIEALKEQMATMMEAMMSMKKIMKVNAAAVVATSVVAERGKELESMGGPHFVQVQNKHAFSPYGLPPNYTPPNMVHTPNQNVNDSTPIFIESQQPQSDHTPIPQPMGGTHETPHHNLANFKPCLEYATEGQTVGGVPLPNTLEGPQFRPQPQPLHFAMGRAPSAMAGKGKLDQIEERLR

SEQ ID NO: 185290 - protein, 404 aa, Glycine max
  Coding DNA Sequence Number=SeqID_68512
  Homolog annotation: Hit_ID=Q01BT5; Match level="QueryCoverage=60%, HitCoverage=64%, E-value=4e-13, Identity=29%"; Hit description=[J] KOG3928 Mitochondrial ribosome small subunit component
  Subcellular localization annotation: CTP_CleavageSite=7; ConfidenceScore=5.34e-01
MLRSLARAVATNHRCHATFSSLSHSSRPPKPTPPFKPDPKKSAPNAAAAAALIDEQERRRQLDADDKNPSLDVGPNGRPLFSAAPSFSHLSRNDVCTYFKLTKDALNKVLPEGLPVGMVNEFQDSLRTALLVRQSFLDLRDNFRRVVDPPMWSSNGVKVRKQVVLDGPVSCGKSIALAMLVQWAREEGWLVLYVPKGKDWTHGGFFYKHPQTGLWDTPVQAEDVLKARLNFNDFLKYNESYLKEMPCQIFDPILLGEGAGVGWLKDVDSLAIPEGTNLYELVKTGIEQTHAAIGVVVRLRKELSLVKDRPVLIAVDQYNNWFTFSEYEEPVTIRSCRPIHARELAMVKAFRSMVHDDMMVGAFSHSTAVGKLRKDLPDVPVDARVMFPRYSLDEAETVCHYYLR

SEQ ID NO: 185291 - protein, 404 aa, Glycine max
  Coding DNA Sequence Number=SeqID_68513
  Gene Ontology: Mol. function=transferase activity; Biological process= paclitaxel biosynthetic process
  Homolog annotation: Hit_ID=Q1RZ42; Match level="QueryCoverage=94%, HitCoverage=91%, E-value=1e-159, Identity=67%"; Hit description =Transferase
  Pfam annotation: Domain name=Transferase; Domain location=8-393; Score=235.5; E_value=1.1e-67; Accession=PF02458.6; Description =Transferase family
MANLKTPLVLNMKDVVIVKPSKPTPPELLALSTIDSGQTIYVYEGNLDSPNGQLDPSHVIKEALSKAFVYYYPLAGKIVTFDDGKLGINCNADGIPFLEVTANCELSSLHYLEGIDAPTAQKLVFADDKPNNSHDHPLVFKVTKFLCGAFTLGMGLSHSVCDGFGASKFFRALAELACGKSEPSVKPVWERERLMGTLLLNMEPVQFPIDETSRAESDDIVKESFTTVEALGAYVWRSRARALELSCNGKTMLCLAVGVRHLLDPPLPEGYYGNAFVGSNVVLTVKELDEKPLSEVVKLIKESKKLPSKNEYIRNTINMLETMRQRNIRVEGTCASVVLTDWRQLSLMEEVDFGWKASVNIVPVPWNMLGYVDLCLFLPPSNLNPSVKGGVRGGDGGPQKAYER

SEQ ID NO: 185292 - protein, 102 aa, Glycine max
  Coding DNA Sequence Number=SeqID_68514
  Homolog annotation: Hit_ID=Q1SD84; Match level="QueryCoverage=58%, HitCoverage=3%, E-value=1e-17, Identity=75%"; Hit description =Integrase, catalytic region
MEVVCSKRGIVVSQHEYILDLLEETGMSGYRLADTPIDPNGKLWEKGSVHVDIGRYQRKVFVEAMFSKFILMMSKTQVKNQESSKFQESKSRSIKTSFKNQD

SEQ ID NO: 185293 - protein, 156 aa, Glycine max
  Coding DNA Sequence Number=SeqID_68515
  Subcellular localization annotation: CTP_CleavageSite=79; ConfidenceScore=5.21e-01
MQMADRGRGGGRRIFNRGTRRGFSLGAPITTNPSPSSIHISSSESMVHVVAQTPNTLPTTQDQPNPTFVRESIPTTPVRDASPSAPDDSVTPEYPPDPNCEHIVDERPFIRAYKGEFQPTYGCSNIIWAKFDEPAPSWLKVSVDLCDRWFGEFKKE

SEQ ID NO: 185294 - protein, 139 aa, Glycine max
  Coding DNA Sequence Number=SeqID_68516
MCHKISKSSNTLQSNHHCYSTHDFFQAAHHNYCWYQEMVYPSGTRQESLKHVVKGLNPDECIYGENLVEREIPLMSANRTFYKKVEYVLEDCIEVLVKINKFFINKEGLVCVETLCMPVTKPERFEFDAFELDEPEDAG

SEQ ID NO: 185295 - protein, 103 aa, Glycine max
  Coding DNA Sequence Number=SeqID_68517
MRPHPHENPTLTPPEPKSTPKRKKLTFNDEREREQRCVASRQRRRGETFAEERRHGEIYDTILPRRGPITRAMSRRLQEDWARDAGEDPRVLLSLRVDFGSMR

SEQ ID NO: 185296 - protein, 90 aa, Glycine max
  Coding DNA Sequence Number=SeqID_68518
MSLHVLYLYAFSRFPPRGFPGQDHLGLPSGVETKHERQKPIKVLKDERKRGWGHDRPIVALLCAKQAGNVAARQPRILCILQLSFTICLF

SEQ ID NO: 185297 - protein, 76 aa, Glycine max
  Coding DNA Sequence Number=SeqID_68519
MYVIGLFAQVTCALELISKSVQSEIARSTHLTTIDTSEPYIGAMRGTMHEPQANLAADQKFSPGRSKTRKGGLGKN

SEQ ID NO: 185298 - protein, 221 aa, Glycine max
  Coding DNA Sequence Number=SeqID_68520
  Gene Ontology: Mol. function=protein binding; Cellular component =integral to membrane; Biological process=protein amino acid phosphorylation
  Homolog annotation: Hit_ID=Q9SN91; Match level="QueryCoverage=99%, HitCoverage=63%, E-value=2e-35, Identity=32%"; Hit description =Leucine rich repeat-like protein
  Pfam annotation: Domain name=LRR_1; Domain location=100-122; Score =9.9; E_value=4.1; Accession=PF00560.23; Description=Leucine Rich Repeat
  Pfam annotation: Domain name=LRR_1; Domain location=124-146; Score =5.0; E_value=33; Accession=PF00560.23; Description=Leucine Rich Repeat
  Pfam annotation: Domain name=LRR_1; Domain location=148-170; Score =5.6; E_value=25; Accession=PF00560.23; Description=Leucine Rich Repeat
  Pfam annotation: Domain name=LRR_1; Domain location=172-194; Score =15.2; E_value=0.24; Accession=PF00560.23; Description=Leucine Rich Repeat
  Pfam annotation: Domain name=LRR_1; Domain location=196-218; Score =16.0; E_value=0.14; Accession=PF00560.23; Description=Leucine Rich Repeat
  Pfam annotation: Domain name=LRR_1; Domain location=28-50; Score =16.3; E_value=0.11; Accession=PF00560.23; Description=Leucine Rich Repeat
  Pfam annotation: Domain name=LRR_1; Domain location=52-74; Score =11.3; E_value=2.2; Accession=PF00560.23; Description=Leucine Rich Repeat
  Pfam annotation: Domain name=LRR_1; Domain location=76-98; Score =10.5; E_value=3.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=100-122::124-146::148- 170::172-194::196-218::28-50::52-74::76-98
MNLSKVESSNWLSGISGSISAELGNFTSLQTLDLSSNSLSVSIPSELGQLQNLRILQLYSNDLSENIHSEIGNLRMLQVLRIGDNMLTGEIPLSVANISELKVLALGYCHLNGSIPFGIGKLKHVISLDVQMNNINGHIPEEIEGCEELQNFAASNNMLERDLPSSMGSLKSLKIVNLANNMLSGSIPTALSHLSNLTYLNLVGNKLHGEIPSELNSLIML

SEQ ID NO: 185299 - protein, 387 aa, Glycine max
  Coding DNA Sequence Number=SeqID_68521
  Gene Ontology: Mol. function=binding; Cellular component=nucleus; Biological process=regulation of transcription
  Homolog annotation: Hit_ID=Q8H3J6; Match level="QueryCoverage=80%, HitCoverage=51%, E-value=1e-90, Identity=48%"; Hit description =Selenium-binding protein-like protein
  Pfam annotation: Domain name=PPR; Domain location=165-199; Score =43.0; E_value=1e-09; Accession=PF01535.11; Description=PPR repeat
  Pfam annotation: Domain name=PPR; Domain location=265-299; Score =26.1; E_value=0.00013; Accession=PF01535.11; Description=PPR repeat
  Pfam annotation: Domain name=PPR; Domain location=330-364; Score=5.7; E_value=1.6; Accession=PF01535.11; Description=PPR repeat
  Pfam module annotation: Pfam domain module=PPR::PPR::PPR; Domain location=165-199::265-299::330-364
  Subcellular localization annotation: CTP_CleavageSite=53; ConfidenceScore=5.76e-01
MHTSSFQATTTPASPPTFSLLPRSVPFPILSLPLQLNPVPHRLRLQLPHPLPRQSELFTLSFSFSLLLNASPFSKPQPAHLHFLGVHIHAHVVKFGYACHVFVRNALIQFYCDCSRVGSAKRVFEEDTLCSDVVTWNSMLAGYVRNGEVRFAEKMFDEMPERDVVSWSTMITGYVLNGLLEDGLECFRDMRETKVRPNEAILTLLSVSAQLGLLGYGRFVHSTIEGLRFPMTVPMGTALVDMYLKCGCVEKARILFDGMAKKDVWIWNVMICGLASHDHAKEALALFQRFVGEGFQPVNVTFVGVLNACSRAGLVGDPRHYFKLMVDDHVMWATLLDACKLHGYVEMGEKIGNKLIELDPTHDGHYVQLAGIYAKARKWEDVVRIRG

SEQ ID NO: 185300 - protein, 53 aa, Glycine max
  Coding DNA Sequence Number=SeqID_68522
MLNGMPWNSPMISVCHIGVVSYGKWRLRNLCWAYGYHYIIEQMRRVVFGLSSR

SEQ ID NO: 185301 - protein, 85 aa, Glycine max
  Coding DNA Sequence Number=SeqID_68523
MKLTSNPTTIMAATLAVKRTSGHHDTGNLLMDNQKASCHGLQRNGEQQASMENNLRCRGYKEKKKALDAEGTRRRIKREQNRSRL

SEQ ID NO: 185302 - protein, 403 aa, Glycine max
  Coding DNA Sequence Number=SeqID_68524
  Homolog annotation: Hit_ID=Q5XM22; Match level="QueryCoverage=21%, HitCoverage=58%, E-value=5e-16, Identity=45%"; Hit description =Resistance-like protein HAAS-2
MVITRALDRALGRAIRKVLGTRDDDNDAPNSEGLHLSTSSDNISEQAIGKALRRREASDDDNDAPSSEGLSHLPEFNEEQQQPPVEEGVIDVEGFLGGPHNTSVLRDFENHIALRVWNEELSSHGMMMAKFVRPALEIECLVATNGLSPLIACSLDTGVTITLDDVALLLHLPNVGAFCRSKLHDDEPNNFDDAKSPTYIIYSTSRAYIYLGCDTKNKRGILQGYWKSQEPVVAWGLDQLHVDDAVDMLVELLEVSVAEARAETIQCHGSYVRLLWLRDVYQTKIEACHWIVVVRAYLLHLLGRTLFANKSATYMHVGIAALVHMYDNLNEAPKSTERKLVGYITLLQLSRIMSSGDHVHAEGPLTILPHPVVLSAFVEKIDARWMQFGDYIAPIEQICVVPG

SEQ ID NO: 185303 - protein, 90 aa, Glycine max
  Coding DNA Sequence Number=SeqID_68525
  Subcellular localization annotation: CTP_CleavageSite=13; ConfidenceScore=5.06e-01
MSLSRPIASTFNRVMATPCHTRGFFSHLLCYLVRVFTTLLCILCHTIASCLVTDVLRLIVVGPAAASCHQALASLVPMLHSQCCLGCCWT

SEQ ID NO: 185304 - protein, 512 aa, Glycine max
  Coding DNA Sequence Number=SeqID_68526
  Homolog annotation: Hit_ID=Q94D97; Match level="QueryCoverage=98%, HitCoverage=95%, E-value=1e-117, Identity=45%"; Hit description =Nodulin-like protein
  Pfam annotation: Domain name=ABC-3; Domain location=44-256; Score= -178.4; E_value=0.098; Accession=PF00950.8; Description=ABC 3 transport family
  Pfam annotation: Domain name=MFS_1; Domain location=11-460; Score= -13.0; E_value=0.0012; Accession=PF07690.6; Description=Major Facilitator Superfamily
  Pfam annotation: Domain name=Nodulin-like; Domain location=7-252; Score=328.6; E_value=1.1e-95; Accession=PF06813.4; Description =Nodulin-like
  Pfam module annotation: Pfam domain module=ABC-3::MFS_1::Nodulin -like; Domain location=44-256::11-460::7-252
MPSTTLQWLSLVGIIWLQAIIGTNTNFPAYSSQLKQLLSISQVQLNNLAFASDAGKLFGWFSGLASIYLPLWLVLFIGSTLGLVGYGVQYLFITNQICSLSYWHVFLLTFLAGNSICWINTVCYVVTIRNFFSDRLVAVGITTSYQGLSAKIYANIVDAVSPHKKARTFLFLNSLLPVIVGLIAAPLVREIDEVTSPNRYTRVGFAVMFVITISTGTYAVLSSLQFVTSKASSLGILIGILLSFLLPLLVPLSMKIKKFQENREKLRIYHYTMEENATSEERVESEVKEGEVVQEEFGIIEEVGVKLMLRRINFWLYFSVYFFGATVGLVYLNNLGQIAESRGCSNTSSLVSLASSFGFFGRLMPSLMHYFYRGKCRISRPASLMAAMIPTTGAFLLLLNKSDIALYISTAVIGVCTGAITSIAVSTTTELFGTKNFSVNHNVVVANIPIGSFIFGYSAALIYHKEGNEHGKCMGMECYRNTFIMWGFFCFLGTLLALILHARTRKFFSLKQ

SEQ ID NO: 185305 - protein, 760 aa, Glycine max
  Coding DNA Sequence Number=SeqID_68527
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=96%, E-value=9e-96, Identity=42%"; Hit description=Zinc finger, CCHC-type; Peptidase aspartic, catalytic; Polynucleotidyl transferase, Ribonuclease H fold
MEEKENRPKSSIGGDDQSQKKRSSSYDLNPNDNLRSVIAQVQLRGENYDEWARAMKTSLRARRKWGFIDGTITKPEEGSSMMEDWWTVQAMLERFLVVNGPCIQQLKSYLAQCKQGGLSMMAYYEKLRALWDDLANYEQLSICTCKGCTYGLLAKLEKHREEERCHIFLMGLDDGLYGTIRSNLLATDPMPSLNKMYYILVQVKGRENKNKFICTNCNKSGHDEAGCFLLIGYPEWWGDCPRNDDKAGGRGRGQNHTGGTGSNSGHAQKGPWETLVALLNNSKVTPNESMTVPCWTSYGHTFTSTKEGTIRLAGGLTLGNVFTTNLCAIHGHTSKMLIGVSERRDELYFFQEIPKVKACRVEGITQLEGGTDTMEDVVTDTTMFPEPPDIQIPNAHDENEPLRRGCRVKYPSTWLQDYVIHTIQKLSPSTRSSTQSHFSCAPYPITHYMLAEKKQCNLRFKLLSKIVRGPCRDYRPKRKLSGINYTETFAPVAKMVAVCTILAVAIAKSWELHQMDVHNAFLDGYFHEEVFMKMPPGSFTIRHDTELVVLVYVDDLIIAGNTPSAIKHFKLYLSTCFHMKYLGVLKYFLAGLLGAKPAATPLEQNHHLSLTAGQLLLDPDQYRHLVGCLIYLCFTRPELSYSVHLLSQFMQQPRIEHWEAALRVVRFLKGNSGQGIFFARECDLQLYGWCDSDWASCPLTRRLAEYRSMATTKCELKWLKGILSDLGVVHDKPMTIRCDSQAALHIAKNPVFHERTKHIK

SEQ ID NO: 185306 - protein, 67 aa, Glycine max
  Coding DNA Sequence Number=SeqID_68528
  Gene Ontology: Mol. function=transferase activity; Biological process= glutamine metabolic process
  Homolog annotation: Hit_ID=Q1SPM3; Match level="QueryCoverage=92%, HitCoverage=25%, E-value=4e-09, Identity=53%"; Hit description=SNO glutamine amidotransferase; CobB/CobQ-like glutamine amidotransferase
MIQIFVVELSVLELVSNEGGPETFCGISICAPAILEAGLEVQVLPDYLVPFSRLLSFDSSIEDQIVG

SEQ ID NO: 185307 - protein, 187 aa, Glycine max
  Coding DNA Sequence Number=SeqID_68529
  Subcellular localization annotation: CTP_CleavageSite=51; ConfidenceScore=5.03e-01
MGWLDRIMSQILRVSFQLPLVIGGSHPHLNGAYVRFRSPPFLSFGSSSVISLHLVCGSCDFLLSFDRLPHFKEETHHEASDDKSSSSERLVDLGYVSGGTSHPHRRVRPSTTPLDEEHVSVTQDEVFRRCRDMLKERNELANKVECTAEEKEDLTAIMAEFAKACRVLQEGGHGATQKGILQGRQTC

SEQ ID NO: 185308 - protein, 76 aa, Glycine max
  Coding DNA Sequence Number=SeqID_68530
  Homolog annotation: Hit_ID=Q6XGE7; Match level="QueryCoverage=99%, HitCoverage=30%, E-value=2e-36, Identity=96%"; Hit description=MobC -like protein
MAGDDRLVTGSGFQAALGLNGDHGATGEGDQAVRPVINLVTAKEGRAIAVYPPGCAFLLKDDPGCLIINVMLQRPA

SEQ ID NO: 185309 - protein, 95 aa, Glycine max
  Coding DNA Sequence Number=SeqID_68531
MNKETDRLANVLTEMSAKALVTWMTHSALQNIPREALLVRGNDFVYALHANFVLLRDVLSETLEDIEQQSHDLEERLDSLEQRLQVLQKDTDDLY

SEQ ID NO: 185310 - protein, 253 aa, Glycine max
  Coding DNA Sequence Number=SeqID_68532
  Gene Ontology: Mol. function=phospholipase C activity; Cellular component=membrane; Biological process=intracellular signaling cascade
  Homolog annotation: Hit_ID=Q1SH97; Match level="QueryCoverage=79%, HitCoverage=49%, E-value=7e-77, Identity=64%"; Hit description =Phosphatidylinositol-specific phospholipase C, X region
MEANPTEIVTIFIEDYVTSPQGLTKVFNASGLRKYWFPVSRMPKNGEDWPTVDDMVHQNQRLVVFTSKSSKEDSEGIANQWKYVVENQYGDDGMKGGSCPNRGESSTMNTKSKSLVLMNYFLTSANASSACADNSTPLVNMLKTCHNASSGRWPNFIAVDFYQRSDGGGAPEAVDVANGHLTCGCDNISYCRPNATYGTCDVPPISPPPPAVAPPTIVEEASHQPVQEEFHVDTPLKLVKFLWVMWGVKNFLT

SEQ ID NO: 185311 - protein, 133 aa, Glycine max
  Coding DNA Sequence Number=SeqID_68533
MKVHFSKLRHIVATYHSTGGRGEMPKVHLPKRKMRWSRHQRLFEENVRKTKKRSANFENKGSGVVYAWGRQLYGANDRLRLNFIKEKRLPMIEGGDEYAQNNKGDPYGCIDRIQIIKTKLINDRMRNTEPRTM

SEQ ID NO: 185312 - protein, 70 aa, Glycine max
  Coding DNA Sequence Number=SeqID_68534
MTESKYIDMISIISSPCWMSHLSDALDDEDIEEDPPMDSTECIEEDPEEDPSKGFYDEGFRNIDFQVWFK

SEQ ID NO: 185313 - protein, 39 aa, Glycine max
  Coding DNA Sequence Number=SeqID_68535
MCWKGSEVNETRSPDKGENEFNFWSPIGGGSRSEEDLGS

SEQ ID NO: 185314 - protein, 105 aa, Glycine max
  Coding DNA Sequence Number=SeqID_68536
MAKGADDHNGLCMPSDLMSLDSKKGADDHNLSPRAIRLACLWIAKKGADDHNLYPRAIRLDCLWIAKVARTLSPTKMDDEDFESYEGGDFEPSKSIKARTLSPIK

SEQ ID NO: 185315 - protein, 96 aa, Glycine max
  Coding DNA Sequence Number=SeqID_68537
MDSGRFQVSVPGNSYPMVLETSSPLVLVKVQHLELGNDHVWVLGTTFLVMRVFNRRCGMQEVQLWVILRASPKGFVGYTTNCLPFSGISEPRLEVG

SEQ ID NO: 185316 - protein, 83 aa, Glycine max
  Coding DNA Sequence Number=SeqID_68538
MVGYTPSSFADLDFASGRIKVGLKRGKFGHPALIKTGANEEGENEGEAHAVTAIPIWPSFPPTQQCHYSTNNNLSPYPPPSYP

SEQ ID NO: 185317 - protein, 68 aa, Glycine max
  Coding DNA Sequence Number=SeqID_68539
MLAIISKYQEELSLATTHEHRVADEYAQVYAEKEARGRHALYVGLGKPEGPYHLLNCKHGALCPQMRK

SEQ ID NO: 185318 - protein, 76 aa, Glycine max
  Coding DNA Sequence Number=SeqID_68540
MSGFTRNSPQISASPHQLDLAPYASEPYNAQWNAPGLLHDMHMLRSSRILRKMEVVFVIGSAVDRLCGWFRDGLCG

SEQ ID NO: 185319 - protein, 131 aa, Glycine max
  Coding DNA Sequence Number=SeqID_68541
EVAQSRSTNTMIDPPSPIRRHMKWKMTRTKKTGQMMSQTAKEIANKIDQTSQGSFVTHGRQDVLTAVIGQPEHPGHVRAARVGVTIKQYFETTPRTSRTKSDSTANVILQPDAVPVSVADAIIGTHIASRA

SEQ ID NO: 185320 - protein, 56 aa, Glycine max
  Coding DNA Sequence Number=SeqID_68542
MSLLSEHAALSEFISTHCVYRRSQKNSLSAPTALKLVPLSAAFKELSAYPCGRCSA

SEQ ID NO: 185321 - protein, 86 aa, Glycine max
  Coding DNA Sequence Number=SeqID_68543
MVVISHHSRDQPGSHQGYDGLIMAQHWKIVDDYPSHDPSITAKCKIEYKKVSKSKSESLALAKLEDFHLEISSPRFQPSWYVYISS

SEQ ID NO: 185322 - protein, 140 aa, Glycine max
  Coding DNA Sequence Number=SeqID_68544
MVAPPDSIPLIEQFNEWVAWPGTQSSLHREDEGPTAQVPLQMEDEPSETTTPEPLVRRKKADETQEAVATSEKPLEATSEPSELVVDTTSPQQATDPSTPEDLTTPVLSLNTSPTATPVLHLTNEEDVQTQETQDQSQNF

SEQ ID NO: 185323 - protein, 98 aa, Glycine max
  Coding DNA Sequence Number=SeqID_68545
MYVDAMFGGWLWLAKVGGGCNSPYCRLLDNSHTMILHSTSRWLEPSTDQNPTINDCPHKPTQEFSACFVLTRFLRNFLEGHLSHNYSKPSTVNYGVLK

SEQ ID NO: 185324 - protein, 78 aa, Glycine max
  Coding DNA Sequence Number=SeqID_68546
MSSQPRKGNPFPEEAFSGNIPEDYLSGNFSEEASSGRRISDSESTQKLFPEEGHPEFFRKKLLPEDILLLSEEGSSGS

SEQ ID NO: 185325 - protein, 78 aa, Glycine max
  Coding DNA Sequence Number=SeqID_68547
MWYHFGNHCECSLEVHVVDELPHNGQPDTITLTEMTSSGVNVFQDYFDDVKESRVKQVPKNQESSKFQESRSRFKIQE

SEQ ID NO: 185326 - protein, 62 aa, Glycine max
  Coding DNA Sequence Number=SeqID_68548
MLENWTTLFDGVVVGGIVVVTLLLNRVEALVVDEELLPLDNKSVSCFHYVHIHEREEKKNGE

SEQ ID NO: 185327 - protein, 247 aa, Glycine max
  Coding DNA Sequence Number=SeqID_68549
  Homolog annotation: Hit_ID=Q5CDC4; Match level="QueryCoverage=16%, HitCoverage=32%, E-value=7e-15, Identity=100%"; Hit description =LacOPZ-alpha peptide from pUC9
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIFTRQSVAQYIGGIPVGIKPARDRPGFAPHADKTVATTSRNDHRFAVGILRTKALNGWRNDIGPYQAYRYRRPRGGARYQLLFPLVRVNFELGVIMVIAVSCVKLLSAHNSTQHTSRKHKV

SEQ ID NO: 185328 - protein, 69 aa, Glycine max
  Coding DNA Sequence Number=SeqID_68550
IFEAPETLEQRVVDAAVPGDVIRFSLTANMGSNVDRETNSDDVPMISVEEDVGKDYSHLINQINLVVLS

SEQ ID NO: 185329 - protein, 119 aa, Glycine max
  Coding DNA Sequence Number=SeqID_68551
  Gene Ontology: Mol. function=DNA-directed RNA polymerase activity; Biological process=transcription
  Homolog annotation: Hit_ID=Q9SMT8; Match level="QueryCoverage=71%, HitCoverage=16%, E-value=8e-18, Identity=50%"; Hit description=RNA polymerase III subunit-like protein
MKEIAKIAASTLVEKKEASKLLYKLWKDNYLYMEKVGATAGAKQITILMWKVNKPLLWEYVLDEMYHAALNLSLRMAFEQEKDEELIISKACVSYCANLDVTGEKEGCGCGSPSSMGFF

SEQ ID NO: 185330 - protein, 74 aa, Glycine max
  Coding DNA Sequence Number=SeqID_68552
MTVSAGRIEFPHCFTWSDPWKQKCLSWLLLKVPKDKLREPGPLQKKYKRLLNVRLLMGSSLLKLDDALMLFHDF

SEQ ID NO: 185331 - protein, 95 aa, Glycine max
  Coding DNA Sequence Number=SeqID_68553
  Gene Ontology: Mol. function=monooxygenase activity; Biological process=electron transport
  Homolog annotation: Hit_ID=Q1S498; Match level="QueryCoverage=69%, HitCoverage=12%, E-value=7e-09, Identity=49%"; Hit description =Cytochrome P450
MEFFLGLCGVLVAFSAALCLLLFSILTLYWWVFPNQKLKKLKKFGLGGPTPSFPLGNIGEMKRKNSIQSSVVSSNLSHDIHSNVFPYFSSWQKSH

SEQ ID NO: 185332 - protein, 141 aa, Glycine max
  Coding DNA Sequence Number=SeqID_68554
  Gene Ontology: Mol. function=monooxygenase activity; Cellular component=membrane; Biological process=electron transport
  Homolog annotation: Hit_ID=Q1S498; Match level="QueryCoverage=99%, HitCoverage=27%, E-value=3e-72, Identity=87%"; Hit description =Cytochrome P450
MKCVMNEVLRLYPPAPNVQRQAREDIKVDDISVPNGTNMWIDVVAMHHDPELWGKDANEFRPERFMDDVNGGCNHKMGYLPFGFGGRMCVGRNLTFMEYKIVLTLLLSKFRFKLSPGYHHSPSIMLSLRPNHGLPLIVQPL

SEQ ID NO: 185333 - protein, 85 aa, Glycine max
  Coding DNA Sequence Number=SeqID_68555
MTTQYEVMFDNGVACVCSVRLSPIKCGSHGEVNADLDYQNFVFFVAKCVFYVSSVQQNFPFKLPVVNKFYNIVSHFENENLRSTY

SEQ ID NO: 185334 - protein, 409 aa, Glycine max
  Coding DNA Sequence Number=SeqID_68556
  Gene Ontology: Mol. function=monooxygenase activity; Cellular component=membrane; Biological process=electron transport
  Homolog annotation: Hit_ID=Q1S498; Match level="QueryCoverage=85%, HitCoverage=66%, E-value=1e-131, Identity=67%"; Hit description =Cytochrome P450
  Pfam annotation: Domain name=p450; Domain location=45-406; Score= -61.0; E_value=3.4e-08; Accession=PF00067.12; Description=Cytochrome P450
MEFLGLAGVLVAFLAALCLFLLLILTFSWWVFPNQTLKKLKKCGLGGPTPSFPLGNIKEMKRKNNIQSSSVVQSSNLTHDIHSYVFPYFSSWQKSHGKVFVYWLGTEPFLYVAEPEFLKKMSTVVMAKSWGKPSVFRTDRDPMFGSGLVMVEGNDWVRHRHIVAPAFNPINLKAMANMMVESTNQMIERWATQINTGNPELDVEKEIIATAGEIIARTSFGMKDDNARDAIAKLRALQMTLFKSNRYVGVPFGKYFNVKKTLEAKKLGKEIDELLLSIIESRKNSPKKNSQRDLLGLLLQGNHQVDGRSGKTLTSREVVDECKTFFFGGHETTALAITWTLLLLAMHQDWQNQLRDEIREVVGNTLELDISMLAGLKKKENGYLWQATCVPPYALGLIPLRMRYPQNTT

SEQ ID NO: 185335 - protein, 89 aa, Glycine max
  Coding DNA Sequence Number=SeqID_68557
  Homolog annotation: Hit_ID=Q6ESI7; Match level="QueryCoverage=36%, HitCoverage=2%, E-value=8e-08, Identity=81%"; Hit description =Putative tripeptidyl peptidase II
MGTEDSDESTATIVVWVRMEESVGANLRLGHEGSQEERSAMHWQCLGDNPIASSGGGSGSVFPSCAFELCLCCGAKDGERVRGQCGESA

SEQ ID NO: 185336 - protein, 149 aa, Glycine max
  Coding DNA Sequence Number=SeqID_68558
  Gene Ontology: Mol. function=RNA-directed DNA polymerase activity; Biological process=RNA-dependent DNA replication
  Homolog annotation: Hit_ID=Q1S7B8; Match level="QueryCoverage=54%, HitCoverage=10%, E-value=6e-13, Identity=47%"; Hit description=RNA -directed DNA polymerase
MAKLLARRLKRVMSDIIEKRQTAFIEGRHMLHNVLIANEAVEEAKRSNKSYMVFKVDCEKWMKNVARYLNCSLLVVPFPYLGISIGANPRCSATWDPIVKMIPKKVVDKLVKLQRWLLWGVTQSKRRSPGLVGAQSIYQRRKEIWESET

SEQ ID NO: 185337 - protein, 133 aa, Glycine max
  Coding DNA Sequence Number=SeqID_68559
  Gene Ontology: Cellular component=cellulose and pectin-containing cell wall
  Homolog annotation: Hit_ID=Q9FWM6; Match level="QueryCoverage=51%, HitCoverage=17%, E-value=2e-19, Identity=66%"; Hit description =Putative pectin acetylesterase
  Pfam annotation: Domain name=PAE; Domain location=2-131; Score= -157.3; E_value=4.4e-06; Accession=PF03283.4; Description =Pectinacetylesterase
MGLHLLEMLCSLTRKIAVKSGRNWVNLRAFVFHQHFHTTTLHFKGQKIWEAIIRDLLPLGLGKARKALLSGCSAGGLATFHHCDNFAKYLPTNASVKCLSDAGFFLDEYDLSILTHFNIIIIFICISSSKSKY

SEQ ID NO: 185338 - protein, 60 aa, Glycine max
  Coding DNA Sequence Number=SeqID_68560
MSNKTNISLKGQTGCLLNHPALHLCLHQLGEVPWGATQGVPPGHQEREMWEERIVEDLIE

SEQ ID NO: 185339 - protein, 105 aa, Glycine max
  Coding DNA Sequence Number=SeqID_68561
MSGQENHLKSYNLEKIFEKTIGRVTSLNFLFRTRHCLKLLKSNFANGNRLQVYLKEHCPLPPVALLWSSNCLPRAKQWPTAYIGRIQQYMSLMTIRREYVDLNED

SEQ ID NO: 185340 - protein, 54 aa, Glycine max
  Coding DNA Sequence Number=SeqID_68562
MGGIPNSPLSAPKAKCLSNLCKSPRNENTYMCLQVPFAICRLHGFNCLGFCLQN

SEQ ID NO: 185341 - protein, 66 aa, Glycine max
  Coding DNA Sequence Number=SeqID_68563
MAGLPTWAVTPVPMATCSESACLASLNSGMGAVSQLWFRCCQWRYKCTADANDDTSLPPVGMAKST

SEQ ID NO: 185342 - protein, 80 aa, Glycine max
  Coding DNA Sequence Number=SeqID_68564
MEKMFIFFLREKWRMTMECLFIGQQDQLQPYRSKLLNAFKDFSHFTPRQVSTLTIARSCTCANTSILYVQPQVEEHPPKK

SEQ ID NO: 185343 - protein, 133 aa, Glycine max
  Coding DNA Sequence Number=SeqID_68565
  Gene Ontology: Mol. function=N-acetyltransferase activity; Cellular component=intracellular; Biological process=metabolic process
  Homolog annotation: Hit_ID=Q2HRF3; Match level="QueryCoverage=91%, HitCoverage=23%, E-value=6e-66, Identity=93%"; Hit description=SDL-1 protein
MDWIIHLDTDELMHPAGTQEYSLRQLLADVPGNVDMVIFPNYESSVERDDIKEPFSEVSMFKKNYDHLPKDVYFGNYKEATRGNPNYFLTYGNGKSAARIQDHLRPNGAHRWHNYMKTPKYVGPACHSFMIVH

SEQ ID NO: 185344 - protein, 60 aa, Glycine max
  Coding DNA Sequence Number=SeqID_68566
MSKRLQENWARAVEEGPRVLMNLMGKMNEHGWRTHDGVKEADIYVGSSECGPILSGKNIL

SEQ ID NO: 185345 - protein, 54 aa, Glycine max
  Coding DNA Sequence Number=SeqID_68567
MAEESLKEKWMTNNWYIGGCSERTYSHVLPFSEIEECPRASVRDCGKELRQAMR

SEQ ID NO: 185346 - protein, 48 aa, Glycine max
  Coding DNA Sequence Number=SeqID_68568
MAVSGYMLILVKAITPCITCWVVKAQVIKLWKTVNQVNGNAIERLFVS

SEQ ID NO: 185347 - protein, 220 aa, Glycine max
  Coding DNA Sequence Number=SeqID_68569
MFCLRSLSQHIGGYILCGTSRGYIYLGLTENKRGYISCGSVLVEGTSTRFKENKGGFRVDVRVGQPHESAIFTLWDRECYALIKETVTEIKQKMIDMDGVFDARAISEELDHVLGKRLTFRFKLSDDDAFIKFVLSKLPTLQHHDEASPSISMMNEINDVSESQCFSATAESDPTLLGSITSAKCILPLSHSQLDGIPFEDLSSIQLSSTRLGKKHIKIE

SEQ ID NO: 185348 - protein, 77 aa, Glycine max
  Coding DNA Sequence Number=SeqID_68570
MSKHWGAKRILLDYNKGFEYKNGPKETTKSLPMWRSHRANDEEECGGDDDGRDASIDRQITHSVDSDSKANMAEYDE

SEQ ID NO: 185349 - protein, 382 aa, Glycine max
  Coding DNA Sequence Number=SeqID_68571
GYDINNYSFYTKSQDDRSSMQNSEVSVEVDSEHFCSASDNNPIRESMPYFGVIKEIWELDYSEYRVFVFKCQWANRNIDLVVLQGRTSGISYLNNASALDISEMPTFSQGMPSINEEHEVDDELTIDSAKKLDCQKLGSAKANASIAKKMMSTVATRWRQFKSSLTTKYIYAANEESHGREEEVTTTGRYEYWGFSNDCRPSILHCKTCEVEDDPHKVHLGRVHATGIGTTISQYFGQKSLEKTRKEFKEAIKVELFQMSLHHSPPVEADIQLLGAHISTKGSCVEVAANPLGEEPCVVDLHTMGLYVVSDHCTWLMVLGKVYDGMSTTHNISYADDVKPVSHDDSQIPQKKLGEPEERSNIVDVEDSLAELIKNLYKLEAC

SEQ ID NO: 185350 - protein, 81 aa, Glycine max
  Coding DNA Sequence Number=SeqID_68572
MAGLGRLLEEGLKFEKFTLDPYKKFVSQQLHELIAFPEVPEPSNNAKTIVKKKPDTKVTKKDNSEYNSDFSDKQTDEEESD

SEQ ID NO: 185351 - protein, 59 aa, Glycine max
  Coding DNA Sequence Number=SeqID_68573
MNAEASLEVVVFNQQTKAGEPQSGEGDEEAIDEGAFGRNGGGEGAENCGKSRENGRVNS

SEQ ID NO: 185352 - protein, 133 aa, Glycine max
  Coding DNA Sequence Number=SeqID_68574
MDFSTNLGSSLQKLRTWRFLSWIETEASEAGHCQQLEQEQIPKGESPNKELVEKAVEVKKEVEEVLKSTKLKIVGVMERSVTMNEIDRVVNEEDLKGKIKELESKIAQGSNSEDMEKIKVLKRVFLLHWMSQH

SEQ ID NO: 185353 - protein, 153 aa, Glycine max
  Coding DNA Sequence Number=SeqID_68575
  Gene Ontology: Mol. function=triacylglycerol lipase activity; Biological process=lipid metabolic process
  Homolog annotation: Hit_ID=Q1SH82; Match level="QueryCoverage=56%, HitCoverage=18%, E-value=1e-19, Identity=54%"; Hit description =Lipase, class 3
MERQRRRQGKHHESASAALRFATKRHEVEKHVSIVEGRECLSEVQHMRNGTHGVQRHHREREDESPEDAGFFDLPRALFSKNLSHRKLVECHEKGVLDESFGHRWLIFISILTQKFLQLVAKPLVGFGSFVENFLNLGALNGGVSGIVLNFFR

SEQ ID NO: 185354 - protein, 109 aa, Glycine max
  Coding DNA Sequence Number=SeqID_68576
MAPKKLPAKRDRKATTGKGSSAAPQLEIEFDGHQPMAKYDPEIVIEFYANAWPTEEGVMNKRSWVRGQWIPYDEDAINQFLGHPLILEEGQRVNTPKEEAKCQVLMKRP

SEQ ID NO: 185355 - protein, 165 aa, Glycine max
  Coding DNA Sequence Number=SeqID_68577
MALNCSGVGHRSYRSTAPDLYGLLPAGQPNVACSGDASTAGFYCWSCPGCCACLGMQYFSMKDLLMGGRMSFVGETGTPYNWQRPVINVGNPSALLDFFGSTGVSEDSVDQLAFRHWEIKIMVTGKDVVDQKRHPDLGQSGHASAHDPHLPPYHAPCKIQSRGAQ

SEQ ID NO: 185356 - protein, 194 aa, Glycine max
  Coding DNA Sequence Number=SeqID_68578
  Pfam annotation: Domain name=BRF1; Domain location=54-155; Score =19.5; E_value=1.1e-05; Accession=PF07741.3; Description=Brf1-like TBP-binding domain
RHIVEMLNLLAVLQKGRFNPRFYIAAATDNMSLQKAQLLENSLAAEYVHDESETLSDIDDEEVDLYIHDEEGKHIKKILWETANREYLEEQAAKEAAAAASKKAFEAKFENCSEDILAARELAASSTEAVAKSKKEQAAKEVAAAINKKAFEAKFENCSEDILAARELGASSTEAVAKSRKVRGVHVRGYGVHV

SEQ ID NO: 185357 - protein, 61 aa, Glycine max
  Coding DNA Sequence Number=SeqID_68579
  Subcellular localization annotation: CTP_CleavageSite=53; ConfidenceScore=5.14e-01
MLQVTLEDPRLKANHNALPKSIPTLSGTLSFPRFLRPAKSRKRRPVCDKDELRQKEKEEER

SEQ ID NO: 185358 - protein, 80 aa, Glycine max
  Coding DNA Sequence Number=SeqID_68580
MSSSAPFVIQGQRVRWWAEIPYGHPRLSSTERNEFGSIRMMLVVREVKRGNCHTLISSGDHLFGGMRPLLDRFEVLDTHR

SEQ ID NO: 185359 - protein, 92 aa, Glycine max
  Coding DNA Sequence Number=SeqID_68581
  Gene Ontology: Mol. function=triacylglycerol lipase activity; Biological process=lipid metabolic process
  Homolog annotation: Hit_ID=Q1RN82; Match level="QueryCoverage=86%, HitCoverage=18%, E-value=2e-15, Identity=52%"; Hit description =Calmodulin binding heat shock protein
MERQETLARHNEEYKEALQRAKTLDVPHAYTPVSQYGTFDEEGEGSSRRSQGKSSFGSTYRGTVDETWDEMIEHLFDKDELMWPRDNVVAQG

SEQ ID NO: 185360 - protein, 100 aa, Glycine max
  Coding DNA Sequence Number=SeqID_68582
  Gene Ontology: Mol. function=triacylglycerol lipase activity; Biological process=lipid metabolic process
  Homolog annotation: Hit_ID=Q1RN82; Match level="QueryCoverage=80%, HitCoverage=17%, E-value=8e-21, Identity=62%"; Hit description =Calmodulin binding heat shock protein
MPIAKSCILKLTALFLDQDNFLPRTANPLEDIFKSLFCLPCLLCLRCMKDTCIPEEKMLKDPRRLYAPGRLYHIVERKPFRNHQQFKALATIVFPLDGIQ

SEQ ID NO: 185361 - protein, 497 aa, Glycine max
  Coding DNA Sequence Number=SeqID_68583
  Gene Ontology: Mol. function=ubiquitin-protein ligase activity; Cellular component=ubiquitin ligase complex; Biological process =protein amino acid phosphorylation
  Homolog annotation: Hit_ID=Q6YYY2; Match level="QueryCoverage=72%, HitCoverage=93%, E-value=6e-41, Identity=30%"; Hit description =Myosin heavy chain-related-like
MSRLGKLLKNDTCKAMKEEVVGADPKSGVVTLGKMALVERKCINDPQQASTIICNMEQLSQPSFQPHQVSDHLLHSDRVPCIEVILREKQEEELEGKEVEYFKERVERLESEREERNGVMFKALESLTSTKESLSSVIEGLEGEKDETFVENVTGEWSGVESRMLLEEARLISRLAIEVETKVDRYKEMRRKEKRELESSLISLTEENRDVHNLLRIALSEKEALEKRIKGHDHKRMPLLQFGLQKVGFGFMMMGGGNNEQSTEHSGVKSDSSECEEEVISLASTVERIMKNLRLETTQLRRSLEESRSDTERLQCLTEKQAKEIEENKLYIKELEDRERILAQNVEEFFMEIKAAEEEVARWKEACELEVEAGKKEIGERNKVVAALKQELHKTKAALDISNGKLRLKEELAITAIAAQEAAERSLRLADTRAVELRRQVEELTRQLEEAEKHEGNSHKVRRICWPWQVFKMSSSNIASTRVGNAKRMLPEMQALI

SEQ ID NO: 185362 - protein, 64 aa, Glycine max
  Coding DNA Sequence Number=SeqID_68584
MQVAESSVILGWQYIQDISILSGAARSYRAMGGHIVPADDRDIIFDNNLHSIILLPITDPLSNF

SEQ ID NO: 185363 - protein, 345 aa, Glycine max
  Coding DNA Sequence Number=SeqID_68585
  Gene Ontology: Mol. function=histone-lysine N-methyltransferase activity; Cellular component=nucleus; Biological process=chromatin modification
  Homolog annotation: Hit_ID=Q9SRV2; Match level="QueryCoverage=92%, HitCoverage=91%, E-value=3e-75, Identity=47%"; Hit description =Histone-lysine N-methyltransferase SUVR3 (EC 2.1.1.43) (Suppressor of variegation ...
  Homolog annotation: Hit description=3-9-related protein 3) (Su(var)3 -9-related protein 3)
  Pfam annotation: Domain name=Pre-SET; Domain location=65-178; Score =52.9; E_value=1.1e-12; Accession=PF05033.6; Description=Pre-SET motif
  Pfam annotation: Domain name=SET; Domain location=180-324; Score =128.3; E_value=2.1e-35; Accession=PF00856.18; Description=SET domain
  Pfam module annotation: Pfam domain module=Pre-SET::SET; Domain location=65-178::180-324
MVMAEESESVPKKRWSCNAKEEALLVQCAELVLPYLTQSELANVSSTCKSLLKLSRAITLRRASDASRAFETLPVPFLNTIDAHPYAHFLYTRSLLLPSPLPLLPRQPWGSSVISPSSPTHLRAESVGFVDASGRAASGCDCEACAGPTCPCAGLDGMDDVGRECGPGCRCGPECGNRFTRNGLAVKVRIVRDEKKGWGLKADQFIAKGEFLFEYSGELLTTKEAQKRHQHYDELASRGGFSSALLVVREHLPSGKACLRLNIDATRIGNVARFVNHSCDGGNLSTKLVRSSGALFPRLCFFASKDIQVDEELTFSYGEIRKRPNGLPCFCNSPSCFGTLPSENT

SEQ ID NO: 185364 - protein, 534 aa, Glycine max
  Coding DNA Sequence Number=SeqID_68586
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LK11; Match level="QueryCoverage=87%, HitCoverage=94%, E-value=1e-173, Identity=61%"; Hit description=Beta- 1,3-glucanase-like protein
  Pfam annotation: Domain name=Glyco_hydro_17; Domain location=26-347; Score=291.2; E_value=2e-84; Accession=PF00332.9; Description =Glycosyl hydrolases family 17
  Pfam annotation: Domain name=X8; Domain location=368-451; Score =142.2; E_value=1.4e-39; Accession=PF07983.3; Description=X8 domain
  Pfam module annotation: Pfam domain module=Glyco_hydro_17::X8; Domain location=26-347::368-451
MAPNCLHQVAFLLVFLIVVSSGYAWVGVNWGTMATHQLPPEKVVKMLKENGFRKLKLFDADEFIMAALMGTGIEVMVAIPNNMLDKISNSPKAADSWVNDNVTSYLFTGGVKIKYVAVGNEPFLKAYNGSFAKKTLPALKNIQTSLNKAGLGSKIKITVPFNADIYYSPDSNPVPSAGDFRPEVRDLTVEIIQFLYANNAPFTVNIYPFLSLYGNEDFPFDFAFFDGNNKPLRDGKTLYTNVFDANLDTLLWALDKAGYPDMEVMIGEIGWPTDGDKNANAKNAKRFNLGLLKHALSGKGTPKRKGTIDLFLFSLIDEDTKSVAPGNFERHWGIFEFDGKPKYELDLTGQHQQKGLVPVEGIKYMEKRWCILDPDVTNLDDLAGNIDYACTFSDCTSLGYGSTCNNLSVQGNASYAFNMYYQVNNQQNWDCDFSGLAVITHKDPSLNGCQFPVMISSSSSLLLHGGFSDILKKALRIMHYLTEHCNIVELKGAYEDCHSPTSSWSSMMVASSSIRSSPRATTPSAPPPISVARS

SEQ ID NO: 185365 - protein, 690 aa, Glycine max
  Coding DNA Sequence Number=SeqID_68587
  Gene Ontology: Cellular component=chloroplast thylakoid membrane
  Homolog annotation: Hit_ID=Q9FF91; Match level="QueryCoverage=89%, HitCoverage=71%, E-value=5e-89, Identity=34%"; Hit description =Arabidopsis thaliana genomic DNA, chromosome 5, P1 clone:MRO11
  Pfam annotation: Domain name=DUF593; Domain location=514-592; Score= -32.0; E_value=0.087; Accession=PF04576.6; Description=Protein of unknown function, DUF593
  Subcellular localization annotation: CTP_CleavageSite=56; ConfidenceScore=5.08e-01
MEMGRALFPFGSGVVGVGVAGILLLSGLAFAALFVSRRNSARQMKPLTTHQEVLLSSDEIEHINAGNEVDQGNGNVEGRIDVSRDCSSPESDKIPESHRIIDDFNVGSQLVYDIHNKDIDTDATKHKSVQEELKIGSAADEESVPRQSAMVLNGSESENPVDSFDSSTAVDSQNSIAELKENPSFVEPRKVSNFDAEPLPVISEQQDEITDSSGNRSSDEQVKNDNNEVDICRSETPNFGAFYSSPGIPAPSAVSSAVQVLTGKVMVPVAVAQGQALAALQALKVIEPDVQPSDLCTHHEYAQWLVSASSALSRKTISKVYPATYIDNVTGHAFDDITPEDPDFSCTQGLAEAGLIESRLSRCCDRPLSTDEDYGPFYFSPESPSSHQDVVSWKIDLEKRQLPEADRNNLFASNMMIDGQMLCQLSGFIDTDKIHTDACPALVADVSAGEHGIIVLAFAIALAAGNAFDLVNEELACTVASQSVLVVQVEKDINAKREKINAVERMAEEARCELERLRDDREKDRISLIKEQAVIESERNAFSWLRHEVEDQLQNLISDKVKIAYEKDKISKLQELAEVQNKEITQLQYELEVERKALSMARAWAEDEAKRVGEHASDLESASDSWERNESKVAVDDDFHELEAAISKAGKSAQEEQQSAHEFGFTIKEGANRFAGDCRGVEKLTQKFKT

SEQ ID NO: 185366 - protein, 648 aa, Glycine max
  Coding DNA Sequence Number=SeqID_68588
  Gene Ontology: Mol. function=DNA binding; Biological process =regulation of transcription
  Homolog annotation: Hit_ID=Q5NB82; Match level="QueryCoverage=96%, HitCoverage=64%, E-value=1e-162, Identity=50%"; Hit description =Nodule inception protein-like
  Pfam annotation: Domain name=RWP-RK; Domain location=618-648; Score= -4.4; E_value=0.069; Accession=PF02042.6; Description=RWP-RK domain
MPESEEENQDYVPRSKPSEEAGGGCTMDFDLDLETSWPLDHMAFGSNPMSPFLFSTSSDQPYSPLWAFSDGEDPKLPASAFSDCHKIFSCDSNSIAEKPVENDDNKKLLPPLVPISPVENLDGYCVIKERMTQALRYFKELTELNVLAQVWAPVKNGNRYVLTTSGQPFVLDPHSNGLYQYRTVSLMYMFSVDGENDGSLGLPGRVFQQKLPEWTPNVLYYSSKEYPRRDHAQHYNVRGTLALPVFEPSIQSCVGVLELIMTSQKINYAPEVDKICKALEIHQSPAVSFLADSKFEEFGNFGSSTHSGYIAVVLYLTLYSHRYNLVMLLNQICNEGRQNALSEILEILTVVCETHNLPLAQTWIPCKHRSVLAQGGGVKKSCSSFDGRCMGKVCMSTTDIAFYIIDAHLWGFREACVEHHLQQGQGVAGRAFLSHGMCFCSNITQFYKTDYPLVHYALMFGLTSCFAICLRSSHTGNDDYVLEFFLPPRITHIHEQKTLLGSILAIMKQHFQSLHIASGVEPEDGSIEIIEATIERVHTRLESIPIASSIKSPPRPDTSPNMGEEVPQDPSEQQILMYCNDINNGGSLGENAARNIDHMPSLETKNINKPLERKRGKTEKSISLEVLQRYFAGSLKDAAKSLGGMFIL

SEQ ID NO: 185367 - protein, 143 aa, Glycine max
  Coding DNA Sequence Number=SeqID_68589
  Homolog annotation: Hit_ID=Q2HTK4; Match level="QueryCoverage=49%, HitCoverage=8%, E-value=1e-11, Identity=49%"; Hit description =Protein kinase; U box
MSAKDMCWSTSVRVRRKERKLHALFWFWLLFLAYNCSTDRNLSGYEPKDHAIKAFQEHGNQKVHELLDQYILTLVPAGVRAYKLLIEMDDIEKGITKAIAQHNIRWLVMGAAAADGYNLGYQFQTSVALILIYVAQMQYVDQI

SEQ ID NO: 185368 - protein, 120 aa, Glycine max
  Coding DNA Sequence Number=SeqID_68590
  Gene Ontology: Mol. function=oxidoreductase activity; Biological process=metabolic process
  Homolog annotation: Hit_ID=Q6RVV4; Match level="QueryCoverage=62%, HitCoverage=23%, E-value=9e-20, Identity=67%"; Hit description=Short- chain dehydrogenase Tic32
MPCSILLLTSVHDQVLYQLALLNIEYRHVEEHLEHSCEALLIITRINCYINSCLTKAIARLLLKNVQQGAATTCYVALHPQVKEISGKYFSASSVAKTTSQGTDADLAKKLRDFSMNLTK

SEQ ID NO: 185369 - protein, 117 aa, Glycine max
  Coding DNA Sequence Number=SeqID_68591
  Gene Ontology: Mol. function=oxidoreductase activity; Cellular component=mitochondrion; Biological process=metabolic process
  Homolog annotation: Hit_ID=Q6RVV4; Match level="QueryCoverage=70%, HitCoverage=26%, E-value=1e-29, Identity=79%"; Hit description=Short- chain dehydrogenase Tic32
MWYPDIMVTGASSGIGAETTRVLSLHGVHVIMGVKNMFAAKDVKETILKEIPSAKVDAMELDLCSMESVKKFASDFKSSGLPLNILVLNGEREGWGNILALAEVSRECRPCDSYLSD

SEQ ID NO: 185370 - protein, 351 aa, Glycine max
  Coding DNA Sequence Number=SeqID_68592
  Gene Ontology: Mol. function=oxidoreductase activity; Cellular component=integral to membrane; Biological process=metabolic process
  Homolog annotation: Hit_ID=Q6RVV4; Match level="QueryCoverage=99%, HitCoverage=88%, E-value=3e-72, Identity=82%"; Hit description=Short- chain dehydrogenase Tic32
  Pfam annotation: Domain name=adh_short; Domain location=2-149; Score=- 12.9; E_value=3.9e-05; Accession=PF00106.15; Description=short chain dehydrogenase
MVTGASSGIGTETTRVLALRGVHVIMGVRNMLAAKDVKETILKEIPSAKVDAMELDLSSMKSVRKFASEFKSSGLPLNILINNAGIMACPFSLSKDKIELQFATNHIGHFLLTNLLLDTIKKTSRESKKEGRIVNVSSEAHRFAYSEGICFDKINDESRFSVSIGEYARSDAKNLLIGFSAHGYNCRPILMYILVAFSRIKNGDMIFVLLAERRSGVYLITLACLQLKRYNNWRAYGQSKLANILHANELTRRLKEDGVDISANSLHPGTITTNLFRHNSAVNGLINVIGRLVLKNVQQGAATTCYVALHPQVKGISGKYFSDSNLAKTTAQGTDSDLAKKLWDFSMDLTK

SEQ ID NO: 185371 - protein, 355 aa, Glycine max
  Coding DNA Sequence Number=SeqID_68593
  Gene Ontology: Mol. function=cysteine-type peptidase activity; Biological process=proteolysis
  Homolog annotation: Hit_ID=Q01CI2; Match level="QueryCoverage=55%, HitCoverage=31%, E-value=2e-09, Identity=27%"; Hit description=[O] KOG0779 Protease
  Pfam annotation: Domain name=Peptidase_C48; Domain location=119-328; Score=10.4; E_value=9.5e-05; Accession=PF02902.9; Description=Ulp1 protease family, C-terminal catalytic domain
MGRKRKNRSNSATDSEPIPVLYQYQYLYLRYFNISIMSVYSTAGSIPEAAPSEAIEPSSSAIRGSENRVPVPLDTSNSQEVKKAVDKKSLSMLNKLYYFCTRRPKAHEELSVLVSMFGVYLNRKDGYTMKPKGWVNDMVILAAGKIMMEEEKATNGVVTRHMFSPQFVNKVICDLNQSNEDSYKPWCIEDVSLFILPSKLGYDINQCKLIFAPTLFEEHWSCYAFEPKDKILYVLDSMHDKFSTRKKNLDDAMKRRFEELLVLMNPGLTKENASITLLRVDVPRQQNIHDCGIYVLKYMEIWDGSIKWQDKTMPDYQRKEILKFRQSLICGWVQHPKNEVREELLKAAGLWGKLC

SEQ ID NO: 185372 - protein, 725 aa, Glycine max
  Coding DNA Sequence Number=SeqID_68594
  Gene Ontology: Mol. function=protein serine/threonine kinase activity; Biological process=protein amino acid phosphorylation
  Homolog annotation: Hit_ID=Q1T627; Match level="QueryCoverage=100%, HitCoverage=77%, E-value=0.0, Identity=67%"; Hit description=Protein kinase
  Pfam annotation: Domain name=Pkinase; Domain location=400-696; Score =280.5; E_value=3.3e-81; Accession=PF00069.15; Description=Protein kinase domain
  Pfam annotation: Domain name=Pkinase_Tyr; Domain location=400-696; Score=128.8; E_value=1.5e-35; Accession=PF07714.7; Description =Protein tyrosine kinase
  Pfam module annotation: Pfam domain module=Pkinase::Pkinase_Tyr; Domain location=400-696::400-696
MLTWWGKSSSKETKKKANKESFFDTLHRKLRISSKGKVSIRSGGSRRHCNDTISEKGDHSPCGSRSPSPSKVARCQSFIDRPHAQPLPLPGLHPSSVGRVDSEISISSKSRLEKVSKPLSFLTLPTPGCIRCRPNPADLDGDMVTASVFSDCSADSDEPADSHNRSPLAIDCETGTRTAAGSPSSLMLKDQPPAVSQLNSTGVKKPGNILSNHMSSTSPKRRPLRNHVPNLQVPPHGAFYSAPDSSLSSPSRSPLRAFGTDQVLNSAFLAGKPYPEINFVGSGHCSSPGSGHNSGHNSMGGDMSGPLLWQPSRGSPEYSPVPSPRMTSPGPSSRIQSGAVTPIHPKAGGTPTESQTHRLPLPPLSVSNSSLFSHSNSAATSPSMPRSPARADNPNSGSRWKKGKLLGSGSFGHVYLGFNSERGEMCAVKEVTLFSDDPKSMESAKQFMQEIHLLSRLQHPNIVQYYGSETISSYCIFVSGGLSDNIEVGISQRYLLLWFLIEASKSPLEQVDNKLYIYLEYVSGGSIHKLLREYGQFGELVIRSYTQQILSGLAYLHAKNTLHRDIKGANILVDPTGRVKLADFGMAKHITGQSCPLSFKGTPYWMAPEVIKNSNGCNLAVDIWSLGCTVLEMATTKPPWFQYEGVAAMFKIGNSKELPTIPDHLSNEGKDFVRKCLQRNPHDRPSASELLDHPFVKNAAPLERPIPAPEALDPVSGITQGAKAL

SEQ ID NO: 185373 - protein, 1063 aa, Glycine max
  Coding DNA Sequence Number=SeqID_68595
  Gene Ontology: Mol. function=methyltransferase activity; Cellular component=nucleus; Biological process=nucleobase, nucleoside, nucleotide and nucleic acid metabolic process
  Homolog annotation: Hit_ID=Q1T631; Match level="QueryCoverage=98%, HitCoverage=99%, E-value=0.0, Identity=63%"; Hit description=MT-A70
  Pfam annotation: Domain name=MT-A70; Domain location=765-908; Score =144.1; E_value=3.8e-40; Accession=PF05063.5; Description=MT-A70
MDSSDSGRGYSKRERDDEDWEFSDKRKDRSRKFGANGGDEGEGSDGSARRKRSSRTTTDGDDYDSRSKQVAKKRLEESTLEKLSSWYEDGELDDKAARKRGGDGEFHESVVCKEDGKGEGGGGGGGREKGGHEGKSSRRKWDEVDVGSVRKVQDEKVDLRSGKHDSSRDRERGGSARSEHGESKTSGGGDRVVKSTSKEDRRGDSERGKSKGKSDSGDVGREERVEKPRHHRAAAGYDVAETWDRSLNAEEDGHVRVRDKSTRESGNSNRSRTPEKSGKRHQDLENSEVDYERSSSFKRKEHEGDGYKDDRSKGKDDTWNDRRKDRESSKESWKRRQPSNTDKDSKNEESAFDDNRDWELPRHGYERMDNERPHGRFGGRKDVSRGEAVKTSTKFGISNDNYDVIEIQTKFYDYGKSESMSNHTKRTETHQQYIAKSGANDEEWAYHQDERGRKSDLSGSGTPGEDLKERYADDDYDFYGGRGRGQKGGVSARGTGGQSSSTGGSQPQYGNPESGSFNRAGAQGIKGNRVGRGGRIRPTGRDNQQVGIPLPMMGSPYGPLGMPPPGAMQPLSHGISPAPGPPISPGVFMSPFTPGVWPGARGVDMNIIGVPPAVSPVPPGPRFNAANIGNPPNPVMYYNQSGPGRVMPPSICTPGFNPTGSIGRGAPPDKAPGGWAPPKSSGTLGKAPSRGEQNDYSQNFVDTGLRPQNFIRELELTNVVEDYPKLRELIQKKDEIVEKSASAPMYYKCDLKEFELSPEFFGTKFDVILVDPPWEEYVHRAPGVADHMEYWTFEEIMNLKIEAIADTPSFIFLWVGDGVGLEQGRQCLKKEHCLMGIKGTVRRSTDGHIIHANIDTDVIIAEEPPYGSTQKPEDMYRIIEHFALGRRRLELFGEDHNIRAGWLTVGKELSSSNFNKEAYVKSFADKDGKVWQGGGGRNPPPEAPHLVVTTPDIEALRPKSPMKNQQQLQQQNSVSISLTSASASNRRPAGNSPQNTTALGVNQDASSSNPSTPAPWGSPLEGFKGREGSVLPSDDKVMDMYGFHGPASANYLDFESYRQMNLL

SEQ ID NO: 185374 - protein, 266 aa, Glycine max
  Coding DNA Sequence Number=SeqID_68596
  Gene Ontology: Mol. function=protein translocase activity; Cellular component=integral to membrane; Biological process=protein transport
  Homolog annotation: Hit_ID=Q1T630; Match level="QueryCoverage=93%, HitCoverage=95%, E-value=5e-70, Identity=59%"; Hit description =Bacterial sec-independent translocation protein mttA/Hcf106
  Pfam annotation: Domain name=MttA_Hcf106; Domain location=77-178; Score=81.9; E_value=2e-21; Accession=PF02416.7; Description =mttAHcf106 family
  Subcellular localization annotation: CTP_CleavageSite=22; ConfidenceScore=5.17e-01
MASSSMSCPKLGNCAVSHTKFQAFHLSSMFSPLDRGLFSPWSGLKHLGISAKPKPLLHIDRKGGCKGKVVYASLFGVGAPEALVIGVVALLVFGPKGLAEAKLTGNVYNRGFDFVGLDKVARNLGKTLRAFQPTIRELQDVSREFKSTLEREIGLDDNLSPTQNTYNSNVRNTTPTSSSTVDPNGTLDPTKAYSSEEYLKITEEQLKASAAQQQGQTPPKEGENGPQIQPPAEETATTVPPPLKPESTTIGTRDEKGQAILLPGSH

SEQ ID NO: 185375 - protein, 257 aa, Glycine max
  Coding DNA Sequence Number=SeqID_68597
  Gene Ontology: Mol. function=transferase activity, transferring hexosyl groups; Cellular component=integral to membrane; Biological process=metabolic process
  Homolog annotation: Hit_ID=Q1S2F4; Match level="QueryCoverage=93%, HitCoverage=70%, E-value=1e-35, Identity=33%"; Hit description=UDP -glucose glucosyltransferase
MEALFILQGQFQQLFHDMQPDFIVTDMFYPWTADAAADLGIPRLVYVGGASYVAHWAMNCVEQFALQTKGAYEEHYKKVMCTKSWSIGPVSLWVNQDDSDKACRGHAKEEGKGKEEGLLTWLDSKKRGICSLHSGHDFIWVVRKIDEGATRVFLEEFEKRVQESSKGYLIWGWAPQLVILEHPVTGGVVTHCGINTVFESVIASLPMAKEWRNLNEFGSEEGGHRKGYCFVDGWREEYVEIRRRVKTLSDATKKTIQ

SEQ ID NO: 185376 - protein, 121 aa, Glycine max
  Coding DNA Sequence Number=SeqID_68598
MTVWKKLELKIQGLESGTIDRVKCLINVKIPKSDTMLDARGIGEAQTATESAKNGSGKPSGKGTVNNLDPSYLKKKSKLQVGCMLGNSISRNHTKEGSELLVIKYNTHKEVERIWESYQRR

SEQ ID NO: 185377 - protein, 253 aa, Glycine max
  Coding DNA Sequence Number=SeqID_68599
  Gene Ontology: Mol. function=triacylglycerol lipase activity; Biological process=lipid metabolic process
  Homolog annotation: Hit_ID=Q1SH82; Match level="QueryCoverage=95%, HitCoverage=52%, E-value=1e-108, Identity=75%"; Hit description =Lipase, class 3
  Pfam annotation: Domain name=Lipase_3; Domain location=71-232; Score =119.0; E_value=1.4e-32; Accession=PF01764.16; Description=Lipase (class 3)
MDDVVRREDSKYYPALSMMASKASYNNEAYLKTTVENYWKMEFVKFSMYQGKPTTQVLIALDKHEDRHTYVVAFRGTEPFEADAWCTDLDISWYGIPGVGRMHGGFMKALGLQKNVGWPKEIERDENLPPLAYYVIRDILRKGLSENDKAKFIVTGHSLGGALAILFGTILCLHNETLLLERLEGIYTFRQPRVGDGAYANYMRQKFKEHHVRYCRFVYCNELVPRLPYDDKEMMFKHFGTCLFFGTCPMNSR

SEQ ID NO: 185378 - protein, 132 aa, Glycine max
  Coding DNA Sequence Number=SeqID_68600
MSHFIVSDIVATRQVATVTTRHLVYSFGTGFNTMFFELGDEGLVYDVSIVCINFVFTIACFLWNSRSEGITPTTTNFQALMMPSTSRHLQAQCSSQTERDISSEEMEEYRELLRQLESMSKEESDDSPDNMP

SEQ ID NO: 185379 - protein, 58 aa, Glycine max
  Coding DNA Sequence Number=SeqID_68601
MMGEKKEFPKEEFSSFRFAGVDLGLHTRAKLALLAECSCLYSRLALVHVFVLSMPHRA

SEQ ID NO: 185380 - protein, 56 aa, Glycine max
  Coding DNA Sequence Number=SeqID_68602
MDRLFTKNLVFISEVPLQYPCGTCHAKATLWVTCSQEKIQKDLTFLRDVASTDSSM

SEQ ID NO: 185381 - protein, 78 aa, Glycine max
  Coding DNA Sequence Number=SeqID_68603
MCEYHSVRGQSLHLRDEIYGEVWWFFVGGEEEMDEEQWRYDIVMSEEVDMNVENKKDAGVKVEYVDCSDVFNTSYIFV

SEQ ID NO: 185382 - protein, 94 aa, Glycine max
  Coding DNA Sequence Number=SeqID_68604
MDKDTLRYSEQRGSKNLGEFASGDYPTFGALIWYGLEEPHHDLEFLLTLVEYDRWGNIHRYIMEQVHPMEVTKDQGDHSDMSSEEIEEYRVFLR

SEQ ID NO: 185383 - protein, 87 aa, Glycine max
  Coding DNA Sequence Number=SeqID_68605
MASNSEEVNCHTVASNPPHGLPQGYTPHVANNPNTFIFAPPDQTQTQEPETNSPDSLMGGRSELVYEPRASMNSHMERLGKGFLETI

SEQ ID NO: 185384 - protein, 423 aa, Glycine max
  Coding DNA Sequence Number=SeqID_68606
  Gene Ontology: Mol. function=triacylglycerol lipase activity; Biological process=lipid metabolic process
  Homolog annotation: Hit_ID=Q1SH82; Match level="QueryCoverage=82%, HitCoverage=81%, E-value=1e-136, Identity=63%"; Hit description =Lipase, class 3
  Pfam annotation: Domain name=Lipase_3; Domain location=208-336; Score= 64.7; E_value=3e-16; Accession=PF01764.16; Description=Lipase (class 3)
MATDCNCNKGFADSYMLLKPEDASFFDLFRVLFKGNLSQRNFVESHADDDALDESLGHRWLIVISILAQKLLQLVAKPLSLFGSCVEFLLNLVALNGGVFSIVLNFLGGKLVLPNPESENYLSFIGNLDIRAKLEDAVQREDSKYYPALSMMASKACYNNAAYLKTTVEDYWKMEFVGFYNCLNEYQGKTTTQVLIALDKHEDRHTYVVAFRGTEAFDADAWCTDLDISWYGIPGVGRMHGGFMKALGLKQNVGWPKEIGEQDENLPPLAYYVIRDILRKGLSENDKANFIVTGHSLGGALAILFGTILCLHDETLLLERFVYCNDLVPRLPYDDKEMMFKHFGTCLFFNRRYELEEHRCCSDRFQRRVSFGPDVVSEIYKDGWKMHPLLLLKISTSGLRTPVIVEGRYKDGSWNDRRCWRTL

SEQ ID NO: 185385 - protein, 46 aa, Glycine max
  Coding DNA Sequence Number=SeqID_68607
MERHLRMRRNAILAMQHKSGVRPSVFDKTSKGPPFGCDTLYPNMKM

SEQ ID NO: 185386 - protein, 166 aa, Glycine max
  Coding DNA Sequence Number=SeqID_68608
MLRNARERREDIKETDRNGIVIHRRKNASKARQRIRGMEAGEESVGIDVSEEDQARERNGGEEEGGGDGAPEGDGFGLPKHVGGGITGGKAVRRRPLAAARERSCYRYGCGLNEQEWKCVSELKRLEIRGKRLNTPPSVFVQQFPSIRLLKGIIYNQSFSAHSISW

SEQ ID NO: 185387 - protein, 52 aa, Glycine max
  Coding DNA Sequence Number=SeqID_68609
MAALILVGFIFTLVANGGGDSTRSLVMPSLAIPKMDGDMASFSALMRMGQGW

SEQ ID NO: 185388 - protein, 345 aa, Glycine max
  Coding DNA Sequence Number=SeqID_68610
  Gene Ontology: Mol. function=drug transporter activity; Cellular component=membrane; Biological process=multidrug transport
  Homolog annotation: Hit_ID=Q1T635; Match level="QueryCoverage=100%, HitCoverage=68%, E-value=1e-163, Identity=81%"; Hit description =Multi antimicrobial extrusion protein MatE
  Pfam annotation: Domain name=MatE; Domain location=1-113; Score=20.1; E_value=0.00016; Accession=PF01554.9; Description=MatE
  Pfam annotation: Domain name=MatE; Domain location=172-335; Score =120.2; E_value=5.8e-33; Accession=PF01554.9; Description=MatE
  Pfam module annotation: Pfam domain module=MatE::MatE; Domain location=1-113::172-335
MGSATETLCGQAFGAGQVNMLGVYMQRSWVILSVTSILLLPIYIFAAPILKLLGQQEDIADLAGSFSILVIPQFLSLPFNFPTQKFLQAQSKVKVIAWIGLVALILHIGMLWFLIYVLDFGLAGAALAFDITSWGITVAQLVYVVIWCKDGWNGLSWLAFKDIWAFVRLSLASAVMLCLEVWYMMSVIVLAGHLDNAVIAVDSLSICMNINGWEAMLFIGVNAAVSVRVSNELGLGHPRAAKYSVYVIVFQSLFLGIFFMAIILATRDYYAIIFTNSEVLHKAVAKLGYLLSVTMVLNSVQPVVSGVAIGGGWQALVAYINIGCYYLFGLPLGFVLGYTVYLGVE

SEQ ID NO: 185389 - protein, 320 aa, Glycine max
  Coding DNA Sequence Number=SeqID_68611
  Gene Ontology: Mol. function=DNA binding; Biological process =regulation of transcription
  Homolog annotation: Hit_ID=Q8LFS2; Match level="QueryCoverage=87%, HitCoverage=76%, E-value=8e-95, Identity=57%"; Hit description =Regulatory protein
MGKQTSNEYPLEKILNEAAMKDRTVILTTLNEAWAAPNSVIDLFLESFRIGDRTSTFLDHLVIIALDQKAFARCQVIHTYCFSLVSEEADFHEEAYFMTPRYLMMMWKRIDFLRTVLEMGYNFVFTDADIMWFRDPFPLFHLDADFQIACDHFTGRFDDVQNRPNGGFNYVKSNNRSIEFYKFWYSSRETYPGYHDQDVLNFIKVHPFITDIGLKMRFLDTTNFGGLCEPSRDLNQVCTMHANCCLGMDSKLHDLRIMLQDWKHYLSLPTSLKRLSVVSWRVPQKCSGTIFRSSKVNTHRAFLSSLNEVQKRRRIVKTRK

SEQ ID NO: 185390 - protein, 105 aa, Glycine max
  Coding DNA Sequence Number=SeqID_68612
MLLGREWVHEVGVVSSTVHQKLFFWNEDGKLEMVEVDQSSYGIYTTFASEGDEAMARTSLFEIEDSFYVNNKSGDEKDKFFCWDVNRGFLPINKAVEKTTKVEEP

SEQ ID NO: 185391 - protein, 66 aa, Glycine max
  Coding DNA Sequence Number=SeqID_68613
MSGLNRELMEHILPICEGKTNVFETLFRLKNEVEFRWEKEHQEAFDDIKKYLVNPPIPMPPGKEKT

SEQ ID NO: 185392 - protein, 124 aa, Glycine max
  Coding DNA Sequence Number=SeqID_68614
PIPLKLLRPQGLTLSLALSRTLESNQFPLLNDPNKACIYVIKLSIPGSLLNNKEKNKMKDCKNTSGEDVSFTSRISQSLTNSSQALKSAPASSSGLCRSSHSKISQNSWNLDLSLFRNPRHAKL

SEQ ID NO: 185393 - protein, 110 aa, Glycine max
  Coding DNA Sequence Number=SeqID_68615
  Homolog annotation: Hit_ID=Q9LKZ5; Match level="QueryCoverage=61%, HitCoverage=6%, E-value=2e-14, Identity=72%"; Hit description =Receptor-like protein kinase 2
MTTSFCGDVLGTTVAYTRVPAIPGEGFRRSERVEKEREEWGRRICLRRGRGWRGMGGGQRVDKEHVGEVQVGVVEGGDMVTIVIGDTEPRAIRDGGISQRENEWCGVGND

SEQ ID NO: 185394 - protein, 597 aa, Glycine max
  Coding DNA Sequence Number=SeqID_68616
  Gene Ontology: Mol. function=zinc ion binding; Cellular component =endoplasmic reticulum; Biological process=ER to Golgi vesicle -mediated transport
  Homolog annotation: Hit_ID=Q9M291; Match level="QueryCoverage=98%, HitCoverage=55%, E-value=0.0, Identity=69%"; Hit description=Protein transport protein Sec24-like CEF
  Pfam annotation: Domain name=Gelsolin; Domain location=497-567; Score= 48.4; E_value=2.5e-11; Accession=PF00626.12; Description=Gelsolin repeat
  Pfam annotation: Domain name=Sec23_BS; Domain location=267-367; Score= 118.6; E_value=1.8e-32; Accession=PF08033.2; Description=Sec23Sec24 beta-sandwich domain
  Pfam annotation: Domain name=Sec23_helical; Domain location=379-480; Score=119.9; E_value=7.1e-33; Accession=PF04815.5; Description =Sec23Sec24 helical domain
  Pfam annotation: Domain name=Sec23_trunk; Domain location=51-265; Score=284.5; E_value=2e-82; Accession=PF04811.5; Description =Sec23Sec24 trunk domain
  Pfam module annotation: Pfam domain module=Gelsolin::Sec23_BS::Sec23 _helical::Sec23_trunk; Domain location=497-567::267-367::379-480::51 -265
MSVTGFSDETPRDYHCNLGPDGRRRDADERPELCRGTVEFVATKEFMVRDPMPAVYFFLIDVSMNAVQTGATAAACSAITRVIKDKDLPEGPRTLVGVATFDSTIHFYNLKRALQQPLMLIVPDVQDVYTPLQTDVIVPLSEAAFLAMKDTGGKLLVFQSVLPSIGIGALSAREAEGRTNISAGEKEAHKLLQPADKAFKELAVEFAEYQVCVDVFVTTQTYVDIASISAIPRTTGGQVYYYYPFSALSDTAKLYNDLRWNITRPQGFEAVMRVRCSQGIQVQEYYGNFCKRIPTDVDLPGIDCDKTFMVTLKHDDKLQDGSECAIQVFGRFTARVYSKGFMICALLYTTVYGQRRIRVITLSLPVTSMLSNLFRAADLDTQFCCFLKQAASEIPSKPLPLVREQVTNLCINALFSYRKFCATVSSSGQLILPEALKLLPLYTLALTKSTGLRTEGKIDERSFWINYVSSISAPLAIPLVYPRMMAIHDLDSKEDDDSVIPPFLPLSSEHISDDGIYLLENGHDCLIYVGDSVNPDIVQKLFGVATVDKVPTLQYDNPLSKKLNEVVNEIRRQRCSYFRFKLCRKGDPSGQCIRMIV

SEQ ID NO: 185395 - protein, 110 aa, Glycine max
  Coding DNA Sequence Number=SeqID_68617
MTSTVTTTIEIPIVITVIMVVTSGCSDVDGGDVVLVVTISGDDNDSDKSGDIDDNGGDGDSNNDSVGGDTIDGDCGNVDGDCGDDNDDDNVGDIDGGNVDNDDGDSSNQL

SEQ ID NO: 185396 - protein, 176 aa, Glycine max
  Coding DNA Sequence Number=SeqID_68618
TVEASGNRLPVYVIDYTEEWVTGNRLHIAGNRLHSAFFRFSCPEAIVMAAQLIHDRVEMECLEGAWETLEGNARCRFRGTIRFTATSLVHPDEPARTLQRTVEWILPMPTPYRLVEPIQVIEVTSSEEDPEEDLEELPPEPVVDALDFLEGDEDPLPEVDSPEDVMSASEADSTED

SEQ ID NO: 185397 - protein, 379 aa, Glycine max
  Coding DNA Sequence Number=SeqID_68619
  Gene Ontology: Mol. function=transcription factor activity; Cellular component=cytoplasm; Biological process=regulation of transcription
  Homolog annotation: Hit_ID=Q1S895; Match level="QueryCoverage=86%, HitCoverage=50%, E-value=1e-108, Identity=59%"; Hit description=GRAS transcription factor
  Pfam annotation: Domain name=GRAS; Domain location=3-290; Score =192.4; E_value=1.1e-54; Accession=PF03514.5; Description=GRAS family transcription factor
  Subcellular localization annotation: CTP_CleavageSite=60; ConfidenceScore=5.01e-01
MVTHNTKPNHSAETHVFVSHFLYDVVQLLRGIHQFQTVPNGGRDRNFRRQNSDQRFVNCMVSALKSRMNHVECPPPVAELFSIEHAESTQLLFEHSLFFKVARMVANIAILESALTENGKLCVLDFDIGDGNQYVSLLHELSARRKGAPSAVKIVAVAENGADERLNSVGLLLGRHAEKLGIGFEFKVLIRRIAELTRESLDCDADEALAVNFAYKLYRMPDESVSTENPRDELLRRVKALAPRVVTLVEQEANANTAPFVARVSELCAYYGALFDSLESTMARENSARVRIEEGLSRKVGNSVACEGRNRVERCEVFGKWRARMSMAGFRLKPLSQRVAESIKARLGGAGNRVAVKVENGGICFGWMGRTLTVASAWC

SEQ ID NO: 185398 - protein, 44 aa, Glycine max
  Coding DNA Sequence Number=SeqID_68620
MDETGEKLECEGRRNMSAKTSACERRVGRKGSNGSLFGSDQQRD

SEQ ID NO: 185399 - protein, 89 aa, Glycine max
  Coding DNA Sequence Number=SeqID_68621
MKNLRSQKENNDLVEKEHKTNSSSDSSISLFIMDPGRTNEVKDAGFPSWVDNHTLYFHRRGRGDTATVFFLASSHTIFLYLTFKVRLVL

SEQ ID NO: 185400 - protein, 76 aa, Glycine max
  Coding DNA Sequence Number=SeqID_68622
MYETWAPSMHLPWIISAIPSWVGIALSAPLALRDTSKVVIFKIPMVRLWKNVLGSSRQNLKMIQRLKNPGITILLK

SEQ ID NO: 185401 - protein, 166 aa, Glycine max
  Coding DNA Sequence Number=SeqID_68623
MGGAVTLLDIPGGGNKVVMWDATLFGLFNEDFPLYIKHEDLSEIAHGGQCLNISITQLHMTRTSMRAGNADVYGYLEPQSIQRFDQSQFESKSYLKNWMQNSKRDAYLGAYLNGAHWQMVVILPNENVVIWFCSLHNRPDNYLKGIINSALKGLDDTQQSKSKPTA

SEQ ID NO: 185402 - protein, 48 aa, Glycine max
  Coding DNA Sequence Number=SeqID_68624
APGCPALVVAPAAGAPPVVPDPWALPKAPASGALPLCATCHVVGGALQ

SEQ ID NO: 185403 - protein, 1084 aa, Glycine max
  Coding DNA Sequence Number=SeqID_68625
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=93%, HitCoverage=65%, E-value=0.0, Identity=41%"; Hit description=Chromo
  Pfam annotation: Domain name=RVP_2; Domain location=129-261; Score= -29.6; E_value=0.0002; Accession=PF08284.2; Description=Retroviral aspartyl protease
  Pfam annotation: Domain name=rve; Domain location=890-1043; Score =40.1; E_value=7.8e-09; Accession=PF00665.16; Description=Integrase core domain
  Pfam annotation: Domain name=zf-H2C2; Domain location=841-883; Score =7.2; E_value=0.04; Accession=PF09337.1; Description=His(2)-Cys(2) zinc finger
  Pfam module annotation: Pfam domain module=RVP_2::RVT_1::rve::zf -H2C2; Domain location=129-261::387-556::890-1043::841-883
LSPEIKREVLALQPISLPQATALAKLQEDKLRDRRSASSRPFNPPPPSNNPSNPSPKPRQPFVQRTPEEMAFRRDKGLCYNCDDKWHSGHRCKGKIQLFIVENSASDLTEPDTVDTSDITEPVSDDPETHSSHVSLHALSGLSSPETFRLYGTVNHARLTILIDSGSTHNFLQPRVAQFLHLPTKPTLPLRVLVGNGSVLDCNQVCPNTQLSLQGHTFEITFHLLPISGADAVLGIEWLKQFGPITTDYSTSLMKFTHSGHDIELHADVETGPEPASASQIKRLVRIGSTSALFHLSILTASPTEPPPSSLSHPIPAINTLLHQYQKLFQPPSTLPPPRQVTHHINLLPGTSPINVRPYRYPHYQKSEIERQVSELLSSGLIRPSTSPYSSPVLLVKKKDGTWRLCVDYRALNTTTVRDRFPIPTIDELLDELGSASWFSKLDLRQGFHQISMHGPDIEKTAFKTHHGHYEYLVMPFGLSNAPSTFQAAMNGLLQPFLRRFAAVFFDDILVYSDPLQAHIEHLQDIFKALLRDQFYLKQNKCLFAQRKLEYLGHLVSGNGVEPEPSKVQAMTQWPTPLSAKDLRAFLGLTGFYRKFIQHYASIAAPLTTLLCKDAFEWSLTAQTAFDQLKRAMTSAPVLALPNFAEPFVVESDASATAMGAVLLQQGRPIAFFSKLFNPRLLLASTYIRELHAIVAAVRKWRQYLLGRPFTIMTDHKSLKELMTQVIQTPEQHYYLSKLLGFDYTIQYKAGNTNIVADALSRIPPDSGQMLLLSVPHLDFMDDIRRTLHDNPEFQQLLSRVRSNPSDHPGFRIHRDLILFNGRIWLNRDNPSIPSLLLEHHSTPLGGHLGVTKTTHRLETSFFWTGLCHDVKQFIRECKGSCNHYRYRQGSGRTCQWISSPICHHRMDSRLSWSLWIDTRRQHISEPYPPTSQPSRWRPSSLISSASTTAFPTSIVSDRDPIFLSSFWRELFRLSGTRLRMSTAYHPESDGQTEVMNRVLEQYLCAFTHSQPSSWFRFLSLAEWSYNTSLHSSSKLTPFEVVYGKAPPSVPHYIPGMTNNEAVESLISSRQQLHTKLQHRLRKA

SEQ ID NO: 185404 - protein, 138 aa, Glycine max
  Coding DNA Sequence Number=SeqID_68626
MADHTTRKTTTDRLEEAIARLTSSQTSLSNKYSDLAGKVDSILDHLRLRETSHNQPNSNPSFNHRHSIKHDIPRFDGRDPLGWIFKIQQMFDYQNTPEEERITVASFYLDGAALSWYQWMFSNGFITSWTGFLQALES

SEQ ID NO: 185405 - protein, 192 aa, Glycine max
  Coding DNA Sequence Number=SeqID_68627
  Gene Ontology: Mol. function=two-component response regulator activity; Cellular component=integral to membrane; Biological process=two-component signal transduction system (phosphorelay)
  Homolog annotation: Hit_ID=P23890; Match level="QueryCoverage=98%, HitCoverage=37%, E-value=2e-57, Identity=56%"; Hit description =Transcriptional activator cadC
MQSVLAGAKIECGNIRIRRQMILPLHFIHFPQQHIIQPRHLQFNPQIDRPVRLVNAPLRQCIYRQNLLHDWRVFQFGDGRQMTDIGAQLRQGLAVERLIRIAQQVHQRFFRQQVVEVRRAFNQLAQLGAGAGQRIGVAVDQQLMRLVEALQQRPVVGQQLRQTLLQLWRPGLLQRCGQAGEEVGLDLQLVIG

SEQ ID NO: 185406 - protein, 569 aa, Glycine max
  Coding DNA Sequence Number=SeqID_68628
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9M069; Match level="QueryCoverage=58%, HitCoverage=92%, E-value=1e-138, Identity=73%"; Hit description =Putative glucan endo-1,3-beta-glucosidase 7 precursor (EC 3.2.1.39) ((1->3)-beta-glucan ...
  Homolog annotation: Hit description=endohydrolase 7) ((1->3)-beta -glucanase 7)
  Pfam annotation: Domain name=Glyco_hydro_17; Domain location=32-353; Score=351.8; E_value=1.1e-102; Accession=PF00332.9; Description =Glycosyl hydrolases family 17
  Pfam annotation: Domain name=X8; Domain location=452-532; Score =145.9; E_value=1.1e-40; Accession=PF07983.3; Description=X8 domain
  Pfam module annotation: Pfam domain module=Glyco_hydro_17::X8; Domain location=32-353::452-532
  Subcellular localization annotation: CTP_CleavageSite=49; ConfidenceScore=5.00e-01
MAIIFLSSSAILLPSLAFFLTLFNLASSESFIGVNYGQVADNLPPPSATAKLLQSTAIGKVRLYGTDPAIIKALANTGIGIVIGAANGDIPGLASDPNFAKTWVNTNVVPYYPASNIILITVGNEVITSNDQNLVNQMLPAIQNVQGALDAASLGGGKIKVSTVHAMSVLRDSEPPSAGRFHPEYDTVLQGLLSFNNATGSPFTINPYPYFAYRSDPGRADNLAFCLFQPNAGRVDSNTNLKYMNMFDAQVDAVRSALDAMGFKNVEIVVAETGWPYKGDSNEAGPSLENAKAYNGNLIAHLRSMVGTPLMPGKSVDTYLFALYDEDLKPGPASERAFGLYNPDQSMIYDAGLSKQQETSSPVPTVAPTPDVSKSPVIPAPTDPGQQTQKSPVIPAPIGPGPTPNKAELLIGHEATILKSLIMFTTTPDVSKSPSTPKPTVSSPTKTNNSATWCVPKGGVADAQLQANLDYACGQGIDCTAIQQGGACFEPNTLVNHAAYAMNLLYQTAGRNPLTCDFSQTAMLSTNNPKVPKILTMSPKSWSYFKTLDFSVVTRVVFMLEEMPNPENK

SEQ ID NO: 185407 - protein, 89 aa, Glycine max
  Coding DNA Sequence Number=SeqID_68629
  Homolog annotation: Hit_ID=Q1T642; Match level="QueryCoverage=41%, HitCoverage=5%, E-value=7e-09, Identity=72%"; Hit description =Protein kinase
MESPEDRKVEPESVESPTKTRLKREALLCDPQLRRKLSVVENETEKGSEENSCHEYKLEDTKGECEQNCNKRTIETERQIAPTFAFAFD

SEQ ID NO: 185408 - protein, 269 aa, Glycine max
  Coding DNA Sequence Number=SeqID_68630
  Gene Ontology: Mol. function=protein serine/threonine kinase activity; Cellular component=membrane; Biological process=protein amino acid phosphorylation
  Homolog annotation: Hit_ID=Q1T642; Match level="QueryCoverage=100%, HitCoverage=39%, E-value=1e-123, Identity=80%"; Hit description =Protein kinase
  Subcellular localization annotation: CTP_CleavageSite=31; ConfidenceScore=5.53e-01
MKKNGTHLVRFHFSPFKAQSFDLKSAKFNVSVNGVSVLSNFQPPNDVLLKEFILKIVSNVLEILFRPVGDSGFAFVNALEVFTAPVDFVIDFGARLVGPSGVEEYRSLSSQVLETVHRINVGGLKITPFNDTLWRTWIPDEDYLVFKGAAKPAVSTHTPNYQKGGATREIAPENVYMTAQQMNRENSSLASRFNITWNFPVSPGGVPHLVRLHFCDIVSPALNLLYFDVYINGYIAYKDLDLSALAIHTLASPVYVDFVTNSDDTGFVQ

SEQ ID NO: 185409 - protein, 343 aa, Glycine max
  Coding DNA Sequence Number=SeqID_68631
  Gene Ontology: Mol. function=protein serine/threonine kinase activity; Cellular component=membrane; Biological process=protein amino acid phosphorylation
  Homolog annotation: Hit_ID=Q9FLW0; Match level="QueryCoverage=93%, HitCoverage=42%, E-value=1e-131, Identity=69%"; Hit description =Receptor-protein kinase-like protein
  Pfam annotation: Domain name=Pkinase; Domain location=35-279; Score =133.0; E_value=8.1e-37; Accession=PF00069.15; Description=Protein kinase domain
  Pfam annotation: Domain name=Pkinase_Tyr; Domain location=35-279; Score=126.8; E_value=6.1e-35; Accession=PF07714.7; Description =Protein tyrosine kinase
  Pfam module annotation: Pfam domain module=Pkinase::Pkinase_Tyr; Domain location=35-279::35-279
MFGGSSLSRSSEPGSHGLLGMKIPFAEIQSATNNFDRNLIIGSGGFGMVYKGELRDNVKVAVKRGMPGSRQGLPEFQTEITVLSKIRHRHLVSLVGFCEENSEMILVYEYVEKGPLKKHLYGSSLQTPLSWKQRLEICIGAARGLHYLHTGFAQGIIHRDIKSTNILLDENYVAKVADFGLSRSGPCINETHVSTNVKGSFGYLDPEYYRRQQLTDKSDVYSFGVVLFEVLCGRPAVDPQLAREQVNLAEWALEWLQKEKCLAEYGVDRPAMGDVLWNLEYALQLQESEPHANSSARESVSVTNAVIPGNPSTNRRTERDYYNCSSDVSTSQVFSQLMNNEGR

SEQ ID NO: 185410 - protein, 313 aa, Glycine max
  Coding DNA Sequence Number=SeqID_68632
  Gene Ontology: Mol. function=oxidoreductase activity, acting on the CH-OH group of donors, NAD or NADP as acceptor; Cellular component =nucleus
  Homolog annotation: Hit_ID=Q10DL9; Match level="QueryCoverage=82%, HitCoverage=83%, E-value=1e-64, Identity=54%"; Hit description =Dehydrogenase, putative, expressed
MEGPYDLSCNGEAGNKSLQIIKYSPYKPCTMISSSPWFDLRVFYVRVCGIQVDESTPEFLSLNHIPLSPDTLLEVNGVRRSIYSDGEESSVLRRDRVDKKSEEATFVNTDSIRFTGSMKFEVYDKEHCILSGVLEMSNSNGFVGGSRSCVKRWSMICQTEMSPGCGFFKRKHVAVPELPCPEIEVYVAGCFSGTPIILTKTLQLNCRKKHNRKCALDSIPEYETTECQKDVSDHGLDLQVVDCRSFKLEQEEDYNSMYWPRTVYVDGEDGELSWFNAGVRVGVGIGLGIFVGVGIGDGISVKFCHHHGLTSIV

SEQ ID NO: 185411 - protein, 73 aa, Glycine max
  Coding DNA Sequence Number=SeqID_68633
MILEFSGDVQLPNQEEKEVNDLALHESHPTIIMCSCSLSLRELRVQARGGDNKLYVTGYRLIQFNIKIQIREC

SEQ ID NO: 185412 - protein, 156 aa, Glycine max
  Coding DNA Sequence Number=SeqID_68634
  Pfam annotation: Domain name=AT_hook; Domain location=73-85; Score =14.6; E_value=0.07; Accession=PF02178.9; Description=AT hook motif
MMLTQKLQKSKDAKPGKQHKWSDWNTALVRVLMMGKKKPQKTKELSVAIAEASSTIDEKEQHEVQVQPQPQAPRKRGRPRKIVLKLEESEEEKAQVIEQGGAQGTESSMEKGTTNEEEGTSSACMRVTTKQEEIQLPKVEPSRSRARRKSKPRKSS

SEQ ID NO: 185413 - protein, 55 aa, Glycine max
  Coding DNA Sequence Number=SeqID_68635
MHSLTVQVSDGVRSRKTRAAQLAIDVSYLTAEGGGGGGYRQVKWKWSHLVDIVHQ

SEQ ID NO: 185414 - protein, 378 aa, Glycine max
  Coding DNA Sequence Number=SeqID_68636
  Gene Ontology: Mol. function=4 iron, 4 sulfur cluster binding; Cellular component=endoplasmic reticulum; Biological process =electron transport
  Homolog annotation: Hit_ID=Q8H8N3; Match level="QueryCoverage=97%, HitCoverage=54%, E-value=1e-179, Identity=78%"; Hit description =Putative oxidoreductase
  Pfam annotation: Domain name=Radical_SAM; Domain location=43-240; Score=32.1; E_value=2e-06; Accession=PF04055.11; Description=Radical SAM superfamily
  Pfam annotation: Domain name=Wyosine_form; Domain location=242-306; Score=126.3; E_value=8.8e-35; Accession=PF08608.2; Description =Wyosine base formation
  Pfam module annotation: Pfam domain module=Radical_SAM::Wyosine_form; Domain location=43-240::242-306
GYKIIGSHSGVKLCRWTKAQLRGRGGCYKHSFYGIESHRCMEATPSLACANKCVFCWRHHTNPVGKSWQWQMDDPIEIVNSAIDLHTNMIKQMKGVPGVTLERLSEGLSPRHCALSLVGEPIMYPGINALVDELHKRRISTFLVTNAQFPEKIKSLKPVTQLYVSVDAATKDSLKAIDRPLFGDFWERFINLTMPYEVYEDGRVTDSLTALKEKHQRTVYRLTLVKGWNTADIDAYSKLFSLGEPDFVEIKGVTYCGSSTTSKLTMDNVPWHADVKAFSEALALKSQGEYEVACEHAHSCCVLLAKTNKFKIDGQWYTWIDYEKFHDLVASGRSFDSRDYMAATPSWSVYGSEEGGFDPGQLRYRKERHHKSTRNQAG

SEQ ID NO: 185415 - protein, 52 aa, Glycine max
  Coding DNA Sequence Number=SeqID_68637
MEIMKERVMNSDTANTIGGISQRERARTLYEGFKLAAPVPVLLLLTSSRCES

SEQ ID NO: 185416 - protein, 151 aa, Glycine max
  Coding DNA Sequence Number=SeqID_68638
  Gene Ontology: Mol. function=RNA-directed DNA polymerase activity; Biological process=RNA-dependent DNA replication
MGKIPPAMVEKGKLDHLEERLRAIEGGRDYAFANLEELFLVPNVVTPPKFKVSDFDKYKGTTSPKNHLKMYCQKMGAYAKDEKLLMHFIQESLTGAAATWYTNLEPSRVHSWKDLMVAFIRQYQYNSDMALDRMQLQSMCKRGHESFKEYA

SEQ ID NO: 185417 - protein, 58 aa, Glycine max
  Coding DNA Sequence Number=SeqID_68639
MVPLAEVQAQTDQTRAKGVQGVQTSTNKRRIDRAGALSARWKIQCWPLGDKNNQIAEF

SEQ ID NO: 185418 - protein, 136 aa, Glycine max
  Coding DNA Sequence Number=SeqID_68640
  Gene Ontology: Mol. function=hydrolase activity
  Homolog annotation: Hit_ID=Q9FRL2; Match level="QueryCoverage=60%, HitCoverage=15%, E-value=2e-23, Identity=61%"; Hit description =Cytosolic IMP-GMP specific 5'-nucleotidase, putative; 41097- 37373
MERRAEGEVASAVGVSWLGRGYVPRSFDLYKAGYRDIEYIIRSQHLINGTSTREELKNPDEDTKQKLNSKLDKLKFHEPWGQLMKTSYQNSRFAHQVERFACLYTSQVSNLALFSSDKYYRPSEDFMQHEFSIFES

SEQ ID NO: 185419 - protein, 861 aa, Glycine max
  Coding DNA Sequence Number=SeqID_68641
  Gene Ontology: Mol. function=protein-tyrosine kinase activity; Cellular component=cellulose and pectin-containing cell wall; Biological process=protein amino acid phosphorylation
  Homolog annotation: Hit_ID=Q9SIX4; Match level="QueryCoverage=93%, HitCoverage=91%, E-value=0.0, Identity=45%"; Hit description =Putative LRR receptor protein kinase
  Pfam annotation: Domain name=LRR_1; Domain location=124-146; Score =11.3; E_value=2.2; Accession=PF00560.23; Description=Leucine Rich Repeat
  Pfam annotation: Domain name=LRR_1; Domain location=148-170; Score =15.4; E_value=0.2; Accession=PF00560.23; Description=Leucine Rich Repeat
  Pfam annotation: Domain name=LRR_1; Domain location=172-194; Score =8.9; E_value=6.2; Accession=PF00560.23; Description=Leucine Rich Repeat
  Pfam annotation: Domain name=LRR_1; Domain location=196-218; Score =18.3; E_value=0.027; Accession=PF00560.23; Description=Leucine Rich Repeat
  Pfam annotation: Domain name=LRR_1; Domain location=220-242; Score =20.0; E_value=0.0085; Accession=PF00560.23; Description=Leucine Rich Repeat
  Pfam annotation: Domain name=LRR_1; Domain location=244-267; Score =6.3; E_value=19; Accession=PF00560.23; Description=Leucine Rich Repeat
  Pfam annotation: Domain name=LRR_1; Domain location=270-292; Score =7.9; E_value=9.6; Accession=PF00560.23; Description=Leucine Rich Repeat
  Pfam annotation: Domain name=LRR_1; Domain location=294-315; Score =13.9; E_value=0.58; Accession=PF00560.23; Description=Leucine Rich Repeat
  Pfam annotation: Domain name=LRR_1; Domain location=341-371; Score =2.0; E_value=1.2e+02; Accession=PF00560.23; Description=Leucine Rich Repeat
  Pfam annotation: Domain name=Pkinase; Domain location=489-766; Score=- 10.1; E_value=5.9e-08; Accession=PF00069.15; Description=Protein kinase domain
  Pfam annotation: Domain name=Pkinase_Tyr; Domain location=489-766; Score=-50.8; E_value=2.3e-09; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=124-146::148-170::172-194::196-218::220-242::244-267::270 -292::294-315::...
  Pfam module annotation: Domain location=341-371::489-766::489-766
MGMGGIAVSVVTVLLLMIGLTMGMSLSSRTEWFALRELRQSLEIRAKYWPIKAEPCGNWTGVQCRNGRVVGINVSGLRRTRWGRLNPSFEVDSLVNFTLLETFNASGFKLNGSIPEWLGERLGVLEELDLSLCSIKGSIPDSIGRLSKLKVLLLSGNFLTGRMPSTLGNLTRLSVLDLSGNSLSWPVPDSVSKLGNLSRLDLSYNFLSGSVPPELGALSSLQFLNLSGNSFTGSVPSQLGNLSKLVEVDLSMNFLSRSLSGGLFSSVVLALEVLILRGNLLDGVLPANLRSMPRLHFLDVSSNNLTGTLPNFADWNVSSAGVVFNLSNNMFYGLLNTSLDRFKMIDLSSNFLEGEVLGGGGGVSNVDLDRNCLQRIPNQRNLEDCRMFYDKRNLSSAFPESESRSRRRVIFMLVGIFGGLGFIVLLALVLMLVLKQCHNRKSLEVPRETKDGGAVEEGESPIPPKDIDFVTGVGEAYSFEQMLRLTGNFAESNVIKHGHSGDLFLGVLEGGATVVVKKVDLNLFKRESYVVELGLLSKVPHARLVPILGHCLDNENEKCIVYKYMPNRDLATSLHRVTGSDGKIQSLDWITRLKIAIGAAEGIAYLHECSPPLVHRDIQASSILLDDKFEVRLGSLSEVTAQGDLQQGVISRVFSKPPSSNQADSGKSPVTCTYDVYCFGKILLELITGNIEVSKSDDATTKEWLEQTLPYITIYDKERVTKIIDPSLIVDEDLLEEVWAMAIVANACLKPKPSKRPPMRHVLKALENPLKIVREENTSSARLRTNSSRKSWSTAFFGSWRHSSSDSVVATNKEGSNDTKKSGKVGSQSSGNDHSSSNKRSSNEIFPEPLEIQDVETGVTR

SEQ ID NO: 185420 - protein, 372 aa, Glycine max
  Coding DNA Sequence Number=SeqID_68642
MTSKNNTGILRFIPTNCTRCVKWVVSQEELQEIPQYGSTKHPRCSDRGGETCVGEEDPKWWRSRPASPRSARDERTSCVMVLERSGMVGCEGWVWGRVNWIYIRAIRIFVFSNEKESFRGVAMSSRKVGSSDVKHFTMGGGGGGGVNDEVRGRGGNDSGLGCMGEKGIQSGVEAACSDIKFGQDGLKAILASGRKVMVGWRLLWMAMVWAVMASMEGSHGSSVRRVAAVGGLTPLETKKEEGEGKLVSRLPVPPEEEEKHRGEMFKIQQFGYSCPLKANIESSILHTTLLHDPVTKGGAVEKRGHGGVRRWWRWRGEEEGHNGGRKGVRVAWLRHGGAERKKEKGAILGGEGGAVAMWQRRKEGGKWCNTGR

SEQ ID NO: 185421 - protein, 660 aa, Glycine max
  Coding DNA Sequence Number=SeqID_68643
  Gene Ontology: Mol. function=methyltransferase activity; Cellular component=cellulose and pectin-containing cell wall
  Homolog annotation: Hit_ID=Q9FMJ2; Match level="QueryCoverage=74%, HitCoverage=62%, E-value=1e-136, Identity=47%"; Hit description =Ankyrin-like protein
  Pfam annotation: Domain name=DUF248; Domain location=218-660; Score =635.6; E_value=4.2e-188; Accession=PF03141.7; Description=Putative methyltransferase
  Pfam annotation: Domain name=Methyltransf_11; Domain location=350 -445; Score=34.0; E_value=5.3e-07; Accession=PF08241.2; Description =Methyltransferase domain
  Pfam annotation: Domain name=Methyltransf_12; Domain location=350 -443; Score=18.6; E_value=0.011; Accession=PF08242.2; Description =Methyltransferase domain
  Pfam module annotation: Pfam domain module=DUF248::Methyltransf _11::Methyltransf_12; Domain location=218-660::350-445::350-443
  Subcellular localization annotation: CTP_CleavageSite=61; ConfidenceScore=5.02e-01
MAIARLVRQAKRPHGLWVKMTAVTILGLCFIFVWGVFSSSSTSVTTQRESFEDIAEPVSSSSSHKPQKLKKDESKKGGGGGKSEKKSNGNGSSHPEQHKGKDNQKKEKKRVHKEDNKEKGNHRGDEDPQPQHDQEEKEKREEEVEVEGEEERVDRESEGDVDADGGGDLAESVDQGDSEAVEDVEEVRKASKGKVKGPLFNPNATYSWKLCSTRSKHNYIPCIDIEVGGGKVPSYRHTERSCPRTPFMCMVPLPHEGYGFPLPWPESKLKVIMEKLDKVAYGKVKILYKNVAHPKLAAYIKRHNWLMESGEYLTFPQNQSELKGGIHHYLESIEEMVPDIEWGKNIRVVLDIGCTDSSFAAALLDKEVLTLSLGLKNDLVDLAQVALERGIPAVISPFSRRRLPFPSQSFDAIHCGGCGIPWHSNGGKLLLEMNRILRPGGYFIMSTKHDSIEEEEAMTTLTASICWNVLAHKSDDVGEVGVKIYQKPEGNDIYELRRKKVPPLCKENENPDAAWYVSMKTCLHTIPIGIEQHGAEWPEEWPKRLESYPDWVNNKEKVVADTNHWNAVANKSYLNGLGINWTSIRNVMDMKSVYGGLAVALSQQKVWVMNVVPVHAPDTLPIIFERGLIGIYHDWCESFGTYPRTYDLLHADHLFSRLKN

SEQ ID NO: 185422 - protein, 138 aa, Glycine max
  Coding DNA Sequence Number=SeqID_68644
MKAKKDLERGKIMGVNFDGMEDAMVVQLEGMVRRDQKEIENIEKVKIEEHKKMQWLYVPSEGTSGEDRLRVWEVLKGIGSRCDIKKWCLLGDFNCVKSPNEREGVGVIGFGRREREEYNAFIESLELMDTPLEGRKFS

SEQ ID NO: 185423 - protein, 72 aa, Glycine max
  Coding DNA Sequence Number=SeqID_68645
MMHIILKIIRVRVAEESKGQDNMLEVERPKEIACIGWDKQLAEPVGEQEEGRELDIEDSTRKIVKEMNKTES

SEQ ID NO: 185424 - protein, 55 aa, Glycine max
  Coding DNA Sequence Number=SeqID_68646
MLDEVCHRVKCSVRAAEKSIIMNVTNNIIIDLSFSTMWFKDEPGGHMLDVGFPRL

SEQ ID NO: 185425 - protein, 257 aa, Glycine max
  Coding DNA Sequence Number=SeqID_68647
  Gene Ontology: Mol. function=DNA binding; Cellular component=nucleus; Biological process=regulation of transcription, DNA-dependent
  Homolog annotation: Hit_ID=Q0PJE7; Match level="QueryCoverage=74%, HitCoverage=83%, E-value=9e-72, Identity=75%"; Hit description=MYB transcription factor MYB135
  Pfam annotation: Domain name=Myb_DNA-binding; Domain location=105 -164; Score=35.5; E_value=1.9e-07; Accession=PF00249.21; Description =Myb-like DNA-binding domain
  Subcellular localization annotation: CTP_CleavageSite=67; ConfidenceScore=5.03e-01
MMRWQKGIGGCKVRSEKQNVLVSVLTNSRISLFLNITPTLKLETFTKQRSMVSKNPNPSEAFYLDPSGMSLPGILPFAAAATATADSFEDPAKKTRKPYTITKSRESWTEPEHDKFLEALQLLQLMKDCYNSYMSRFDRDWKKIEAFVGSKTVIQIRSHAQKYFLKVQKSGTNEHLPPPRPKRKAAHPYPQKASKTAPVLSQVSGSFQSSSALLEPGYILKHDSSAMPKTPIINTAVSSWSNNSLQKTTSVLHGTKG

SEQ ID NO: 185426 - protein, 152 aa, Glycine max
  Coding DNA Sequence Number=SeqID_68648
KVIRLNYLGDDMVLIRGLTMEKTQSMITSNDDDVMSLLYVVQPMEPCVLCDGIPLQAWGEQCFSRVVGLFGTFVSLDIEIANLERLGRAQIMLKVSFFLPISSCYDVKDSDNDEDFEHSVLEMDISSFSSECYSKEYDKDTYAYQGFGWKEY

SEQ ID NO: 185427 - protein, 168 aa, Glycine max
  Coding DNA Sequence Number=SeqID_68649
MDLSPFTHPYMEVGEGKGARDYKVLGDEQPIEGIQEPLKYKAGNEKENLKWGHEEVYGSLTEVIREIILTNNKVDQWEQSKLKQSSLGRVLNKSKKKREERPCQQSLKNTISNSNVRNCNKNLWMRNETKGTKRSWELGKIMGVTYGGNEDDMVREMEDLEGRDQQEI

SEQ ID NO: 185428 - protein, 200 aa, Glycine max
  Coding DNA Sequence Number=SeqID_68650
MERGSKVLFPPPQPGPSEKVSVIHQLRYVQRLIMKNHIIPELPYGTCSCYPPNFPSCIGNLRTYYGGVLEEMIHGPTVKSSILLNPAEAIPKILFPCSKDLKSNLEECLLEVEAKAEHECREYNKASFRGLELARKHWETLKILENSESSSRDIYKERLGRTKQSKSKVGLKMLESVEDAREEWGGGGIEIARLPPKTKQ

SEQ ID NO: 185429 - protein, 226 aa, Glycine max
  Coding DNA Sequence Number=SeqID_68651
  Gene Ontology: Mol. function=metal ion transporter activity; Cellular component=membrane; Biological process=metal ion transport
  Homolog annotation: Hit_ID=Q8H1H0; Match level="QueryCoverage=62%, HitCoverage=34%, E-value=2e-46, Identity=65%"; Hit description=MRS2-5
  Pfam annotation: Domain name=CorA; Domain location=46-226; Score= -33.3; E_value=0.00013; Accession=PF01544.9; Description=CorA-like Mg2+ transporter protein
MDETQDHYYSSSLPESSLSHDGGGRSYFNGQINRGTAISGLKKRGHGSRSWIKIGQDGNFQTVTLDKATIMRYCSLPSRDLRLLDPMFIYPSTILGREKAIVVNLEQIRCIITADEVILMNSLDGSVGQYRLELCNRLQNEKADDLPFEFRALELALELTCTSLDAQLDRYYTLLTVTQYFPPFTAIKIQAGKSCRNNVALKRNMGRQKNVQGDLKHKQRGAGGIF

SEQ ID NO: 185430 - protein, 216 aa, Glycine max
  Coding DNA Sequence Number=SeqID_68652
MSDPDAAAIKVITSNGGIMEFSAPVTVSFITNEFPGHAMFRSHDLFWKPLSQFDELEPGQSYYLLPLSNNNNNNNNSKNTDSTLPCGGENINVVVRQGHVRSHSVPTISNPALYRMSLDYHHHHQGMGLLKRSSNNIDAFSSRSSGVVNSSNNIGGGGSSRFWKVKLVISPEQLLDILAQEARTKELIESVRMVAKCGIAGAFPAPVGAFPLRLMP

SEQ ID NO: 185431 - protein, 358 aa, Glycine max
  Coding DNA Sequence Number=SeqID_68653
  Gene Ontology: Mol. function=RNA-directed DNA polymerase activity; Cellular component=chromatin; Biological process=chromatin assembly or disassembly
MPEHNTRQSATERLEEAVQTLSQAHSAMNDKLESILDRLSLLAIPADPTTPTSQPNQHHHHLKLEIPRFDGQDPLGWIFKISQFFDYQGVPEQERLTVVSFYMDGPALSWYQWMMRNGFLNSWPAMLQALESRFAPSFYDDPHGALFKLFQHGSVNDYLTEFERLANRTVGLAPPYILSCFISGLHPELRREVQALQPVSLPQVVALAKLQEDKILDRRKGSRYPTPTQPSPLPSHNHLNPIPSSHPTPSFPYTQTHPSPTPLTTSTPTPKIPVKRLSPEELAVHRDRGLCYHCDEQWTRGHRCKPRLHLFIADEDDEVTPPSLEPPTDHLSPQLNLNALAGFPTSETLRLFGTINNH

SEQ ID NO: 185432 - protein, 618 aa, Glycine max
  Coding DNA Sequence Number=SeqID_68654
  Gene Ontology: Mol. function=hydrolase activity; Cellular component =chloroplast; Biological process=RNA processing
  Homolog annotation: Hit_ID=Q8VXF6; Match level="QueryCoverage=99%, HitCoverage=100%, E-value=0.0, Identity=84%"; Hit description =Putative metallophosphatase
  Pfam annotation: Domain name=Metallophos; Domain location=292-508; Score=59.6; E_value=1e-14; Accession=PF00149.18; Description =Calcineurin-like phosphoesterase
MGESKFVSLAFLLVCLVVQRVWSHGYHPLSKVAVHKATVSLLDLAYIKASPAVLGLQFSTCHLVAHCLLVADYSSPIPSIDDWIGVFSPANFSASTCPKENRRVYPPLLCSAPIKYQYANYSSPLYKETGKGFLKLLLINQRSDFSFALFSGGLSNPKLVAVSDKIAFANPNAPLYPRLALGKSWNEMTVTWTSGYGINDAEPFVQWGPKEGDRMHSPAETLTFTRDSMCGAPARTVGWRDPGYIHTSHLKELWPNKIYEYRIGHKLNNVTYIWSGNYQFTAPPFPGQKSLQRVVIFGDMGKGEVDGSNEYNNFQHGSINTTQQLIQDLENIDIVFHIGDICYANGYLPQWDQFTAQVEPIASAVPYMIASGNHERDWPGTGSFYENMDSGGECGVLAQTMFYTPASNRAKLWYSIDYGMFRFCIADTEHDWREGTEQYKFIEHCLASVDRQKQPWIIFLAHRVLGYSSCICYAEEGSFAEPMGRESFQKLWQKYKVDIAIYGHVHNYERTCPIYQNICTNEEKHHYKGRTLNGTIHVVAGGGGASLSAFTSLKTKWSIFKDYDYGFVKLTAFDHSNLLFEYKKSRDGKVYDSFKISRDYRDILACTMDSCPSITMAS

SEQ ID NO: 185433 - protein, 340 aa, Glycine max
  Coding DNA Sequence Number=SeqID_68655
  Gene Ontology: Mol. function=ornithine cyclodeaminase activity; Cellular component=cytoplasm; Biological process=visual perception
  Homolog annotation: Hit_ID=Q1S1V7; Match level="QueryCoverage=99%, HitCoverage=84%, E-value=1e-139, Identity=77%"; Hit description =Aconitate hydratase, N-terminal; Ornithine cyclodeaminase/mu- crystallin
  Pfam annotation: Domain name=OCD_Mu_crystall; Domain location=19-340; Score=161.1; E_value=2.8e-45; Accession=PF02423.6; Description =Ornithine cyclodeaminasemu-crystalli
  Pfam annotation: Domain name=Shikimate_DH; Domain location=133-274; Score=-2.1; E_value=0.00053; Accession=PF01488.10; Description =Shikimate  quinate 5-dehydrogenase
  Pfam module annotation: Pfam domain module=OCD_Mu_crystall::Shikimate_ DH; Domain location=19-340::133-274
MATTTANKDETISTIASSSSPVFISTETLCTILTHHTLMNHFQSTLPKASTILQTPIRQHHSLSPSSSLLLMPSWSSSSSLPYIGVKLVTHFPQNSSLNLPGVQGSYVLFSSTTGQTLASMDSTELTLYRTSCVSGLASKYLARHDSEVLVMVGAGSLAPHLIKAHLSAIPSLRKVIIWNRTVEKATTLANKLSQSGEFGGVRFEGCGCLDEVVGFGDIVSCATNSETPLVKGERLKGGAHLDLVGSFKNSMMECDDEAIRRGKVFVDNETALVEAGELVGAFERGVIKKDEIGGSLVELVRGEKVGRISSEQITVFKSVGSAVVDMLAAQLVYETYTRS

SEQ ID NO: 185434 - protein, 1043 aa, Glycine max
  Coding DNA Sequence Number=SeqID_68656
  Gene Ontology: Mol. function=RNA-directed DNA polymerase activity; Cellular component=chromatin; Biological process=chromatin assembly or disassembly
  Pfam annotation: Domain name=rve; Domain location=707-863; Score =112.6; E_value=1.1e-30; Accession=PF00665.16; Description=Integrase core domain
  Pfam module annotation: Pfam domain module=RVT_1::rve; Domain location=195-364::707-863
MQVLVGNGTTMQCDHSCPQVPVLIQGHHFTMDLFSIPLSGADLVLGIQWLRELGPITTDYTRLTMSFTHLGQPITLTADVPPHPSSISAQQVRRCLHTNSVSALFQLTTSPSDVSPSNTPDPPPDISSLITKFAHLFSEPTSLPPFRQISHHIHLHPHTSPVNVKPYRYPYYQKAELEKQVASMLKNGLIRISQSPFSSPVLLVKKRDGTWRCCVDYRALNAITVKDRFSMPTIDELLDELGHARWFSKLDLYQGFHQIRVAEEDIHKTAFRTHHGHYEFRVLPFGLCNAPATFQATMNELLKPFLRRFAAVFFDDILIYSPTLPTHVQHLAAAFNTLSQGEFYLRRTKCLFARRTLQYLGHIVSDKGIAPDPDKIQAMLSWPTPSTVSELRGFLGLTGFYRRFIRGYASIASPLTSLLRTDAFQWNSDAQAAFVQLQQAMTQAPVLAPPDFTAPFILETDASRTAMGAVLIQRAHPIAFHSKVFCDRLRRASTYVCELHAITVAVRKWRHYLLGSHFIIRTDHKSLRDLMNQTIQTPEQQTYLTKLLGYDYDIEYKSGATNIVADALSRIPTQGTFLSLSLPNFDFLDQLRQSLHSSQSYTTLLQDILQRPDLHPGYTTNREMIFLHKKLWLPSDCSFIPALMDEFHSTPVGGHLGFAKTLHRIQENFYWPSMRQDIHKFIAHCTTCLQTKYETKKPAGLLHPLPIRATPWEELSLDFICGLPPSHGHSTILVIVDRFSKGIHLGALPAHYTAHSVATLFFNLVCKLHGLPRSLVSDRDPIFVSKFWRELFRLMGTKLCMSTAYHPETDGQTEVLNRVVEQYLRAFAHDHPHSWTRFLALAEWSYNTSFHSGTGFSPFEVTFGKPPPSIPQYLQGSSQVEAVDTLLANHQHIRSVLQTRLRKAQDNMKKAADTHRREVSYSPGDWVYVRLRPYRQSSLAPGYCKLSKRYFGPFKIQERIGPVAYRLELPPHSRIHPVFHVSLLKLHPGETPTTPGFLPETTKGNDPIVAPLTILDWKLDASTSPPSRQVLVQWNGLSPEDST

SEQ ID NO: 185435 - protein, 399 aa, Glycine max
  Coding DNA Sequence Number=SeqID_68657
  Gene Ontology: Mol. function=nucleic acid binding; Cellular component= integral to membrane; Biological process=isoprenoid biosynthetic process
  Homolog annotation: Hit_ID=Q10Q12; Match level="QueryCoverage=93%, HitCoverage=67%, E-value=3e-89, Identity=49%"; Hit description =Expressed protein
  Pfam annotation: Domain name=DUF647; Domain location=3-388; Score =276.5; E_value=5.4e-80; Accession=PF04884.5; Description=Protein of unknown function, DUF647
MERFIPHKTLQDLHHHKKLNTIDTSKPFQIWDSLQGLSTYIRTMLSTQYMSSQRNAFQALLIAIGVEEKSATVIGATFQRASPGAAVKLCLGDLLVMGSNPETASLHMQGDLTGMLGGILFTFYQGSNLDSYAKMWRLVADLMNDPGMLMDLISPLFPSAFVFVVCLGSISRSFTGVASGATRAALTQHFALQDNAADISAKEGSQETVATMIGMALGMLVARLTIGHPLAIWFSFLSLTVFHMYVLSPEQVSSQEHILPIQFISWSSKKANCLHKKVNLGMRISSFDNMEIKEHLLSAAPYYTKAKYLLVERKGIIDVIVHKDSNAADVLKLFFHALVLAKNVHKSKSVHSEGQKWIDYQYEVFIQKLKSLGWKIERLLSPIIWRAYWSYEPLEEKID

SEQ ID NO: 185436 - protein, 154 aa, Glycine max
  Coding DNA Sequence Number=SeqID_68658
  Subcellular localization annotation: CTP_CleavageSite=75; ConfidenceScore=5.40e-01
MTSQAQGSAQSINNKLNMGARDSSFMNRARDPRYFVPPVNLLHSLCPRRLLHPQRPPKLAWSQVRPMESSLEWPPANAVAEAPRLQRPHLPPEEKARLLAKPPVLNKPWWRLYSINTKTSELCMEVPEGVGIDVDGGGAGAEGVRGVEEAGVKV

SEQ ID NO: 185437 - protein, 118 aa, Glycine max
  Coding DNA Sequence Number=SeqID_68659
MEGHKEPVPEHAPDKCKGWCSSVGIPHGEQDLMEGMMVNEHGVLLHEEEGGGKGPLEVEGVTKGGEVDEEGIVLLLVREFWRVVWRVESWEEESKVGDFGEGSELGWCCFLVRAKTEG

SEQ ID NO: 185438 - protein, 77 aa, Glycine max
  Coding DNA Sequence Number=SeqID_68660
MTLTTFLAIVTSFFVALFEDQDQLISSTLHCNPRGTENVTRSGELPSLQVATMTGELGQAFGAGCRPKGGWQLQLAI

SEQ ID NO: 185439 - protein, 67 aa, Glycine max
  Coding DNA Sequence Number=SeqID_68661
MVFLQNSTARWPPGRGNLLPPSPMTPPGLHLREPGNDIHSRNILLERNVILYITEFDEFHQELERWN

SEQ ID NO: 185440 - protein, 697 aa, Glycine max
  Coding DNA Sequence Number=SeqID_68662
  Gene Ontology: Mol. function=transferase activity; Cellular component= plastid chromosome; Biological process=metabolic process
  Homolog annotation: Hit_ID=Q9FGR7; Match level="QueryCoverage=87%, HitCoverage=85%, E-value=0.0, Identity=56%"; Hit description =Similarity to salt-inducible protein
  Pfam annotation: Domain name=PPR; Domain location=215-249; Score=9.1; E_value=0.62; Accession=PF01535.11; Description=PPR repeat
  Pfam annotation: Domain name=PPR; Domain location=250-284; Score =31.9; E_value=2.3e-06; Accession=PF01535.11; Description=PPR repeat
  Pfam annotation: Domain name=PPR; Domain location=321-355; Score =11.8; E_value=0.3; Accession=PF01535.11; Description=PPR repeat
  Pfam annotation: Domain name=PPR; Domain location=356-390; Score =44.6; E_value=3.3e-10; Accession=PF01535.11; Description=PPR repeat
  Pfam annotation: Domain name=PPR; Domain location=391-425; Score =37.9; E_value=3.6e-08; Accession=PF01535.11; Description=PPR repeat
  Pfam annotation: Domain name=PPR; Domain location=428-462; Score=2.2; E_value=4.1; Accession=PF01535.11; Description=PPR repeat
  Pfam annotation: Domain name=PPR; Domain location=463-497; Score =36.3; E_value=1e-07; Accession=PF01535.11; Description=PPR repeat
  Pfam annotation: Domain name=PPR; Domain location=498-532; Score =18.2; E_value=0.029; Accession=PF01535.11; Description=PPR repeat
  Pfam annotation: Domain name=PPR; Domain location=533-567; Score =32.4; E_value=1.6e-06; Accession=PF01535.11; Description=PPR repeat
  Pfam annotation: Domain name=PPR; Domain location=568-602; Score =36.6; E_value=8.7e-08; Accession=PF01535.11; Description=PPR repeat
  Pfam annotation: Domain name=PPR; Domain location=603-637; Score =28.3; E_value=2.6e-05; Accession=PF01535.11; Description=PPR repeat
  Pfam module annotation: Pfam domain module=PPR::PPR::PPR::PPR::PPR::PP R::PPR::PPR::PPR::PPR::PPR; Domain location=215-249::250-284::321 -355::356-390::391-425::428-462::463-497::498-532::533-567::568 -602::603-637
  Subcellular localization annotation: CTP_CleavageSite=49; ConfidenceScore=5.51e-01
MSLSLIHHKPLSSSCIFYLHSSTSHHIHTLSKPFFLLHSKTLPSSLSLSASPSNSSPHSSTTPIPLPYLQEEEEEEGHDPDEPNYNFFETSKWISSQDPQSEEKLYLEEDPHISWHLATDLDEESEMSLEKEEMGCFQKRELPEAEGIVGEIVELARNLPQNLTLEEALAEYEGRFSEKECWEVLEILGEEHLLLCCVCFFQWMSLQEPSLVTPRACTVLFPLLGKGGMGDEVMDLFRNLPSSNEFRDVHVYNATISGLLSSGRSEDAWKVYESMETENIHPDHMTCSIMVTVMRELGHSAKDAWQFFEKMNRKGVRWSEEVLGALINSFCVEGLRRQALIIQSEMEKKGVSSSAIVYNTLMDAFCKSNHIEAAEGLFVEMKAKGIKPIAATYNILMHAYSRRMQPKIVEKLLEEMQDVGLKPNATSYTCLIIAYGKQKNMSDMAAADAFLKMKKVGVKPTSQSYTALIHAYSVSGLHEKAYAAFENMQNEGIKPSIETYTTLLNAFRHAGDAQTLMEIWKLMISEKVEGTGATFNILVDGFAKQGLFMEAREVISEFGKVGLKPTVVTYNMLINAYARGGQHSKLPQLLKEMAVLKLKPDSVTYSTMIFAFVRVRDFRRAFFYHKQMIKSGQMMDGGSYQTLQALLETRPARKNKDWSSLLGIIKSKMGVKVRRQKDEFWKFKKRHVRKNSSDVSV

SEQ ID NO: 185441 - protein, 800 aa, Glycine max
  Coding DNA Sequence Number=SeqID_68663
  Gene Ontology: Mol. function=binding; Cellular component =intracellular; Biological process=metabolic process
  Homolog annotation: Hit_ID=Q1S1V5; Match level="QueryCoverage=74%, HitCoverage=81%, E-value=0.0, Identity=42%"; Hit description =Tetratricopeptide-like helical
  Pfam annotation: Domain name=PPR; Domain location=202-236; Score =40.1; E_value=7.5e-09; Accession=PF01535.11; Description=PPR repeat
  Pfam annotation: Domain name=PPR; Domain location=266-300; Score =11.8; E_value=0.3; Accession=PF01535.11; Description=PPR repeat
  Pfam annotation: Domain name=PPR; Domain location=398-432; Score =42.7; E_value=1.2e-09; Accession=PF01535.11; Description=PPR repeat
  Pfam annotation: Domain name=PPR; Domain location=433-467; Score=4.7; E_value=2.1; Accession=PF01535.11; Description=PPR repeat
  Pfam annotation: Domain name=PPR; Domain location=469-503; Score=1.0; E_value=5.7; Accession=PF01535.11; Description=PPR repeat
  Pfam annotation: Domain name=PPR; Domain location=60-94; Score=36.1; E_value=1.2e-07; Accession=PF01535.11; Description=PPR repeat
  Pfam module annotation: Pfam domain module=PPR::PPR::PPR::PPR::PPR::PP R; Domain location=202-236::266-300::398-432::433-467::469-503::60-94
MMLGSGQCPNEFTLSSALRSCSALGEFEFRAKIHASVYTKCDCTVEAPKLLVFVKDGDVMSWTIMISSLVETSKLSEALQLYAKMIEAGVYPNEFTSVKLLGVCSFLGLGMGYGKVLHAQLIRFVVEMNLVLKTAIVDMYAKCEWVEDAIKVSNQTPEYDVCLWTTVISGFIQNLQLLSFIIGAWGTVSFKGYHGIALPNVISWTSLIAGFAEHGLVEESFWLFAEMQAAEVQPNSFTLSTILGNLLLTKKLHGHIIKSKADIDMAVGNALVDAYAGGGMTDEAWAVIGMMNHRDIITNTTLAARLNQQGDHQMALKVITHMCNDEVKMDEFSLASFISAAAGLGTMETGKLLHCYSFKSGFGRCNSASNSLVHLYSKCGSMCNACRAFKDITEPDTVSWNVLISGLASNGHISDALSAFDDMRLAGVKLDSFTFLSLIFACSQGSLLNLGLDYFYSMEKTYHITPKLDHHVCLVDLLGRGGRLEEAMGVIETMPFKPDSVIYKTLLNACNAHGNVPPEEDMARRCIVELHPCDPAIYLLLASLYDNAGLSEFSGKTRKLMRERGLRRSPRQCWMEVKSKIYLFSGREKIGAIWDCYAGENLSPVKVGNPYSSQIAAVSETENYSMCKIQVYGFDLEDEDPTAFPDPRTLIIQRSLMKEIQRCANDVTGKRPGRSEPVQKKSNPNWVIVFECHRHRPHRFPYPGRVLNRRFPVAPPTATSESAVAKKKKKKRAWLGRRRVTQVTVADWSPESYSGVTPFNLFSSHTTFGAAAPIVVRLVKLWGNCSGAVEIRVSEVPVVD

SEQ ID NO: 185442 - protein, 125 aa, Glycine max
  Coding DNA Sequence Number=SeqID_68664
  Gene Ontology: Mol. function=binding
  Homolog annotation: Hit_ID=Q2HPC2; Match level="QueryCoverage=95%, HitCoverage=19%, E-value=8e-10, Identity=38%"; Hit description=SGT1
MASDLELKAKEAFEDDNHDLPYDLLTQAIGLSPNNADLYADRAQVNNLTVICSFTLKELKLVNLAKLRNFDKFLTKMEILLCGCLCGSMVWRLIVLAFFSPEAVADANKAIKLNPSHSKSIFAER

SEQ ID NO: 185443 - protein, 85 aa, Glycine max
  Coding DNA Sequence Number=SeqID_68665
MPPIEKQFTSPTTHPIDPSSLLIDNNNNKIIKIINNTSRLNRIVESDVKLRGCCPVTARAHHHHPKCDDDGGDIRWRRERKGEME

SEQ ID NO: 185444 - protein, 337 aa, Glycine max
  Coding DNA Sequence Number=SeqID_68666
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=98%, HitCoverage=83%, E-value=1e-108, Identity=37%"; Hit description =Tetratricopeptide-like helical
  Pfam annotation: Domain name=PPR; Domain location=102-136; Score =41.8; E_value=2.3e-09; Accession=PF01535.11; Description=PPR repeat
  Pfam annotation: Domain name=PPR; Domain location=137-171; Score =41.5; E_value=2.9e-09; Accession=PF01535.11; Description=PPR repeat
  Pfam annotation: Domain name=PPR; Domain location=172-206; Score =42.6; E_value=1.4e-09; Accession=PF01535.11; Description=PPR repeat
  Pfam annotation: Domain name=PPR; Domain location=241-275; Score =38.8; E_value=1.9e-08; Accession=PF01535.11; Description=PPR repeat
  Pfam annotation: Domain name=PPR; Domain location=276-310; Score =21.8; E_value=0.0025; Accession=PF01535.11; Description=PPR repeat
  Pfam annotation: Domain name=PPR; Domain location=32-66; Score=31.6; E_value=2.8e-06; Accession=PF01535.11; Description=PPR repeat
  Pfam annotation: Domain name=PPR; Domain location=67-101; Score=11.9; E_value=0.29; Accession=PF01535.11; Description=PPR repeat
  Pfam module annotation: Pfam domain module=PPR::PPR::PPR::PPR::PPR::PP R::PPR; Domain location=102-136::137-171::172-206::241-275::276 -310::32-66::67-101
TVMDGLCKDGMVSEALDLFSQMCGKGIEPDLVTYTCLIHGLCNFDRWKEAAPLLANMMRKGIMPTLKTFNVTVDQFCKTGMISRAKTILSFTVHMGPEPDVVTYTSITSAHCMLNQMKDAMEVFDLMIRKGFSPSVVPYNSLIHGWCQTKNMNKAIYLLGEMVNNGLNPDVVTWSTLIGGFCKAGKPVAAKELFFIMHKHGQLPNLQTCAVILDGIVKCHFHSEAMSLFGEFEMSLDLSIIIYTIILDGMCSSGKLNDALELFSHLSSKGIKPNVVTYCTMIKGLLRRYEISNSTKYLMLMKGKGFRADATTTELLIKYFFANQENSALQVFLQKFV

SEQ ID NO: 185445 - protein, 85 aa, Glycine max
  Coding DNA Sequence Number=SeqID_68667
MRIKRSFKVVMGPRTRLIVSFKTRKGKQGSKGLSKELIQGKSIWLEAYKNKIASIISKYACELGSINKNQAKATVHAINGEKHTK

SEQ ID NO: 185446 - protein, 62 aa, Glycine max
  Coding DNA Sequence Number=SeqID_68668
FDAPHSFGEQGQSSSTAATHIESIDIGQQHHHDMGEPVIQEKRNPRRNRRSLPCETDHRLGH

SEQ ID NO: 185447 - protein, 118 aa, Glycine max
  Coding DNA Sequence Number=SeqID_68669
  Gene Ontology: Mol. function=allantoin transporter activity; Cellular component=integral to membrane; Biological process=allantoin transport
  Homolog annotation: Hit_ID=Q9ZPR7; Match level="QueryCoverage=78%, HitCoverage=24%, E-value=4e-29, Identity=65%"; Hit description =Ureide permease 1
MYVVESKVGAIGCMLVSLFFLGTWPAVMTLLERRGRLPQHTYLDYTLTNLMAAVIIAFTFGQIGNAQPNFLSQLSQSIYVLSCFTKACGELMTLPSRFELYLPLEFNSNSLPMIIISS

SEQ ID NO: 185448 - protein, 182 aa, Glycine max
  Coding DNA Sequence Number=SeqID_68670
  Gene Ontology: Mol. function=DNA binding
  Homolog annotation: Hit_ID=Q1S0F5; Match level="QueryCoverage=87%, HitCoverage=33%, E-value=2e-16, Identity=34%"; Hit description=IMP dehydrogenase/GMP reductase
MGSNQTPLLKKRFYHVKIKSLEIASLRELGQLMGQLQCHVFRKTYGKICDLATVEVSVKAIASLTQYYDQPLRCFTFGDFQLVPTVEEFEEILGYPLRGRKPYLFSGLYPSMARVARVVKISVQELDHVKQNRNGVVRIPRKHLEGKAKALADQEEWASFIDVFALLIFGVILFPNVEASSN

SEQ ID NO: 185449 - protein, 134 aa, Glycine max
  Coding DNA Sequence Number=SeqID_68671
  Gene Ontology: Mol. function=nucleoside-triphosphatase activity; Cellular component=integral to membrane; Biological process =translation
  Homolog annotation: Hit_ID=Q1S1V3; Match level="QueryCoverage=99%, HitCoverage=22%, E-value=5e-55, Identity=76%"; Hit description=AAA ATPase
MANSFALFLSSLAPNYIAGTSLLTVLLAAFFLFSGYFISKESLPKYWLFMHFFSMYKYALDALLINEYSCLVSRCLIWYQENEQCMVTGGDVLQKRGLKESERWTNVYFLLGFFLLYRVLCFLVLARRVSRSKT

SEQ ID NO: 185450 - protein, 288 aa, Glycine max
  Coding DNA Sequence Number=SeqID_68672
  Gene Ontology: Mol. function=steroid hormone receptor activity; Cellular component=nucleus; Biological process=regulation of transcription, DNA-dependent
  Homolog annotation: Hit_ID=Q1S1V4; Match level="QueryCoverage=88%, HitCoverage=32%, E-value=2e-75, Identity=63%"; Hit description=SPX, N-terminal; Major facilitator superfamily MFS_1
MAIDANKNNALEKGIKQPLLTSLKDKVDEDDDQDYDDSEEAPEDSRQPANSIGAAYRLLTPSVKVGSPLTISLLEVCALSHCLNGTLIFHVRHRTLLNDGKVQLLIYFMLKYAMEILLSESSVITTYYFNWTTSTVSIFLACLGLTVLPVNIIVGSYISNMFEDRQILLASEVMVFVGILFSFHVIFPYTEPQYICSGLLMFVSAEVLEGVNLSLLSRVMSSRLSRGTYNGGLLSTEAGTLARVIADATITLAGYGGVSRLLNVTLFPSFFICVASIIATCYTYNSLY

SEQ ID NO: 185451 - protein, 139 aa, Glycine max
  Coding DNA Sequence Number=SeqID_68673
MGDVDEVQEQMKVDMSTLKDQMASMMEAMLSMRRLIESNTVATAAPSTAAETDPALPTSTNQAHQLTPDMRNAYPYGLPPNYTPPTMHENVDHVVPVTFEGQLSQPIGGAREGPQERAQVDIDSYPPFTTEGPTFHTMP

SEQ ID NO: 185452 - protein, 309 aa, Glycine max
  Coding DNA Sequence Number=SeqID_68674
MDALNFLKFWRNATTTTTSEPHLVVETDTESDEEDSFFDLELTLHDFHNKENTTTTKIDDDPKQTTTTTTTELKSICSKDDELSKIDNDVPRKTPLPMSSPPEPISKRKVLPIEPISKPQSPIALLRSAPSFRIFMFRKRNRAPPQKTEHSVNETKVFAVKLSVDDFRSSPALSRDNSTRSLRSKVRGLSYEEPKPERFSKEVLRKYLKLIKPLYVKVSKRYSDKVRFSGEGFATSPSSSPSVASVSSRTEKQGKGMTVVSKHLGKSRSASSTVVGVGSPAKRSDDTLQQQLDGIQSAILHCKRSFNSR

SEQ ID NO: 185453 - protein, 78 aa, Glycine max
  Coding DNA Sequence Number=SeqID_68675
MNEAFQSSSEFHRTPFYVTTPMFEEVQVFVPLNEHKGPSLLPQKSHGLHNKQAKTITKLKFTSERYLSSFKKGSEPEY

SEQ ID NO: 185454 - protein, 277 aa, Glycine max
  Coding DNA Sequence Number=SeqID_68676
  Gene Ontology: Mol. function=signal transducer activity; Cellular component=endoplasmic reticulum; Biological process=neuron differentiation
  Homolog annotation: Hit_ID=Q1S1U9; Match level="QueryCoverage=99%, HitCoverage=100%, E-value=3e-92, Identity=63%"; Hit description =Reticulon
  Pfam annotation: Domain name=Reticulon; Domain location=94-277; Score= 326.1; E_value=6.3e-95; Accession=PF02453.8; Description=Reticulon
MASGDTDSFSDKVEENFHHHHNSDSDSYSDSDDDHNKRPPPKTTGSTNVYRLFGRDQPVHKVLGGGKRNSIANVSAFVMFLCVSRYYLLAFLTPADILLWRSRRSTGIVLGAGTAFWIFFELMQYHLITFICHLLIVSLAALFLWSNASVFIHKSPLHIPHVALPEECVHQVASALTIEINRAFVVVREIGTGKDLKKFLSVIAVLWVISVIGSWFNFMTLFYLFFVSLFTLPLLYEKYEDQVDALGEKAMIEIKKQYAVFDAKVLSQIPIAGFKKD

SEQ ID NO: 185455 - protein, 707 aa, Glycine max
  Coding DNA Sequence Number=SeqID_68677
LALVLPHEESDGETLDKGQKEKSKDTNQDSTTSQMQKIQEVFIPAKRDKHGYRFGFAKLIDVHDVHILCLTRNKLFFGEKRLMVHLPRFAKGQKHETRRNEPQQKKKLISVGSQKNALMVKINKVQHGSNNFYGLSFEVAVEDVRRLSQAYVAREWFNEIKPWEPKDVDRERLIWIKCYDVLCHAWSEDFFEKLGLAYGAFMYTNEHIKDKEHLDIGKFVMKTTHNIVINEVVKVKINDNIFHIKLVKEGCKECLNYFGCRNRRHKDSATFEELEDYKEEDKLNNNEDGQVGDLIPNFNFEIQNEKASKPLTVLLDQRDYQGLETSRGLLTLVITALGEVPLEFSCDHPHGRVQAKCNRRNCASLEVSEDAGTKLWGLAKSIGKSKDDMYVTYINRVDETKRGSKSKGSTIKRFEAILFHETKISGVSRSTIREIWGPSEYEWIAKDAKEGVALYERWESLSIMFIKTCISVSIHGSIPECQKVKDFMKAIDEQFESFEKVLDSTLMSKLSSMRLIGVVGRLAQEIGEGALTVTQDKGKKERKEKNHIPPIAKIKKESRSSSQSSPLGNLLFSWAAFSVLVNGCPTWEIVAEKGLKQGDPLSPFLFLIATEGLSDDSLAIGKASYDNLWALKAILRNFEMVSGLKINFNKSNIIGINVEERFLDAAEQFLNCKKSSFPFKFLGIPVGANPHRCERWKVFESRLASWK

SEQ ID NO: 185456 - protein, 52 aa, Glycine max
  Coding DNA Sequence Number=SeqID_68678
MHLGNTTTNRCNPIINDEWKRGTYGDDKCEGSGGTAYLNKSGAEYGPDLDQA

SEQ ID NO: 185457 - protein, 104 aa, Glycine max
  Coding DNA Sequence Number=SeqID_68679
MEQKHVLFSALSVGVGLGVGLGLSTGQAVQKWVVGSCESDEISGEQIVLELNNRVIDGKNSKVTFDDFPYYLRLFVVDFTSPLLLCQPQSFFDILLTVLLWFSM

SEQ ID NO: 185458 - protein, 154 aa, Glycine max
  Coding DNA Sequence Number=SeqID_68680
  Subcellular localization annotation: CTP_CleavageSite=51; ConfidenceScore=5.01e-01
MSGPGASGVLKATSADPWSASFMVETRTLFVFHKSKNFTSDYEIRMPPTVPVNHYSDPEGQHNRIRILTGRHDPASLRTGAHRRQKGTSRPVHTGGGPIDPTQAGITAAAGTRLALQWILVKGFRLYSFQLPDSMSPAPSPESNPNSPSPVTTM

SEQ ID NO: 185459 - protein, 81 aa, Glycine max
  Coding DNA Sequence Number=SeqID_68681
MGGADVDYGSGGGNIDDNCVFGEDGSRCIGGDHSSSVGAYGYGGGGSGADGGGGNSDSGADDNVGGGRGAGAGGDCNKNEK

SEQ ID NO: 185460 - protein, 70 aa, Glycine max
  Coding DNA Sequence Number=SeqID_68682
MEMSSGLRVQPRLLLLLLLLLLSSWLSSLDTHELDGDVGGAMGNRVGESGLKDQALAKGKPSCEREKKVG

SEQ ID NO: 185461 - protein, 85 aa, Glycine max
  Coding DNA Sequence Number=SeqID_68683
MTRCIGGDRGSSVGAYGYGGGGSGADGGGGNSDSGADDNVGGGRGAGGGGDCKKNEKCQMCDYNTVVAGFRMFAATSIIAEEGKP

SEQ ID NO: 185462 - protein, 396 aa, Glycine max
  Coding DNA Sequence Number=SeqID_68684
  Gene Ontology: Mol. function=RNA-directed DNA polymerase activity; Cellular component=intracellular; Biological process=RNA-dependent DNA replication
MDIQAAYSCLLGRPWIHEAGAVTSTLHQKLKFVRNGKLITVSGEEALLVSHLSAFSFIGADETEGTSFQGLTLEGKKPERNEVSFATWKSAQKVVQEGTGVGWGKVVQLLESKNREGLGFASSAGSATNSVGSSSITSTFCSAGFINNSPEANAVLEDAPEEIVLAFVTPGKLVRNWDAVDIPSVVHASKLGIYEPVEHNNPALSPNFESPVYEAEEEEDDEIPEELARLLEYEKKTIRPHEEVVEVINLGTEEDKKEVKIGASLEAAVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSK

SEQ ID NO: 185463 - protein, 89 aa, Glycine max
  Coding DNA Sequence Number=SeqID_68685
  Subcellular localization annotation: CTP_CleavageSite=33; ConfidenceScore=5.06e-01
MTDEGCANGGGRRMVGMTQRRRMKRRQRTLMPCAAKRFRGCARFCSRGERQGCHRNGCGGCCSEWQRKTIMRKRKSGGAVFGVAEKDNH

SEQ ID NO: 185464 - protein, 177 aa, Glycine max
  Coding DNA Sequence Number=SeqID_68686
MRRRRRLNLCEIPHGKRYGNVSEAPRLRFSSRKQFFQANSKEREVPKGLTPSFLPSSPIYSKIGEVVAAQLAQASSARPGEQGCFLQKQPPSGGIFRRAQDCHHQKGGDCGSNTFQGYFDDAKESRVKQIPKVQESSFKNQDSRFNNQVSRIIKIKIQESREDSIKISTKNVFQNIE

SEQ ID NO: 185465 - protein, 73 aa, Glycine max
  Coding DNA Sequence Number=SeqID_68687
  Gene Ontology: Mol. function=RNA polymerase II transcription factor activity; Cellular component=transcription factor TFIIE complex; Biological process=transcription initiation from RNA polymerase II promoter
SFEDDDFHCESCNGKLEVENDKFVAQEGGDGDENARRRRHEKLKDMLQKMESWLSLPFARTEKFVSLLIWAYR

SEQ ID NO: 185466 - protein, 154 aa, Glycine max
  Coding DNA Sequence Number=SeqID_68688
  Subcellular localization annotation: CTP_CleavageSite=85; ConfidenceScore=5.09e-01
MPISPCGSISWSVPSRHRGRAHKTPSGLEEVQQGPGVSSSSYGPLSILQGARTPPPCMVMPSRHRDRARRTPSGTKEVQQGPGVSSSDYGPLSVLRSACHPSKVIRPPTNRAFIKKYCAPMQAEGETPQQPGDGQQQATNAPPPPPEPLSSSIK

SEQ ID NO: 185467 - protein, 474 aa, Glycine max
  Coding DNA Sequence Number=SeqID_68689
  Gene Ontology: Mol. function=calcium ion binding; Cellular component =integral to membrane; Biological process=peptidoglycan metabolic process
  Homolog annotation: Hit_ID=Q4K3M9; Match level="QueryCoverage=100%, HitCoverage=44%, E-value=6e-66, Identity=29%"; Hit description=Rhs family protein
  Pfam annotation: Domain name=RHS_repeat; Domain location=110-146; Score=3.4; E_value=16; Accession=PF05593.4; Description=RHS Repeat
  Pfam annotation: Domain name=RHS_repeat; Domain location=160-198; Score=24.2; E_value=0.00048; Accession=PF05593.4; Description=RHS Repeat
  Pfam annotation: Domain name=RHS_repeat; Domain location=226-263; Score=4.2; E_value=13; Accession=PF05593.4; Description=RHS Repeat
  Pfam annotation: Domain name=RHS_repeat; Domain location=268-305; Score=26.5; E_value=9.4e-05; Accession=PF05593.4; Description=RHS Repeat
  Pfam annotation: Domain name=RHS_repeat; Domain location=332-369; Score=11.6; E_value=1.5; Accession=PF05593.4; Description=RHS Repeat
  Pfam annotation: Domain name=RHS_repeat; Domain location=374-411; Score=33.2; E_value=8.9e-07; Accession=PF05593.4; Description=RHS Repeat
  Pfam annotation: Domain name=RHS_repeat; Domain location=437-474; Score=22.7; E_value=0.0013; Accession=PF05593.4; Description=RHS Repeat
  Pfam annotation: Domain name=RHS_repeat; Domain location=64-105; Score=1.3; E_value=30; Accession=PF05593.4; Description=RHS Repeat
  Pfam module annotation: Pfam domain module=RHS_repeat::RHS _repeat::RHS_repeat::RHS_repeat::RHS_repeat::RHS_repeat::RHS _repeat::RHS_repeat; Domain location=110-146::160-198::226-263::268 -305::332-369::374-411::437-474::64-105
RSYNSLTQRAGLFGRGWSTVFDSYLTLEGNQATWFDDNGRELRFALPGEKEVLYSISEGLMVRRNAHGDVVIADDDGAVWRLYKPTARNPQLLRLASLSDEYGNALEMGWDEQSRLVRIHDEPLAIDVTLHYNDERHPQRVTAASHFDGEQHWPLMRWSFDDHGQLASVTDAAGIETRRFRYNVDGLMVWHRLPGGLESEYRWQLFDHWRVIENRTSSGDGCRMQYDLAAGITRVSTYDGQQREHHWNAQGLITCYIDERGEQWRYEWDDNELLTRRIDPLGHAVNFTYDELGNRIEEQDADGNAQTTEWLTHRALPSVITQPGGAAIRYYYDIHHGLERVVDALGHSTRYLRDEFGLITEEIDAAGNRYRREYNDAGQVIRETDCSGQTTRYRYHPLGWLSCVTAADGEETRYYYDAAGRPRQMERAEGWEERLEWSERGLPVAYASADGKRSEFAYDQAGRLTLSRNAQGEE

SEQ ID NO: 185468 - protein, 159 aa, Glycine max
  Coding DNA Sequence Number=SeqID_68690
MVIHSCMYVTRRGWHTLELNRCSCTDAMDGMVLVHACHSPWVACTGGLVGAHVHMSCMACTRGLVGARAHMPFMVVCYCIRPSYQVAHTGDIMLEEGLTKDGPLVLRASELRLWMLVSFLILIVSWTSSMVSYPNFVRGPLLDDMQLLFGPCEVLGTHH

SEQ ID NO: 185469 - protein, 84 aa, Glycine max
  Coding DNA Sequence Number=SeqID_68691
MYGYMNFDDAKEESNKAASKDKHLLQDKFKIASTNKALFQDSLKIKPCLKTKGYKVMQGFEFSEKLPTVTSFHWIGGWPSKAYK

SEQ ID NO: 185470 - protein, 84 aa, Glycine max
  Coding DNA Sequence Number=SeqID_68692
MLRWRKNRVLGRLLVQMLLLSSTLPIVAYLVDEKFEVLRKKGRETYTLLLETATMSGERWQEEWWEEYGRILRCFDVLAWIMEY

SEQ ID NO: 185471 - protein, 624 aa, Glycine max
  Coding DNA Sequence Number=SeqID_68693
  Gene Ontology: Mol. function=nucleic acid binding; Cellular component= beta-galactosidase complex; Biological process=DNA integration
  Homolog annotation: Hit_ID=Q1S4N1; Match level="QueryCoverage=96%, HitCoverage=74%, E-value=1e-157, Identity=59%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=85-224; Score=-7.3; E_value=0.024; Accession=PF00665.16; Description=Integrase core domain
  Pfam module annotation: Pfam domain module=RVT_2::rve; Domain location=177-389::85-224
MKEYAKAILNGRMMPKHSSSSDCWLVDSGCTNHMTSNEEFFRDLDKSQVSKVRIDNGDYITVKGKGIVIIESSTVFFENKQCTINDPYDNEVIRIKMRGKSFSLDPMEKEQAAYTAVMTNTETWHKRLGVFFKFKNWIENQSGFRIQVLRSYNDKEYTLNEFDKFCEEVGIEHQLTTPYTPKQNGVNFPQKQLMGRLLLRLVARLDTIRMLLAIAAQKQWKIDQLDVKSAFLNDFLNEEIYFEKPEGFAAKGDEDKVYLLKKALYGLKQDPRAWYNKIDEYLLKLGFVKSFSEITLYVKGYNDHFFVVSLYVDDLLVIGSNIELIQQFKEDMIRVFEMTDLGEMSYFLGIKIKQRQNEIFICQQKYAEEILKKFCMGNCKSMTTHMCQKEKLCKDDGTTKADEFEYRSLVGCLMYLTTTRPDIMYAVSVLSRFMNCANESHLRAAKRVLKYVKGTVSFGVKFFLIPSFELQGYFDSDWVGSLDDMKNTFGFCFNFGSRVFTWNSKKQEIVAQLTTEAEFFAATTSVNHALWLIKFLNDLHLEQKMSIEVMVDNQAAIAISNNPVFHGKTKHFSIKLLFIRDVQKDGAVRLKYFKTEDQLTDIFTKPLAKSIFEDLRERLGICTY

SEQ ID NO: 185472 - protein, 114 aa, Glycine max
  Coding DNA Sequence Number=SeqID_68694
  Gene Ontology: Mol. function=zinc ion binding
MTFEDTNDVDDRPSKLLKYCVSLCEDDENVITFQESKRKPEPQSENIDTWVPYEGQIFKSDENGYNFYSLFAKKNGFSIKRYRVCKCSKSKGEKNSSEVYRREFVHHPTSNVKP

SEQ ID NO: 185473 - protein, 70 aa, Glycine max
  Coding DNA Sequence Number=SeqID_68695
MVFSLKVKINLYRKFKYTKARLQIVTDQPLPLTSKAATTAGPTQEMKKVLLKRKELHGNYSTKGPKPYEV

SEQ ID NO: 185474 - protein, 190 aa, Glycine max
  Coding DNA Sequence Number=SeqID_68696
MGVGTMWSMKASICRVLVAVAMVMLLETRADKMDLARLAWWSGNLTLGWAEPKKFHPKRIWIKPRPTCFQCMARWVRPGQSGQSILTALLGTACKATMITHPSNTKTHMTTVTSVGLGCEGSKNHEFVNQVQNSGGQMRVIEVNISGPLDAQMQASDDKKSDISPMMEDMLEIVETEGTPQALSSIDLSQ

SEQ ID NO: 185475 - protein, 176 aa, Glycine max
  Coding DNA Sequence Number=SeqID_68697
  Homolog annotation: Hit_ID=Q53K52; Match level="QueryCoverage=72%, HitCoverage=33%, E-value=5e-52, Identity=79%"; Hit description =Expressed protein
MNMDEESEKVAVELAAQGVIGKRVDEMESDFMMALDYMIQLAENDQDDKRKSLLEVIKETVLSHLTKKCPPHVQVIGLLCRTPKKESRHELLRRVAAGGGVFKGENELKMHIPAANLNDIANQADDLLELFSDIISLCHVPYNLIFDKECRFLYLHREYLTLDIVQVLEDVQFWGL

SEQ ID NO: 185476 - protein, 83 aa, Glycine max
  Coding DNA Sequence Number=SeqID_68698
MGAIDAWAKGAPSILNCLMEVQEECNSFNKKVFGNILVRKRKVEARLNGVQLALEDGGSKSLRRIEQELYAKYNDILPQEEFL

SEQ ID NO: 185477 - protein, 162 aa, Glycine max
  Coding DNA Sequence Number=SeqID_68699
  Homolog annotation: Hit_ID=Q9LV67; Match level="QueryCoverage=88%, HitCoverage=39%, E-value=3e-50, Identity=71%"; Hit description =Arabidopsis thaliana genomic DNA, chromosome 5, P1 clone:MJE7
METRPVIPDRKLLARLVLIREEARNMMGGGITDERNHRGFYTLPQPEVDFLAKLVALKPGKNVLDMIRNVMQGKDEGADKSGNNDEDDTTNGDPAEFLGRPLVTGEKTLPVRPGMFLETVSKVLSGLYAGTDSGITAQHLEWVYSLSLYRFTIFSISKINVL

SEQ ID NO: 185478 - protein, 65 aa, Glycine max
  Coding DNA Sequence Number=SeqID_68700
MFVRKRLYAIFVLRVAFLGDSKRSRKLASKRSRKDKAAEGTSFAPEYDSHRFRSAEHQQRFEAIR

SEQ ID NO: 185479 - protein, 216 aa, Glycine max
  Coding DNA Sequence Number=SeqID_68701
IELCSEYIENSKPVGLPESQHDKRVGDLKKLAYQNESFIMTEQGKQVFYVQDPCDERWLGVLHGKTMDLNLEDDDSTLDTCPTPFSTQMPNVNGEEKVDNIHANHNDHDEGELINIAHDYSELPSSSWRPVVHVDPSTRKANGPHKKKLRTYLGIVARDKGSTIVHNVPLGNDHMKVDVEEVRDVDASLPVPTQEGFNDIQGSKPKAIAKWIFQLK

SEQ ID NO: 185480 - protein, 191 aa, Glycine max
  Coding DNA Sequence Number=SeqID_68702
  Homolog annotation: Hit_ID=Q1SXA8; Match level="QueryCoverage=47%, HitCoverage=5%, E-value=4e-07, Identity=34%"; Hit description=Zinc finger, CCHC-type; Polynucleotidyl transferase, Ribonuclease H fold
  Pfam annotation: Domain name=zf-CCHC; Domain location=29-46; Score =31.3; E_value=3.4e-06; Accession=PF00098.13; Description=Zinc knuckle
MWKSKRGSKWNNSSKKVFKERKDKENSSIICYECKKPGHFKSECPNLEKSKDKKKYYKSKEKKGLMSTWEDLDDTLSDEEGEEEANLCLMANTTFRESKSDQKDEVQPLTTPFLLGQLRWARTRPKSPPVALKRAEERSEWWAVDGEVHEIGDLVPLRERFVIPRENIPNKRRKQLREQFMRRTRLVLKES

SEQ ID NO: 185481 - protein, 184 aa, Glycine max
  Coding DNA Sequence Number=SeqID_68703
  Gene Ontology: Mol. function=transition metal ion binding; Cellular component=chromatin; Biological process=cytoskeleton organization and biogenesis
  Pfam annotation: Domain name=Transposase_21; Domain location=38-183; Score=80.9; E_value=1.6e-21; Accession=PF02992.5; Description =Transposase family tnp2
MSLKKCINAPGVGVSRYKVKDDDECNSDKNTKKGPLSEDGRNCNGMLHQPTDSSQWKKINRLYLDFDKEIRNLRLGLTTDGMNPYGSLSTQHRNEIDAYLSPLIEDLTKLWDEGVAVFDGYRNRTFKLRAMLFCTINDFPVCGNLRRYNVKGHRACPICEEDTMRVRKGSSGHEKGFKVRQLDG

SEQ ID NO: 185482 - protein, 262 aa, Glycine max
  Coding DNA Sequence Number=SeqID_68704
  Gene Ontology: Mol. function=nucleic acid binding; Biological process= RNA-dependent DNA replication
MEYLTPKVEENNNIQLPTLPQGVTFDFKYGFLQMIESNQFNEASHEDPMVHLRRFLRLCDTIRQPNICKKYVRLHVFPFSANGKAWDRLSVFSENIITNWTRCSSAFLKRYLSVMKTDKLQRHIGNFTQNEQENFLEAWERFHETSLVVACQGNLMMKPPAYVIKIIEDFPTSVMGYENHEEALMLHVKRSVNQVETKAATYDLGQKIQALSKQIESLTKAQSQLPNSTPLYHTCERCGCVHGPGECTLAGKLAQVIMPLIK

SEQ ID NO: 185483 - protein, 88 aa, Glycine max
  Coding DNA Sequence Number=SeqID_68705
  Gene Ontology: Mol. function=beta-galactosidase activity; Cellular component=beta-galactosidase complex; Biological process =carbohydrate metabolic process
  Homolog annotation: Hit_ID=Q9SCV5; Match level="QueryCoverage=85%, HitCoverage=9%, E-value=2e-22, Identity=64%"; Hit description =Putative beta-galactosidase
MKHSGLVACNFQKAKYGGLDAIESYIFWDRHEPVRREYDCSGNLDFIDFLKLIQEAELYFILRIGPYVCEDGTLEAFHYGYTICQRLN

SEQ ID NO: 185484 - protein, 131 aa, Glycine max
  Coding DNA Sequence Number=SeqID_68706
  Homolog annotation: Hit_ID=Q4QYX3; Match level="QueryCoverage=34%, HitCoverage=5%, E-value=5e-08, Identity=55%"; Hit description=Beta -galactosidase
MTSIDIPDISLWNNSTLRVSTMGHTLRAYVSGRADDFEAPFGIDPMVMDLQDSGKRQAWVNGKSIGCYWSSWITNTNGCSDPYPLELVSLRSSSSMDSFASWKMNGSGMEKEEREETPLQGEDESRRSPPP

SEQ ID NO: 185485 - protein, 265 aa, Glycine max
  Coding DNA Sequence Number=SeqID_68707
MGRRVPNENNNITLIEPFLYFPFCMVGFVTSITIIAALCSVRFRKKSSSAPAPVDHDSHEVTNLLNIESTTPPTTTSLEHEQHPSTSEGPMLENTAQTTQTQNNDTLVKELPLPPALQQHPNVDPKIVKRATSERRLSFNLSMKMPRSFSVARNDQKGNFNDGGNKGKLLKTNESMWMKTKGKLKNEDSVWMKTIILGGKCVPDEEEDVVIYEGKGKKISAYHPRKSTSMSLSRQCSYINPGAFSVPQSHEERIKSINNTCYTQP

SEQ ID NO: 185486 - protein, 104 aa, Glycine max
  Coding DNA Sequence Number=SeqID_68708
MEGCARGREKVADQRCLKEEEGRARGEGEMEGHVRGRGRVAGHQYRKGEGRSCEGEKEGPFRGRGKLREKNEEREMKSVLRGRKGKKVKRSGEMKRHERGRRKK

SEQ ID NO: 185487 - protein, 417 aa, Glycine max
  Coding DNA Sequence Number=SeqID_68709
  Homolog annotation: Hit_ID=O64852; Match level="QueryCoverage=99%, HitCoverage=99%, E-value=3e-86, Identity=44%"; Hit description =Putative SF16 protein
  Pfam annotation: Domain name=IQ; Domain location=122-142; Score=5.2; E_value=11; Accession=PF00612.17; Description=IQ calmodulin-binding motif
  Pfam annotation: Domain name=IQ; Domain location=74-94; Score=26.5; E_ value=9.2e-05; Accession=PF00612.17; Description=IQ calmodulin -binding motif
  Pfam annotation: Domain name=IQ; Domain location=96-116; Score=16.5; E_value=0.097; Accession=PF00612.17; Description=IQ calmodulin -binding motif
  Pfam module annotation: Pfam domain module=IQ::IQ::IQ; Domain location=122-142::74-94::96-116
MGASGKWVKALIGLNNKNDLGGKKKKWRLWKISSAGENRSQDYDYASVASDSFNAAVATVVRAPPKDFKLLKQEWAATRIQTAFRAFLARRALRALKGVVRLQALVRGRLVRKQAAVTLRCMQALVRVQARVRARRVRMSIEGQAVQNMLNERRTKAELIKQAEEGWCDSKGSLEDVKTKLQMRQEGAFKRERAIAYSLAHKQWRSTPISNSRANATLNNQDTDKANWGWSWLERWMAAKPWESRLMEQTHHANATEKTPPPPPKKCVDSSNSKTSEPCNVKIRKNNVSTRISARPPLIWQANHLSSSPSSEFHYDESSNSSSICTSTTPISGSAALPCDRTEDTNNTRPSYMNLTESTKAKQKTNNHQYNRSHRQQSMDEFQFLKRTAVFSNGASDPSTNFCRPLYLPTYMDKRSQ

SEQ ID NO: 185488 - protein, 99 aa, Glycine max
  Coding DNA Sequence Number=SeqID_68710
KMLQCERYFSQLNNDIKISNGENSRNWAANVVIEFDDDPTVNDSKIIVFLRQAEAQFNGELTSGIDLLCQKLCVMGCYTCSGTTTFGQAMAVLTALDSA

SEQ ID NO: 185489 - protein, 458 aa, Glycine max
  Coding DNA Sequence Number=SeqID_68711
  Gene Ontology: Mol. function=monooxygenase activity; Cellular component=membrane; Biological process=electron transport
  Homolog annotation: Hit_ID=Q1RV73; Match level="QueryCoverage=99%, HitCoverage=85%, E-value=0.0, Identity=79%"; Hit description=E-class P450, group I
  Pfam annotation: Domain name=p450; Domain location=1-454; Score =147.5; E_value=3.5e-41; Accession=PF00067.12; Description=Cytochrome P450
MGRQPLILVADPELCKKVGIKQFKDIPNRSIPSPISASPLHQKGLFFTRDSRWSAMRNTILSVYQPSHLASLVPMMQSFIESATQNLDTPNEDIIFSNLSLRLATDVIGEAAFGVNFGLSKPISVCESIKSVSVNNVRNDDNDNGDDEVSDFINQHIYSTAQLKMDLSGSFSIILGLLAPILQEPFRQILKRIPGTMDRKIESTNEKLSGRLDEIVKRRMENKNRTSKNFLSLILNARESKKVSENVFSPDYVSAVTYEHLLAGSATTAFTLSSIVYLVAGHIEVEKKLLQEIDGFGTPDRIPIAQDLHDSFPYLDQVIKEAMRFYTVSPLVAREASNEVEIGGYLLPKGTWVWLALGVLAKDPRNFPEPEKFKPERFDPKCEEMKRRHPYAFIPFGIGPRACIGQKFSLQEIKLSLIHLYRKYVFRHSLDMENPVEMEYGMVLNFKHGLKLRVIRRT

SEQ ID NO: 185490 - protein, 191 aa, Glycine max
  Coding DNA Sequence Number=SeqID_68712
  Gene Ontology: Mol. function=sequence-specific DNA binding; Cellular component=nucleus; Biological process=regulation of transcription, DNA-dependent
  Homolog annotation: Hit_ID=O82042; Match level="QueryCoverage=92%, HitCoverage=66%, E-value=2e-38, Identity=50%"; Hit description=Heat shock transcription factor
MAEIVRLRHQQLNSREQLNSMETRLQATEKKQQQMMSFLAKALSNPSFTKQLVQKTPQSREVLGVEINRKRRLTASPSVENLQQDDQDLATLDYPSHDRDLATMETDMDTFFSPAYDNELSSETNEPASISVEDTILEDFLNKDLVTWNPEDEVIIGDSSQVDVPVEDLVANPDDWTGKVVDAEEPNKYCS

SEQ ID NO: 185491 - protein, 150 aa, Glycine max
  Coding DNA Sequence Number=SeqID_68713
MPKKGASMEEGVGLQCQRAEVNVKEWSKQKGVGFTARRKQAESSRVHSKEKASRKRNRGDDDDGGDSCEMVMFWNDGDDNVDDGGGENSNKMVMAAAKTVVQCNNDSDNDNINEGNDNGDSSDVMVATCQSSGMDNVVAAIAVAGAAAVA

SEQ ID NO: 185492 - protein, 658 aa, Glycine max
  Coding DNA Sequence Number=SeqID_68714
  Gene Ontology: Mol. function=actin binding; Cellular component =cytoskeleton; Biological process=bipolar cellular bud site selection
  Homolog annotation: Hit_ID=Q67XH3; Match level="QueryCoverage=99%, HitCoverage=100%, E-value=0.0, Identity=75%"; Hit description =Fimbrin 2
  Pfam annotation: Domain name=CH; Domain location=116-232; Score=97.5; E_value=3.9e-26; Accession=PF00307.21; Description=Calponin homology (CH) domain
  Pfam annotation: Domain name=CH; Domain location=261-363; Score=99.5; E_value=9.8e-27; Accession=PF00307.21; Description=Calponin homology (CH) domain
  Pfam annotation: Domain name=CH; Domain location=387-492; Score =109.4; E_value=1.1e-29; Accession=PF00307.21; Description=Calponin homology (CH) domain
  Pfam annotation: Domain name=CH; Domain location=508-615; Score=86.1; E_value=1e-22; Accession=PF00307.21; Description=Calponin homology (CH) domain
  Pfam module annotation: Pfam domain module=CH::CH::CH::CH; Domain location=116-232::261-363::387-492::508-615
MSGHWGILVSDPWLQNQFTQVELRSLKSHFMSMRRESGRLVIADLASKMSRVKVVGENLSEEERASCVKDLYQNTEEEVYLKLQTFVNSRTGSSPKNSLAFLKAATTTLLHTISESEKASYVAHINHYLAQDEFLKKYLPIDPSTNELFEIAKDGVLLCKLINVAVPGTIDERAINTKKILNPWERNENHTLCLNSAKAIGCTVVNIGTQDFIEGRRHLVLGVISQIIKIQLLADLDLKKTPQLLELLDDSKDMEELMNLPPEKILLRWMNFHLKKAGYKKIVTNFSSDVKDAEAYAHLLNVLAPEYTNPSTLAVKNPFERAKLVLEHADKMGCKRYLTARDIVEGSPNLNLAFVAHIFQHRNGLSAQTKQQMSLLETFPDDTQDSREERAFRLWMNSLGNSTYINNVFEDLRNGWVLLETLDKVSPGIVNWKIANKPPIKMPFRKVENCNQVVKIGKQIKFSLVNVAGNDIVQGNKKLILAYLWQLMRYNILQLLKNLRFHSRGKEINDADILEWANSKVSSSGSQSRMDSFKDKSLSDGIFFLELLSSVQPRAVNWGLVTKGVTDQEKKMNATYIISIARKLGCSIFLLPEDITEVNQKMILTLTASIMSWCLKHPREERTVGTSDNESGSQLETTSNSTLDDSASDSSIDENGNM

SEQ ID NO: 185493 - protein, 217 aa, Glycine max
  Coding DNA Sequence Number=SeqID_68715
MEGLVDLAAIDAFLTFHHGKESLVVAILAIYDTFDRGCEKNGARIEGRIGILSSCEGCPMRGVPSDESITPFIARGFSDHNARDRELRGSSNGIIGGYHKWLRVRTQGLDWLPNLKTVRDDEVKASEESDEVQALKAELERAWVVEEKFKAAIVSSSSEEVKGIITGQRHDLEGRAKGNMWAIIDKCKENLNLAVTHEQRLEDEYAKISAEREARER

SEQ ID NO: 185494 - protein, 203 aa, Glycine max
  Coding DNA Sequence Number=SeqID_68716
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-25, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRRQHVLAFAFIGIHTLTFKGLHALAFRGLHVLTFRGQHALTFRGLHVLTFKGLHILAFRGQHVLAFAFIRLHTLTFRGLHVLTFRGLHALAFRGLHVLTFRGPNILIFRGLHVLTFRGLHVLTFRGLHALAIKGLHVLTFRGLHALTFRGLHALAIKRLHALAFRGLYVLAFRGLHILTFRGLHICALREFMVLCP

SEQ ID NO: 185495 - protein, 211 aa, Glycine max
  Coding DNA Sequence Number=SeqID_68717
  Subcellular localization annotation: CTP_CleavageSite=44; ConfidenceScore=5.19e-01
MDDLTVNFRGARKARARLADVPSSSTPPAPPTYATPTPAPPGPSAQDSQCFESMLLSLYQGQILLMQSLQVVWPGTQPSLVREGGGSGAQVPQQVQDASLEATILVPFVFKVGGTQVRQEAATPERSPQISPDPPSPMMDQSSPQQLADSPTTVHEMPADLSTPLLEIPEDPATPVLGLTTTPPATPVLHFTDEEATQDQDTQQDDQSQEF

SEQ ID NO: 185496 - protein, 54 aa, Glycine max
  Coding DNA Sequence Number=SeqID_68718
MVDVDVVKEQVSQNLEPTKCDGWDCLTYCDENNYGLNGIQDARKFVKRLIQKQH

SEQ ID NO: 185497 - protein, 87 aa, Glycine max
  Coding DNA Sequence Number=SeqID_68719
MGVKYLKAVKRRLHATKQWSPDEIRMMHDARTTLSNQFVGLRTLDGGRCTNSSRQSIHGASDFMMDDARTALGNQFVGLQDLIVDDA

SEQ ID NO: 185498 - protein, 198 aa, Glycine max
  Coding DNA Sequence Number=SeqID_68720
  Homolog annotation: Hit_ID=Q1SMF0; Match level="QueryCoverage=88%, HitCoverage=34%, E-value=1e-19, Identity=32%"; Hit description =Tetratricopeptide-like helical
MVGSVVNGDTSEMDKDQWMYDSILSEEVDINDENEGEAGVNEEHIDHSDVFNTSHVFATQDDILQWAPSVAYEIGFVTMILRSDINIGMRGRTSFMLIGCKRSGQYGSRKKDFVRRITGSRKCGCPFKLHGKPVVGGQGWMMKLMCGSHNHELAKSLVGHPYAGRLTKDEKTIIAYMTKSMVKLRTILLTLKEHNANS

SEQ ID NO: 185499 - protein, 101 aa, Glycine max
  Coding DNA Sequence Number=SeqID_68721
RDVRACLNEWWDQRKGMKGQLRKPPPASGSEFPYKIQPTRNLSTRSPPSANHNATMDRSSLCGVELNESVPQFETLEIAEEKISRFSNEALSEHCEECNQQ

SEQ ID NO: 185500 - protein, 43 aa, Glycine max
  Coding DNA Sequence Number=SeqID_68722
MALVMDAVVCSSLSVPSGSMGQAQLSATSAPTARYFWVQTSDF

SEQ ID NO: 185501 - protein, 65 aa, Glycine max
  Coding DNA Sequence Number=SeqID_68723
  Gene Ontology: Mol. function=structural constituent of ribosome; Cellular component=ribonucleoprotein complex; Biological process =translation
  Homolog annotation: Hit_ID=O81363; Match level="QueryCoverage=87%, HitCoverage=22%, E-value=3e-25, Identity=94%"; Hit description=40S ribosomal protein S4
  Pfam annotation: Domain name=RS4NT; Domain location=5-42; Score=73.4; E_value=7e-19; Accession=PF08071.2; Description=RS4NT (NUC023) domain
MNIARGLKKHLKRLNARKHWMLDKLGGAFAPKPSSGSHKSRECLPLILILRNRLKYALTYLKTSR

SEQ ID NO: 185502 - protein, 214 aa, Glycine max
  Coding DNA Sequence Number=SeqID_68724
MLVLEEGQECEYSQRRNRADGFDEEAIAQLLCIPGMPPTRHPLDPDKSNRALGFPALITILCQSFGVPVTPSKVIRPPITRAFIEKYCTARQAQGGDPQAPDAPPPPPQADPAGSFDTERYLRHLVRQQAANHRAHVQTHDYLYQLSLSLQSQGFPPFPCPTLDQFRAEVAWPEDWPEAQAGEAPAEAPGDADEARMDEEMTNLLDFLGGSGVT

SEQ ID NO: 185503 - protein, 165 aa, Glycine max
  Coding DNA Sequence Number=SeqID_68725
  Gene Ontology: Mol. function=nucleic acid binding; Biological process= DNA integration
  Homolog annotation: Hit_ID=Q1S1G2; Match level="QueryCoverage=98%, HitCoverage=11%, E-value=2e-09, Identity=26%"; Hit description =Integrase, catalytic region; Zinc finger, CCHC-type; Peptidase aspartic, catalytic
MDPLPSIAKVFSYAIQQERQIDNNDALGSTSLIKATNTSSPNSPFSCTYCGKNWHIVDRCYRKMAFLISHFLEKHGYPHGRKYHKPQGPSINNENAINEENANSNVEQNQEAQGSDVKVTTQQYKALMTLLQQQGSSTHNSLHVNQIGTMTGSGHALTSNVINKL

SEQ ID NO: 185504 - protein, 84 aa, Glycine max
  Coding DNA Sequence Number=SeqID_68726
MRKCRRVKLPASIVDHRVVPGDMSRGSRDLADIRRAPGSQPITGTKTTKQGGLCRWLASCESCVIYGLWPLVIDNQGWVIDSKA

SEQ ID NO: 185505 - protein, 104 aa, Glycine max
  Coding DNA Sequence Number=SeqID_68727
  Gene Ontology: Mol. function=DNA binding; Biological process=DNA integration
MGDSWLWHRRAAHINMHPLNHLVKKELVIGIPKLKFEKNKLCEACHKRKQVKNSFQKNEIHHNICSPRTPQQNDVVGRKNRSLEEGPRTLLNESKLAKCFWADV

SEQ ID NO: 185506 - protein, 295 aa, Glycine max
  Coding DNA Sequence Number=SeqID_68728
  Gene Ontology: Mol. function=protein transporter activity; Cellular component=cell outer membrane; Biological process=protein transport
  Homolog annotation: Hit_ID=Q7WNY6; Match level="QueryCoverage=57%, HitCoverage=85%, E-value=3e-63, Identity=68%"; Hit description=Outer- membrane lipoprotein lolB precursor
  Subcellular localization annotation: CTP_CleavageSite=45; ConfidenceScore=5.25e-01
MPPTSSWKVKNTAMIPKSIVAIRVFLNIGILRKKAAARSAATGLACRARGSCARHRFCNADLLIEAGRTCYRQTTQRPRRAVVDVTKRWRSGLVDDQAHHDATPWLLPFQHQHLRAERVVARQPRAPAALLEGHGAAEVVVGHVGGFGLARQLAAQPVAHAGYRHAAAQGVLGQGIGIVGHQAGAVGLGQAGRAGPAFDPRFGRAERVGQVEHVAAAIVRPGKAALHGALLAVFLVDRDGEASDARERVGRHAFNGLGRGGAGRQHERQHGQQRPAHPFQPEAARRSRHRLTPSA

SEQ ID NO: 185507 - protein, 155 aa, Glycine max
  Coding DNA Sequence Number=SeqID_68729
MVKVVTPNGGIMELYTPITAECITNEFSGQGIFRSRRDLFSEQLHHDEELHAGELYYLLPLDPSCRLSSTKNITRQLSNNAATLTPYRMFTCDINNNRMWSEAAEVFPRKGVWKVKLVINPEQLSEILSQESRTEAFVETLRTVAKCGNGMPSGA

SEQ ID NO: 185508 - protein, 74 aa, Glycine max
  Coding DNA Sequence Number=SeqID_68730
MACTHIPLSKLPHVWHLLSMSGFTRDSPQISASLHQLDLAPYASGPYNAQWNAPGLLHDKHHVAFESYSRRNGG

SEQ ID NO: 185509 - protein, 120 aa, Glycine max
  Coding DNA Sequence Number=SeqID_68731
MEVDACDHLIPIHNLSIQFRALSKEWNRKGSRKKKKKRRKKKKKWNKILQKKRKKNLIPSLQRDRSTTDSASKKYVDEDHSGKHDILKSKPELREESKGSVATPNPSLQDPKGNQTGRAS

SEQ ID NO: 185510 - protein, 181 aa, Glycine max
  Coding DNA Sequence Number=SeqID_68732
  Gene Ontology: Cellular component=mitochondrial matrix
  Homolog annotation: Hit_ID=Q8W487; Match level="QueryCoverage=53%, HitCoverage=39%, E-value=9e-12, Identity=36%"; Hit description =Protein At2g39795, mitochondrial precursor
  Pfam annotation: Domain name=MAM33; Domain location=4-128; Score= -42.9; E_value=0.037; Accession=PF02330.6; Description=Mitochondrial glycoprotein
MFGGAVPAPTPTPNGGVVNSDEMQMHITVIVTISKGEGCVLEIMCSAWPDSIEIKRLFIRANEKIIAEPYAGPEFMELDDELQYRLYDFLEVRGINDELACFLHQYMKNKDKAELIGWMKRTQILKRLEPQASFWPSNFWDRYVIVLKYESFVNQYNLIVYSQLSEVYANLVIQIEPQNRI

SEQ ID NO: 185511 - protein, 261 aa, Glycine max
  Coding DNA Sequence Number=SeqID_68733
  Homolog annotation: Hit_ID=Q39262; Match level="QueryCoverage=45%, HitCoverage=48%, E-value=3e-24, Identity=52%"; Hit description=Zinc finger protein 3
  Pfam annotation: Domain name=zf-C2H2; Domain location=104-126; Score =20.4; E_value=0.0063; Accession=PF00096.16; Description=Zinc finger, C2H2 type
MDLQRQESCPSENLNIITFSDTVPCQNPEPSINTQTKTNQTQTEDQKHPHDSVPRVLLDLSLSNKDSSDDDSKSELNLLNCFHTNFSENTSESSQGNELDPRVFSCNYCQRKFYSSQALGGHQNAHKRERTLARRGYKAGVADFGHTYSNMHFLPSHDLYNKALGIQVHSMINKPSYQTPIFGPCRSIGWQRQPLDAQPAIGNFRVGAETESSLADSVPKLGKFSTRLVTEGFGGYCFGSITNLKSKQQEKLQKLDLSLKL

SEQ ID NO: 185512 - protein, 225 aa, Glycine max
  Coding DNA Sequence Number=SeqID_68734
  Gene Ontology: Mol. function=receptor activity; Cellular component =integral to membrane; Biological process=ER to Golgi vesicle -mediated transport
  Homolog annotation: Hit_ID=Q9LMP7; Match level="QueryCoverage=93%, HitCoverage=94%, E-value=6e-85, Identity=77%"; Hit description=Golgi SNARE 11 protein
  Pfam annotation: Domain name=V-SNARE; Domain location=52-203; Score =149.2; E_value=1.1e-41; Accession=PF05008.5; Description=Vesicle transport v-SNARE protein
MIDSRNLPLPNLLQARKLEAQLDEQMNSYRKLVSANVSTKADIAESDLGSWIERLLKQLQQVNTQMQAWVSSGGSEMVSHTLTRHQEILQDLTQEFYRLHSSVKAKQEHASLLEDFKEFDRTRLDLEQGVDSEQHALLKERSSISRSAGHMDNVISQAQASLGALVFQRSTFGGINSKLGNVSSRLPTVNNILSAIKRKKSMETIILSLVSAVCTFLIFMYWLSK

SEQ ID NO: 185513 - protein, 74 aa, Glycine max
  Coding DNA Sequence Number=SeqID_68735
MGEETRAPPLPELLCPLPTLGNMIYLKRSMSITITLHNSLIIAGEGSVGFRLGGFCEELGEIPKKKSSRQQAVV

SEQ ID NO: 185514 - protein, 213 aa, Glycine max
  Coding DNA Sequence Number=SeqID_68736
  Subcellular localization annotation: CTP_CleavageSite=63; ConfidenceScore=5.08e-01
MTICYDYTTACCLLLFFFGISPNSSQKPPSLNPTDPSLPVQQFILFTLFLHPTSPAMIKLLCRVMVIDMLLFKYIMFPNVGNGHSPRCHESLHSFRFQYVGLQFSILACLSVCKSGGGLGRGGDLESCGDCPEGIETLCADMEVDHTDVRVLMLACLCLELMRTKFNRKMKAEEQGYFTLDEWRRGLKALRADTVSKLKKALPDLEKEVQLLK

SEQ ID NO: 185515 - protein, 199 aa, Glycine max
  Coding DNA Sequence Number=SeqID_68737
  Gene Ontology: Mol. function=transcription factor activity; Cellular component=nucleus; Biological process=regulation of transcription, DNA-dependent
  Homolog annotation: Hit_ID=Q8S9H4; Match level="QueryCoverage=88%, HitCoverage=93%, E-value=1e-26, Identity=45%"; Hit description =Ethylene response factor 1
  Pfam annotation: Domain name=AP2; Domain location=11-78; Score=56.1; E_value=1.1e-13; Accession=PF00847.10; Description=AP2 domain
MVRNMMESEENDKDRGVQSDNPNNAIVESAKGTGALGKTRIWLGTFETAEDAARAYDEAARLMCGPKARTNFPYNPNEPHSSSSKLLSATLTAKLHKCHMASLSLQMAKQKPPQNKEPQPSHGSNPFASANAIAGSSADTSFRWPDNRHEEFRWLEGNWVGVEGQVEVSNQQFQPVLEDDHIEQMIQELLDYGSIELCP

SEQ ID NO: 185516 - protein, 74 aa, Glycine max
  Coding DNA Sequence Number=SeqID_68738
MLNSCNRLIVDPASRDDYKRLRTCEAMEKEKDNRKGSMHNIPCVPLLYVSLAKIYRESVLFLVRIVAGYCAVWT

SEQ ID NO: 185517 - protein, 101 aa, Glycine max
  Coding DNA Sequence Number=SeqID_68739
MEEERVEVGVVEAREVEGGEKGEPEEEVREKRERRVGNGEGGSEAVGDGEELGGEKRERLKVTMGFQEFQYQFPALVGGNTMVLKLISSNGDVVSGMLLKN

SEQ ID NO: 185518 - protein, 339 aa, Glycine max
  Coding DNA Sequence Number=SeqID_68740
  Subcellular localization annotation: CTP_CleavageSite=61; ConfidenceScore=5.75e-01
MVNGDGGSSGSGTKFSGGSSGSSGGAKKTSGGSSGSSGGVKKTSGGSSGSSGGARKTSGVVGMLKVGGSSGISGVSGTVKAGGTSATNGGGKKAFGVCGIVKTGGVERNGVGSSGGGKEMSGSVGVERRGGEDKNGTSGGALFMKGFGGGRTRGGKRVGAGGGGDGTNGGAGGRGGGEGGGNGQQGATGGGEHTGGGGGGGGGDGHAGLGGDGHGSGHGGHNGGGGGGGDGGSGGGDGGDCGGGGGAEYCTGGGILGKGDEGIGVWSKGLSGQVKVGKGQRPHFPNRYRGVVLVSAARECVSKSSANKVVVTVFAFFISGAFGLFLALFSEQCETTPTT

SEQ ID NO: 185519 - protein, 499 aa, Glycine max
  Coding DNA Sequence Number=SeqID_68741
  Gene Ontology: Mol. function=protein binding; Cellular component =cytoplasm; Biological process=protein modification process
  Homolog annotation: Hit_ID=Q1RXV5; Match level="QueryCoverage=98%, HitCoverage=86%, E-value=2e-84, Identity=40%"; Hit description =Cyclin-like F-box
  Pfam annotation: Domain name=F-box; Domain location=1-49; Score=23.2; E_value=0.00093; Accession=PF00646.23; Description=F-box domain
  Pfam annotation: Domain name=LRR_1; Domain location=170-194; Score =7.5; E_value=11; Accession=PF00560.23; Description=Leucine Rich Repeat
  Pfam annotation: Domain name=LRR_1; Domain location=258-283; Score =2.1; E_value=1.2e+02; Accession=PF00560.23; Description=Leucine Rich Repeat
  Pfam annotation: Domain name=LRR_1; Domain location=310-335; Score =0.4; E_value=2.4e+02; Accession=PF00560.23; Description=Leucine Rich Repeat
  Pfam annotation: Domain name=LRR_1; Domain location=336-363; Score =4.9; E_value=34; Accession=PF00560.23; Description=Leucine Rich Repeat
  Pfam annotation: Domain name=LRR_1; Domain location=416-440; Score =7.0; E_value=14; Accession=PF00560.23; Description=Leucine Rich Repeat
  Pfam annotation: Domain name=LRR_1; Domain location=465-491; Score =7.4; E_value=12; Accession=PF00560.23; Description=Leucine Rich Repeat
  Pfam module annotation: Pfam domain module=F-box::LRR_1::LRR_1::LRR _1::LRR_1::LRR_1::LRR_1; Domain location=1-49::170-194::258-283::310 -335::336-363::416-440::465-491
MSVKDLPEECWELVFRFIGHGRHLESLSLVCKQFLSITNRLQFSLTIYDPTIPLLPRLLLRFPRLRILDFSHLNGHHEALLHQISQSRLDLDLLNLSNQKTLSVDGLRELGSNMKNLRVLICSNIGSLRDSHLVVIAYCFPFLEELDISFPLDSQASDFGVLRLSSMLENLRKINISGNYLITDKSLFSLCQNCLSLEEISFFTCYKITQLGIASAIRLRPGLNSISFNIEKKRIHGPGLTLTPIDLDLIDSFRSLKSLTAIDLSNSVISDEFLFAVAEGGGLLLKKLILQDCCNCTFSGISYVLSKCQSVQRLDLRKADFLTDQCISKLSIFLLNVTSINLSGCCQLTNSTFFILTRNCPLLSEIKMERTYLGVEGEEDSIQDSFVNLEVKKVYLGDNVLLSDASLIKFASVCPSLQLLDLNGCEGVSGEGIVEVLKRCCEIRHLNLAYTGMKVFEMMDFEVSQLEVLKLSGSRIEDEALSIISKRCSGLLLLDIQSC

SEQ ID NO: 185520 - protein, 449 aa, Glycine max
  Coding DNA Sequence Number=SeqID_68742
  Gene Ontology: Mol. function=protein binding; Cellular component =cytoplasm; Biological process=ubiquitin cycle
  Homolog annotation: Hit_ID=Q1RXV5; Match level="QueryCoverage=99%, HitCoverage=77%, E-value=1e-106, Identity=49%"; Hit description =Cyclin-like F-box
  Pfam annotation: Domain name=LRR_1; Domain location=139-158; Score =0.6; E_value=2.2e+02; Accession=PF00560.23; Description=Leucine Rich Repeat
  Pfam annotation: Domain name=LRR_1; Domain location=164-185; Score =0.8; E_value=2e+02; Accession=PF00560.23; Description=Leucine Rich Repeat
  Pfam annotation: Domain name=LRR_1; Domain location=190-214; Score =1.7; E_value=1.4e+02; Accession=PF00560.23; Description=Leucine Rich Repeat
  Pfam annotation: Domain name=LRR_1; Domain location=216-237; Score =8.0; E_value=9.1; Accession=PF00560.23; Description=Leucine Rich Repeat
  Pfam annotation: Domain name=LRR_1; Domain location=270-293; Score =3.0; E_value=77; Accession=PF00560.23; Description=Leucine Rich Repeat
  Pfam annotation: Domain name=LRR_1; Domain location=296-319; Score =10.3; E_value=3.4; Accession=PF00560.23; Description=Leucine Rich Repeat
  Pfam annotation: Domain name=LRR_1; Domain location=321-338; Score =1.0; E_value=1.8e+02; Accession=PF00560.23; Description=Leucine Rich Repeat
  Pfam annotation: Domain name=LRR_1; Domain location=344-366; Score =6.1; E_value=21; Accession=PF00560.23; Description=Leucine Rich Repeat
  Pfam annotation: Domain name=LRR_1; Domain location=369-393; Score =0.9; E_value=1.9e+02; Accession=PF00560.23; Description=Leucine Rich Repeat
  Pfam annotation: Domain name=LRR_1; Domain location=51-71; Score=0.5; E_value=2.3e+02; Accession=PF00560.23; Description=Leucine Rich Repeat
  Pfam annotation: Domain name=LRR_2; Domain location=270-295; Score =12.2; E_value=0.34; Accession=PF07723.3; Description=Leucine Rich Repeat
  Pfam annotation: Domain name=LRR_2; Domain location=296-320; Score =0.8; E_value=12; Accession=PF07723.3; Description=Leucine Rich Repeat
  Pfam annotation: Domain name=LRR_2; Domain location=344-367; Score =6.2; E_value=2.3; Accession=PF07723.3; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_2::LRR_2::LRR_2; Domain location=139-158::164-185::190-214::216-237::270-293::296 -319::321-338::...
  Pfam module annotation: Domain location=344-366::369-393::51-71::270 -295::296-320::344-367
MGSLRNSDLILIAQCFPFLEHLDLSFPEDTDNSTFPVSDVGVKALSLALPMLLSVDLSGNFFINDASILSLCKNCNFLEQVTIFECHFITQRGIASAIRERPCLRSFRVSNFGCGTKKGDFLRPSVTSDFITALVSLKGLTCLDLSCSSISDELLCCVAEEGIPLKKLVLQGCCNYSYVGVLCLLSTCQSLEHLDLQNAEFLCDQRVEELCGYLGNLVSVNVSGCRMLTDLALFALVRGCPLLNEIRMGGTDVGKRRVDQDLMNGVVNCQVKSLYLGNNSLLRDESVEMFASVCPSLEVLDLSSCCGISEGVVEVLRRCCEVRHLSLAFCSGVELAGLNFEVPKLEELNLSRSGVDDEMLSVISKCCRGLLHLDLENCSGVTANGVRQVVGKCTRLREINLGSCDEVGANVVAWMVFSRPSLRRIMAPPSFDLSDGQKELLLRHGCLVC

SEQ ID NO: 185521 - protein, 934 aa, Glycine max
  Coding DNA Sequence Number=SeqID_68743
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=O22613; Match level="QueryCoverage=98%, HitCoverage=97%, E-value=0.0, Identity=80%"; Hit description=Plasma membrane proton ATPase
  Pfam annotation: Domain name=Cation_ATPase_N; Domain location=5-71; Score=50.6; E_value=5.1e-12; Accession=PF00690.16; Description =Cation transporterATPase, N-terminus
  Pfam annotation: Domain name=E1-E2_ATPase; Domain location=83-304; Score=313.0; E_value=5.3e-91; Accession=PF00122.10; Description=E1 -E2 ATPase
  Pfam annotation: Domain name=Hydrolase; Domain location=308-594; Score=69.0; E_value=1.5e-17; Accession=PF00702.16; Description =haloacid dehalogenase-like hydrolase
  Pfam module annotation: Pfam domain module=Cation_ATPase_N::E1-E2 _ATPase::Hydrolase; Domain location=5-71::83-304::308-594
MDNLEKLKNENLDLEKIPLEQVFQQLNCSEEGLTTEEGRKSKLLKFLGFMWNPLSWVMEAAAIMAIALANGGGRPPDWQDFVGILALLVINSTISFIEENNAGNAAAALMAGLAPKTKVLRDGKWTEEDAAILVPGDIISIKLGDIVPADARLLDGDPLKIDQSALTGESLPVSKNPGDEVFSGSTVKQGELEAVVIATGVHTFFGKAAHLVDSTNQEGHFQKVLTAIGNFCICSIAVGMVIEIIVMYPIQHRPYRSGIDNLLVLLIGGIPIAMPTVLSVTMAIGSHRLSQQGAITKRMTAIEEMAGMDVLCSDKTGTLTLNKLTVDKTLIEVFAKDADKDTVILLAARASRVENQDAIDACIVGMLGDPKEARDGIKEVHFLPFNPVDKRTAITYIDNNGNWNRASKGAPEQIIHLCNLREDVKKKAHAIIGKFADRGLRSLAVAKQEVPEKTKESPGGPWQFVGLLPLFDPPRHDSAETIRRALHLGVNVKMITGDQLAIGKETARRLGMGSNMYPSSSLLGDHKDESIAALPVDELIEKADGFAGVFPEHKYEIVKILQDRKHICGMTGDGVNDAPALKKADIGIAVADATDAARGASDIVLTEPGLSVIVSAVLTSRAIFQRMKNYTIYAVSITIRIVLGFMLLALIWKFDFSPFMVLIIAILNDGTIMTISKDRVKPSPLPDSWKLNEIFATGIVLGAYLAIMTVVFFWAAHASDFFTEKFGVRPIRNVQDELTAAVYLQVSIVSQALIFVTRSRNFSFLERPGLLLVTAFIIAQLIATLIAVYANWGFARMRGIGWGWAGVIWLYSIIFYIPLDFLKFGIRYFLSGKAWNNITENKTAFTTKKDYGKEEREAQWATAQRTLHGLNPPETEQIFSEKNNYRELSEIADQARKRAEVARLRELHTLKGHVESVVKLKGLDIDTIQQHYTV

SEQ ID NO: 185522 - protein, 112 aa, Glycine max
  Coding DNA Sequence Number=SeqID_68744
MEEDFCENFEHTEEVGFIWKNFFHNAKCILTEELIPNPMEELLPWSPYGRSSYVLGDEQLWKKFFRSCSSTTTEEVPSWILYGRINNYGRTSSVRKPQKKFLRRIPPEEVLP

SEQ ID NO: 185523 - protein, 403 aa, Glycine max
  Coding DNA Sequence Number=SeqID_68745
  Gene Ontology: Mol. function=structural constituent of ribosome; Cellular component=ribonucleoprotein complex; Biological process =translation
  Homolog annotation: Hit_ID=Q69SJ7; Match level="QueryCoverage=68%, HitCoverage=59%, E-value=3e-42, Identity=40%"; Hit description =Ribosomal protein S15-like
  Pfam annotation: Domain name=Ribosomal_S15; Domain location=308-388; Score=74.6; E_value=3.2e-19; Accession=PF00312.12; Description =Ribosomal protein S15
  Subcellular localization annotation: CTP_CleavageSite=65; ConfidenceScore=5.78e-01
MAIVLRLGSRSRSKGNHPSSHIVFFSTSNSNSNSNSNSNSPFSDLFSEIKNNFKESSPSPSNTPRSSNFRDEINKNLHEFRARTTAPPPQQQQISFQKIYQENMNRNPPNSSSFNFNSIRDSLKNIKPAAQTTQTWSRPMPSTTSGSFLGKEVSSDGSPASSSSSLSFLRTYSVDDLGEKLRMLRPEGMRNDWFSVRELSERLRRLRKMEEEEVEKQAHSNTQYGFNKAVLDHVRGSLAQLDQNQTEAAKKASRQGLSILSHLNGTPTFSLDPPKPHLVEKAIIISSFHSLSRYFHPDNMSSSEKLKIELAKVRDEFKMSDSDCGSARVQIAQLTTKIKHLSAVLHKKDVHSRKGLLAMVQRRKRLLKYLRRTDWDSYCFVISKLGLRDNPDHIYRARSGTAT

SEQ ID NO: 185524 - protein, 193 aa, Glycine max
  Coding DNA Sequence Number=SeqID_68746
  Gene Ontology: Mol. function=acid phosphatase activity; Cellular component=outer membrane-bounded periplasmic space; Biological process=metal ion transport
  Homolog annotation: Hit_ID=Q8PLJ7; Match level="QueryCoverage=69%, HitCoverage=55%, E-value=2e-54, Identity=73%"; Hit description =Phosphatidylglycerophosphatase B-related protein
MVPDPGRRADHRRAPGLPALARGHLRGGQLRRLGAAEHGQQALLPAPAPQPVGIDRAGIDVQLPQRPRDGLDDPGGDPGTAGLEHPLALAGAAAGAGIQPAGQRVPGLSGGALPLRYPGRMVCRAGLGGRVLSGHVQSPAPLATSRPAASEGQRSIITGGLTWMALEGRLRDRSVVSLQQVLQDRGQAQRAVL

SEQ ID NO: 185525 - protein, 208 aa, Glycine max
  Coding DNA Sequence Number=SeqID_68747
  Gene Ontology: Mol. function=branched-chain-amino-acid transaminase activity; Biological process=branched chain family amino acid biosynthetic process
  Homolog annotation: Hit_ID=P0AB80; Match level="QueryCoverage=99%, HitCoverage=77%, E-value=4e-98, Identity=74%"; Hit description =Branched-chain-amino-acid aminotransferase
  Pfam annotation: Domain name=Aminotran_4; Domain location=12-208; Score=150.8; E_value=3.6e-42; Accession=PF01063.9; Description =Aminotransferase class IV
MSTKKADFIWFNGEMVKWEDAKVSVMSHALHYGTSVFEGVRCYDSHKGPVVFRHREHMQRLHDSAKIYRFPIKASVDELMEACREVIRVNKLKSAYIRPLAFVGDVGLGVNPPDGFTTDVIIAAFPWGAYLGAEALEQGINAMVSSWNRVAPNTLPTAAKAGGAGKNLFEVNYGILFSPSFTSSALPGITRDAIIKLAKDLGIEVREH

SEQ ID NO: 185526 - protein, 194 aa, Glycine max
  Coding DNA Sequence Number=SeqID_68748
MKVACICIPKIMFILGYKCIDFPNLLPYLFEFRMRGPLKESTSCFLIRLSPLVLVPIGLFHRTQRPLLYDFMGLKVLTFIFHRTQSPHFYLSRDSESSLLSLIGLKVLAFIFHKTQSPRLYLSQDSKSSLLSFIGLTSSPLSFIGLKVLCLYAFIGLKVLCEEENEEEDSDDEEDFSLFVKKFQKFVKKRRIER

SEQ ID NO: 185527 - protein, 66 aa, Glycine max
  Coding DNA Sequence Number=SeqID_68749
MGAKYLEVVKRELHPNNGWSPDEIRYRHIILILSNLFLSVDTRCRMTIICLCVPLETIEPGRRDTE

SEQ ID NO: 185528 - protein, 395 aa, Glycine max
  Coding DNA Sequence Number=SeqID_68750
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=60%, HitCoverage=46%, E-value=1e-69, Identity=45%"; Hit description =Receptor protein kinase like protein
  Pfam annotation: Domain name=Pkinase; Domain location=64-274; Score =57.7; E_value=3.8e-14; Accession=PF00069.15; Description=Protein kinase domain
  Pfam annotation: Domain name=Pkinase_Tyr; Domain location=77-274; Score=6.4; E_value=7.3e-13; Accession=PF07714.7; Description=Protein tyrosine kinase
  Pfam module annotation: Pfam domain module=Pkinase::Pkinase_Tyr; Domain location=64-274::77-274
WFPGAQAFAIGVTSIVFVLIIGFGYVAFFVLRRRKTQEEVEDWELEYWPHRIGFHEIDAATTVFFEENVVAVGGTRKVYKGVLHGVEVAIKRIPQEREEGMREFLAEVSSLGRMKHRNLVGLRGWCKKEKGNLILVYDFMSNGSLDKWIFECEEGMMLTWEERIQVLKNVATGILYLHQGWEVKVLHRDIQANNVLLHKDMNARLGDFGLARMHDHQGQVVSTTRVIGTLGYIAPEVIQRGTAAVDERLKAKGGYTIEEDPSIRPTMRQVVKILEVEIDSIESDEDNMEMSLLGKIRSATTWSRAECALPYSGYPSFDEVKMFSFNSRTSRSGSNTTKHEDSKSEAQIKHHGFHQVQCTNLDQTLNETDNVAQDDTPLMKDGSRLFPKVIHSLPA

SEQ ID NO: 185529 - protein, 55 aa, Glycine max
  Coding DNA Sequence Number=SeqID_68751
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=98%, HitCoverage=28%, E-value=2e-18, Identity=80%"; Hit description =Anaphase-promoting complex subunit 10
LIVLYVVFKLDKSYMPSKVSILAGDSFHNLKEIKTVELMKPTGWVYLSLSGADPR

SEQ ID NO: 185530 - protein, 54 aa, Glycine max
  Coding DNA Sequence Number=SeqID_68752
MPSQFVQNPINASAITLRWGKQYQGPQPVASSSSANEPAQPHSTPEKDDDQNLK

SEQ ID NO: 185531 - protein, 85 aa, Glycine max
  Coding DNA Sequence Number=SeqID_68753
  Subcellular localization annotation: CTP_CleavageSite=72; ConfidenceScore=5.10e-01
MSAEKYQSRLFNGPMLAIVWSIQSRNNIWMMSIRKCSIGVTRKCAIGAIRRGFFSKPRSVIFPGRSRLALFSISAGESCFSAEVG

SEQ ID NO: 185532 - protein, 330 aa, Glycine max
  Coding DNA Sequence Number=SeqID_68754
  Gene Ontology: Mol. function=NADPH:quinone reductase activity; Cellular component=cellular_component; Biological process=induction of apoptosis by oxidative stress
  Homolog annotation: Hit_ID=Q2RVI8; Match level="QueryCoverage=97%, HitCoverage=97%, E-value=2e-73, Identity=47%"; Hit description=Zinc -containing alcohol dehydrogenase superfamily
  Pfam annotation: Domain name=ADH_N; Domain location=27-107; Score =73.7; E_value=5.7e-19; Accession=PF08240.2; Description=Alcohol dehydrogenase GroES-like domain
  Pfam annotation: Domain name=ADH_zinc_N; Domain location=138-280; Score=135.8; E_value=1.2e-37; Accession=PF00107.16; Description=Zinc- binding dehydrogenase
  Pfam module annotation: Pfam domain module=ADH_N::ADH_zinc_N; Domain location=27-107::138-280
MTAIIAAPPGGAEVLTEVQRPVPQPGPGEVLLRVVSAGVNRPDILQRNGMPPPPGCSDILGLEAAGVIIALGAGVSELQPGMAVMALLSGGGYAQYCVARADLCLPVPDTLPLSHAAGFPEAAFTVWHNLFELGRLMPGDSVLIHGAASGVGTLAIQCAQACGARVIATAGGAEKIAALQQLGVWRAIDRHSEDFVAVIQTLTRERGVDVVLDNVGGDYIARNLSVLAAGGRHVSLAFMQRATVEIDLQLIMRKGLSLTSSTLRPKSAAEKARLAQCVRAHLLPLLAAGRITPQVHQRLPLTAAAQAHRILEANANIGKVLLLPDAEAMP

SEQ ID NO: 185533 - protein, 90 aa, Glycine max
  Coding DNA Sequence Number=SeqID_68755
MPKAQNSTDTTVPTSGKELWRQQKEQLLQRYLGFNLIEAGSQLSLTRGIYGLSFGFNYVVTIMLFSMLLQEGSADEAYAKLGETFVSCLS

SEQ ID NO: 185534 - protein, 141 aa, Glycine max
  Coding DNA Sequence Number=SeqID_68756
  Gene Ontology: Mol. function=DNA binding; Biological process=DNA integration
MSPYQVVFGKACHLPVEIEHKAYWAVKTCNFSIDQAGKKKKLQLSELDEIRLEAYENAKFYKEKTNKFHDCMIIKKDFMVGQKVLLYNSKLGLMSVEIKSDSTNKSFKVNGHQLKPFLTNPSLVDVVVEKDFLPYTSSTMT

SEQ ID NO: 185535 - protein, 51 aa, Glycine max
  Coding DNA Sequence Number=SeqID_68757
RAWRGEQASMNLVGLADEMDMEMAQEREGDGGNCYWQTALWPFVAKSVCAK

SEQ ID NO: 185536 - protein, 467 aa, Glycine max
  Coding DNA Sequence Number=SeqID_68758
  Gene Ontology: Cellular component=chloroplast
  Homolog annotation: Hit_ID=Q20EU8; Match level="QueryCoverage=97%, HitCoverage=51%, E-value=4e-66, Identity=38%"; Hit description =Hypothetical chloroplast RF1
  Subcellular localization annotation: CTP_CleavageSite=70; ConfidenceScore=5.14e-01
SSIFQYLGNLTVGPEPTALDTFSSSSGGGSLLIDGSYVLGFAFGSCVFTLVFGCFAILLRTLWLRWWSMTASRLTNQLNSLFLVLLIAFSFASVPYYGVDYLLTNGLGFLPQDKSLDRTVVYPSTTGDISQILGRLSDYKSFDTDVSTFDRGVYLQEDKALPQSFEDLNYQGEYAWTKRMSKLVKHLTRTNTPSAWYKLLGSGGQAPAEDGPSALSRAPGTGQASPELNAPSSGRGQPRLRDKVADLAGKQGNVLNGRELGGAESSKVSDLVALEDDIVAKLGSAPLGPNGVDGDISYMAESLAEDGETEKQFLSLFDTGLSPLFIADMPDPSVIERSLKKKYVENPLYSLLLRIDIDSFLARQPASHLLSPNEERTLFQKRQILGHYYDTLRQYNQLQNWDEFQAIYNGSKSFANRVYNQQFKGTLKVVRRLFSITLDEDPDGGGGRRVLKYDQPLFQAPAGQPGT

SEQ ID NO: 185537 - protein, 131 aa, Glycine max
  Coding DNA Sequence Number=SeqID_68759
  Gene Ontology: Mol. function=NADH dehydrogenase (ubiquinone) activity; Cellular component=integral to membrane; Biological process=ATP synthesis coupled electron transport
  Homolog annotation: Hit_ID=Q9G924; Match level="QueryCoverage=99%, HitCoverage=21%, E-value=2e-39, Identity=66%"; Hit description=NADH dehydrogenase subunit 5
MCMLKGGLVGIGWREEGKEDQAEGVVCGHCHTNRAKPVGDVATYRVSCVGGLQDHILGIEPSKKWESNKGDCTTPPIFRMSCSLDRAWITDPAPRKSNALKKAWFTRWKTPTEYWDSPEANTMYPNWLHVE

SEQ ID NO: 185538 - protein, 114 aa, Glycine max
  Coding DNA Sequence Number=SeqID_68760
MARGDCNSLSQKTWKSSKKGQMTIICLRVPTDLLVSGRQRETIKTRTLSLMKDKGEDFESYEGIKVRTLSPIKDKVRTLSPIKARTLSPMKDKVRTLNPIKARTLSPMKQTNGH

SEQ ID NO: 185539 - protein, 79 aa, Glycine max
  Coding DNA Sequence Number=SeqID_68761
MWSRHQCLFEENVGKTKTEKVEALRILKIRVQELFMHGEGLQYERSSMIEEGDEDAQTIKGTPKGPEIKFKSLKQALIG

SEQ ID NO: 185540 - protein, 149 aa, Glycine max
  Coding DNA Sequence Number=SeqID_68762
MVICTLFDIRRQSSPMARRDKHGHPHPFCYPETIKSDGTRRQTWSSVPFLQSRDNQVRWHAETKHGHPHPFCYLETIESDGTQRQTWSSAPFFLFRDNQRQSSPMACGDHHGHPCPLCYPETIKSDGMRRPSWSFAFIVFETILVSFAI

SEQ ID NO: 185541 - protein, 94 aa, Glycine max
  Coding DNA Sequence Number=SeqID_68763
  Subcellular localization annotation: CTP_CleavageSite=66; ConfidenceScore=5.05e-01
MRLHCHQASQRPNMTTDRPPLLVAHIDPGIGPNISMCVRVPSGVANYRNLPFGRRATRGSQVRLPRNENAWSRHQHLFEENVGKTKMEKVEGSL

SEQ ID NO: 185542 - protein, 76 aa, Glycine max
  Coding DNA Sequence Number=SeqID_68764
MHQTLTRPLPPPTTIDGRDEPPVLAVGPPHGDKHFNWSKIFRIHLKDSINGSGMEKEEREEMPLQGEDESRRSSPP

SEQ ID NO: 185543 - protein, 311 aa, Glycine max
  Coding DNA Sequence Number=SeqID_68765
AARSPWGHVLQDMPFLTWLSSRGYPPGRIIASQDGSTRICHTGALATSIPLKALLHSLQHGKDTLLPKAFTAIGNNVPPLLPTRQGDEPFNEAPFASSACGARLLSHTLGKGSHSLLVTTQKRSKDFLVTTITESFYLAMYFTFLAFLVGLSASLRWRYKDQLVSGFVRNNLPAVGNPSNKITWETFEHVGSKELSLHHLAPSSVGGGLRTGLTERPWAWAPAPSLAGGGLRTPVRPVTPAKAWEITPAGGPLALLVESPLVERIDVYNDSFVIKPKTPWQKLQSQKYVGFYISSSDQYKDATLGTSLTTT

SEQ ID NO: 185544 - protein, 92 aa, Glycine max
  Coding DNA Sequence Number=SeqID_68766
MVRGGDGQQQRWWTMIPFSSSTILPFDEVLENFNRGNQKRSENDEDWALRDVFWDEGGTRERVRLRSVTGFEGIYRGGRGVIDYKVWLPVLV

SEQ ID NO: 185545 - protein, 247 aa, Glycine max
  Coding DNA Sequence Number=SeqID_68767
  Homolog annotation: Hit_ID=Q15ZI8; Match level="QueryCoverage=75%, HitCoverage=75%, E-value=6e-09, Identity=22%"; Hit description=MSHA biogenesis protein MshJ
MDTFLLEPKRSEVASAQQEIVKIQNDTATLTEQMTTIASQAAPQPANNAFQREIDETQQKIASQSADLVKVSSYMVPPQEMVALLKKLLQKHTDVQVVEMQSLPVVDFIDKQRKQLQAQAGDSANVAAQAGSEDVWKNVPHVYQHAVKVRLKGKYFALMAYAQSLKAIGSTLAWENAELKADYPESELTVQEAFAASEGMIDPTKPPAEVMAFLPNAEAQMETPWELSAIQENGKSGFAVVNGQMVQ

SEQ ID NO: 185546 - protein, 187 aa, Glycine max
  Coding DNA Sequence Number=SeqID_68768
  Homolog annotation: Hit_ID=Q1S6U1; Match level="QueryCoverage=73%, HitCoverage=54%, E-value=1e-18, Identity=73%"; Hit description=GRAS transcription factor
  Subcellular localization annotation: CTP_CleavageSite=75; ConfidenceScore=5.36e-01
MWMLNKLSSPYSDTDQKLASYFLQAFFNRITQVGDRTYKTLASASEKTCSFKSTRKTYSFVTVGANMQKVMKEIRARMEKEVDLDIGLEGFEFVKGFEECLRWFRVYFEALDGSFPRTSNEHLMLEREAGRAVVDLVAWFFTVPLEDRRMGVEERTRRWRRGEGGDRERGRREKKKGNKHKEEEEWT

SEQ ID NO: 185547 - protein, 394 aa, Glycine max
  Coding DNA Sequence Number=SeqID_68769
  Homolog annotation: Hit_ID=Q1SW54; Match level="QueryCoverage=28%, HitCoverage=11%, E-value=4e-26, Identity=54%"; Hit description =Protein kinase
  Pfam annotation: Domain name=LRR_1; Domain location=122-145; Score =11.9; E_value=1.7; Accession=PF00560.23; Description=Leucine Rich Repeat
  Pfam annotation: Domain name=LRR_1; Domain location=49-72; Score =17.7; E_value=0.041; Accession=PF00560.23; Description=Leucine Rich Repeat
  Pfam annotation: Domain name=LRR_1; Domain location=74-96; Score =10.7; E_value=2.9; Accession=PF00560.23; Description=Leucine Rich Repeat
  Pfam annotation: Domain name=LRR_1; Domain location=98-120; Score =9.1; E_value=5.6; Accession=PF00560.23; Description=Leucine Rich Repeat
  Pfam module annotation: Pfam domain module=LRR_1::LRR_1::LRR_1::LRR _1; Domain location=122-145::49-72::74-96::98-120
MRFQGGCPGPTSQRRTRKGRQRRRREYFRRLTGLDIKGELSEDIGLLSELEMLDLSNNKGLTGSLPHSIGNLTKLSNLFLVDCGFTGPIPDEIRSLKELVFLSLNSNSFSGGISAFIGNLPKLNWLDIADNQLEGTIPISSVSLITRDNYPSLEFTLQIFSSSRAYFSQAEIVRISSALSNLTMDAFYFYPDEYEHYEEPIESSKSSNAGFIIRAAIGDGSSLLVLLLLTGGCALWLKKKLLLQEEAFECVLRYGIEQEYTLLQKDVNWPLGWPLGGFPRPQRQTMLTLFNNGFSVEALMEVLKSGMYLEKIGLDNLEESLLLQADMMDLKARIHGPAQAYVMEARLDKGRGSLVLEVLVEVVQGDARNVLCDAVERHRASVLVLGSHGYGAIK

SEQ ID NO: 185548 - protein, 140 aa, Glycine max
  Coding DNA Sequence Number=SeqID_68770
  Pfam annotation: Domain name=zf-H2C2; Domain location=22-59; Score =6.8; E_value=0.046; Accession=PF09337.1; Description=His(2)-Cys(2) zinc finger
MIRKTYWLMLCAEVRESHGGGMMRHFGVKKTLEILHEHFYWPNMKHDMQSVCEKCMPCNGSDSSLNPFEEGGNDRGENSSSNDPLHGIRSPMTMSKTKRMKQALQGLILKIKEKEDQCELRATPNWVTFIRIDEDVWSLT

SEQ ID NO: 185549 - protein, 145 aa, Glycine max
  Coding DNA Sequence Number=SeqID_68771
  Gene Ontology: Mol. function=RNA-directed DNA polymerase activity; Cellular component=nucleus; Biological process=RNA-dependent DNA replication
MSGEEEGVDSSCLLMIFRGRRQPTSEEEEEEEYLDGRRRRGEPRRDNHLGSIKMRIPTFQGKNDPELYLEWERKVKLVVIEFTDYAGIWWDQHVTSRHKNGERPISRWEEMKIVMRRRFVPSHSHRDLHRKLQTLTQVSMSLEHY

SEQ ID NO: 185550 - protein, 276 aa, Glycine max
  Coding DNA Sequence Number=SeqID_68772
MAAPQPRPVPLRDRGGPAGAPAGPSPVPQGADVTVDPAAAVTADPSAPWAHVWQVVHASHLDRRQRVTAWRLLHGQLFVGGFARHVHRADPAGHVCPHPSCAGQLATLTHVFIICPLAAGVWDWFAATWAAVTGDDAPPRSADLLLADDTRIWGPPRQLRQLWDRLRLATICQLWAAYQRGRHQPDAAAITPGAVAARILSSCKKALLADWRLATVNVRQTAGVLSDWLRGRDPMITREQFAARWCHRAVLCALEELPGAQPVIHWSAQHPVPLPA

SEQ ID NO: 185551 - protein, 159 aa, Glycine max
  Coding DNA Sequence Number=SeqID_68773
MRDRAAWAPNCASLTAGHIVREIRTLKFHAPPLYGCGRVPHSSAGLGTLISFLTSWLHGQVLRAWLSRASRGLTVLGRFAERAVHTKALQLSFVEGFGRLCLSTKRVRCRPQCLQHGPGQIRQGLQFMHHLLSSLATSYLASLERGSYPASTITKKMLK

SEQ ID NO: 185552 - protein, 212 aa, Glycine max
  Coding DNA Sequence Number=SeqID_68774
MTNQDTMLSFQIAALRYQNADQVSLEREQKILKLLEKKVALKKAFRDLMTQILAILHGGLQYQSAARWAIYLWARDKIMVCAIAIQAIQLLNAPSTLKNIDYSLLDRRWPGIAKDYLKTVDSGSSNVSETWIVPLEELKPNRAVSFRAKERELGPDGKGALPTGVPLARYLTFREKDPNLWICRYFLCEDCLISLQTGTGKPQSLEAQQWGA

SEQ ID NO: 185553 - protein, 130 aa, Glycine max
  Coding DNA Sequence Number=SeqID_68775
MAIIEPTRSLSLGCRVRIVLKSTQKSPTHLRMLIRHVGVGGLVKNRTTWDWLIRERGATRWLLYQIVGQTLVKRAQCRIALRILSMEVKDRHDLARVCRWADALSQLNPRSKLRRRNTWSKVSEGVPRND

SEQ ID NO: 185554 - protein, 201 aa, Glycine max
  Coding DNA Sequence Number=SeqID_68776
  Gene Ontology: Mol. function=DNA-directed RNA polymerase activity; Cellular component=chloroplast; Biological process=transcription
  Homolog annotation: Hit_ID=Q20EX2; Match level="QueryCoverage=95%, HitCoverage=20%, E-value=4e-76, Identity=75%"; Hit description=Beta' subunit of RNA polymerase
  Pfam annotation: Domain name=RNA_pol_Rpb1_2; Domain location=60-166; Score=98.9; E_value=1.5e-26; Accession=PF00623.11; Description=RNA polymerase Rpb1, domain 2
MVDLNSVGQAKRLLQEAVDGLLDNGKGGAMPISGPNDRPLKSLSDGLKGKRGRFRQNLLGKRVDYSGRSVIVVGPLLKLHECGLPKEMALELFQPFLSRQLKERGIVENINAAKRFMRQDHPILWEILQQLMQQHPVLLNRAPTLHRLGIQAFQPKLPSMQTLMGIRWQFISHSPSRHKGRLGSCFGPETICCPPQLVSLF

SEQ ID NO: 185555 - protein, 65 aa, Glycine max
  Coding DNA Sequence Number=SeqID_68777
  Subcellular localization annotation: CTP_CleavageSite=51; ConfidenceScore=5.46e-01
MARQCIAFIQRPHRGSAKQRARPTERPWAWGRSTKRRTRPTERRTPVRPVRPAPVRPVRPAPVRP

SEQ ID NO: 185556 - protein, 300 aa, Glycine max
  Coding DNA Sequence Number=SeqID_68778
  Gene Ontology: Mol. function=electron carrier activity; Cellular component=integral to thylakoid membrane; Biological process =electron transport
  Homolog annotation: Hit_ID=P23577; Match level="QueryCoverage=99%, HitCoverage=95%, E-value=1e-126, Identity=73%"; Hit description =Apocytochrome f precursor
  Pfam annotation: Domain name=Apocytochr_F_C; Domain location=182-300; Score=273.7; E_value=3.6e-79; Accession=PF01333.10; Description =Apocytochrome F, C-terminal
MVVLIGLSANQPAQSYPVFAQQNYANPREANGRIVCANCHLAQKSVEIEVPQSVLPDTVFEAVVKIPYDQQVTQVLGNGKKGGLNVGAVLILPEGFSAAPADRIPEEMKAKAGKLYFQPYASDKKNILVVGPVPGKKYSEMVFPLLSPDPSKDKNVSFLKYPIYLGANRGRGQVYPDGSKSNNTVFNASTGGTISQIQPVEKKGGFEITIETGNGEPIVDKVPAGPDLIVKVGQTIQADQPLTNNPNVGGFGQKDTEIVLQNPVRVQGLLAFFSFVVLTQVFLVLKKKQFEKVQLAEMNF

SEQ ID NO: 185557 - protein, 80 aa, Glycine max
  Coding DNA Sequence Number=SeqID_68779
  Subcellular localization annotation: CTP_CleavageSite=17; ConfidenceScore=5.34e-01
MKFVQFQLSLAHQWAKRASTTKRSLSVLSAIKESGRALISRSHAKHEISVLSVVVVFSQAQLTTGAKLTSTYSRYAQGWR

SEQ ID NO: 185558 - protein, 100 aa, Glycine max
  Coding DNA Sequence Number=SeqID_68780
MSGLAITTPTSLGLSASWCMAPTRHPLDPDKSNRALGFQALIIGLCQSYRVPITPNNAQGDAHQAAGTPPSPWQADPAGPLGMECYLQHLVLQQAANHRG

SEQ ID NO: 185559 - protein, 220 aa, Glycine max
  Coding DNA Sequence Number=SeqID_68781
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-20, Identity=28%"; Hit description= UPI00006A17C9 related cluster
LHTLALGELHVLTFRGPPILAFRGLYVVAFKGVHVLTLRGLHAYAFRGPHVFAFRGQHILAFTRPHVLALRGLHILTFRGLHVLTIRGLHALSLSGLHALAFRGLYVLAFRGLHVVTFRGQHVLTFRGLHVLTFRGLYALAKARATRPRLQRTTCPRLQRTTRPHLQRAICPRLQRTTCPRLQRITRLHVLAFRGMHAFAFRGMQVLAFRGLHILPFRGS

SEQ ID NO: 185560 - protein, 99 aa, Glycine max
  Coding DNA Sequence Number=SeqID_68782
MASRKRKAPSTPTQDRFDRSRFTSQEAWERYTDVIVPRKLFPKRNVVVYYTEFDEFKEELERHHWDKELTDFGDDNIDVAIVKEFYANLYDLEDKSPKQ

SEQ ID NO: 185561 - protein, 59 aa, Glycine max
  Coding DNA Sequence Number=SeqID_68783
MKSVHFQVKKRLSFELQKAAIGLSSAVGLSAYPSLSVASARLTQRRICFYRWPGQRIPE

SEQ ID NO: 185562 - protein, 72 aa, Glycine max
  Coding DNA Sequence Number=SeqID_68784
MRTLSPMKDKSDDFESYESIKARTLSPMKDKGEDFESYETSQQIDTHETSSYLFANLFRDSLRVYVLFDLVT

SEQ ID NO: 185563 - protein, 57 aa, Glycine max
  Coding DNA Sequence Number=SeqID_68785
MTLSSVDMAEAHALTLRKDSSQVLKAFHSQKSSTDRSLRPIVSDVQQLRMSHHSWSV

SEQ ID NO: 185564 - protein, 134 aa, Glycine max
  Coding DNA Sequence Number=SeqID_68786
  Gene Ontology: Mol. function=transporter activity; Cellular component= integral to membrane; Biological process=siderophore transport
  Homolog annotation: Hit_ID=P24077; Match level="QueryCoverage=86%, HitCoverage=34%, E-value=3e-50, Identity=89%"; Hit description =Enterobactin exporter entS
MTHSSWLVGLSVMLTGSAMFIGLMVGGVLADRYERKKLILLARGTCGVGFIGLCINALLPEPSLMAIYALGLWDGGGDHHAHRAPRLGDFADGGWPAAGHRQRGVELRAGGGGNLHYHVDAAAPAVAATSAAAA

SEQ ID NO: 185565 - protein, 238 aa, Glycine max
  Coding DNA Sequence Number=SeqID_68787
  Gene Ontology: Mol. function=tetracycline:hydrogen antiporter activity; Cellular component=integral to membrane; Biological process=tetracycline transport
  Homolog annotation: Hit_ID=Q476R2; Match level="QueryCoverage=97%, HitCoverage=49%, E-value=2e-79, Identity=56%"; Hit description=Drug resistance transporter EmrB/QacA subfamily
MPQRADHKQHARRQRNPAGGGNGVIIKPAPARPLFQRIFQTAERQRQQHDAEIIRAAQQFAVGRVDVHQQRNRNGDVNTGNDVDKKQPVPAEVIGDPAANGRAERRRQRRQRADGRGSNHPLPALEKGEGGGEHQRDHRATRQPLQRTERDHALNVPRPAAQQAHQRKAAGRGGEQPARRQHAGQPAGERNNDDFGDQRDKHADAQGGKGEDFPADRHLRGRDRRGDHAAHCALRSST

SEQ ID NO: 185566 - protein, 88 aa, Glycine max
  Coding DNA Sequence Number=SeqID_68788
MNFRGLTRGLGVCFTAAPRWAPNVLTKIQNRDMSGLTWLSGVPNFTHRLGEVPLTGGGTCKTKDSDAQVRVCVRKINLVDNSRLIDNS

SEQ ID NO: 185567 - protein, 126 aa, Glycine max
  Coding DNA Sequence Number=SeqID_68789
MERCHKKELTKLKADHDQLEARVRRPHGHKFLLVTLTCLEPIVARSVRFCDVSQGNKPKAQNRAELINLGGVLQPWAHLSPSGSFYMKQPARLGKHVTSSLSHQLAWASWAASSSPIFAINRRGRL

SEQ ID NO: 185568 - protein, 240 aa, Glycine max
  Coding DNA Sequence Number=SeqID_68790
  Gene Ontology: Mol. function=sequence-specific DNA binding; Cellular component=excinuclease ABC complex; Biological process=response to DNA damage stimulus
  Homolog annotation: Hit_ID=Q6AF49; Match level="QueryCoverage=98%, HitCoverage=38%, E-value=3e-59, Identity=44%"; Hit description =UvrABC system protein C
  Pfam annotation: Domain name=UVR; Domain location=44-79; Score=36.0; E_value=1.3e-07; Accession=PF02151.9; Description=UvrBuvrC motif
MATGRPCFPGQIGKCGGPCSMTVTIAEHRAMVDDFIAFMEGGDERFTRDLTRRMHEASAAMDYESAAKYRDRLASIDAVLGRSALVLPQDEDADLFGVAEDELSAAIQHFVIRGGRVRGVRASTLDKEIDIAGADLVDQILQRAYGEATGEQVPRRVLVPSLPDDAAELEEWLRARRGKKVEIAVAQRGQRAELMRTATLNAQQALIRHKTRRSSDYTTRTQALTDLQEALGLDEAPLRI

SEQ ID NO: 185569 - protein, 274 aa, Glycine max
  Coding DNA Sequence Number=SeqID_68791
  Homolog annotation: Hit_ID=Q10I34; Match level="QueryCoverage=85%, HitCoverage=59%, E-value=1e-30, Identity=30%"; Hit description =Expressed protein
  Pfam annotation: Domain name=DUF1723; Domain location=111-160; Score =69.3; E_value=1.2e-17; Accession=PF08330.1; Description=Protein of unknown function (DUF1723)
MESSEDPIIQVKDEQLMVSPLSGENPVHRTAYFIKPCVEDSATLPHSMFSSGRTATVNSDHAKLLEVRYKGWHYPSAEWNTWVQQMQHKYECVWMKAGIDQAIKASTFQIRRNDELIIELAQRWCSKTNTFVFPWGEATITLEDMKVCWGYSVMGAPISSPLVSGEEREIEQKLIGVFRMFFKSKARRADHTPWMKHFMSNESRVEHEAFLSLWLSRGLKLALAPAVLASIYRDFSTPLYPSPFLQTLPFAFSCTDSSFNPLSFPTPYPLKNKN

SEQ ID NO: 185570 - protein, 94 aa, Glycine max
  Coding DNA Sequence Number=SeqID_68792
  Subcellular localization annotation: CTP_CleavageSite=29; ConfidenceScore=5.09e-01
GSVLGCNPPLPMAAKVERGWAISPLALARCSLLTGAASPSGGIGAMLFLFMMRLNIRSEIGFKASCRLRMLSLFMMRLNIRSEIGLITSCKCSQ

SEQ ID NO: 185571 - protein, 311 aa, Glycine max
  Coding DNA Sequence Number=SeqID_68793
  Gene Ontology: Mol. function=hydrolase activity; Biological process =tRNA processing
  Homolog annotation: Hit_ID=Q8ZHF4; Match level="QueryCoverage=57%, HitCoverage=91%, E-value=2e-81, Identity=83%"; Hit description=HAM1 protein homolog
  Pfam annotation: Domain name=Ham1p_like; Domain location=132-311; Score=311.4; E_value=1.7e-90; Accession=PF01725.7; Description=Ham1 family
  Pfam annotation: Domain name=YGGT; Domain location=5-80; Score=34.7; E_value=3.3e-07; Accession=PF02325.8; Description=YGGT family
  Pfam module annotation: Pfam domain module=Ham1p_like::YGGT; Domain location=132-311::5-80
MSDDMDAAIAAGSTMVRIGTAWSRCDFYNPLAQFVVKITQPIVKPLRRILPALGPIDTASLLLAFVLTTLKYPILLLIQVGVFSVDPTNLLPGTRCDGLCADPADRTADGTDSPYPAGDGRHRFLGDDRDSVVLATGNPGKVRELADLLAAFGLDIVAQTELGVESAEETGLTFIENAILKARHAAQITGLPAIADDSGLAVDALGGAPGIYSARYAGVDASDQQNLDKLLQALEQVPDGERQAQFHCVLVYVRHAADPTPLVFHGSWAGEITRAAAGEGGFGYDPIFYVPALGKTAAELSKDEKRAVSHR

SEQ ID NO: 185572 - protein, 144 aa, Glycine max
  Coding DNA Sequence Number=SeqID_68794
MTNRRGVSMHAETLRQKLRRVKGQSMSLDLFELATEWMMEKQGGEAYARDWLLALNVRHGVSANILPPAPQHPDEVDAARQKVMEMSQLNGELSAVAIEALSDGDICEADASAIVIECRKIVEKAQRLERNVVRAAGDKARAGC

SEQ ID NO: 185573 - protein, 412 aa, Glycine max
  Coding DNA Sequence Number=SeqID_68795
  Gene Ontology: Mol. function=transcription factor activity; Cellular component=intracellular; Biological process=regulation of transcription, DNA-dependent
  Homolog annotation: Hit_ID=UPI00006AF25E; Match level="QueryCoverage =60%, HitCoverage=98%, E-value=2e-59, Identity=48%"; Hit description =conserved hypothetical protein (DUF88)
  Pfam annotation: Domain name=DUF88; Domain location=158-299; Score =6.7; E_value=2.2e-06; Accession=PF01936.9; Description=Protein of unknown function DUF88
VGGAGGQQQAVVVQRAAIGHADLPGLLVDGHHFAEADFHIALVAEDVAQRCGDIRGGQAGGGHLVQQRLEEVMVAAVDQGDAYALAGQGAGGPETGKTAADNNQVGNALATHRLTPVGALGEAPGIFARRPPVTSAPGWIGDTRVQATAREEPMSEPEKRIALLIDADNAPASKIDEVLAEVARYGVANVRRAYGNWKSPRLKGWEAVLHEYAIRPIQQFAYSKGKNASDMAMVIDAMDLLYARNLDGFAIVSSDADFTPMVMRLLTDGVKVYGFGEKKTPEPFVNACSKFTYLEALGQTHASVPDTEQASSEQASNEPVANDDARPRKSGAEMRSDTRLVKMLRRAVSSAEGEDGWSHLGPVGSQIGNQASFDPCNYGYGKLSDLLAAIRLFELKKDGMSSYVRALPKKNR

SEQ ID NO: 185574 - protein, 325 aa, Glycine max
  Coding DNA Sequence Number=SeqID_68796
  Gene Ontology: Mol. function=5-methyltetrahydropteroyltriglutamate -homocysteine S-methyltransferase activity; Cellular component =cytoplasm; Biological process=methionine biosynthetic process
  Homolog annotation: Hit_ID=Q71EW8; Match level="QueryCoverage=97%, HitCoverage=41%, E-value=1e-157, Identity=85%"; Hit description =Methionine synthase
  Pfam annotation: Domain name=Meth_synt_1; Domain location=2-318; Score=582.3; E_value=4.5e-172; Accession=PF08267.2; Description =Cobalamin-independent synthase, N-termina
MASHIVGYPRMGPKRELKFALESFWDGKSSADDLKKVAFDLRASIWKQMIDAGIKYIPNNTFSYYDQVLDTTAMLGAVPPRYGWNSEEIGFDTFFSMARGNASVPTMEMTKWFDTNYHFIVPELGPDVNFSYASHKAVNEYKEAKALGVDTVPVLIGPVSYLVLSKPAKGVDKSFCLLSLLPKVLAIYREVVADLKQAGASWIQFDEPILVLDLGSQTLQALTAAYAELESTLSGLNVLIETYFADIPVEAYQTLTALNGVAAFGFDLVRGTKTLDLIKGGFPSGKYLFAGVVDGRNIWANNLTASLDTLNSLEGIVGKGTCCNS

SEQ ID NO: 185575 - protein, 313 aa, Glycine max
  Coding DNA Sequence Number=SeqID_68797
  Gene Ontology: Mol. function=hydrolase activity, hydrolyzing O -glycosyl compounds; Cellular component=cell wall; Biological process= carbohydrate metabolic process
  Homolog annotation: Hit_ID=Q5UU21; Match level="QueryCoverage=93%, HitCoverage=90%, E-value=1e-138, Identity=87%"; Hit description =Xyloglucan endotransglycosylase hydrolase 1
  Pfam annotation: Domain name=Glyco_hydro_16; Domain location=60-236; Score=279.5; E_value=6.7e-81; Accession=PF00722.11; Description =Glycosyl hydrolases family 16
  Pfam annotation: Domain name=XET_C; Domain location=259-309; Score =96.7; E_value=6.8e-26; Accession=PF06955.3; Description=Xyloglucan endo-transglycosylase (XET)
  Pfam module annotation: Pfam domain module=Glyco_hydro_16::XET_C; Domain location=60-236::259-309
  Subcellular localization annotation: CTP_CleavageSite=43; ConfidenceScore=5.37e-01
MLVSFFSFVFFSYLVCVFWVDQPLFYKTFMSRGLTPTSGNLIKAGQSNSDLTKALCVFGFSVSNFHLHPTSIFNKHPLLCFCSERCGFASKVKYMFGRVSMKIKLVPGDSAGTVTAFYLNSDTNYVRDELDFEFLGNRTGQPYTVQTNIYAHGKGDREQRVNLWFDPAADFHTYSILWNHHHIVFYVDDFPIRVYKNNEARGIPYPKMQAMGVYSTLWEADNWATRGGLEKIDWSKAPFYAYYKDFDIEGCAMPGPANCASNPSNWWEGAAYQALNSIEARRYRWVRVNHVIYDYCKDKSRFPVTPPECLAGI

SEQ ID NO: 185576 - protein, 65 aa, Glycine max
  Coding DNA Sequence Number=SeqID_68798
MMMTVWEEYALQLDDAIEKNHIDRKPLVVMLTLANIKDPKDKYPLSVQNIKHGSKLYVNTDIAEI

SEQ ID NO: 185577 - protein, 159 aa, Glycine max
  Coding DNA Sequence Number=SeqID_68799
  Homolog annotation: Hit_ID=Q1SCP5; Match level="QueryCoverage=38%, HitCoverage=34%, E-value=2e-16, Identity=65%"; Hit description =Ribosomal L18ae protein
  Pfam annotation: Domain name=Ribosomal_L18ae; Domain location=4-151; Score=33.3; E_value=1.5e-10; Accession=PF01775.7; Description =Ribosomal L18ae protein family
MKIHFHQYQVVGRALPTQPDQHPKIYQMKLWSTNEVFAKSKFWYFLRKLKKVKKRNNQVLAINEVGNVLRQSVARSTKAPVLSMYNYIRCMSSSKLFIGAKVIIDIDSRRSRRFGFANFSNDEFLMAIKFLIFVSPSFLGNKWFSLQAMFVVEKVLRLE

SEQ ID NO: 185578 - protein, 118 aa, Glycine max
  Coding DNA Sequence Number=SeqID_68800
MAPPPLALSRRSCHVASETPVAPTRCPSAYVAMEAQGPLARFAWKPKAPVKLACYLCSKDISFGRRPGAALAGRSSEAVAWKRKWGWRFRVFKYTSSFTIFFSCFHLQQLPSFLLSWV

SEQ ID NO: 185579 - protein, 75 aa, Glycine max
  Coding DNA Sequence Number=SeqID_68801
MSRAKIGATLWQELFAEFESKLHCGSAYVIQNIKVVKNHSEYKVSKIPFLIYLVKTTSVGEAECPEILPDVHVLT

SEQ ID NO: 185580 - protein, 178 aa, Glycine max
  Coding DNA Sequence Number=SeqID_68802
  Homolog annotation: Hit_ID=A0CHQ3; Match level="QueryCoverage=57%, HitCoverage=54%, E-value=2e-09, Identity=36%"; Hit description =Chromosome undetermined scaffold_183, whole genome shotgun sequence
  Pfam annotation: Domain name=NuA4; Domain location=11-113; Score =106.8; E_value=6.3e-29; Accession=PF09340.1; Description=Histone acetyltransferase subunit NuA4
MESEGQKGTVNPSAMLASLLSRRAKLHEELRSIEKQVDFSTLASGCPSKGAETFSHYVYDMETSYLQDPGQCGNVLKGFEGFLSSSKNTALLKRSRKFQPEDRLFSLSSVTSPAAEELAAGRDDGRPDYGPGRSKGGGIYANGQGKPKKGRGGAREAKRARASSEQDFDYEDDPDLTL

SEQ ID NO: 185581 - protein, 100 aa, Glycine max
  Coding DNA Sequence Number=SeqID_68803
  Homolog annotation: Hit_ID=Q1SEE1; Match level="QueryCoverage=44%, HitCoverage=3%, E-value=2e-13, Identity=80%"; Hit description =Integrase, catalytic region; Zinc finger, CCHC-type; Peptidase aspartic, catalytic
MGDAKPISTPLASHFRLSKDQSPQTEKEREFMAKIPYASVIGSLIESNRNIAARGVYMARHAVLDFDAHAKPFNQLFLLKLTANETYVVVETNKDIGENS

SEQ ID NO: 185582 - protein, 1232 aa, Glycine max
  Coding DNA Sequence Number=SeqID_68804
  Gene Ontology: Mol. function=nucleic acid binding; Cellular component= intracellular; Biological process=DNA integration
  Homolog annotation: Hit_ID=Q1RWN2; Match level="QueryCoverage=96%, HitCoverage=99%, E-value=0.0, Identity=48%"; Hit description =Peptidase S8 and S53, subtilisin, kexin, sedolisin; Integrase, catalytic region; Zinc finger, CCHC-type
  Pfam annotation: Domain name=rve; Domain location=428-591; Score =142.5; E_value=1.1e-39; Accession=PF00665.16; Description=Integrase core domain
  Pfam annotation: Domain name=zf-CCHC; Domain location=274-291; Score =23.7; E_value=0.00012; Accession=PF00098.13; Description=Zinc knuckle
  Pfam module annotation: Pfam domain module=RVT_2::rve::zf-CCHC; Domain location=789-1031::428-591::274-291
MVLFVVRLWSLSSSGRHDQRALKATLYGLEKPVDLFSVAGLAKRSTTMSDGQSSAKIPHFDGLHYDHWSELMENFLRAKGLWNLVDSGVREENDTTTDYKVKHYLFRAIDRSIFKQILDRSTSKIVWDSLKRKFGGNEGVKKSLLNALRREFEVLEMKEAETITEYFARVMAVANKMRSNGENMPDSKVVEKILRTLTERFTYVVVSIEESKDTAAMSIDELQSSLVVHEQKFKRVSRDDEQVLKVESSRGRGRGTYRGRGRGRGRQSFTKAAVECFKCHNLGHFQYECPQWNKEANYAELDEEEELLLMTVVQENEATRQDAWFLDSGCSNHMCGDKGMFTDMVEGHKHSVNSEVTAPIEECLHTSSDLTYLWHQRYGHLSYKGLKTLQTKKMMRRLPQLEVSSVTCTDCFTGKQHRNPIPKKSEWRASKVLELIHADICGPIEPISNSGKRYPLCFIDDYSRKGWVYLLSKKLEALECFKSYKKLVEKEAEASIKCLRKDRGGEFNSLNFKSFCEEEGIKRQLTTSYTPLQNGVAERKNRTVMNMVHCMLSSKKVPKPFWTEAVNWTFYFLNRCPTLAVKNVTPQEAWSGVKPSVEHLQVWGCVAHVHIPEAKRGKLDDKSFPCILLGMSDESKGYRLFDPKTKRIVVSKDVMFEEEKSWNWGPNYKEQIEAELVWGDDDFSSDESEGEHRDEGNSDRFVEDMEFDSEGENDGNNARGSEARNEAGSSQENVIQGRERRQPAWMREFVSGEGLSEEEEAEAYAVQDVVGDDPTQFEEAVKHEKWRKAMDSEINSIEKNQTWELMDLPSGAKTIGVRWIFKTNLNELGEIDKYKARLVAKGYSQQHGIDFTEVFAPVARMDTVRMIVALVACKGWNIFQLDVKSAFLHGELSEDVYIEQPKGYVKKGKEHKVYKLQKALYGLRQAPRAWFSRIESHFVKKGFQKCPNEQTLFIKRGMGDNILIGMMIEFKQSMMQAFDMTDLGKMRFFPGIEVLQKPEGIFLCQRKYATDILKKFAMSESKHVKSPIVPGFKINRDVDGAAVDDTYFKQIVGSLMYLTTTRPDIMYSVSLISRYRSKPIELHLQAAKRILRYLNGTTSYGIFYKKGGAEDLFAFTDSDYAGDEEDSKSTSGYVFFLSSGAVSWMSKKQPIVTLSTTEAEFVAAAACACQAVWMRRVLRNLNHAQEDLVKDGEIELVHCGTQKQVADLMTKALKLEAFQKLRKKMGMLDFTE

SEQ ID NO: 185583 - protein, 382 aa, Glycine max
  Coding DNA Sequence Number=SeqID_68805
  Gene Ontology: Mol. function=transporter activity; Cellular component= integral to membrane; Biological process=auxin mediated signaling pathway
  Homolog annotation: Hit_ID=Q5FV66; Match level="QueryCoverage=92%, HitCoverage=97%, E-value=1e-133, Identity=71%"; Hit description =Auxin efflux carrier protein
  Pfam annotation: Domain name=Mem_trans; Domain location=9-366; Score =299.9; E_value=4.6e-87; Accession=PF03547.8; Description=Membrane transport protein
MISLADVYHVVTATVPLYVTMFLAYISVKWWKLFNPEQCSGINKFVANFSVPILSFQVISSNNIYKMSLKLVYADVVQKLLAFLVFTAIIRIKGRGGLKWIITGLSLSTLPNTLILGIPLMKAMYRDEASLLLPQIIFLQSMVWYNLLLFLHELDAAIPARTMPVVAPPSQDTGESETSLEIQSKEEEEEEAEHRTQSKTRMLLILMKVGNKLIINPNTYATFIGLIWASIHFRWGVDMPDVVNQSIEILASGGLGMATFSLGLFMASNNRVIVCGPRMTLVAMGLKFLVGPAIMAVASIVIGLRDRMLKVAIIQAALPQGIVPFVFAREYNVNPGILSTGSGLARNAHGLARGIDLLSPLITLLIHYVKYIPETMTRVALV

SEQ ID NO: 185584 - protein, 183 aa, Glycine max
  Coding DNA Sequence Number=SeqID_68806
  Gene Ontology: Mol. function=nucleic acid binding; Biological process= DNA integration
  Homolog annotation: Hit_ID=Q1SEE1; Match level="QueryCoverage=98%, HitCoverage=19%, E-value=2e-39, Identity=44%"; Hit description =Integrase, catalytic region; Zinc finger, CCHC-type; Peptidase aspartic, catalytic
MATKEGKVKIEKFDGVDFGFWKMQIKDYLYHKKLYQPFSGNQLKGMKDEDLALLDRKALEMTKGVLAAQHLNELNIVTTQLSSVGFEFDEEVRTLILLSSLLEIWNATITSVSRLSGSNKLKFNDVHDLSQEKEIQPKDMDVENQKTAGGQNLGVIEVPTTRRLSSVRIMEKSCITKISARLQ

SEQ ID NO: 185585 - protein, 697 aa, Glycine max
  Coding DNA Sequence Number=SeqID_68807
  Gene Ontology: Mol. function=DNA topoisomerase (ATP-hydrolyzing) activity; Cellular component=chromosome; Biological process=xylan catabolic process
  Homolog annotation: Hit_ID=Q67YL8; Match level="QueryCoverage=25%, HitCoverage=40%, E-value=4e-16, Identity=32%"; Hit description=MRNA, complete cds, clone: RAFL24-22-E06
MFRLSPRRSQRSKGFKVKHALQLCVLLGVCIWLVYQLKHSKEKKSSYVESTKTTSEVVKFGRKDLHPRVEETSVVDARHKEEDEEEEQEENKQEEQHKLDDVSGVQDEVLKHEQNDNEENSEHKQDSVDQETEENSENALTQVEGEQHNEKLGEENDNIDNKESESTLKENEENKSEGKDKETGENTEEKTEQENDSMDNKESDNTVKENEENKDKENETEGKNNGEENHEQDSKEMTDESNQREAEKEEHGKIQEETSSENQAQDGGKIEEEHREENYAGDNASSAVDNKSQDDTSDESSKTEEESDKKEKNEFESQKNGTETTEVADSTVTTTNSQGNENQTQSENDSQKSVTSESKWQQQEQNNPTKVEESGVETHTTEALENEDNSKVEDSNARSTTQKTEDSSSNSDASEEKAETHDSNATNGEDKNKDTSTNSAQDENTSNNYVQEGNVASSNNDNKDSSQDVQLTSSDTSSEQKKDESLNLESNTDSAQNDNENSDQSNKNSDGSANDNKDASQSYTSSEQNKEGSSNSDNNASQSDTSSDQNNKEGSSNSDNNASQSDTSSDQNNKEGSSNSDNSSDANQNGSNSNENANDNGNASHEAQNNADAGQGNNEATVESKTSENEGGAQNETVESQKEEESAHSGGDSNSNLNDQGSSDHSITQEDKESRVDLGTLPQSNAENNNIEVTAAE

SEQ ID NO: 185586 - protein, 257 aa, Glycine max
  Coding DNA Sequence Number=SeqID_68808
  Gene Ontology: Mol. function=structural molecule activity; Cellular component=protein complex; Biological process=microtubule-based movement
  Homolog annotation: Hit_ID=Q53M52; Match level="QueryCoverage=99%, HitCoverage=53%, E-value=1e-121, Identity=85%"; Hit description =Tubulin alpha-2 chain
  Pfam annotation: Domain name=Tubulin; Domain location=49-257; Score =285.4; E_value=1.1e-82; Accession=PF00091.15; Description =TubulinFtsZ family, GTPase domain
MRECISIHIGQAGIQVGNACWELYCLEHGIQPDGQMPSDKTVGGGDDAFNTFFSETGAGKHVPRAIFVDLEPTVIDEVRTGTYRQLFHPEQLISGKEDAANNFARGHYTSNVPFISLLQGVFGSVGKEIVELCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASL

SEQ ID NO: 185587 - protein, 198 aa, Glycine max
  Coding DNA Sequence Number=SeqID_68809
  Homolog annotation: Hit_ID=Q2R149; Match level="QueryCoverage=46%, HitCoverage=10%, E-value=3e-07, Identity=33%"; Hit description=HAT family dimerisation domain containing protein
HSKQGTKPKNNNKRKGDETISEEDDGACRQAFARMIIVDELPFKFVEGEGFRWGISRVFTVTVDNASFSDVALSYLKDCRIQDNCTVQLDVPTRWNSTYLMLETALKFHRAFKRLGERDTKFAMMQGGIPLSKDWDNARHKLQVVEICFRKLYIKEDVECLRFKENKTFHKMFNSYKDFHGAVESESTQASHDIELLM

SEQ ID NO: 185588 - protein, 143 aa, Glycine max
  Coding DNA Sequence Number=SeqID_68810
MPGERKGRHDFAIVTEPRQAFIHRVQHRAGKGRGLIARVHAARRFVLHNDQLSSQNRCAGKRRQNTRGKCQYPEMLECALHEGLSESVTKSEESLPGRQLTVNARHRLPYALVVLTAADERARRYIRHTLQTKAKMSVHIFYL

SEQ ID NO: 185589 - protein, 158 aa, Glycine max
  Coding DNA Sequence Number=SeqID_68811
  Gene Ontology: Mol. function=DNA binding; Cellular component =intracellular; Biological process=regulation of transcription, DNA -dependent
  Homolog annotation: Hit_ID=Q9EWT7; Match level="QueryCoverage=97%, HitCoverage=36%, E-value=4e-13, Identity=36%"; Hit description =Putative transcriptional repressor
MKLSKAAISTLIKEMLSAGLLEESIPESNGQGRPSVLLKMRADSAYFLGASLLGDDVYLVLTDMHGRILASTHMPLNPDPALLAGALAAAIPGLLAQKGISADQLIGLGVTLSGFVDENQAVCVQSALLGWKNVPLAALLNAQTGQEVSLENDAKALA

SEQ ID NO: 185590 - protein, 155 aa, Glycine max
  Coding DNA Sequence Number=SeqID_68812
  Gene Ontology: Mol. function=unspecific monooxygenase activity
  Homolog annotation: Hit_ID=O04892; Match level="QueryCoverage=60%, HitCoverage=17%, E-value=5e-28, Identity=79%"; Hit description =Cytochrome P450 like_TBP
SPETSAGAPERVIFSVYSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 185591 - protein, 64 aa, Glycine max
  Coding DNA Sequence Number=SeqID_68813
MKTTIERRRGRLEFFWEKEKQETQQAHPGERDASEKNPHCIVVVLPEKNPTEAAQHRVKKTVKQ

SEQ ID NO: 185592 - protein, 120 aa, Glycine max
  Coding DNA Sequence Number=SeqID_68814
  Pfam annotation: Domain name=zf-GRF; Domain location=20-65; Score =32.4; E_value=1.6e-06; Accession=PF06839.3; Description=GRF zinc finger
  Subcellular localization annotation: CTP_CleavageSite=30; ConfidenceScore=5.37e-01
MSQKSNASSSRTRVSSQVVLFCGCGRRAVRRVAGTNINRGMAFFTCSINKDEVGYCGYFIWVDQLIEALGVDDSLGTFSMEQRRQFEREEDKTMWKAQVNSKLDCMGIEMKMFRTIVYGI

SEQ ID NO: 185593 - protein, 149 aa, Glycine max
  Coding DNA Sequence Number=SeqID_68815
MGVGGKVGSFGGKGWWVIVLLKFVGPKEKKLCARELRREVKIMYLVVKRETEKRKRTSELKSFEKWDAPEENGREGRRGRLEFFSEKENQETQQPHPGEGNTPEKNPHCVTVVLPEKDAGGVNFFCRCGVVRKEARRGRATQSGEDHEV

SEQ ID NO: 185594 - protein, 150 aa, Glycine max
  Coding DNA Sequence Number=SeqID_68816
  Gene Ontology: Mol. function=transition metal ion binding; Biological process=lipid metabolic process
WMCPVERYMKILKGYTKNLHHLETSIVERYNTEGAIEFCLEYIEKEKPIGLLESRHDERVGGYDINKYFFYTKSQDNRSRMQNNGVSQRVESQQFVTLHDYNPRLSSMSYFGVTKEFSKLNYAKFIVCVFKFDLKKLAYQNDPFHHSRTS

SEQ ID NO: 185595 - protein, 165 aa, Glycine max
  Coding DNA Sequence Number=SeqID_68817
  Homolog annotation: Hit_ID=P28002; Match level="QueryCoverage=44%, HitCoverage=20%, E-value=8e-27, Identity=86%"; Hit description =Caffeic acid 3-O-methyltransferase
MILRLDIANDSYPNVYTMTQPSRLNLTILWYNNLMELLMNEGGLGANAILAMSLVVCKAGAAVKKIPLYKDYYKVLKVEYDAIECYFGSITMYYMKDVVLKGGIPFNKAYGMTTFEYHGIDPRFNKVFNKGMADHFTITMKKILETYTGFEGLNLWLMLVEKLEL

SEQ ID NO: 185596 - protein, 99 aa, Glycine max
  Coding DNA Sequence Number=SeqID_68818
  Subcellular localization annotation: CTP_CleavageSite=77; ConfidenceScore=5.46e-01
MAEPSMSSLRALRLMWAWKASSASLLLSRFNASFSLCGTSDEKRKKLNNTTSKTRSFLTTSTLAMHEEWFSRLHWPRGGEREAHEDGGREKGVHVHRAV

SEQ ID NO: 185597 - protein, 57 aa, Glycine max
  Coding DNA Sequence Number=SeqID_68819
MMGCDGIQWSGTAGPSDGKRNGVWSNEEMLVWNSRIKINGVWNLYRIRIHISMRGGC

SEQ ID NO: 185598 - protein, 92 aa, Glycine max
  Coding DNA Sequence Number=SeqID_68820
MYIAYFRKRTPTGAEKREELEPERQHANQDKILASKKKISAALFPPSTLLFLLFFSTIVASLEAPNSSSFLPQIARKSYFQSLGAYLYFMGL

SEQ ID NO: 185599 - protein, 79 aa, Glycine max
  Coding DNA Sequence Number=SeqID_68821
MEGACGGVTTVGLEGSRCGDNFVVVIVIVGVVVACVVLVSVDVVTVMIAVVSSMLALCASAWERWGQRTKLKNEEREIK

SEQ ID NO: 185600 - protein, 458 aa, Glycine max
  Coding DNA Sequence Number=SeqID_68822
  Gene Ontology: Mol. function=transferase activity; Cellular component= integral to membrane; Biological process=glycolysis
  Homolog annotation: Hit_ID=Q9T071; Match level="QueryCoverage=92%, HitCoverage=86%, E-value=1e-132, Identity=55%"; Hit description =Probable hexokinase-like 2 protein
  Pfam annotation: Domain name=Hexokinase_1; Domain location=16-208; Score=-45.0; E_value=7.5e-08; Accession=PF00349.11; Description =Hexokinase
  Pfam annotation: Domain name=Hexokinase_2; Domain location=210-453; Score=153.9; E_value=4.2e-43; Accession=PF03727.6; Description =Hexokinase
  Pfam module annotation: Pfam domain module=Hexokinase_1::Hexokinase _2; Domain location=16-208::210-453
DEEKCGGGSEHNNSCAGSSRGIDQKVADDFVSNMKVSLGSSDENSTLNMVISNVTSLPLGDEEGFFYGVNLQGKHLLMLCARLGGKSMPISALQREEISIPDAVLAGASEEITDYVATEIAKFVSLHPEIQDGAPAKKKKLGFTLSYPVDEVLPFAATTFQRKSANNPVRKGMVKDLNKALTNHGMKMHVSSLVDETIGGLAGGRYYNRESVAAITLGMNTNAAYVESAEEVANDLTQSPNSSELVISMEWGKFNSPHLPLTSFDASVDAESSNPGREIFEKLISGMYLGEVVRQVLLKLARETALFGSNVPPKLMTPYLLRSPDMAAMHQDMSEDREIVSEKLSEIFDIDSCSLMAREMVAEVCDIVTERGARLAGAGIVGIIKKLGRVENRKSVVTVEGGLYEHYRIFRNYLHSSIWEMLGKDLSDNVIVEHSHGGSGTGALFLAAAQTYAHRADS

SEQ ID NO: 185601 - protein, 157 aa, Glycine max
  Coding DNA Sequence Number=SeqID_68823
  Gene Ontology: Cellular component=cellular_component; Biological process=defense response
  Homolog annotation: Hit_ID=P83332; Match level="QueryCoverage=51%, HitCoverage=32%, E-value=1e-08, Identity=40%"; Hit description =Thaumatin-like protein 1 precursor
MPKRSCVTSDCDSCKVECSRNGVFSLATLVKIYPDNMDEHVLYHISLEHGFNVLVMVVPFDVPGKKCISTECPKDPNRICPPKLSFIILVMFKRKWNHTQNPTASEVGISLLSPNGNMSIPLQVFKTAIDNFSEENLLGRAILALFTKDSCLMEQIL

SEQ ID NO: 185602 - protein, 55 aa, Glycine max
  Coding DNA Sequence Number=SeqID_68824
MKVQRGCSKITTERSKVVGVWVDGVATSSSFGITLTKNKVVFKDFTRLPHVHYFY

SEQ ID NO: 185603 - protein, 350 aa, Glycine max
  Coding DNA Sequence Number=SeqID_68825
  Gene Ontology: Mol. function=transcription regulator activity; Cellular component=nucleus; Biological process=regulation of transcription
  Homolog annotation: Hit_ID=O81348; Match level="QueryCoverage=99%, HitCoverage=91%, E-value=9e-40, Identity=35%"; Hit description =Symbiotic ammonium transporter
  Pfam annotation: Domain name=HLH; Domain location=199-248; Score =49.7; E_value=9.6e-12; Accession=PF00010.16; Description=Helix-loop -helix DNA-binding domain
MMQISSNMYMPEFGMEDPTLFHQYPMDSSSALFQLEDLDFESFSASPKNSSSHNKRLFNSESTQNSFHKSPHEQYSVAPPRPTKQNKTVMSTTWSAYNAHHHHHDMVAPKASSSSSSKIISFDQHSNASSVTSQQLYNNVDAAAKVKKPKIETGYGENLDFSAAAAAASQSICDNNSFLDHYDNQDKKAAASTTRNPTQAQDHVIAERKRREKLSQRFIALSAIVPGLKKMDKATVLEDAIKYVKQLQERVKTLEEQAVDKTVESAVFVKRSVVFAGVDSSSSDENSDQSLPEMEARISGKEVLIRIHCDKNSGGAAAILRELEKHYLTVQSSSFLPFGNNTLDITIVAK

SEQ ID NO: 185604 - protein, 56 aa, Glycine max
  Coding DNA Sequence Number=SeqID_68826
MEQIGETMRVYYKGGMYTLRTRFLSIDHSHSVNMLIPFSWVCDVNNASIANAINNA

SEQ ID NO: 185605 - protein, 152 aa, Glycine max
  Coding DNA Sequence Number=SeqID_68827
MKLCFYTLMVKEECKEVSVSSKRLARKESHFEIKKNIKEASPLKQPPHLLLCKKTLVSTATPLGLEVIPQVKENNQHENTEKGRFYCITFLNFLNGDQRVPIDPKKIKAIPDWPTPPSVKGRSPEYKEPRDLRSNPFQGGGDDAILPPKGIG

SEQ ID NO: 185606 - protein, 78 aa, Glycine max
  Coding DNA Sequence Number=SeqID_68828
MVFGEIHLEARESGKEGRDGAKKLIVGERNRKKMKIYQFVGVGEEVSLVSVHWHVVPGHQIPQTKYNVKLRSFMKEHR

SEQ ID NO: 185607 - protein, 72 aa, Glycine max
  Coding DNA Sequence Number=SeqID_68829
MMLWWKGSDDEYKETTMDNHALLLSNYVIATEVELFVECVGGNEGVMDNNFSVDKAGGGKKATSGGKKCWIE

SEQ ID NO: 185608 - protein, 182 aa, Glycine max
  Coding DNA Sequence Number=SeqID_68830
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=99%, HitCoverage=22%, E-value=9e-69, Identity=75%"; Hit description=EGF -like, subtype 2; S-locus glycoprotein; Curculin-like (Mannose- binding) lectin; ...
  Homolog annotation: Hit description=Apple-like; Serine/threonine protein kinase, active site
  Pfam annotation: Domain name=Pkinase; Domain location=5-178; Score= -47.2; E_value=9.4e-06; Accession=PF00069.15; Description=Protein kinase domain
  Pfam annotation: Domain name=Pkinase_Tyr; Domain location=1-175; Score=-121.8; E_value=5.4e-05; Accession=PF07714.7; Description =Protein tyrosine kinase
  Pfam module annotation: Pfam domain module=Pkinase::Pkinase_Tyr; Domain location=5-178::1-175
MLIYEYMSNRSLDYFIFGWTHEAKRKLLDWRKLFNIICGSARGLLYLHQDSRLRIIHRDLKTSNILLDTNLDPKISDFGLARSFLGDQVEANTNTVAGTYGYMPPGYAVSGQFSVKSDVFSYGVILLEIVSAKKNREFSDPESYNNLLGHEWRLWTKDRALNYWMMCWENNAHSVKSYDAYR

SEQ ID NO: 185609 - protein, 143 aa, Glycine max
  Coding DNA Sequence Number=SeqID_68831
MANNWIVTWFVKPFPFTFSPPIFALTYMSYPFPGDRDTSISSLSAICRLGQTYRDVLYYHITFLAKDASSSLDLPIAIRELLSKFATLFQPPSTLPPTGDTETETLAEAIEVTEGATTSTAEVQKVEKSKRVVKKPTYLKDFV

SEQ ID NO: 185610 - protein, 257 aa, Glycine max
  Coding DNA Sequence Number=SeqID_68832
  Gene Ontology: Mol. function=protein serine/threonine kinase activity; Cellular component=membrane; Biological process=protein amino acid phosphorylation
  Homolog annotation: Hit_ID=Q1T6P5; Match level="QueryCoverage=85%, HitCoverage=27%, E-value=3e-64, Identity=56%"; Hit description=EGF -like, subtype 2; S-locus glycoprotein; Curculin-like (Mannose- binding) lectin; ...
  Homolog annotation: Hit description=Apple-like; Serine/threonine protein kinase, active site
  Pfam annotation: Domain name=B_lectin; Domain location=43-158; Score =95.2; E_value=2e-25; Accession=PF01453.15; Description=D-mannose binding lectin
MSQYIPDDGETLVSAGEITEMGFFSPGNSTRRYLGIWYKNVSPFTVVWVANQNTPLENNFGVLKLNEKGILELLNPTNNTIWSSSNNISSKARTNPIVRLLNSENLVKNGQGTKDDSFLWQSFDHPCDTYMPGMKVGWNLDTDLEWFLSSWKSVDDHAKGEYALKIDLRGYLQIIKFKGIVIITRAGSWNGLSAVGYPGPTLGISPIFVFNKKEMSYRYNSLDKSMFKGATTYTAEVQKVEKSKRVVKKPTYLKDFV

SEQ ID NO: 185611 - protein, 258 aa, Glycine max
  Coding DNA Sequence Number=SeqID_68833
  Homolog annotation: Hit_ID=Q9FIS0; Match level="QueryCoverage=51%, HitCoverage=20%, E-value=1e-18, Identity=40%"; Hit description =Arabidopsis thaliana genomic DNA, chromosome 5, P1 clone:MTG10
MLISFLPCFCLILTTWFYFLRVRDGDDDARDAKRSAQLFSSSGLSYKQEAPRPHSPRGGTTSSDDDKSHGTSATTTGADDDDEGPEYQYITTILTRSTTTTGPHNSNLPHLQFQWFSPTHPLDPSVFHRLEHYTTSNSFVSFPSDNKDCIFKRKQHLGPRCNRRLLFDLVDELLSEILVRPRRYKGALLETVWERVRSFPRAKCEVLEDIDALIEMEEMKKDEEGEGLVKEIERSMFETLVHETFTVMVGGVDTKGKC

SEQ ID NO: 185612 - protein, 302 aa, Glycine max
  Coding DNA Sequence Number=SeqID_68834
  Gene Ontology: Mol. function=oxidoreductase activity; Cellular component=vacuole; Biological process=hydrogen peroxide catabolic process
  Homolog annotation: Hit_ID=Q9LT91; Match level="QueryCoverage=92%, HitCoverage=93%, E-value=1e-112, Identity=67%"; Hit description =Peroxidase 66 precursor
  Pfam annotation: Domain name=peroxidase; Domain location=43-286; Score=358.1; E_value=1.4e-104; Accession=PF00141.13; Description =Peroxidase
MAPLPAENILPIIFLLLIIFSVSKAELHAHYYDQTCPQVEKIISETVLKASKHDPKVPARILRMFFHDCFIRGCDASILLDSTATNQAEKDGPPNISVRSFYVIDEAKAKLELACPRTVSCADIIAISASNVVAMSGGPYWNVLKGRKDGRVSKASDTINLPAPTSNVSQLIQSFAKRGLTVKDLVTLSGGHTLGFSHCSSFEARLRNFSSLHDTDPSMNTEFALDLRKKCPKPNHNHNAGQFLDSTASVFDNDYYKQLLAGKAFVKDQSLFFKEFTASMLKLGNLRGSRNGEVRLNCRIVN

SEQ ID NO: 185613 - protein, 74 aa, Glycine max
  Coding DNA Sequence Number=SeqID_68835
  Gene Ontology: Mol. function=fructose-bisphosphate aldolase activity; Cellular component=chloroplast; Biological process=metabolic process
  Homolog annotation: Hit_ID=O22486; Match level="QueryCoverage=54%, HitCoverage=11%, E-value=1e-10, Identity=78%"; Hit description =Aldolase
MQRKELEGVISNFLRSGIVLGLGSWSNHARLEENTFEQDIVLYQLSSLPCQNTRREKASLRSLPGKQVLHPSNS

SEQ ID NO: 185614 - protein, 67 aa, Glycine max
  Coding DNA Sequence Number=SeqID_68836
MGPPLAAVAFPRCHRHRRGEIESMAGYTPRVNLAIGMVPRRESRFYHDFTVPVALLCLIDDNLRICQ

SEQ ID NO: 185615 - protein, 47 aa, Glycine max
  Coding DNA Sequence Number=SeqID_68837
MVGLSTCTYDFVGPAHGWKQPGPLYTCRFWRYIVAPQHSATFSRFLI

SEQ ID NO: 185616 - protein, 87 aa, Glycine max
  Coding DNA Sequence Number=SeqID_68838
MEIMCTCLQNYGGLRGDRAHGSPSQLGSDGGLGKKGRCLKNDGEEDKGGNGGPTKLGIVGNKKVHHSCTTDKRGASSHGKGRATRNE

SEQ ID NO: 185617 - protein, 131 aa, Glycine max
  Coding DNA Sequence Number=SeqID_68839
FYPMPLRGRIASCMLSNKGTLVIIVIPLELEVIPQVKELLDEGMVRKSLNPCALLLPKIGIMRHQIPMIGGMMNVLRGVPMNPKRIKTIPEWPTPPTPLIELVRNYVLSWEDGQERGVEERIHEFQEPLDL

SEQ ID NO: 185618 - protein, 595 aa, Glycine max
  Coding DNA Sequence Number=SeqID_68840
  Gene Ontology: Mol. function=methyltransferase activity; Cellular component=intracellular; Biological process=protein kinase C activation
  Homolog annotation: Hit_ID=Q1RWK6; Match level="QueryCoverage=95%, HitCoverage=81%, E-value=1e-111, Identity=38%"; Hit description =Pancreatic ribonuclease; Tetratricopeptide-like helical
  Pfam annotation: Domain name=PPR; Domain location=176-210; Score =25.2; E_value=0.00023; Accession=PF01535.11; Description=PPR repeat
  Pfam annotation: Domain name=PPR; Domain location=274-308; Score =36.6; E_value=8.4e-08; Accession=PF01535.11; Description=PPR repeat
  Pfam annotation: Domain name=PPR; Domain location=309-343; Score=9.6; E_value=0.55; Accession=PF01535.11; Description=PPR repeat
  Pfam annotation: Domain name=PPR; Domain location=375-409; Score =29.9; E_value=8.9e-06; Accession=PF01535.11; Description=PPR repeat
  Pfam annotation: Domain name=PPR; Domain location=410-444; Score =17.3; E_value=0.055; Accession=PF01535.11; Description=PPR repeat
  Pfam annotation: Domain name=PPR; Domain location=447-481; Score=8.8; E_value=0.68; Accession=PF01535.11; Description=PPR repeat
  Pfam annotation: Domain name=PPR; Domain location=513-547; Score=4.4; E_value=2.2; Accession=PF01535.11; Description=PPR repeat
  Pfam annotation: Domain name=PPR; Domain location=75-109; Score=11.0; E_value=0.37; Accession=PF01535.11; Description=PPR repeat
  Pfam module annotation: Pfam domain module=PPR::PPR::PPR::PPR::PPR::PP R::PPR::PPR; Domain location=176-210::274-308::309-343::375-409::410 -444::447-481::513-547::75-109
MNKAGQSLKWVLLDLIHKCNDLRSFKQIHAHLLTSALVTNDLVVTKAANFLGKHITDVHYPCNFLKQFDWSLSSFPCNLLISGYASGQLPWLAILIYRWTVRNGFVPDVYTFPAVLKSCAKFSGIGEVRQFHSVSVKTGLWCDIYVQNTLVHVYSICGDNVGAGKVFEDMLVRDVVSWTGLISGYVKTGLFNEAISLFLRMNVEPNVGTFVSILGACGKLGRLNLGKGIHGLVFKCLYGEELVVCNAVLDMYMKCDSVTDARKMFDEMPEKDIISWTSMIGGLVQCQSPRESLDLFSQMQASGFEPDGVILTSVLSACASLGLLDCGRWVHEYIDCHRIKWDVHIGTTLVDMYAKCGCIDMAQRIFNGMPSKNIRTWNAYIGGLAINGYGKEALKQFEDLVESGTRPNEVTFLAVFTACCHNGLVDEGRKYFNEMTSPLYNLSPCLEHYGCMVDLLCRAGLVGEAVELIKTMPMPPDVQILGALLSSRNTYGNVGFTQEMLKSLPNVEFQDSGIYVLLSNLYATNKKWAEVRSVRRLMKQKGISKAPGSSIIRVDGMSHEFLVGDNSHPQSEEIYVLLNILANQIYLEGHINTLS

SEQ ID NO: 185619 - protein, 628 aa, Glycine max
  Coding DNA Sequence Number=SeqID_68841
  Gene Ontology: Mol. function=oxidoreductase activity, acting on CH-OH group of donors; Cellular component=membrane; Biological process =alcohol metabolic process
  Homolog annotation: Hit_ID=Q9FJ99; Match level="QueryCoverage=87%, HitCoverage=90%, E-value=1e-164, Identity=53%"; Hit description =Mandelonitrile lyase-like protein
  Pfam annotation: Domain name=GMC_oxred_C; Domain location=456-610; Score=99.1; E_value=1.3e-26; Accession=PF05199.4; Description=GMC oxidoreductase
  Pfam annotation: Domain name=GMC_oxred_N; Domain location=75-365; Score=43.1; E_value=2.6e-10; Accession=PF00732.10; Description=GMC oxidoreductase
  Pfam module annotation: Pfam domain module=GMC_oxred_C::GMC_oxred_N; Domain location=456-610::75-365
MEIIQASNEGRQTSMGLVYEQFIWAFLVGCTFISVLSHPDEAFIFFDIFIQCVHAAAPKYTFLKEATSAPEILTYDYIVIGGGTCGCPLAATLSQGAGVLVLERGGSPYTNPERINIKNFANSLVDISPSSFSQPFISRDGVLNSRARVLGGGSVVNAGFYSRASSTYIRDSGWNETLAEDSYIWVEKKVVFEPLLMQWQSAVRDGLLEVGVLPNNGFTFDHLYGTKVGGTIFDKEGNRYTAADLLEYADPKRISVYLHATVQKILFKYNTEKRRQQAYGVIFKDALGVMHRAYLSTQGKSEIILSAGAIGSPQLLMLSGIGPANHLQAHGIKVVLDQPFVGQGMADNPLNVLVVPSPVPVEVSLVQTVGITKFGSFIEAASGLSLGHSWSERLQGIFEFVSNQGFAGGFRNSQIHRGAVFGDASGEPSTFPPEAKESVADTIRFLTNPTLKGGVIGEKVTGPRSTGHLELITTNPNDNPSVTFNYFKDPEDLKKCVEGMRIVIDVINSKAFSKFRYHNMPVQALIDLMLHLPVNLRPKHANAAFSLEQYCIDTVLTIYHYHGGCQSGKVVDHNYKVIGVEALRVIDGSTFHGSPGTNPQATVMMLGRYMGEKIIKEDSSIGGSEGIN

SEQ ID NO: 185620 - protein, 480 aa, Glycine max
  Coding DNA Sequence Number=SeqID_68842
  Gene Ontology: Mol. function=oxidoreductase activity, acting on CH-OH group of donors; Cellular component=membrane; Biological process =alcohol metabolic process
  Homolog annotation: Hit_ID=Q9FJ99; Match level="QueryCoverage=91%, HitCoverage=75%, E-value=1e-123, Identity=52%"; Hit description =Mandelonitrile lyase-like protein
  Pfam annotation: Domain name=GMC_oxred_N; Domain location=42-326; Score=18.3; E_value=8e-09; Accession=PF00732.10; Description=GMC oxidoreductase
MQIIQASYKRRQTSMGWVSEQFICAFLVGCTFLSVLSHPDKVIGGGTCGCPLAATLSQGARVLVLERRGSPYTNPEQINIKNFVNSLADISPSSFSQPFISRDGVLNSRARVLGGGSVLNAGFYSRASSTYIRDSGWNETLAKDSYKWVEEKVAFEPPMLQWQSAVKDGLLEVGVLPYSGFTFDHLYGTKVGGTIFDKEGNRHTAADLLEYADPKRISVYLHATVQKILFKYNTEKRRPQAYGVIFKDALGVMHRAYLSTKGKNELILSAGAIGSPQLLLLSGIGHANHLEAHGIKVVLDQPLVGQGMADNPLNVLVVPSPVPVEASLVQTLGITKFGSFIEAASGLSLGHSWSERLQGIFEFVSNQSGQPSTFPPEAKESVAETVRSLANPILKGGVLLEKIIGPRSTGHLELINTNPNDNPSVTFNYFKGPEDLRKCVEGMKTIIDVINSSILKIPLPQHASPSSNRLDVALASEPEA

SEQ ID NO: 185621 - protein, 168 aa, Glycine max
  Coding DNA Sequence Number=SeqID_68843
  Subcellular localization annotation: CTP_CleavageSite=74; ConfidenceScore=5.15e-01
GVVSDTLIFESLSPAINLAYVKKNCWNPADPSITFPGPRRTRTRASASASEAPLPTQSPSQPSQRPRHPPASTSASMDTHGQMLRSLHVGQQLIMENMHRLSLHLQMDPPLTTPEAYRQRVAWPGDQPSTDRGEEPSRVAEDPAVDEDLIADLATADWGPWADLGGGS

SEQ ID NO: 185622 - protein, 80 aa, Glycine max
  Coding DNA Sequence Number=SeqID_68844
MDVSCLLLYFVILFDGHQRRKGKQVLLSQPSKERWMLLPRSGGASASNRSKGASTKSGLKSKDGNKSKDSKTISKPRACS

SEQ ID NO: 185623 - protein, 67 aa, Glycine max
  Coding DNA Sequence Number=SeqID_68845
  Subcellular localization annotation: CTP_CleavageSite=55; ConfidenceScore=5.30e-01
MDAWGANTFPVRKCNSQTFHLKFVDHVFFPVFLTFSSNKRWWRLHAFSFLGRRIRESHVALPSKDRL

SEQ ID NO: 185624 - protein, 182 aa, Glycine max
  Coding DNA Sequence Number=SeqID_68846
  Gene Ontology: Mol. function=protein serine/threonine kinase activity; Cellular component=flagellin-based flagellum; Biological process=protein amino acid phosphorylation
  Homolog annotation: Hit_ID=Q6QA01; Match level="QueryCoverage=94%, HitCoverage=37%, E-value=3e-87, Identity=90%"; Hit description=CDPK -related protein kinase
  Pfam annotation: Domain name=Pkinase; Domain location=1-174; Score =98.8; E_value=1.6e-26; Accession=PF00069.15; Description=Protein kinase domain
  Pfam annotation: Domain name=Pkinase_Tyr; Domain location=1-182; Score=-81.2; E_value=1.7e-07; Accession=PF07714.7; Description =Protein tyrosine kinase
  Pfam module annotation: Pfam domain module=Pkinase::Pkinase_Tyr; Domain location=1-174::1-182
MTRLSGHPNVVDLKAVYEEEDFVHLVMELCAGGELFHLLEKHGWFSEFEARGLFRHLMQMVLYCHENEVVHRDLKPENILLATRSSSSPIKLADFGLATYIKPGQSLHGLVGSPFYIAPEVLAGAYNQAADVWSAGVILYILLSGMPPFWGKTKSGIFEVAKTANLRFPPEPWIAFPNQLRI

SEQ ID NO: 185625 - protein, 205 aa, Glycine max
  Coding DNA Sequence Number=SeqID_68847
  Gene Ontology: Mol. function=transcription factor activity; Cellular component=nucleus; Biological process=regulation of transcription, DNA-dependent
  Homolog annotation: Hit_ID=Q5K6K2; Match level="QueryCoverage=99%, HitCoverage=100%, E-value=9e-49, Identity=50%"; Hit description=CBF -like protein
  Pfam annotation: Domain name=AP2; Domain location=54-118; Score =140.9; E_value=3.6e-39; Accession=PF00847.10; Description=AP2 domain
  Subcellular localization annotation: CTP_CleavageSite=36; ConfidenceScore=5.10e-01
MFSINHFSAPDANSPGSGSGTSRPVPALSDEDYFLAASNPKKRAGRKKFRETRHPVYRGVRRRDSGKWVCEVREPNKKSRIWLGTFPTAEMAARAHDVAALALRGRSACLNFADSASRLPVPATAEARDIQKAAAEAAEAFRPGKDDGAVVATATEREEEEEKVVPEYLRNMVLMSPTHCFGSDEYGSADVEFDDAEVRLWSYSI

SEQ ID NO: 185626 - protein, 960 aa, Glycine max
  Coding DNA Sequence Number=SeqID_68848
  Gene Ontology: Mol. function=aminoacyl-tRNA ligase activity; Cellular component=intracellular; Biological process=tRNA aminoacylation for protein translation
  Homolog annotation: Hit_ID=P93736; Match level="QueryCoverage=85%, HitCoverage=74%, E-value=0.0, Identity=77%"; Hit description=Valyl -tRNA synthetase
  Pfam annotation: Domain name=Anticodon_1; Domain location=778-926; Score=126.0; E_value=1.1e-34; Accession=PF08264.3; Description =Anticodon-binding domain
  Pfam annotation: Domain name=tRNA-synt_1; Domain location=110-734; Score=991.5; E_value=3e-295; Accession=PF00133.12; Description=tRNA synthetases class I (I, L, M and V)
  Pfam annotation: Domain name=tRNA-synt_1g; Domain location=132-694; Score=-220.9; E_value=4e-06; Accession=PF09334.1; Description=tRNA synthetases class I (M)
  Pfam module annotation: Pfam domain module=Anticodon_1::tRNA-synt _1::tRNA-synt_1g; Domain location=778-926::110-734::132-694
MDSSANNKEKEKVQVQPTPEEDPEKKRKKEEKAREKQLKKEKFLQKQAQQQAQQSSNASTSKKSEKKVVKRGGEGENPEDYVDPETPSGEKKRMARQMAKQYSPTAVEKSWYEWWEESQYFVADANSSKPPFVIVLPPPNVTGALHIGHALTAAIEDTMIRWRRMSGYNALWVPGMDHAGIATQVVVEKKLFREKNLTRHDLGREKFVSEVWEWKHKYGGTILQQLRRLGASLDWSRECFTMDERRSKAVTEAFVRLYKQGLIYRDLRLVNWDCVLRTAISDIEVDYLEIKERSLLKVPGYDKPVEFGVLTKFAYPLEGNLGEIVVATTRIETMLGDTAIAVHPNDDRYSHFHGKYAIHPFNGRKLPIICDAILVDPKFGTGAVKITPAHDPNDFEVGKRHNLEFINVFTDDGKINSNGGSDFLGMLRFKAREAVAEALQKKDLYRGSENNEMRLGVCSRSNDVVEPMIKPQWYVNCNDLAKQALHAAVDEENKRIEIIPKQYLADWKRWLENIRDWCISRQLWWGHQIPAWYVTLEDDVLREFGAYNDHWVVAKNEEEAQKEASQRYNGKQFHLSQDPDVLDTWFSSGLFPLSVLGWPDDTEDLKTFYPTSVLETGHDILFFWVARMVMQGLKLGGDVPFTKIYLHPMVRDAHGRKMSKSLGNVIDPIEVINGISLEGLHKRLEAGNLDPRELATALEGQKKDFPNGIDECGADALRFALVSYTAQSDKINLDIQRVVGYRQWCNKLWNAVRFAMSKLGDDYIPPANLIPEVLPFSCQWILSVLNKTISKTVNSLESFDFSQATTAVYSWWQYQLCDVFIEVIKPYFTGNDPKFASKRRFAQDTLWFCLDNGLRLLHPFMPFVTEELWQRLPSPRECERAESIMICDYPSTVEAFCVFKVPIMTGVIDGGSWRKAEILPYKHAIVPHGATMVVLPSQIAYGSWQKSATPFGHGAAMTAI

SEQ ID NO: 185627 - protein, 228 aa, Glycine max
  Coding DNA Sequence Number=SeqID_68849
  Gene Ontology: Mol. function=transcription factor activity; Cellular component=nucleus; Biological process=regulation of transcription, DNA-dependent
  Homolog annotation: Hit_ID=Q076D7; Match level="QueryCoverage=57%, HitCoverage=63%, E-value=4e-24, Identity=46%"; Hit description=DRE -binding protein 3b
  Pfam annotation: Domain name=AP2; Domain location=42-105; Score =105.9; E_value=1.2e-28; Accession=PF00847.10; Description=AP2 domain
  Subcellular localization annotation: CTP_CleavageSite=49; ConfidenceScore=5.72e-01
MDGNSFGNVPPPPIQVPDNLAISSSSSPTPTTSSPSPTPSGGFRYRGTRCRSGKWVSEIREPRKTNRIWLGTYPTAEMAAAAYDVAALALKGPDTPVNFPNSILSYPIPASLSSTDIRAAAAAAAQARIVRAPQESEETVNPDDGGQGLSERREEYIDEDELLNMPNLLDEMARGMQEGFITGLWEYLWSRTKEKCFECVCVWFALFLVEADFGFGDCWEGCVAVFME

SEQ ID NO: 185628 - protein, 264 aa, Glycine max
  Coding DNA Sequence Number=SeqID_68850
  Homolog annotation: Hit_ID=Q9FJ89; Match level="QueryCoverage=92%, HitCoverage=62%, E-value=5e-79, Identity=62%"; Hit description =Arabidopsis thaliana genomic DNA, chromosome 5, P1 clone:MSG15
  Pfam annotation: Domain name=TraB; Domain location=1-218; Score=-9.2; E_value=1.4e-08; Accession=PF01963.8; Description=TraB family
  Subcellular localization annotation: CTP_CleavageSite=84; ConfidenceScore=5.02e-01
MHILTSIGTDFISRAGIMYATANDELGKQLRSNMFSLSGTGFFGAVGRSINLGGQTALALRLLLATFSSKISSDINRPFGDEFRAARKASEEIGAQIVLGDRPIEITLQRAWKAMKWTQKLSLVLSIIRGIASSSNSSINKLKEASSDDGTFQLYEQLSFSYPSLLPPLIHERDTYLAWSLKRSKAVNNSKNVVGVIGKGHMNGVIYALLSDTGNLRFRDLVGKNSYDGGGSNGWIDDLIKSLVRDTIIGILLWALYEFINGGT

SEQ ID NO: 185629 - protein, 36 aa, Glycine max
  Coding DNA Sequence Number=SeqID_68851
MREKSILAPRDEVRGPRLEKNPYWIKSEKSQHLSCL

SEQ ID NO: 185630 - protein, 1332 aa, Glycine max
  Coding DNA Sequence Number=SeqID_68852
  Gene Ontology: Mol. function=RNA-directed DNA polymerase activity; Cellular component=chromatin; Biological process=chromatin assembly or disassembly
  Pfam annotation: Domain name=Chromo; Domain location=1245-1296; Score= 39.1; E_value=1.6e-08; Accession=PF00385.14; Description='chromo' (CHRromatin Organisation MOdifier
  Pfam annotation: Domain name=RVP_2; Domain location=300-415; Score= -60.9; E_value=0.055; Accession=PF08284.2; Description=Retroviral aspartyl protease
  Pfam annotation: Domain name=RnaseH; Domain location=745-864; Score= -17.8; E_value=0.0026; Accession=PF00075.14; Description=RNase H
  Pfam annotation: Domain name=rve; Domain location=999-1137; Score =67.9; E_value=3.3e-17; Accession=PF00665.16; Description=Integrase core domain
  Pfam annotation: Domain name=zf-H2C2; Domain location=940-981; Score =13.2; E_value=0.0064; Accession=PF09337.1; Description=His(2)-Cys(2) zinc finger
  Pfam module annotation: Pfam domain module=Chromo::RVP_2::RVT _1::Retrotrans_gag::RnaseH::rve::zf-H2C2; Domain location=1245 -1296::300-415::494-741::95-169::745-864::999-1137::940-981
MAEHATRHTTSDRLEEAIITLAAKHSELASRVDAMCERFSSVPPHQHPSSSSRMHQRPPVKLDVPRFDGHDPLGWIFKISQFFDYQATPEEDRITVASFYLDGAALTLLHAIETRFAPSIYDDPRDALFKLVQRGSVTEYMTEFERLANRIVGLSLSDLLSCFISGLNPEIRREVQAFQPVSLPHATSLARLQEDKINDRRKNSRSHQSVPQTTPSQPFSLPQHPRPKNPFIQRTPEEMMHRREKGLCYNCDEKWSSSHRCKGRVLLFIADSDEPLLPNTKLDDTLPQPLTETAPAYDPTPFQTHISLHAMAGVPATDTFRLYGVINHARVTILIDSESTHNFIQPRVAKFLGLAMEETTTLRVMLIQSHPFTVTLRVLPLSGADVVLGVEWLRTLGPIITDYTAFTMAFTYMGQPITLHADVSSDTNPTSAYQLKRSLHTHSISGLFHLSLLPVTQPDLDSEPPHPISAINTLLLKYQVIFQQPTTLPPPRQHDHHINLIPSALPVNVRPYRYPHSQKNEIEKQVTSLLESGLIQPSRSPFSSPVLLVKKKDGTWRMCVDYRALNAITGFHQILMAEDDVPKTAFRTHNGHFEYRVMPFGLCNTPSTFQAAMNALLNPFLRKFATALSQAQYYLKRSKCFIGQRQLDYLGHVVSGKGVQPDPSKVQAIIDWPTPRSSKDLRSFLGLTGFYRKFVRGYAGLTTPLTRLLCKDAFQWSSESQSTFDSLKTAMTTAPILALPNFNLPFILETDASGSAIGAVLQQHGHPIAYFSKPLCPRLQHASAYVRELHAITAAVRRWRQYLLGHRFTIYTDHRSLRELMSQVVQTPEQQFYLVKLLGFDYEIQYKAGSSNIVADSLSRIDCSSQAQCLILSVPHHEFMIQLKDSLKASTEFQQQREAILAHPEQYPDFSIFDDLILLRGVIWLDSKNPFIQSLLHEYHATPIGGHFGIKKTLHRLQSSFHWPSMAKDVRAFIRNCIVCQQVKHLTRKPAGLLQPIPIPNGVWEDLSMDFVTHLPSSHGFTAILVVVDRFTKGVHLRALPTQFTAFKVANLFMDMVCKLHGFPRSIISDRDPVFISSFWRELFRLQEVMNRTVEQYLRSFVHHRPKEWYKFLALAEWSYNTSQHSGTELTPYEATYGKPPPSVPSYVLGSSNNDAAAVVTQTRVEVHATLQRKLIKAQATMKQFADKQRRDVQYEVGQLVYVKLRPYHQLSVRQGRSNKLTKRYFGPFCILECIGQAIHNQPILKPLTILDSRLDTSVSPPTRSVLVQWEGLPPEDSTWESWEDFRGHPHLEDKVSFPGDGNVSNSSSTTMDREARPRRQASRPKYLEDYV

SEQ ID NO: 185631 - protein, 530 aa, Glycine max
  Coding DNA Sequence Number=SeqID_68853
  Gene Ontology: Mol. function=drug transporter activity; Cellular component=membrane; Biological process=multidrug transport
  Homolog annotation: Hit_ID=Q1SB90; Match level="QueryCoverage=94%, HitCoverage=92%, E-value=1e-177, Identity=64%"; Hit description =Multi antimicrobial extrusion protein MatE
  Pfam annotation: Domain name=MatE; Domain location=279-442; Score =155.5; E_value=1.4e-43; Accession=PF01554.9; Description=MatE
  Pfam annotation: Domain name=MatE; Domain location=58-218; Score =145.6; E_value=1.3e-40; Accession=PF01554.9; Description=MatE
  Pfam module annotation: Pfam domain module=MatE::MatE; Domain location=279-442::58-218
MCHISSQLPCKCNSMKSQEAEESDMKITNPLIQKDITVTPPHHHVLKELISISKIALPMILTGLLLYCRSMISMLFLGRLGELALAGGSLAVGFANITGYSILSGLAVGMEPFCGQAYGAKKFTLLGLCLQRTILLLLFTSIPISLLWLYMKHILLLCGQDEAIATQAQSYLLYSIPDLLAQSFLHPLRIYLRSQSITLPLTLCATFSILLHIPINYLLVSHLNWGIKGVALSGVWTNFNLIASLILYIVFSGTHKKTWGGFSFECFTQWKSLLDLAIPSCISVCLEWWWYEIMILLCGLLVNPRATVASMGILIQTTSLLYILPSSISFSVSTRVGNKLGAQKPSKAKLSAIVGLSCSFMLGFLAFVFTILVRNIWASMFTQDKEIITLTSLVLPIIGLCELGNCPQTTGCGVLRGTARPKVGANINLGCFYLVGMPVAVWLGFFAGLDFQGLWLGLLAAQGSCAVTMLVVMSQTDWDVEALRAKKLTSVVVAVDDSKEVGAEKPPKAEIKEDSLLSLADSEEDKQSWV

SEQ ID NO: 185632 - protein, 232 aa, Glycine max
  Coding DNA Sequence Number=SeqID_68854
  Gene Ontology: Cellular component=membrane
  Homolog annotation: Hit_ID=Q7VYZ7; Match level="QueryCoverage=76%, HitCoverage=100%, E-value=8e-85, Identity=82%"; Hit description =Putative exported protein
RPLARAPCRPGTPGRSTARRRCGAEGARFARSVATLLAGAGIDEFIFQVERLEPVAHAGFLVDVAAEVAHLVGGRRQDGVLQLVLARAFQLDVLAVVRAVVGDHGHEGALLHVLAADLLDFVFDDQVGHPFAFGKARGIAGRGVDVGLEVDVGILGGAHHARGVHFDRLQVDRADFHAALFHGLADGVFSRLGGGHAQSDNGQGQGFLHHVGHPRSSIETTDPKNINKNRLH

SEQ ID NO: 185633 - protein, 113 aa, Glycine max
  Coding DNA Sequence Number=SeqID_68855
MYPTEAMCMIVPIYKIVNKPRDRIDQCPISFCFMSNTDQITTCIKWDFEEGKSTDSEAGIIPEETELDDVNGPDVHSSKNQWLKNKLRIPSFLFPENIHLLRKHSKQVVIIIN

SEQ ID NO: 185634 - protein, 102 aa, Glycine max
  Coding DNA Sequence Number=SeqID_68856
  Subcellular localization annotation: CTP_CleavageSite=39; ConfidenceScore=5.37e-01
MSNVTAKGSLLRRSDKRFRKKQAQNLLSSRETRQRLELRSASESNAFNKSLSPCLLLFTPFLPIAKAYLFTLLGFSSYWNGFAPKAQQHAPTAKTFILPKNL

SEQ ID NO: 185635 - protein, 385 aa, Glycine max
  Coding DNA Sequence Number=SeqID_68857
  Gene Ontology: Mol. function=transporter activity; Cellular component= integral to membrane; Biological process=transport
  Homolog annotation: Hit_ID=Q76IH8; Match level="QueryCoverage=96%, HitCoverage=75%, E-value=1e-178, Identity=78%"; Hit description=High- affinity nitrate transporter
  Pfam annotation: Domain name=MFS_1; Domain location=1-286; Score= -53.0; E_value=0.084; Accession=PF07690.6; Description=Major Facilitator Superfamily
MGAVCDLLGPRYGCAFLIMLSAPTVFCMSFVKDAAGYIMVRFLIGFSLATFVSCQYWMSTMFNSKIIGLANGTAAGWGNMGGGATQLIMPLVYELIRRAGATPFTAWRIAFFVPGFMHVIMGILVLTLGQDLPDGNLAALQKKGVWYAITNYRTWIFALLYGYSMGVELTTDNVIAEYFYDRFNLKLHTAGIIAASFGMANLVARPFGGYASDVAARLGFCIWLGRANSLPIAILAMILFSLGAQAACGATFGIIPFISRRSLGIISGLTGAGGNFGSGLTQLVFFSTSKFSTATGLSLMGVMIVACTLPVSVVHFPQWGSMFLPPSKDVNKSTEEFYYTSEWNEEERQKGLHQQSLKFAENSRSERGKRVASAPTPPNATPTHV

SEQ ID NO: 185636 - protein, 42 aa, Glycine max
  Coding DNA Sequence Number=SeqID_68858
MISQRAAVDSRHEEHYGISGNNVGSGFLSCRQKLATVTKPGS

SEQ ID NO: 185637 - protein, 81 aa, Glycine max
  Coding DNA Sequence Number=SeqID_68859
  Gene Ontology: Mol. function=protein binding; Biological process =protein modification process
  Homolog annotation: Hit_ID=Q1S0J6; Match level="QueryCoverage=97%, HitCoverage=24%, E-value=1e-12, Identity=53%"; Hit description =Ubiquitin; Apoptosis regulator Bcl-2 protein, BAG
MRMNAKMERTTKYISEISLEVDRLAGQVSALESILSKGGKVSEMNVLNLIDLLINQLLKLDSIMVDEDVKEFKRMLKLRIC

SEQ ID NO: 185638 - protein, 254 aa, Glycine max
  Coding DNA Sequence Number=SeqID_68860
  Gene Ontology: Mol. function=dihydrodipicolinate reductase activity; Cellular component=cytoplasm; Biological process=lysine biosynthetic process via diaminopimelate
  Homolog annotation: Hit_ID=Q1S0J3; Match level="QueryCoverage=99%, HitCoverage=73%, E-value=1e-105, Identity=79%"; Hit description =Dihydrodipicolinate reductase
  Pfam annotation: Domain name=DapB_C; Domain location=90-221; Score =85.3; E_value=1.9e-22; Accession=PF05173.4; Description =Dihydrodipicolinate reductase, C-terminus
  Pfam annotation: Domain name=DapB_N; Domain location=1-87; Score= -26.9; E_value=0.0069; Accession=PF01113.11; Description =Dihydrodipicolinate reductase, N-terminus
  Pfam module annotation: Pfam domain module=DapB_C::DapB_N; Domain location=90-221::1-87
ICGMEELLEIPIINDLTMILGSISQSKAAGVVVDFTDPSSVYDNVKQATAFGMKSIVYVPRIKLDTVAALSAFCEKASMGVLVAPTLSIGSILLQQAAISASFHYSNVEIVESRANANDLPSADANQIANNLSNLGQIYNREDPSTDVLARGQVLGDGIRVHSMVLPGLPSSTTVHFSGPGEVYSIKHDITDVKCLMPGLLLAIRKVVRLKVATHSYQVFKSQLLVSLYHSASIFLTATLSSLQNLVYGLEKFI

SEQ ID NO: 185639 - protein, 107 aa, Glycine max
  Coding DNA Sequence Number=SeqID_68861
  Gene Ontology: Mol. function=transcription factor activity; Cellular component=nucleus; Biological process=regulation of transcription, DNA-dependent
  Homolog annotation: Hit_ID=Q1RZP2; Match level="QueryCoverage=96%, HitCoverage=46%, E-value=7e-15, Identity=47%"; Hit description =Pathogenesis-related transcriptional factor and ERF
MTCLRLDPENSHIGVWQKRAGQHSDSNWVMMVPPLGKKGGANEGGTGDGSCSNNPSSFSKCDPAPQVVRQELLRTEMDEEERIALQMIEELLGRNCPITSPSFNNLY

SEQ ID NO: 185640 - protein, 89 aa, Glycine max
  Coding DNA Sequence Number=SeqID_68862
MASKYAQEANCRTVLNKFQAIEECIRKTTDLDLELAGVIVPASVGKEVQRVATSWKKPLVQSGPWNTHGAEVNSAHQSRKRMKGKRIEN

SEQ ID NO: 185641 - protein, 107 aa, Glycine max
  Coding DNA Sequence Number=SeqID_68863
  Gene Ontology: Mol. function=DNA-directed RNA polymerase activity; Cellular component=RNA polymerase complex; Biological process =transcription, DNA-dependent
  Homolog annotation: Hit_ID=Q9FJ98; Match level="QueryCoverage=90%, HitCoverage=69%, E-value=2e-27, Identity=64%"; Hit description=DNA -directed RNA polymerase II subunit-like protein
  Pfam annotation: Domain name=RNA_pol_Rpb6; Domain location=61-103; Score=34.1; E_value=4.8e-07; Accession=PF01192.13; Description=RNA polymerase Rpb6
MADDDYEDIDMGYEDEPPEPEIEEGAEEDLENKNDELTGEPIDTEDKEEEQPVERPRKTSKYMTKYERARILGTRALQISMNAPVMVELEGETDPLEVIEPFVLFAV

SEQ ID NO: 185642 - protein, 868 aa, Glycine max
  Coding DNA Sequence Number=SeqID_68864
  Gene Ontology: Mol. function=zinc ion binding; Cellular component =nucleus; Biological process=regulation of transcription, DNA -dependent
  Homolog annotation: Hit_ID=Q1S0I8; Match level="QueryCoverage=99%, HitCoverage=100%, E-value=0.0, Identity=71%"; Hit description=FAR1; Zinc finger, SWIM-type
  Pfam annotation: Domain name=DUF291; Domain location=692-761; Score= -23.8; E_value=0.051; Accession=PF03442.5; Description=Domain of unknown function
  Pfam annotation: Domain name=FAR1; Domain location=76-290; Score =133.4; E_value=6e-37; Accession=PF03101.5; Description=FAR1 family
  Pfam annotation: Domain name=SWIM; Domain location=568-604; Score =26.4; E_value=0.0001; Accession=PF04434.8; Description=SWIM zinc finger
  Pfam annotation: Domain name=WRKY; Domain location=111-163; Score= -14.6; E_value=0.043; Accession=PF03106.6; Description=WRKY DNA -binding domain
  Pfam module annotation: Pfam domain module=DUF291::FAR1::SWIM::WRKY; Domain location=692-761::76-290::568-604::111-163
MDGDQNELGTVGEGNVDIGPQTLNNLDLNVEQNCCSSNVAHASDTQSCHPSSANVLSGDTVLGIGTEFESDDHAYQFYNKYARLLGFNVRKDWINRSKVHGQVVSRKFTCSKEGYRRKDKRDANVKKHRKETRSGCLAHMIVTRQPDGKYQVTHFEAQHNHDNINSNSNSANMLNLQNEFSVAQAVEADSNNSLGPKSKSALDVLNKKTSARESLDLLSMNYDNYLHYARERDMKEGEAGRLLGYFQRQHFENPTFFYAIQLDVDDKVSNIFWADDNMVVDYEHFGDVICLDTTCRTNKDLRPFVQFLGINHHRQVLIFAAAFLYDDSIESYNWLFRTFISAMSGKKPKTILTEQEAVIIEAINTVLSHTNHCTCVWQLYENTLKHLSHVVKDAESFANDLRRSIYDPKDEEEFTHAWEAMLEKYNLQQNEWLRWIYREREKWAVVFGQNTFFVDIKGFHLGEILSKKFRNYLNPDLDVLQFFKHFERVVDEQRYKEIEASEEMSRCLPRLMGNVVLLKHASDIYTPRTFEVFQRAYEKSLNVLVNQHSRNGSLFEYKANTFGHTRQYNVTFNSSDDTVVCSCMKFERVGILCSHALKVLDHRNIKVVPSRYILDRWTGHARLGNLREIRQCKMQDNPNMVVTSCYKDLCNRLLKLSARASESMEAYQFAARQLDEVMIGVEKILTLKVEQRQVITSSNIDANASENEPAEIFLNGHSIEDQDESNRANGGKDRRATSDRGYLTTMTCNGADSDRILNVEVSPPNTVVCISSPSSAYVSSHSATPNPILQGLYGFEANQVVHCMYEQSNRVLDHQSNSNTLQPPNIFSNQQDSPGQSQLLQGMDLDIRNPHSSSFLLYDHRYRSSKSA

SEQ ID NO: 185643 - protein, 176 aa, Glycine max
  Coding DNA Sequence Number=SeqID_68865
  Gene Ontology: Mol. function=cysteine-type peptidase activity; Biological process=proteolysis
  Subcellular localization annotation: CTP_CleavageSite=20; ConfidenceScore=5.05e-01
MSSRFGWHGYMRAVAPTITRSTNVFAPSMSLSQKYETRSLTLNKLDDLENEASIILCQLEMYFSPSFFYIMIHLIVHLVREIRLYGPIFLRWMYLVEHYMKMLKGYTRINIGQRQELLKDTLLKKLLGFDQSICKPLHQSRFLKVDMTTHGKVGVHEDSMLQPWIVSSCHKLIYMY

SEQ ID NO: 185644 - protein, 227 aa, Glycine max
  Coding DNA Sequence Number=SeqID_68866
  Homolog annotation: Hit_ID=Q8GZU1; Match level="QueryCoverage=27%, HitCoverage=5%, E-value=5e-19, Identity=69%"; Hit description =Kinesin related protein
MKDDSKNALYIENLTKEYVTSYDDVTQILIKGLSNRKVGATSLNSKSSRSHIIFTFVIVSWCKEELIRAKPKVHSSDGSKNGYLQVRNVRDNLDNDTNEEENMDKEDIRQLCQQIDELCHRSMSKLCPEESEGSTTTLYASADDFACTANASWTIKSAFRDSFLVSSCTQSPILGEPQLPDSLKIKNVQRKSNHLKRVSRCDRHYGQARFFKVLPNPWQQAFRGDYR

SEQ ID NO: 185645 - protein, 102 aa, Glycine max
  Coding DNA Sequence Number=SeqID_68867
  Gene Ontology: Mol. function=sequence-specific DNA binding; Cellular component=nucleus; Biological process=regulation of transcription
  Homolog annotation: Hit_ID=Q2PJS2; Match level="QueryCoverage=60%, HitCoverage=25%, E-value=7e-11, Identity=58%"; Hit description=WRKY40
MGKRIGEDDNYHVRVSAMKMKKMKAIVMMTEARFCFKTMSDVDVLDDGYKWRKIERLVVGNTKNRFLVSFGNWPSLSCWTLNHMCNRLVLMLDDGLFVFPTM

SEQ ID NO: 185646 - protein, 76 aa, Glycine max
  Coding DNA Sequence Number=SeqID_68868
MGTYTEEIAVRHSTSAVGETHTYGDNGGKPSISLKSETLSTTPKAAACELTSQERDSALLRYKQKKKTRRTSFNFS

SEQ ID NO: 185647 - protein, 74 aa, Glycine max
  Coding DNA Sequence Number=SeqID_68869
MYAVMQNTPLGLRVDGGAREWMVRGHNGTASGTQRWCIMERDSLEMEVWWGEVNALEAGGANPDLNDKLMIKWI

SEQ ID NO: 185648 - protein, 285 aa, Glycine max
  Coding DNA Sequence Number=SeqID_68870
MSCYGSDGDSSPHVPRKSMLAKEEVKSSSDAGDQPKEKATKTIETTTAGGTTDSSLKTLIPSKPNIEKTTTGGGDATNLGGSYDVENDTSTPLVVPSKNKGKQIPLNGVELMPTNKLPNRFDVRMMDFIGVNESMDASDMREKKMIEALNEKNEVIPTKLGIIESLEQKITDHEKMVFVKCIKNEKLFSDVENLNQKFNEALKDLAESKKTTITLNEQLIIKENKKTTVMLEEEKEKVSAQKTTLDQVFMMGHQDGFQKPYNHLCGHLSLHNIRTIGIVSLDEIV

SEQ ID NO: 185649 - protein, 140 aa, Glycine max
  Coding DNA Sequence Number=SeqID_68871
  Gene Ontology: Mol. function=protein-tyrosine kinase activity; Cellular component=integral to membrane; Biological process=protein amino acid phosphorylation
  Homolog annotation: Hit_ID=Q1SE30; Match level="QueryCoverage=99%, HitCoverage=30%, E-value=1e-34, Identity=53%"; Hit description =Protein kinase
MAPEFQASGVATQKSDIYAFGVVMLELLSGEEPLKFKFDEKTRTFVRTSVIDAARAAVVDGEGSVEGKLRRWVDRRLKDSFPVDVAEKWTRVALECVHVDPDKRPNMGRVAGKISKFYLTSRIWSDSIKMPDMTVSLGPR

SEQ ID NO: 185650 - protein, 288 aa, Glycine max
  Coding DNA Sequence Number=SeqID_68872
  Homolog annotation: Hit_ID=Q9ZW85; Match level="QueryCoverage=37%, HitCoverage=43%, E-value=5e-37, Identity=68%"; Hit description=3 -isopropylmalate dehydratase, small subunit
MIETKKQLPHGRGLAKAIFDHISPRNLLCHAEIPMLLLLTNKQEDEGFACKSTRQAPSPSLTSSSNLRMNIALPYRNTNIYVNIHLAGGHGVPKEDPSVRLREHYGGAGGAQRHRGMLMRGAATKVGTANDNGILGIGLTEVDEAHGVGGRDASEGVGAKLLVLVGLRRDKGEVLCGNDLVGVDVVVDDITKVVEGGAHARLNVCGLERDRNAVAREERLPKQRTMPLFNAQCLISQLFSLSLMFVVIYVGYPNDGIYVQEPNGEDESGRCRNPSTAETQEVGLEYID

SEQ ID NO: 185651 - protein, 86 aa, Glycine max
  Coding DNA Sequence Number=SeqID_68873
  Homolog annotation: Hit_ID=Q9FHG6; Match level="QueryCoverage=55%, HitCoverage=16%, E-value=5e-10, Identity=63%"; Hit description =Arabidopsis thaliana genomic DNA, chromosome 5, P1 clone:MRI1
MERSARMDDADFGSSPAWKSNNVKSWIWMQQAMHTELNDNSCFRKKWVCCDHHADAMEAAHTTEKCLNKIKMKRKADQRCMQQYQL

SEQ ID NO: 185652 - protein, 274 aa, Glycine max
  Coding DNA Sequence Number=SeqID_68874
  Gene Ontology: Mol. function=DNA binding; Cellular component =intracellular; Biological process=DNA integration
  Homolog annotation: Hit_ID=Q1S3H4; Match level="QueryCoverage=93%, HitCoverage=55%, E-value=5e-84, Identity=56%"; Hit description =Integrase, catalytic region
  Pfam annotation: Domain name=rve; Domain location=10-163; Score=22.2; E_value=8.4e-05; Accession=PF00665.16; Description=Integrase core domain
MHTSMCCIVTNVRGSGVYHEGMKCPFKISLRWKSLIAGVETIATPKNDAKTVVRFLKKNIFSRFGVPRVLISDGGSHFYNVQLQKVLGHYNVTHKVASPYHPQTNGQDETAFKTPIGLFPFQMVYGKTCHLLVEMEHKAYWALKFLDFDEVLSGEKRNLQLLELEEMRLNAYESSKLYKQKLKAYHDKKLLKKNFQPGQRVFLFNSRLKLFPGKLKYKWFVPFTIKEVKPHGAMELMDPNSDTPERSWVVNGQRLKLYHGNVERLTTILHLQDP

SEQ ID NO: 185653 - protein, 174 aa, Glycine max
  Coding DNA Sequence Number=SeqID_68875
  Homolog annotation: Hit_ID=P84527; Match level="QueryCoverage=81%, HitCoverage=76%, E-value=2e-53, Identity=68%"; Hit description =Kiwellin
  Pfam annotation: Domain name=DPBB_1; Domain location=93-171; Score =0.1; E_value=0.015; Accession=PF03330.8; Description=Rare lipoprotein A (RlpA)-like double
MGFSPYSQNKNFSILTFTFLLKIALCNTLNDDGSCQKSGTLTCATGEYDQYQCSPPVSSSTDAILTRNDFTEGGDGGDRSQCDEQFHDNSELVVALSTGWFDNGSRCLKLITITAGNGRSVTAKVVDQCDSVHGCDKEHADQPPCRNNIVDGSQAVWDALGLDSGEERVTWSMA

SEQ ID NO: 185654 - protein, 149 aa, Glycine max
  Coding DNA Sequence Number=SeqID_68876
  Homolog annotation: Hit_ID=Q0X0N3; Match level="QueryCoverage=52%, HitCoverage=5%, E-value=2e-23, Identity=66%"; Hit description=YD repeat:PAAR
MQGQYLDRETGLHYNLFRYYDPDSARFTQQDPIGLAGGLNLYQYAPNSFSWIDPLGLSKCGVDQARKRQHAMLKNSNEGYNISPKSWDVYPTIGRDGSFISDKQGIMQYFSHADARRQGSDSPVQPAWLTSYRPRTPPHEAATPGKSKW

SEQ ID NO: 185655 - protein, 78 aa, Glycine max
  Coding DNA Sequence Number=SeqID_68877
MYIVVVKQGQDHLGLPSGVETKHERQKPIKVLKDERKRGWGHDRPIVALLCAKQAGNVAARQPRILSILQLSFTICLF

SEQ ID NO: 185656 - protein, 157 aa, Glycine max
  Coding DNA Sequence Number=SeqID_68878
  Subcellular localization annotation: CTP_CleavageSite=83; ConfidenceScore=5.56e-01
MPLTRDDSFHLFGSLSSLLLPYKAPQNLFWSCSSFRAFLVSHSKASSVAILTSLSSSYSLQTLMAMDLNFSLTTRALSSFAFRAYLGANPNPCVRILSHFMIASDDPITASPKLSVLSSRRILCPCETPWSTLALWSLKPRAMKGVMLSSDGTSLMG

SEQ ID NO: 185657 - protein, 172 aa, Glycine max
  Coding DNA Sequence Number=SeqID_68879
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=79%, HitCoverage=25%, E-value=5e-71, Identity=95%"; Hit description=NADH -plastoquinone oxidoreductase subunit 2
  Pfam annotation: Domain name=Oxidored_q1; Domain location=23-172; Score=-46.9; E_value=6.4e-05; Accession=PF00361.10; Description=NADH- Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDVYHT

SEQ ID NO: 185658 - protein, 269 aa, Glycine max
  Coding DNA Sequence Number=SeqID_68880
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=2e-34, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHTLVVRGLQLQTLRGLHVLTLRRPYALALKGLRILTFRGLHFLAFRKLHLLTFRGLHVLAFKGLHILAVRGLHVLAFNGVHVLAFRGLHVLGIRGLHVLTFRGLHVLAFRGLDALSSEDYTGLHILALRGLHALAFKGLHVLTFRGLHVLALKGLHVLTIRGLHVLAFKLLHVLTFRGLQVLAFRGLHVLTFRGLQILAFTGVHVFAIKGLHILAFRGLHVLTFRGLHDALLPRKGSVTRTMSKRLQEDWARVVEEGPRVLMNLRVDF

SEQ ID NO: 185659 - protein, 192 aa, Glycine max
  Coding DNA Sequence Number=SeqID_68881
TQHKDAQAKVEYVKRLYDQVKVQIAKKNESYAKQANKKRKKVILDLAQVEKDKAPEWRRMKAQVEKDEGLELLSGFLVEPISNLSRITSPNIFHRTTKLEETLTQFMQVKISNHKSTESALKNLEVQVGQLAKQIADNSSNSFVENIEQNPKEECKVVMKRSKRFVEAEDEDSVVHKKKTADKKSIDGKKNE

SEQ ID NO: 185660 - protein, 91 aa, Glycine max
  Coding DNA Sequence Number=SeqID_68882
THLLLEVASPLSLPFSIPLPFIFQEAKESIDEEDPRPTSSNGACINKGYQVSRSGQSKVAITPARFPQLHSSEDMTRTECVLIMEEPRGIH

SEQ ID NO: 185661 - protein, 139 aa, Glycine max
  Coding DNA Sequence Number=SeqID_68883
MGLCRPYRAPVPPSKFISSWHRDCACKTPSGPEEGQQGLGVASSKYGSLSVLGSACCPQQGHQVPPTNRAFIKKFCVSRQAQGETPQQPGDGRQRATDAPPSPLEFTSAHPQKGLSIAYTTWPTNRRPSPKPKDAPSCS

SEQ ID NO: 185662 - protein, 112 aa, Glycine max
  Coding DNA Sequence Number=SeqID_68884
MGSFWNNFWHGALFYVGCMHFGCKTQVRMSTSWAEDTWKPNPPVLLATSRGSVSRQLCWRLHPCAEIAALTGDFRGYQARVQDAQKPFPRELQTAAAGRREAGNHQFDWRFC

SEQ ID NO: 185663 - protein, 147 aa, Glycine max
  Coding DNA Sequence Number=SeqID_68885
GYVGSQLGKRDLRGGRKGEKTRGGIFYPTICVMKSFGFPQWSPFIRYPYDQKNEERSPWSTETAESTIHSLSGLDTSVSLLTQAPLVDYRNLPRLALSATDRWPLSLKTHLIRTLFGKSVGDCLDAIFSRSMKYPFFAQFEVSYSLE

SEQ ID NO: 185664 - protein, 70 aa, Glycine max
  Coding DNA Sequence Number=SeqID_68886
MGSEVYPEVHENPRAFFSSSSPILFEPLAHASSDWSLPREDCIITQGFQKFYGSITEVPETIFQQNVEFA

SEQ ID NO: 185665 - protein, 123 aa, Glycine max
  Coding DNA Sequence Number=SeqID_68887
MTRNGFLTTWPVMLQALESRFAPSFYDNSHGTLFKLHQHSTVNDYLIEFERLANCIVGLALLFLLSCFISGLNPELCCQVQALQPISLLEAMPSLSFKKTSLTTAARDPVTYFPRLNLRSQHR

SEQ ID NO: 185666 - protein, 116 aa, Glycine max
  Coding DNA Sequence Number=SeqID_68888
MGLDKVTGSSIIHENKDVMVADVPAQLMGSPLQGTLGLVKANDAEIEDLVEGNRYGLEGLHLATQLRIETRDEATKEKQQSETNDTVGQPFKLDQIVIDRAVLMKLEECAMRIVIK

SEQ ID NO: 185667 - protein, 75 aa, Glycine max
  Coding DNA Sequence Number=SeqID_68889
MARPKTKKGVDGWVGIRARRPNPTRDYAVGLENCSCLTQKTKRPMRKPPRRVACCLWHHWWKVQWREAITGPAAI

SEQ ID NO: 185668 - protein, 95 aa, Glycine max
  Coding DNA Sequence Number=SeqID_68890
MRDNAIKFIHIISIVTVVYRSYSAQWNAPKLPYDKHMSHSSCILREMKGWCLVLDVQRVDFVVAFVVGWGVMGKTDIGLVVILLGRILVHGIIRG

SEQ ID NO: 185669 - protein, 194 aa, Glycine max
  Coding DNA Sequence Number=SeqID_68891
  Pfam annotation: Domain name=zf-CCHC; Domain location=141-158; Score =6.4; E_value=0.086; Accession=PF00098.13; Description=Zinc knuckle
METYGLPYVHIMAALMRLNIDELPSCLVLERWTIAVKDRFVGMIIDDASFWNSHVIARYVWMLNACREFCTLACQSANDFVEGRNKSRKEIQNLKYKNGIEVGTGWVERCVGGLQDPTYVRTKGSGCKKSRVSKLRIKRIVKCSACKLPGHNKLACTTVNKPDAIDDNVLASCSFDGEDNASPMAGDFNVDVIG

SEQ ID NO: 185670 - protein, 240 aa, Glycine max
  Coding DNA Sequence Number=SeqID_68892
MVSTECYPQDYVNGYFQVDGWDFAQPRRLPQCGYSKNSAVWVLIEVAGYAGRLHSTYSTIGMVVRMRIALSLLKYSHNSKRHVIEKESHKVRKVSWSVACPLGPSLITINTPFLKNLLVLKGICSTQFFLVLPSGFFWDNLIHWTNTNLVGGQLSLFHFQSSIVRVAIQETRGESWMIPIVASGLAIRTKPKVHPATYGIWDVTTVSVCRVLHSAVIWASTTSTVGVPYKYWGMDGGGFP

SEQ ID NO: 185671 - protein, 35 aa, Glycine max
  Coding DNA Sequence Number=SeqID_68893
MLKVQVTTSVLARNDVESTGLRQLPNSPSYINDSE

SEQ ID NO: 185672 - protein, 61 aa, Glycine max
  Coding DNA Sequence Number=SeqID_68894
MSLDFTGQDDKGAEDDVTVGCLHMPLDSWVTVTKGGVVEKSKVVALTYPQFVMRNSNLRSS

SEQ ID NO: 185673 - protein, 77 aa, Glycine max
  Coding DNA Sequence Number=SeqID_68895
  Gene Ontology: Mol. function=nicotinate-nucleotide diphosphorylase (carboxylating) activity; Biological process=pyridine nucleotide biosynthetic process
  Homolog annotation: Hit_ID=Q3SKL2; Match level="QueryCoverage=97%, HitCoverage=27%, E-value=3e-20, Identity=68%"; Hit description =Nicotinate-nucleotide pyrophosphorylase
  Pfam annotation: Domain name=QRPTase_C; Domain location=1-72; Score= -48.7; E_value=0.0002; Accession=PF01729.9; Description=Quinolinate phosphoribosyl transferase, C-t
QALDAGAKSILLDNFTLNDLRQAVVINQKRALLEASGNVDLTTVRAIAETGVDRISIGALTKHIQAVDLSMRIQMRL

SEQ ID NO: 185674 - protein, 126 aa, Glycine max
  Coding DNA Sequence Number=SeqID_68896
  Subcellular localization annotation: CTP_CleavageSite=75; ConfidenceScore=5.69e-01
QYQSAAFSGYASQGCEQSFQPVGFSSYMPQYSFQVPFISNVFGGPSQMFATTFNTPPSACNLPPSTSCYRPSLPTQMRDMGHEDEEDDDDNNNNDDDDDNGEQEEVEVVDQEDNKHRQIQSNKMRD

SEQ ID NO: 185675 - protein, 150 aa, Glycine max
  Coding DNA Sequence Number=SeqID_68897
  Subcellular localization annotation: CTP_CleavageSite=35; ConfidenceScore=5.07e-01
MDMNIGALISGQMTSIAQSNSSRLGFLALITTLCRARGVISDNLTFERLSLIINLAYIRKNYWNPDDLTVAIRGARRARARPADLPSTSVAPTPASTSASPSVPAQMDSQRFEAMLQSIHQGQIILLQSLQVVAPPRSIPSIEQFLERVA

SEQ ID NO: 185676 - protein, 1028 aa, Glycine max
  Coding DNA Sequence Number=SeqID_68898
  Gene Ontology: Mol. function=RNA-directed DNA polymerase activity; Cellular component=chromatin; Biological process=chromatin assembly or disassembly
  Pfam annotation: Domain name=rve; Domain location=655-793; Score= -3.5; E_value=0.012; Accession=PF00665.16; Description=Integrase core domain
  Pfam module annotation: Pfam domain module=RVT_1::rve; Domain location=173-342::655-793
MVGDGGVIHCDCRYPQVSITIQGHQFTTDLFGLPLSGADLVLGVQWLRALGPVTTDYTALSMSFTHLGLPIKLFADVLLGPASSSPITNSPTLLLATEPPPPALTPLLTKFRHLFQEPSQLPPARPISHHIHLTPDAKPVTVKPYRYPHSQKTELEKQVQTMLDSSLIRLSHSPFSSPVLLIKKKDGSWRCCIDYRALNSITIKHSFPMPTIDELLDELGAASCFSKLDLRQGFHQIRRAEEDIHKTAFRTHSGHYEYCVMPFGLCNAPATFQATMNEMLKPFLRKFVAVFFDDILVYSSSWDDHLLHLEAVFSALARDSFYLRESKCVFAKPRLQYLGHILSSKGVSPDPSKISAILDWPTPTTTTALRGFLGLTSFYRRFIRGYAPLAAPLNALLRKDSFLWTEDSQRAFDTLKQVMTSAPVLIPPDFTIPFCLETDASGVAVGAVLSQHAHPITFFSKTLCPRLQRSSTYVRELHAITSVVRKWRHYLLGHPFTIITDHQSLKDLMNQVIQTPEQQQYLVKTIQYRAGSDNAAADALSRVTPAGQCLILSIPLLDCMADIHHSMQQSPAYHELLATLHQQPEAHPDYSITSGQIHFRGKLWLPPDNPFIPMLLEEFHSTPLGGHMGEKKTLICQQIKYKARKPAGLLQPLPIPSVLWEDLSPDFITGLPPSHGFTAILVVVDRYSKGTHLGALPPKYSAHKTRSFSVHSGANYFALVAPNSGIAPRTTLNLTARRRSLIELWSSTSVRSLMTSLPSGTPSFWHAFLPLAEWSYNTSTHFGTGLSPYEITYGKPPPAFPPYTTGTSPVEAADSILSTRQALHTKLQSRLLKAQMAMKNHADRHRRDVHLQPGDLVYVRLKPYRQLSMRPHYSKLAKRFYGPYPITECVGPMAYRLQLPADSKIHPIFHVSLLKPHHGPPPPVDDPVPPTQVDHHPLVEPLSFLDWKFDTTKDPPSHSVLVQWRGLAPKDTSWKDWDALRSVYNLGDEVVFPREVVVSNKTQISREAPTKDRPKRNIKKPAHFQDYI

SEQ ID NO: 185677 - protein, 134 aa, Glycine max
  Coding DNA Sequence Number=SeqID_68899
  Gene Ontology: Mol. function=ribonuclease H activity; Biological process=RNA-dependent DNA replication
  Homolog annotation: Hit_ID=Q1T6C8; Match level="QueryCoverage=84%, HitCoverage=54%, E-value=1e-15, Identity=43%"; Hit description =Ribonuclease H
MPRCISHALIRPNQGFYGRLGDVDILKAEFMGLLQGPKIAWDMHYSNIICVTNSALAMKLIQQPLQPCHAYATLIANIKDFQRKEWSLEFCPSLREGNQCADFLSKRGLHGNVFLVIVDVPPHDMVELWLLRLS

SEQ ID NO: 185678 - protein, 220 aa, Glycine max
  Coding DNA Sequence Number=SeqID_68900
SLDEDDSVDGISDTDDEVTHMIEPVTIVQPREGKYVALQICDDEDVEIMIESFQEQEQMSVIELYIEKDAISGSTFHFANSIRSCRNNESKLPRNSLDEHDSVDGISDTDDKITHMIEPVTIVQPKEGVEGIQNPFWNDVLHYNNINWSHPDEEDICGLEMSSSFNVGQELYITYSTQWWSLRNEATIPPSDDSWTLILDPSIIRAKGQSKSTRIRNEMD

SEQ ID NO: 185679 - protein, 197 aa, Glycine max
  Coding DNA Sequence Number=SeqID_68901
  Gene Ontology: Mol. function=oxidoreductase activity; Cellular component=mitochondrion; Biological process=electron transport
  Homolog annotation: Hit_ID=Q2V993; Match level="QueryCoverage=96%, HitCoverage=46%, E-value=2e-85, Identity=78%"; Hit description =Sulfite oxidase-like
  Pfam annotation: Domain name=Oxidored_molyb; Domain location=1-174; Score=138.3; E_value=2.1e-38; Accession=PF00174.9; Description =Oxidoreductase molybdopterin binding d
  Subcellular localization annotation: CTP_CleavageSite=49; ConfidenceScore=5.03e-01
MLFDDRMLPKYSVTATLQCAGNRRTAMSKIKTVKGVGWDVSAIGNGSLSSGMRRGEGMPTSIWGGAKLSDVLELVGIPKLTSVTRFGGRHVEFISVDKCKEENGGPYKASIPLSQATNPEADVLLAYEMNGEPLNRDHGYPLRVVVPSVIGARSVKWLEDINIIAEECQDYKMFPPSVNWDNIDWSTRRPQMDFPVQ

SEQ ID NO: 185680 - protein, 136 aa, Glycine max
  Coding DNA Sequence Number=SeqID_68902
  Gene Ontology: Mol. function=oxidoreductase activity; Cellular component=mitochondrion; Biological process=electron transport
  Homolog annotation: Hit_ID=Q2WFI1; Match level="QueryCoverage=67%, HitCoverage=14%, E-value=1e-16, Identity=73%"; Hit description =Sulfite oxidase
EPFNAEPPRAALVASYVTPSDFFYNRNHGPIPIVEDINRSLSFFLFNLLCCALKPCGFKFDSFCDAFACLEQILRDRVWFGGASQTALHERYLVLNCRHGRGRGFLLSLYGGKLHTNVADAATIAVVLWLQKLQKL

SEQ ID NO: 185681 - protein, 358 aa, Glycine max
  Coding DNA Sequence Number=SeqID_68903
  Gene Ontology: Mol. function=RNA-directed DNA polymerase activity; Biological process=RNA-dependent DNA replication
MTLRSANRYNSSFFQILPRAQPRSVVLPRLGYATEGQAVGGVPLPNTLEGPQFHPQPQPLHLAARRIPPAMAEKGKLDHMEERLKAIEGGGDHAFADMSELYLVPDIVIPLKFKGTACPKNHLRMYCRKMRAYAKDEKLLMHFFQESLTEAAVTWYTNLEPSRVHSWKDLMVAFVRLYQYNSDKALDRMQLQNMCKKEHESFKEYAQRWRDLLAQVAPPMTEKEMITMIVDTLPVFYYEKMVGYTPSRFADLVFVGERIEVGLKKGKFDHPALINEKPGANREEEKEEGTHVVTVIPTWPKFPLAQQLVVITPTKVPQPPFFQGYNSNTTCDYHGGVLGHSIEHCMTLKHKVQSLIDA

SEQ ID NO: 185682 - protein, 107 aa, Glycine max
  Coding DNA Sequence Number=SeqID_68904
  Subcellular localization annotation: CTP_CleavageSite=63; ConfidenceScore=5.09e-01
MDPKEEKGANNVAPFGSAARDGGGVSQFCNPWRSTAPSHNCHRQASPHHGSLPLPSPAPSGVRACTTLHGGATRCVVKVLLLHLWFSNLFADLWVGLSRSDLISTLA

SEQ ID NO: 185683 - protein, 59 aa, Glycine max
  Coding DNA Sequence Number=SeqID_68905
MEAMKRQMTTMMEAMMSMRKMMDPTHTPDFNQENHPVLDMGGQGGATTANAYELHCVQV

SEQ ID NO: 185684 - protein, 106 aa, Glycine max
  Coding DNA Sequence Number=SeqID_68906
MEYLLPCYHFQDPMLTTPLNPPFFIDARRGGSMTIRLMRLLLGFLPCHIIPEPWVSPWVDLVNLVFEDEGEDVEEDTSIKEDLFMDEEDPVTKLELMEEDSSDESY

SEQ ID NO: 185685 - protein, 544 aa, Glycine max
  Coding DNA Sequence Number=SeqID_68907
  Gene Ontology: Mol. function=RNA-directed DNA polymerase activity; Cellular component=mitochondrion; Biological process=RNA-dependent DNA replication
  Pfam annotation: Domain name=RnaseH; Domain location=135-245; Score= -25.4; E_value=0.013; Accession=PF00075.14; Description=RNase H
MLRKIEPFLWDEAYEQAFLSFKKTIATSPVLCQSKLVVPLLIYLSVDDKAISLTLIQKEGKHQLPIYFTSCILHDVEKRYQMIKKVVLPELTGRMVVWSVEVSEFNLQYEPQDPMKTQFMTDFLAKFVGNDQTTPDWWNLYMDSASYMKGSGAGIILKGLNNVTLGQGLKLNFKASNNQAEYETLTVGLKLAKEVRAKKLRCYTDSQLVQGQGEQHRANLFSKLAITKKTRHLNTNIQETLQASTIDTKKVMAGKEEEPDYMTSYKNFLIQGRGLTTPLLKCLNNQQANYVIRELHEVIYGLYTRGRSLATKVVRASYYWPTLRANTLDFTKRCRQCQEFVDVTRTPHDNLYSLSSPCHFAMRGMDILGLLPKALGAVEEATRVILKALCTRLNKSKGEARKDSRAGKLGPNWEGPFRVIASLDNGPYKLHEPDGPPLVSLDKIQDRRVPGRISKGLSNPRSTLGESHFSKGSSNPRFALAESLISKGSSNPRSTLGGSRFYKGSSNPRSALVESHFLKGSTNPRTTLGEPHQNPGQTRPWSTL

SEQ ID NO: 185686 - protein, 598 aa, Glycine max
  Coding DNA Sequence Number=SeqID_68908
MEGVRIAGLLSLSSPLAWAGVVRDAFAKLSKNALKIGVSFCLLLWASAAHTRYSCIRVTHGVRTPSSTVSFISNSAKGIGGSDPGVSIQQPLVNWGGLEEETCHGTSNSESTSSKRIVGERMLEEVLIASVAGTGGGDVKASPRVRHNHSVGSPSSPSIVIGYEWVWDNVLKYRSSITSMENVATLQPQLRLANPEDSSRITVQAYRSDDFPFLRVVSGNLPFFFMYKCLFEDCFFKVIATDVMANRLPLLFNQDGEPRFLFYWQSNATRFKSFDKDLLTLVEKVDKAILEQLPPRRMHRTFCLFIRQTILSLPWTGSPSTPSVVQATTPAPTIVVAHAPPTLSSLPILGFMLLLLLRVTTMSAPEMSPSSFLAPLVPSPTMLASASPSSSFHPKQKTLIGFVSSFDKNLIQSVGVQNATDSTKVFLQRSLVILEENGQWYQEALSKVASLEVEIAKWRTTTQTIWRVEHPKVANTTVSFSEAVRMNWWTRWRALRRKDELAKVVADLQAWLRESESKLEESEQRVSKKREANKEFEEELLVYKKEAIEQHEKGFHKIIRQAKIFAKDLDLGFFDPFKDVKDSELLDKEEIDAIMKED

SEQ ID NO: 185687 - protein, 122 aa, Glycine max
  Coding DNA Sequence Number=SeqID_68909
MVFHLRLVVSFKTRKGKQGSKGLSKELIQEKARISIHKMPRNSYFENNYPFPVHNPKFKEKHAMLYTKKNSLSHGGREVRWSKEVSFTTASTKEGFVRNGLSRCPLTLKLLFMESLLISTVP

SEQ ID NO: 185688 - protein, 69 aa, Glycine max
  Coding DNA Sequence Number=SeqID_68910
MTLKYFYLPLQILKDLFQNKDIDTGTGYEEEDAEEEEDQSSAQEKKKGVQGEEKPKRRIVKPSYLKDYV

SEQ ID NO: 185689 - protein, 122 aa, Glycine max
  Coding DNA Sequence Number=SeqID_68911
  Subcellular localization annotation: CTP_CleavageSite=40; ConfidenceScore=5.28e-01
MATPPNSPPPLLESAAHLLSTPKKTRKATQLRSLATRLVEAERPMVHVDPATGNVVDLHRKKLRMYLGIVTRHKVDVTIDNWKQVHAAQKDLIWEDIQVEFDIPEASNLRMKKKIFQTVGER

SEQ ID NO: 185690 - protein, 266 aa, Glycine max
  Coding DNA Sequence Number=SeqID_68912
  Subcellular localization annotation: CTP_CleavageSite=31; ConfidenceScore=5.36e-01
ESGAPRIDRLALFANSPFSTFIRSPTNSLPSAVHASYTFESGALRIDCLALFANSPFSTFIQSPMNSLSSTVHASSTNESGGPRIDCLALFASSPFSTFILSPMNLLPSAVHVSSTFESGALRIDCLALFANSPFSTFIRSPMNSLPSAVHASSTNESGAARIDCLALFANSPFSTFIRSPMNSLPSAVHVSSTFESGVPQIDCLALFASSSFSTFIRSPMNLLPSAVHVSSTFESGAPRIHCLAKFANSPFSTFIRSPMNSLPSA

SEQ ID NO: 185691 - protein, 83 aa, Glycine max
  Coding DNA Sequence Number=SeqID_68913
  Gene Ontology: Mol. function=RNA-directed DNA polymerase activity; Biological process=RNA-dependent DNA replication
MVQEGIMLGHKISKRGIKVDKSKIDVIDKFPPLVNVKGVVLGQRKGRIFHTIYYARKVLNDAQINYAITEKEMLAIVYELEKF

SEQ ID NO: 185692 - protein, 311 aa, Glycine max
  Coding DNA Sequence Number=SeqID_68914
MSPTRLFFTGNPGEKVTKTVTLQNSSDKDYVFNLNYKDWVREEDGNKVYLEAGSSKTSNASWISTLENTVTVPAKSTKEIVVTMQIPANASKSSVTNSMLFFTQLPQQADKARIQNGIGIITLFEVGLHIFYTPPGNHVKSLDITNISEASNENAANRKVAVSIHNDGNTINDATVEFELTNTDSGKEIKLPAISISMLPDTNQVVQFSLPENISGNFLGVEKKDIQIHFENDSVAVEKGSTFSNFLVIENKSSEEITIQNIIPKEKYPGLLFYPKNDFILGAGQSKNLPVKLLANVDFMKLRSNEIQFQI

SEQ ID NO: 185693 - protein, 101 aa, Glycine max
  Coding DNA Sequence Number=SeqID_68915
MVILHPFVIQRRRAPMTCGDKLWSFRTPLPFRHSRVRWYAETNYGHSAPFCHPEAAGPMTCGDKIWSFRIPLPFRHSCVRWHAETNYGHSAPFVDRGRQAR

SEQ ID NO: 185694 - protein, 273 aa, Glycine max
  Coding DNA Sequence Number=SeqID_68916
  Gene Ontology: Mol. function=transferase activity; Cellular component= integral to membrane
  Homolog annotation: Hit_ID=Q6EVP5; Match level="QueryCoverage=98%, HitCoverage=19%, E-value=3e-58, Identity=46%"; Hit description =Putative membrane-bound sugar-binding protein
  Subcellular localization annotation: CTP_CleavageSite=16; ConfidenceScore=5.14e-01
MAHLAKAAVLAAPAHRAALVGHFQRRAVQIGVKPVNLTAVLVTKMIHPRQRAPGFIRVVDIGVAQPALLLLLQQAVALPQEARFGGAVRRSDDFTRAAAQRVVVIARLKPPFRAGSAGGYQPVLGVIRIMVFIQPVAAADQVAPVVVFHKQRLPVLQAVIRDRYRIIIGGEVIRGVIAELRAAVPLSGLVVLQQTTFGVVAVIYLTAQGVADAGKLTARGVAIEAFQERLLRQGHVRAQLTCAAGCVCRGCHTDGAARARPGCGAPRGAGGRG

SEQ ID NO: 185695 - protein, 130 aa, Glycine max
  Coding DNA Sequence Number=SeqID_68917
VQHSISSVSIYDVTQSDNRVKSYCRLNWLRASTFKFERLDMIQDSINHPSKKLLSFELAQSFHIQFRASQYITGLNQTSEGSTFNFERPDMLSDCIGHPSKKLLSVELAQRFNIQFRASQYITGLNQTSE

SEQ ID NO: 185696 - protein, 72 aa, Glycine max
  Coding DNA Sequence Number=SeqID_68918
MTDIPGEGNRVGDLDTGRLVFLSDSVLWTCLGYFLMDGTTLCRNLPYDGRAGEKQKCVFQKENAWKSPPTFI

SEQ ID NO: 185697 - protein, 80 aa, Glycine max
  Coding DNA Sequence Number=SeqID_68919
  Subcellular localization annotation: CTP_CleavageSite=46; ConfidenceScore=5.04e-01
MTFFQLDYKAQNAQVTNALRNGRVAQTPAIFSKIPMLQTKFREDPTVNEGWTAFLTRQIHVASLRSFIKRLPRVFGNVQD

SEQ ID NO: 185698 - protein, 530 aa, Glycine max
  Coding DNA Sequence Number=SeqID_68920
  Homolog annotation: Hit_ID=UPI00005F7F94; Match level="QueryCoverage =99%, HitCoverage=53%, E-value=0.0, Identity=65%"; Hit description =COG4457: Uncharacterized protein conserved in bacteria, putative virulence factor
  Pfam annotation: Domain name=SrfB; Domain location=1-530; Score =282.4; E_value=8.9e-82; Accession=PF07520.2; Description=Virulence factor SrfB
MPKPEREIFRRRMQEAIALVWKAEGWHPADAAFDATSQAHSLRPVPDVQMEWDEATCGQMVWLFNETQVNFAGRAEDFFSSMARPDRPREADELPGKSLRIASIDIGGGTTDLAITQYRLDDGQGNNVKITPRLLFREGFKVAGDDILLDVIQLWILPALQQSLQKAGLALAEPLMNKLFGHDSRMDGQATLRQQVTLQLFIPLAQAVLERYENWNPLDSHSEINALFGELVPQKPASSVLAFVNGEIQRTLGGDSRFDLLDVPLVVSMAQLHAEFLQHRMAIIPALRAMCEVVSLYQCDVLLLTGRPSRFPGIQALVRHLQPLPGSRILSLEGYHTSDWYPFNKQGRIDNPKSTAAVGAMLCLLALDLRLSSFWFRAGDFEPYSTIRYLGVLDENATLSDDNLCYSEIDLDSHSFALDRKSSFRIRGNVCLGFRQLENDRWPATPLYSLSITDPQLARQVAGESVLRIRLAVQPGPDNLGPERLVLSEARMDDGTRVPLEQLSLKLNTLSATGNANAQYWIDSGSVCKR

SEQ ID NO: 185699 - protein, 96 aa, Glycine max
  Coding DNA Sequence Number=SeqID_68921
MQAEESTKAQRHKHKTSFGVKHNKRAKRTSKNSKIVRDWRLAHPTTKPNYESSIPELIWGLAQDSALSAATINFSREEVALSASSPLSPLLEVYFQ

SEQ ID NO: 185700 - protein, 59 aa, Glycine max
  Coding DNA Sequence Number=SeqID_68922
VEGVTVSLPFPHKVKNDQRDVQFRKFLEVMRKMHINLPFIEAISQMPSYVKHLKEMLSN

SEQ ID NO: 185701 - protein, 94 aa, Glycine max
  Coding DNA Sequence Number=SeqID_68923
MLGAPSNSPLLNMGLGPRLAVHFPIWLLFLQFSTIIFKGNETPENAPSHQPKILNLDPSFFCRTKRAKVALSVGCTLSSNGELSATAPFSTSRF

SEQ ID NO: 185702 - protein, 338 aa, Glycine max
  Coding DNA Sequence Number=SeqID_68924
MDKSLKVGEDEWREKEGRSTKFDATNEDTHRGTSLERVGVSCRTGGALLDLAGSNGGDVRVSPCMQRSIGSPSSPPAIAGYEWVRDNVLKYKSSLTFAACGSDDFPFLRAASGSLPFFFKYKCLFEILDLILPLNAFQCALLEHLNVPASQLHLNSWTMVSLNIISKKLFDFDSNIFHHFKDHFFKVLGIDVTTDGLPLMFNRDEEPCFPFYWQSNLTRFKSFDENLFTLVDRVNKAILEQLPASLDARAILSLPSTSDPLAALDGIMGDFTWRPLVKQVEPAVEVGPVVVVVDITSSATSSVLAKRKRDDGVGLSGRKKSKASMSLRVLRQATRLMP

SEQ ID NO: 185703 - protein, 71 aa, Glycine max
  Coding DNA Sequence Number=SeqID_68925
MFSSVGCGNLDRLSLTCQTCAAHAQYSCIRVTRGVDTYWSRGAWVSGGASWCKNLGHHFYTRQLPKNSSPF

SEQ ID NO: 185704 - protein, 301 aa, Glycine max
  Coding DNA Sequence Number=SeqID_68926
  Subcellular localization annotation: CTP_CleavageSite=70; ConfidenceScore=5.82e-01
MAAISASPVVVPSSTIIAPLLSVSVATVGAPVMSPPSSSAPSVPPFAVMASCYSFSRPRVSLDHLYTSSDADSLWGASYRREQKTLDGFVSTFDKNLILLAGVQNAMDSTKVVSFEAEVAKWRATAHTIWRVERPKVANATIAFTKAIWSNRQLSSKVGGALAKLLRTRLDGDELFKHCKDLQVEKKDLAGKVEGIAVERDKLAKMVVDLDAQLKESESRLEEFKLRATRERKANKELEDERLVYKKEVVEQHEKRFNKAVKHLGFFAKDLDLGLFDLCKDVKDGVLFDKEEITAEEKVVD

SEQ ID NO: 185705 - protein, 130 aa, Glycine max
  Coding DNA Sequence Number=SeqID_68927
  Gene Ontology: Mol. function=RNA-directed DNA polymerase activity; Cellular component=mitochondrion; Biological process=RNA-dependent DNA replication
MLPNDIKGSASTHHLSPMTQTLLPESSCGNQNELPHQAEFARNDTTTPNWWNLFVDSASNVKGSRARIILEGPYNISLEQALKLNFRASNNQAEYEVFIASLKLATKIGAKKLQCYIDSHLVQGQVANRY

SEQ ID NO: 185706 - protein, 87 aa, Glycine max
  Coding DNA Sequence Number=SeqID_68928
MDDHLENMIRDIGSKSFQQAHVYDTLKSDVEIPLYLGCTSFTRNEFKAMPKCLMCGVSGCKLKDEDCSSDEVIKGIPAKVLQYLSII

SEQ ID NO: 185707 - protein, 160 aa, Glycine max
  Coding DNA Sequence Number=SeqID_68929
MELSNKKGSPRVNLGFIEPWTRDMFALSFDKPMELRRGLDDDKKPERMISRLSQQFKNQEKFDFKIQEKMNSSSKRRNQEDFTREGTSFVVQVEGTSTWVVVTENKRGYISCGSVQVEGTYTWLFKENKGGYIPCGSLLVKVFTRLKRNLKDRRSLGDWV

SEQ ID NO: 185708 - protein, 459 aa, Glycine max
  Coding DNA Sequence Number=SeqID_68930
  Gene Ontology: Mol. function=RNA-directed DNA polymerase activity; Biological process=RNA-dependent DNA replication
MTSLATERYRSRGTPGQGRIKTGGATMYDSTFVGVGFNPPVSDHEAGELASAYPESTFFRVEAHISIVGAHSPFSIGIFDHDDVRKPSGVPDFSDKMASLSQIMLGWIPSMSDGCQANKFALLCSTLTSSLMGLGPLSEVSSRGSISKSSSSLAWLPSGRIRCYLQVLYIALSCLLLVCLDIYNLLGQGREFHFQRRRGDYGPKLVKRVHVASGLYSLAYKAKEWTVVRMDSVRGDLKSLESFSIQDISGIVLVDDDLGHHEVCNDDGDNHWVILVNGVDTLEVPIRESDKRETSLRWCIEKIDVDVPNGVKIVLSGLAGLFSLGKSAHNGVDYTSDLLGGFLPVLMEVVSHTAVAGLVLAWWLSDLLTNWASTRTWTLLEEANACLAYVSCPTCVSRSWCLLLACCAFVRLISGHFLSLDEHGMQCYLWVKFSDLDGDAPKSIHEVFERLDCRLLVTD

SEQ ID NO: 185709 - protein, 81 aa, Glycine max
  Coding DNA Sequence Number=SeqID_68931
  Gene Ontology: Mol. function=DNA binding; Biological process=DNA integration
  Subcellular localization annotation: CTP_CleavageSite=73; ConfidenceScore=5.09e-01
MAYGRSYLQMKCFQLVATSKYLTALGAFGSGPSMSIPNMAKGQEELRFRRLSGGVHGMFENFWHRLHFLVKSRASALSVGH

SEQ ID NO: 185710 - protein, 118 aa, Glycine max
  Coding DNA Sequence Number=SeqID_68932
MAMTEVRENKMGKHGWWVGSLLKDFSTQSLHDHYGTHMESEEGIPWSFYMNMVVLNNEAKCGGKGHMPNAQDPMGERGTLTDRVTEVVQCLESYYINILSKGKDVVAGEAPTTHSKKG

SEQ ID NO: 185711 - protein, 323 aa, Glycine max
  Coding DNA Sequence Number=SeqID_68933
MEGYSYTWSNKQIYPDMVEEKLDRVFANKPWCQGARRESRRKREKLYHFKKDQKHELELDVLLIKDEKIWEQCSRALWLKSGDKNTNFFHKHLVDDIEQIEEVIYDFYANLFKTSDPQNMDEIAYLVGGGAHTISHILFANDNIVFGRPIVEEAKEISFILNRVNQLVQLLNVKAVENHDRDLGLPTIVGRSKTRKFNFLEMAARACHNALRVRKSLLRRGMPLDPTCPREESHFVVWMSNFLLVSDNESATLVFEILYNTWSCCHLLVFERKSIPIPQLLSRAISMHSQEETIVTKTTARPTIWKSPPDGNLMPRFSLGKEL

SEQ ID NO: 185712 - protein, 135 aa, Glycine max
  Coding DNA Sequence Number=SeqID_68934
MATKKHERELMRLHQHEENDIKRKGIALRASSSSIQEESDKEDLTEIEEDDDDFRFFVKRFNKFLRNKTNKRESNINTKKKEEDSSLAPKCYESDQPGHMRFNCLVFKRRMKNPTRGISKKRKKRKDTSLGKIMS

SEQ ID NO: 185713 - protein, 92 aa, Glycine max
  Coding DNA Sequence Number=SeqID_68935
  Homolog annotation: Hit_ID=Q1RY42; Match level="QueryCoverage=72%, HitCoverage=7%, E-value=1e-23, Identity=80%"; Hit description =Ribosomal RNA methyltransferase RrmJ/FtsJ
MIDVNTTLRKVSSVANFIWSNSPLEILGLVTSITFTDPADSLIKDHDLTSEEVKSLYDDLRVLGKQDFKQAKPFILFLIFVLQLCINFCLFY

SEQ ID NO: 185714 - protein, 150 aa, Glycine max
  Coding DNA Sequence Number=SeqID_68936
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=83%, HitCoverage=14%, E-value=2e-34, Identity=57%"; Hit description =Receptor protein kinase-like
MTVSCDLSLLVTIPNRITVLVKKIEWEERSSKVASEFIIRLGNARDKNLVRLLGFCHNPHLVYLLYDYLPNGNLAEKMEMKWDWAAKFRTVVGIARGLCFLHHECYPAIPHGDLKASNIVFDENMEPHLAEFGFKQVLRWSKGSSPTTNK

SEQ ID NO: 185715 - protein, 356 aa, Glycine max
  Coding DNA Sequence Number=SeqID_68937
  Gene Ontology: Mol. function=DNA binding; Cellular component=nucleus; Biological process=regulation of transcription
  Homolog annotation: Hit_ID=Q1SV84; Match level="QueryCoverage=99%, HitCoverage=96%, E-value=1e-103, Identity=56%"; Hit description=No apical meristem (NAM) protein
  Pfam annotation: Domain name=NAM; Domain location=11-139; Score =317.0; E_value=3.3e-92; Accession=PF02365.6; Description=No apical meristem (NAM) protein
MEGNHEKEETLPPGFRFHPTDEELISYYLTNKISDSNFTGKAIADVDLNKCEPWELPEKAKMGQKEWYFFSLRDRKYPTGVRTNRATNTGYWKTTGKDKEILNSATSELVGMKKTLVFYKGRAPRGEKSNWVMHEYRIHSKSSSFRTNKDEWVVCRVFRKSAGAKKFPSSSHIRALNLNPFSLEVGPSIMPPPPMMHLADPAAAAHFLYGRNYMMNPSEVAEVTRVLRGGGPTNVNVMNMNLPMQYSHLNNPVAGGGGEGFTISGLNLNLGGTVATTTAQAQQSLLRPMMPPPQPSPAHTIAQVHHDFSSNMVTPNIALAADNVGYGGEVASANSHGNRYMGMDHCMDLDNYWPSY

SEQ ID NO: 185716 - protein, 97 aa, Glycine max
  Coding DNA Sequence Number=SeqID_68938
MVFYDAEEVEEVVIYGSPRRLHRLHGGVPLRSVAVVPTGIRGLDIVVSTRVSEASIEEPKKLKTLASLFFPHSARVSESSRSLTWLRLAFSIVDSTR

SEQ ID NO: 185717 - protein, 263 aa, Glycine max
  Coding DNA Sequence Number=SeqID_68939
  Gene Ontology: Mol. function=nucleic acid binding; Biological process= RNA-dependent DNA replication
MLENNLFNGAAHENPMQRLRKFIDQHGEIGLCTSKNSITTWNQCTSVFLRRYFSPKKIDQYIRDIGNFVQREQENLPKALERLQKMIKSCPYYSFSPQRLVHTFYGGVSSHNRKSLNATCGDYEDMCSNSYNNLGDKRIMKKCINYVEKDGKHMQALTLKIETLMRGEYTIDVKLVGAMDNINFSSNLPSQPEPNPKREDVNAMRTRSKRIQEDSEKKEGSFPKATDNVLIEKEQATRKVEVPMDRNPVASKEDEKKVLTPPQ

SEQ ID NO: 185718 - protein, 177 aa, Glycine max
  Coding DNA Sequence Number=SeqID_68940
  Subcellular localization annotation: CTP_CleavageSite=39; ConfidenceScore=5.02e-01
MESRKRARTEDIPSSSTPAPPSVTVGQDVQSSLTLVPMLQSLFRGQFILMHSLQELAHNRPMIFMEHFLEQVACPEAQLPLVRPNEAVPPEPTHVQVNSEPANPQSPVVNPPSSPELETVPPSPPLIVISDASSDEAAAPLDSPAAKTVDPPVSPIGGISDLSDSSSGKVVALTDSP

SEQ ID NO: 185719 - protein, 116 aa, Glycine max
  Coding DNA Sequence Number=SeqID_68941
MPPYPPVVVEASYYGGSEWREEYNPFEKKIMDHVGPEVGQFIDEEMITKDDDKGDDKKLKGQSKNEFKIFKIESRTIQDSRGKLISRIKNQDSRDQDSRIKRRLNQDKYEKVFFKN

SEQ ID NO: 185720 - protein, 282 aa, Glycine max
  Coding DNA Sequence Number=SeqID_68942
  Homolog annotation: Hit_ID=Q1S0I7; Match level="QueryCoverage=87%, HitCoverage=49%, E-value=2e-52, Identity=52%"; Hit description=IQ calmodulin-binding region
  Pfam annotation: Domain name=IQ; Domain location=23-43; Score=17.2; E_ value=0.057; Accession=PF00612.17; Description=IQ calmodulin-binding motif
MGREIETPKYPTPNKARRALRALKALVKLQALVRGHIVRKQSADMLRRMQTLVRLQAQARASRAHLSDNTPSFNFNSSLLSHYPVPEEYEHPPRGFSTKFDGSSILKRCSSNANSRNVDSERVGFDSNWLNRWMELDNKCSQTGDASLKNNGRPDDDKSDKILEVDTWRPHFKSHHNSSSSSQAAHYYLNADYNNENFAAAHESPSKRSAKALNQSFSSREVLQLRSLKFHKGKEEASSRTADNSPQAFSANSRNGSGARRGGGPFTPTRSECSLGFFSGYT

SEQ ID NO: 185721 - protein, 115 aa, Glycine max
  Coding DNA Sequence Number=SeqID_68943
MSGFTRNSPQISASPHQLDLAPYASEPYHAQWNAPGLLRDKHTLRSSRILRKMEVEEPWLGLWLPLNPRVDMGSSLAYDNGKRGEPYRLFAAKVVFVIGSAVDRLCGRFRDGLCG

SEQ ID NO: 185722 - protein, 77 aa, Glycine max
  Coding DNA Sequence Number=SeqID_68944
MCAQVCSKSKRLEMAPKKLSMNRSRRDAAAEGSNAAPEFDSHRFRSTEHQHRFEAIKGWSFHRERHVQLKEDEYTYF

SEQ ID NO: 185723 - protein, 80 aa, Glycine max
  Coding DNA Sequence Number=SeqID_68945
MVAAQLAQASQVASSRSNSLLEESSGGPKWAWVLFAPPFLLITETYKFRNDTCFLSVMLWNLADYIIIPFLTYGMLRNLT

SEQ ID NO: 185724 - protein, 126 aa, Glycine max
  Coding DNA Sequence Number=SeqID_68946
MPLTNSTTTTACLGHLLRLPLSPTATLLAPPLFSIQISNIGHSRVAGFVDIAINRRKVADTILITVAYRDDLAAKKTRLKQWAQVVACSVWESSSSSCSNPSDQIFTQVTNLLIGCVKNKRKENTK

SEQ ID NO: 185725 - protein, 91 aa, Glycine max
  Coding DNA Sequence Number=SeqID_68947
MVAMVVVVVVEWWWQRPHRCNNGCSSGGDNDSGMNGGGGGGMMMVRELGQEMKLGLHHLSMTCCALKRREEVIVEGVDMPCSNTSLEQGEP

SEQ ID NO: 185726 - protein, 276 aa, Glycine max
  Coding DNA Sequence Number=SeqID_68948
MSNLRPESHVAQQIRREKLRIQNSSQPSHEFPNNLEQLSLHPAGGFNNLDLLQVRSVRNANILDGLAVYSSEMPNFSTSSSNPNLSDARNALEYHQEQGAAAEPSNRLMMNQYGSFPHSMSAIHSSHKEHCELRNLGNWRNSAPHQGSDWFVNYASNANSFLSADLNNNVSAYNELMDVHCSNASGEISGREIQKQLGVLHNNPPPSPLYQNALQDIVKSASFSSHTRQDMSSLMQQNDHSIWVGNAGEAEPQQPSYETSQISCILGGQIEQLLIP

SEQ ID NO: 185727 - protein, 595 aa, Glycine max
  Coding DNA Sequence Number=SeqID_68949
  Gene Ontology: Mol. function=nucleoside-triphosphatase activity; Cellular component=membrane; Biological process=transport
  Homolog annotation: Hit_ID=Q84ZB2; Match level="QueryCoverage=92%, HitCoverage=93%, E-value=0.0, Identity=87%"; Hit description =Putative iron inhibited ABC transporter 2
  Pfam annotation: Domain name=ABC_tran; Domain location=406-571; Score= 148.1; E_value=2.3e-41; Accession=PF00005.17; Description=ABC transporter
  Pfam annotation: Domain name=ABC_tran; Domain location=94-285; Score =140.0; E_value=6.5e-39; Accession=PF00005.17; Description=ABC transporter
  Pfam module annotation: Pfam domain module=ABC_tran::ABC_tran; Domain location=406-571::94-285
  Subcellular localization annotation: CTP_CleavageSite=16; ConfidenceScore=5.10e-01
MVSDASKKKAAQKKAAAAAKRGGKAAAASSKTTSSEKAADKLANGIGEIQISDRTCTGVLCSHPLSRDIRIESLSVTFHGHDLIVDSELELNYGRRYGLLGLNGCGKSTLLTAIGCRELPIPDHMDIYHLTREIEASDMSALEAVISCDEERLRLEKEAEALAAQDDGGGEALERIYERLEAIDASTAEKRAAEILFGLGFNKQMQAKKTRDFSGGWRMRIALARALFMNPTILLLDEPTNHLDLEACVWLEENLKKFERILVVVSHSQDFLNGVCTNIIHMQNKKLKLFTGNYDQYVQTRAELEENQMKQYKWEQEQIASMKEYIARFGHGSAKLARQAQSKEKTLAKMERGGLAEKVVRDKVLVFRFVDVGKLPPPVLQFVEVTFGYTPDNLIYKNLDFGVDLDSRIALVGPNGAGKSTLLKLMTGDLEPLDGMVRRHNHLRIAQYHQHLAEKLDLEMSALQYMIKEYPGNEEERMRAAIGKFGLSGKAQVMPMKNLSDGQRSRVIFAWLAYRQPHLLLLDEPTNHLDIETIDSLAEALNEWDGGMVLVSHDFRLINQVAHEIWVCADQAVTRWEGDIMDFKEHLRSKAGLSD

SEQ ID NO: 185728 - protein, 970 aa, Glycine max
  Coding DNA Sequence Number=SeqID_68950
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=84%, E-value=0.0, Identity=40%"; Hit description=Chromo
  Pfam annotation: Domain name=RVP; Domain location=217-321; Score= -13.5; E_value=0.082; Accession=PF00077.10; Description=Retroviral aspartyl protease
  Pfam annotation: Domain name=rve; Domain location=786-917; Score =19.2; E_value=0.00015; Accession=PF00665.16; Description=Integrase core domain
  Pfam module annotation: Pfam domain module=RVP::RVT_1::rve; Domain location=217-321::425-637::786-917
MADNTRMKGIEAAIQAINTTLKKMVEDAELRHSNYMQMRSTGLARMDHFETQLGFLHLKSILHGSENSLPSHTAQPFQIRNIKLDFPRFDGFDYYSTPDQHRLTIAAVHMEKDLEFGPSPYESPRPALFKLTQTSSVAEYYTTFPALANRKPYPTPQTKPSFPSAKNPPIKRLTLAEMQLRRDKGLCYYCDDKFSLTHKCPNKHSLLLQVNETDDSHLEHQPLGTGHIQGLKVQILLDNGSSDNFLQPYIARCLKLPIEPRAKYQVLVGNGSSLTVNGYIPELPVTIQGHTLHLPVYLLANTGENLVLGAPWLKTLGPHIADYESFSIKFYMGNTFITLHGDTGATLAQAQFHHIDRMQRTRSIDASFILQFQQLQQQIGDPGCIPVHLPPDLTALLYAYLDVFAEPLGLPPPRVHDHAIPLLEGSNPVKVKPYRYPHSQKTHIEKMVHEMLSQGIIQPSTSPFASPVLLVKKKDGTWHFCTDYRALNAITLDLRSGYHQILVKSEDRHKTVFHTYHSLYEWLVMPFGVSNAPTSFQSLMNHVFKEQLRKSVLLLRQHSLFAKWSKCCFGLTQVDYLGHTISSQGYYRRFIKNYATIAGPLIALLQKDVVSWNSEATEAFNNLKREITQALVLALPNFQHPVAFFSKKLSLRMQKQSTYVRELYAIIEALAKFRHDLIGHKFIIKIDQKSLKYKPGIDNVDADALSRSFCMAFSTPKTDLMSQIHAAINVDAAHAEIKNQCLQGICVAPHYQFHSSPLGGYAGFTRTKQAKASTIVPAGLLQPLPILLQIWEDITIDFITGFPCSNFFTVAAEVFMASIVKLHSFLKSIVFGKDKVFTSRFWQLLFQLCGTTLGMSSSYHPQLDGQSEVVNKCSELYLRCFTSQNPRTWSKMLPWVKFWYNTSFHTSIGMTSFKAMYGRDPPTLIKYDLHPSDPPLLQALLSDIDTFFTLLKANLLRAQQVMKKFADARR

SEQ ID NO: 185729 - protein, 292 aa, Glycine max
  Coding DNA Sequence Number=SeqID_68951
  Gene Ontology: Mol. function=metal ion binding; Biological process =metal ion transport
  Homolog annotation: Hit_ID=Q8S6Y3; Match level="QueryCoverage=52%, HitCoverage=60%, E-value=4e-16, Identity=30%"; Hit description =Putative ATFP3
  Pfam annotation: Domain name=HMA; Domain location=128-191; Score =18.1; E_value=0.017; Accession=PF00403.16; Description=Heavy-metal -associated domain
  Pfam annotation: Domain name=HMA; Domain location=37-98; Score=51.8; E_value=2.3e-12; Accession=PF00403.16; Description=Heavy-metal -associated domain
  Pfam module annotation: Pfam domain module=HMA::HMA; Domain location =128-191::37-98
MGQKQTKKSDYGHKKNKEKDKGKKKEETTSSNPTTLVLKVDMHCEGCASRIVKCVCGFEGVESLKPEIETGKLTVTGNVDPAKLRDKLARKMKKNVDIVSSLPNKDKPKNNDKKSKDKEAPVTTAVLKVTALCPCQGCSDRVRRAVLKTKGVKDVGIDREKGMVMVKGTMDVTALAKKLKEKFKRNVEVVPPKKEKEKGKEKESDEKGENGSAKKKKKGDNGHGGGKGNTDKDNESGGDNCQGKMDQNIVSYMVPAYGYGYGYGEYSNNYMGQYHPVSQMFSDENPYACHIM

SEQ ID NO: 185730 - protein, 136 aa, Glycine max
  Coding DNA Sequence Number=SeqID_68952
  Gene Ontology: Biological process=auxin mediated signaling pathway
  Homolog annotation: Hit_ID=Q8S8L5; Match level="QueryCoverage=53%, HitCoverage=58%, E-value=3e-18, Identity=63%"; Hit description =Expressed protein
  Pfam annotation: Domain name=Auxin_inducible; Domain location=23-123; Score=63.2; E_value=8.5e-16; Accession=PF02519.5; Description=Auxin responsive protein
MANFSSVRNSSKKKSVVGGIVKFKFVVEKLQKRLILLGRNKEGCDSSNSSYVPEDVKEGHFAVIAEGGGEEQKRFVLPLSCLTNPTFLKLLEQAEEEYGFDHEGAVTIPCRPCELERILLAHQWHQEGTCRKSLVF

SEQ ID NO: 185731 - protein, 67 aa, Glycine max
  Coding DNA Sequence Number=SeqID_68953
  Gene Ontology: Mol. function=phosphatidate cytidylyltransferase activity; Cellular component=membrane; Biological process =phospholipid biosynthetic process
MVGHKYGVLRWSKTGKKTVEGTAAGITSVLAACSLLLPLLASTGYILTQHWFSLLLAVTELNSFIPV

SEQ ID NO: 185732 - protein, 128 aa, Glycine max
  Coding DNA Sequence Number=SeqID_68954
MSRGRRRLGLLNMILFPDDLTYVYLHGLLMSSELVTAEYEISRSEISIIIQGLVLGLLLYPIALKYILQIWEWFISTASAEARRYCEIGRSLMFVASLGIVLILIVPSWMQFVHEFRMHPFFWYLINI

SEQ ID NO: 185733 - protein, 883 aa, Glycine max
  Coding DNA Sequence Number=SeqID_68955
  Gene Ontology: Mol. function=nucleoside-triphosphatase activity; Cellular component=integral to membrane; Biological process=transport
  Homolog annotation: Hit_ID=Q9ZUU9; Match level="QueryCoverage=74%, HitCoverage=85%, E-value=0.0, Identity=64%"; Hit description=White -brown complex homolog protein 3
  Pfam annotation: Domain name=ABC2_membrane; Domain location=519-682; Score=14.8; E_value=0.00043; Accession=PF01061.14; Description=ABC-2 type transporter
  Pfam annotation: Domain name=ABC_tran; Domain location=136-363; Score= 72.3; E_value=1.5e-18; Accession=PF00005.17; Description=ABC transporter
  Pfam module annotation: Pfam domain module=ABC2_membrane::ABC_tran; Domain location=519-682::136-363
  Subcellular localization annotation: CTP_CleavageSite=17; ConfidenceScore=5.29e-01
MEEIQSQSDNYRSSSSSASSPASRVPSSNFFYLRKPGSLRHPISFEDSPEWEDTDIDARVEEGGDSINVATTPASPSLSKLNSGSLPSPHLPEGAVIPRKIAGASVAWKDLTITIKGKRKYSDKVIKSSTGYAIPGTMTVIMGPAKSGKSTLLRAIAGRLHPSARMYGEVFVNGAKSQMPYGSYCYCIVEFLGTAIATPSTIAAAMGVVVAVAADAACILHPLGYVERETTLIGSLTVREFLYYSALLQLPGFFCQKKSVVEDAIHAMSLGDHANKLIGGHCYMKGLPSGERRLVSIARELVMRPRILFIDEPLYHLDSVSALLMMVTLKRLASTGYTLIVTIYQSSTEVFGLFDHICLLSNGNTLFFGETLACLQHFSNAGFPCPIMQSPSDHFLRAINTDFDRIIAMCKNWQDDNGDFSSVNMDTAVAIRTLEATYKSSADAAAVETMILKLTEKMILLKYGTCTSHDSVRKEDQVRTVRQLFLLEEVGLRSIKGSLLGQGGEGPVLKSKGKASNATRIAVSTWRSLLVVSREWKYYWLHLILYMLLTLCIGTVFSGLGHSLSSVVLLSSIPFLFLISISSSLVFYFLVGLEDQFSLLMYFVLNFFMTLLVNEGLMLVVATLWQDVFWSVLTLLCIHVAMMLSAGYFRVRNALPGPVWMYPMSYIAFHTYSIQGLLENEYLGTSFAVGQESVCCVVVLLHCMRDLILFPRKTRFWWRPSMTTSFLNGERAVVVFFICRILYSLTFSLLSHGLALSLLALASFSLDISFDSSNSPSLFRTRPGASSGILLGAVTLPSLLLSKLVQLSREFSLAQLHLEEIQYLTLQYWATSASACSVVLFLAFARRRRAPSSPSHWGVRFSLCSIFFQALVSVAALATTSQI

SEQ ID NO: 185734 - protein, 46 aa, Glycine max
  Coding DNA Sequence Number=SeqID_68956
  Homolog annotation: Hit_ID=Q2PMM5; Match level="QueryCoverage=98%, HitCoverage=2%, E-value=5e-20, Identity=100%"; Hit description =Protein ycf2
MEREKQMNNHLLPQEIEEFLGNPARATRSFFSDRWSELHLSSNPTE

SEQ ID NO: 185735 - protein, 125 aa, Glycine max
  Coding DNA Sequence Number=SeqID_68957
MTENLHDFAHENVSEALRKHLSLDFLHGNNFFHPKQLKCIAKGVRDIWNSIPSPIHRKMGEEVAAQIARGSWVASSIKCCGTLRITQQCSFWLPEYCGSLRIEHSIEHCMTLKHKMQGLIDVGWL

SEQ ID NO: 185736 - protein, 33 aa, Glycine max
  Coding DNA Sequence Number=SeqID_68958
AVILIARFPDPNYGVKRGSVKHAMAVSKLRMMQ

SEQ ID NO: 185737 - protein, 395 aa, Glycine max
  Coding DNA Sequence Number=SeqID_68959
  Gene Ontology: Mol. function=metalloendopeptidase activity; Biological process=proteolysis
  Homolog annotation: Hit_ID=Q2UXQ3; Match level="QueryCoverage=70%, HitCoverage=63%, E-value=1e-10, Identity=26%"; Hit description=Group I snake venom metalloproteinase
  Pfam annotation: Domain name=Reprolysin; Domain location=176-333; Score=-67.8; E_value=3e-07; Accession=PF01421.9; Description =Reprolysin (M12B) family zinc metalloprotease
MEEYKRAATDITAMTIHSVNLKKLVRDKPESIEISFPFEGDKKLTVELYKHQIFTDNFKVTTNTGEIVPYNPGAYYRGIIKGDNSSIVAFSFFEDDVVGVASSSELGNVIVGKIKNSEDFVSYSESKLTDTNPFVCGVDELKENQVQKTAFDPATVNKAVTENCVRIYYEVCFAPYQNNGSNTTTVTNWLTAVHNNIATLYNNDDIKVALNEIFIWTTADPYTGTPGANLSSFRTNRPTFNGDLAHLVNAPATTSIAYLNSLCTGNKYAYSGISQTYSNVPVYSWTIQAMTHEMGHSLGSPHTHACAWNGNGTAIDGCGAQAGYSEGCTGPIPATTVKGTIMSYCHLVSGVGISFSNGFGPQPAALIRSTVDSKPCLGTNCTTPCALSITSYEYF

SEQ ID NO: 185738 - protein, 329 aa, Glycine max
  Coding DNA Sequence Number=SeqID_68960
  Gene Ontology: Mol. function=transcription factor activity; Biological process=regulation of transcription, DNA-dependent
  Homolog annotation: Hit_ID=Q8U9C0; Match level="QueryCoverage=90%, HitCoverage=97%, E-value=1e-119, Identity=70%"; Hit description =Transcriptional regulator, LysR family
  Pfam annotation: Domain name=HTH_1; Domain location=33-92; Score =76.2; E_value=1e-19; Accession=PF00126.17; Description=Bacterial regulatory helix-turn-helix protein, lysR family
  Pfam annotation: Domain name=LysR_substrate; Domain location=116-328; Score=126.5; E_value=7.7e-35; Accession=PF03466.10; Description=LysR substrate binding domain
  Pfam module annotation: Pfam domain module=HTH_1::LysR_substrate; Domain location=33-92::116-328
MPGICGTRIYNTDRLSAQTDNQSLRLEDRVPDITDVNAFLLVARSRGFRQAARETGISSSALSDAVKRLEEDLGVRLFNRTTRSVLPTEAGRLLLERTGPAFAEVASALDEVRSSRGRTSGELRLNVPMSAARLVLPPIVPAFLAAYPDIRLEIVTDENFVDIIKSGCDAGIRYDERLEQDMVALPIGPRQQRYALAASSRYLARRGRPQHPRDLLSHDCILGRFSGRALPSWEFERDGEEVIINPKGNLVVQFGGGTDLGIEAAIAGSGMIYIFEDWLRPHFDRGDLVPVMEEWWLRFSGPFLYYPGRRLVPAPLRAFIDFVKQLHKV

SEQ ID NO: 185739 - protein, 195 aa, Glycine max
  Coding DNA Sequence Number=SeqID_68961
MSNSSEITTPATTIIITNTTTIHANGEPTVHVKHYFDISMLEEEETRTRKTQRRPMRAMSKSSLWEELQRGGWEEEVTLQYYQPEAMKVEIRRKKHMPSVDQDGIQERRFKGSFKSSKARSRPGSKPKKKKKKKKKTKLFPRSNESRKHMRSPDPFVQCSPKGLVQRLLQSGEVKGKSLSSTSLKTCPTKSKRFN

SEQ ID NO: 185740 - protein, 94 aa, Glycine max
  Coding DNA Sequence Number=SeqID_68962
  Subcellular localization annotation: CTP_CleavageSite=71; ConfidenceScore=5.10e-01
MIALAMDNFAKKQKAENEEFRRTMQQAIATQFSSLASSMSLPPTQPPPPVSVPPTLLTLNPNQTLSLDPPSQTAISQTLLPPTYFDIPPLPNHP

SEQ ID NO: 185741 - protein, 188 aa, Glycine max
  Coding DNA Sequence Number=SeqID_68963
  Gene Ontology: Mol. function=calpain activity; Cellular component =intracellular; Biological process=proteolysis
  Homolog annotation: Hit_ID=Q1S3Q9; Match level="QueryCoverage=95%, HitCoverage=39%, E-value=7e-18, Identity=32%"; Hit description =Cyclin-like F-box; F-box protein interaction domain
MFVFGYDPSSDKYKVVAIALTMLSLDVSEKTEMKVHGAGDSSWRNLKGFPVLGTLPKVGGVYLSGTLNWVVIKGKEIIHFEIVIISVHLEKETCISLFLPDDFCFVDTNIGVFRDSLCVWQDSNTHLGLWQMRKFGDDNKSMILPLCMSDNGDFFMLKFTRNADDEYQTILYNQGDGTRTEQEWYIKL

SEQ ID NO: 185742 - protein, 52 aa, Glycine max
  Coding DNA Sequence Number=SeqID_68964
MEQMQAEIEALKAQVSQVDVSKEQIAFLMQNVRGNESFIMQMYLLIVNFGDL

SEQ ID NO: 185743 - protein, 109 aa, Glycine max
  Coding DNA Sequence Number=SeqID_68965
MVDESNKGESVEVRRRRRGSEKRKSEGSDVDAKDVGKGVPEESSGRAEVAEVISSLFGGAGEERKHRSDGNSVASVWVRGERSKGVEEKCERIVREWRSQSTKEFQILS

SEQ ID NO: 185744 - protein, 258 aa, Glycine max
  Coding DNA Sequence Number=SeqID_68966
  Gene Ontology: Mol. function=transporter activity; Cellular component= membrane; Biological process=transport
  Homolog annotation: Hit_ID=Q392A2; Match level="QueryCoverage=47%, HitCoverage=90%, E-value=3e-25, Identity=52%"; Hit description =Biopolymer transport protein ExbD/TolR
  Pfam annotation: Domain name=ExbD; Domain location=99-224; Score =63.9; E_value=5.1e-16; Accession=PF02472.7; Description=Biopolymer transport protein ExbDTolR
  Pfam annotation: Domain name=MotA_ExbB; Domain location=1-89; Score =64.9; E_value=2.6e-16; Accession=PF01618.7; Description=MotATolQExbB proton channel family
  Pfam module annotation: Pfam domain module=ExbD::MotA_ExbB; Domain location=99-224::1-89
MDGGVAVLASIGSTAPFIGLFGTVWGIMNALRTITATGSAGLDVVAGPIGEALIATAIGIATAVPAVLAYNYFMRKQKVHRADMEQRVNAMAMFSDSDNEDLVSEINVTPLVDVMLVLLTVFIVTAPLLMNAVKVKLPQASAEVAVTVPKTAHISVTDAGDVFLDQKNMPLDSLTAELGTLKQKHDPAVEIYADEHAQYGVVAKVLAAIQRAVAVSLGLHLLVAMIYPKLSQIQLPAIPERMEIEFFSIKAPAPAVQQ

SEQ ID NO: 185745 - protein, 263 aa, Glycine max
  Coding DNA Sequence Number=SeqID_68967
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=95%, HitCoverage=48%, E-value=4e-78, Identity=51%"; Hit description =Putative receptor protein kinase TMK1 precursor
  Pfam annotation: Domain name=LRRNT_2; Domain location=93-132; Score =22.0; E_value=0.0021; Accession=PF08263.3; Description=Leucine rich repeat N-terminal domain
  Pfam annotation: Domain name=LRR_1; Domain location=136-158; Score =2.4; E_value=1e+02; Accession=PF00560.23; Description=Leucine Rich Repeat
  Pfam annotation: Domain name=LRR_1; Domain location=160-182; Score =16.9; E_value=0.075; Accession=PF00560.23; Description=Leucine Rich Repeat
  Pfam annotation: Domain name=LRR_1; Domain location=184-205; Score =9.8; E_value=4.1; Accession=PF00560.23; Description=Leucine Rich Repeat
  Pfam annotation: Domain name=LRR_1; Domain location=26-48; Score =13.1; E_value=0.99; Accession=PF00560.23; Description=Leucine Rich Repeat
  Pfam annotation: Domain name=LRR_1; Domain location=3-24; Score=9.8; E_value=4.2; Accession=PF00560.23; Description=Leucine Rich Repeat
  Pfam annotation: Domain name=LRR_1; Domain location=50-71; Score=4.2; E_value=46; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=93-132::136-158::160-182::184- 205::26-48::3-24::50-71
  Subcellular localization annotation: CTP_CleavageSite=33; ConfidenceScore=5.18e-01
MTSLTQVWLHSNAFTGPLPDFSGLVSLRDLNLRDNAFTGPVPGSLVELKSLKAVNLTNNLFQGAVPEFGSGVEVDLDLGDDSNSFCLSRGGKCDPRVEILLSVVRVLGYPRRFAENWKGNSPCADWIGVTCSGGGDITVVNFKKMGLEGTIAPEFGLLKSLQRLVLADNNLTGSIPEELASLPGLVELNVANNRLYGKIPSFKSNVVLTTNGNKDIGKDKPNPGPRSSPLGPLNSRAPNRSEENGGKRSSHVGVIVLAVIGGV

SEQ ID NO: 185746 - protein, 198 aa, Glycine max
  Coding DNA Sequence Number=SeqID_68968
  Gene Ontology: Mol. function=RNA-directed DNA polymerase activity; Cellular component=signal recognition particle, endoplasmic reticulum targeting; Biological process=RNA-dependent DNA replication
MKVEQVFACNHISEKRKVPLATLSFQGYALYWWTSVVRERRIHGDPPVEYGNDLKSSLRKKHIPSYYERELMDKLQRLRQGSMSVEEHRKEIELLLLRARLREEERTRIDRFLSGLNMMDLDELVQLCSRVEQQLKRNSSSKSYGFHSYPRKYQAQGTLGVAPSKPKEDKGKTIEKSIPKTSGSEDVTLPLNAPQRKP

SEQ ID NO: 185747 - protein, 124 aa, Glycine max
  Coding DNA Sequence Number=SeqID_68969
MAICALRWRLDDYFSPPPFAIQRQSSPIACKDHDGHSPSLLRDYQIPSIIQRQEGLMVCGDDDVICFPRRKTQHLLIKATEVSPAILRQESPIACGDHHGFANRAIGRWKLPSSSGRAELASAS

SEQ ID NO: 185748 - protein, 416 aa, Glycine max
  Coding DNA Sequence Number=SeqID_68970
VAEEPQLFVVFGAVVVVVVGLVEERMVGMIPPPGIVPVAGEVEEVYCRCLQHKLQAIQLLQIVAQKGKGLLTKASSLPSSFLVSADEDEFVATSCTPLMTIASFLALNCWEGHVSKGSTTGSIYHTSHEMKWPQESFPQRHPGRTSPKKAPALPSKLTRILTGTDSRASSINNASRPSRDGHSSKRAHRHWAPLVTPMAKFDSEIVMEFYSNAWPTEEGARDVLSHFLGHPLILEEGFLSDHCRETGEDHAHQHDHHNPDIDDVSIHVAQLIADAIYQFVGMVPTRHPVDPKKSNRALGFPTLITGLYQFYGVSVVPSKVIWLPITRAFIEKCTTAAMRGGTISEVFLRSPGQDRAPDGQDPSPFPWPTLEQFEATVAWPGDEVEFEMQAGPIGTSGGRDEAKDDQDMADMLDFLL

SEQ ID NO: 185749 - protein, 89 aa, Glycine max
  Coding DNA Sequence Number=SeqID_68971
GYHKWFKPRTQGITWLQKLKGLNREESEEVQALKAELKKTRVENEKLKVAVTRVRKECDKLKDINMTVAEALEWETKKDRKEEWSKNKF

SEQ ID NO: 185750 - protein, 45 aa, Glycine max
  Coding DNA Sequence Number=SeqID_68972
MSRDFMGYATMPFLTSGMLQNFTDCTTMLPFDFRHVAELHGLPND

SEQ ID NO: 185751 - protein, 54 aa, Glycine max
  Coding DNA Sequence Number=SeqID_68973
MSRNFTDYLTMGVKYLEAVKRRLHATKQWFPDEIRVQVVILIARFPDPNYGVKM

SEQ ID NO: 185752 - protein, 117 aa, Glycine max
  Coding DNA Sequence Number=SeqID_68974
  Homolog annotation: Hit_ID=UPI00006A17C7; Match level="QueryCoverage =90%, HitCoverage=55%, E-value=6e-08, Identity=35%"; Hit description =UPI00006A17C7 related cluster
MKGTTCSPLKEIMYSPLKARTCCPLNAKACSPLKARTCSFLKARACKEVQPDKGEDVQLSKVEKDVQSSEGEDMLSSEGEDVKSSEGEELQSSKCEDVLSSEGEGVQPSEGEDLQSS

SEQ ID NO: 185753 - protein, 45 aa, Glycine max
  Coding DNA Sequence Number=SeqID_68975
MEISVVVLGIFRGVSGALVKAEFNNGGNMVLSQPQRAWIGKARVI

SEQ ID NO: 185754 - protein, 108 aa, Glycine max
  Coding DNA Sequence Number=SeqID_68976
  Homolog annotation: Hit_ID=Q2HTW0; Match level="QueryCoverage=40%, HitCoverage=9%, E-value=2e-18, Identity=93%"; Hit description=Myb, DNA-binding
MTTICSWAIIASKFKDKTTRQCRRRWYTYLNSDFKKGGWSLEEDKLLCEKTWVVQSLRLEPTIVKEQYLQRLMGAVEAKSNFLVQDLLSVGQCQSGTFEILETQIPSC

SEQ ID NO: 185755 - protein, 52 aa, Glycine max
  Coding DNA Sequence Number=SeqID_68977
MKIPLGVIGAIVDLALIVVSKGAPVLIAGKLIVLKPPTQKSLIYTSRLIEST

SEQ ID NO: 185756 - protein, 248 aa, Glycine max
  Coding DNA Sequence Number=SeqID_68978
  Gene Ontology: Mol. function=chlorophyll binding; Cellular component =integral to membrane; Biological process=photosynthetic electron transport
  Homolog annotation: Hit_ID=P56777; Match level="QueryCoverage=95%, HitCoverage=47%, E-value=1e-135, Identity=97%"; Hit description =Photosystem II P680 chlorophyll A apoprotein
  Pfam annotation: Domain name=PSII; Domain location=1-240; Score =173.2; E_value=6.7e-49; Accession=PF00421.9; Description=Photosystem II protein
NNPLLNYSVPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQVV

SEQ ID NO: 185757 - protein, 134 aa, Glycine max
  Coding DNA Sequence Number=SeqID_68979
MGKYFKVSNCKRAKDMWDTLQEHEMELMRLNQHEENDKKKKGICFKASSSTQEGSDKEDTIEIDEDDDLSLFVKRFNKFLRKRIEKSEKKVFNEKKAKKAYITWDANDMDSSEDSENEVVNLSIMAKSYESDEE

SEQ ID NO: 185758 - protein, 465 aa, Glycine max
  Coding DNA Sequence Number=SeqID_68980
  Gene Ontology: Mol. function=oxidoreductase activity; Cellular component=intracellular; Biological process=lignin catabolic process
  Homolog annotation: Hit_ID=P93366; Match level="QueryCoverage=99%, HitCoverage=83%, E-value=0.0, Identity=78%"; Hit description =Diphenol oxidase
  Pfam annotation: Domain name=Copper-bind; Domain location=116-204; Score=-13.7; E_value=0.022; Accession=PF00127.11; Description=Copper binding proteins, plastocyanina
  Pfam annotation: Domain name=Cu-oxidase; Domain location=67-217; Score=220.4; E_value=3.9e-63; Accession=PF00394.12; Description =Multicopper oxidase
  Pfam annotation: Domain name=Cu-oxidase_2; Domain location=315-449; Score=187.4; E_value=3.4e-53; Accession=PF07731.4; Description =Multicopper oxidase
  Pfam annotation: Domain name=Cu-oxidase_3; Domain location=1-56; Score=32.2; E_value=1.5e-08; Accession=PF07732.5; Description =Multicopper oxidase
  Pfam module annotation: Pfam domain module=Copper-bind::Cu -oxidase::Cu-oxidase_2::Cu-oxidase_3; Domain location=116-204::67 -217::315-449::1-56
WADGPAYITQCPIQPGQAFIYNFTLTGQRGTLWWHAHILWLRATVHGALVILPKLGVPYPFPKPNMEQVMILSEWWKSDTEAVINEALKSGLAPNVSNAHTINGHPGPVQGCASQEGFKLDVQPGNTYLLRIINAALNEELFFKIAGHELTVVEVDAVYTKPFKTDTIVIAPGQTTNVLLTTKHAAGKYLVAASPFMDAPIAVDNKTATATLHYSGTLGSTITTLTSMPPKNATPLATSFTDSLRSLNSKKYPARVPLKIDHNLLFTVSLGINPCATCVNNSRVVADINNVTFVMPKISLLQAHFFKIKGVFTDDFPGNPPVVYNFTGTQPSNLRTMKGTRVYRLAYNSTVQLVLQDTGMITPENHPIHLHGFNFFVVGRGQRNFNPTKDPKKFNLVDPVERNTVGVPAGGWTAIRFRTDNPGVWFMHCHLEIHPTWGLKMAFVVDNGKGPNESLLPPPSDLPKC

SEQ ID NO: 185759 - protein, 89 aa, Glycine max
  Coding DNA Sequence Number=SeqID_68981
MPASYLLLKICILIFPELDAPLSMERPSFDGLEALLVLGAPETVAIKLGGGTGPFHCGVSPRPLRGKLFQSHFLRRQTFGKSIYKEMPF

SEQ ID NO: 185760 - protein, 161 aa, Glycine max
  Coding DNA Sequence Number=SeqID_68982
  Subcellular localization annotation: CTP_CleavageSite=38; ConfidenceScore=5.06e-01
MNSLSEHTAASTSTAPSVPTQTDSHGFHQGQIILLQSLQMMAPPDSIPSVEQFNEMVAWPETQPSLHKEDEGPRAQEEETQVRQVAAATPERSLEATSEPSAPVVNLPSPQPAADPSTPLLHMPEDPTTPVLAVDTSPPTTQVLQLIDEEDGQTQDTQDQS

SEQ ID NO: 185761 - protein, 185 aa, Glycine max
  Coding DNA Sequence Number=SeqID_68983
VPMNPKRIKVIPEWPTPPTSLIELVRNHVPSWEDAKEMVLRKMPRVSRTLGFETHLLLEVASPFIFLLLHSAAIRPQEEKESIDEEDPRPTSFTWSYINEEPPAAATAEDEDELTPPEPLDFDAGTHTAQEEEAIPEQIPEPSPAPAYAPDDATPVVEPKQTIQDSLVALALDLNEDQPQEEQDV

SEQ ID NO: 185762 - protein, 391 aa, Glycine max
  Coding DNA Sequence Number=SeqID_68984
  Gene Ontology: Mol. function=carbohydrate binding; Cellular component= outer membrane; Biological process=outer membrane biogenesis (sensu ProteoBacteria)
  Homolog annotation: Hit_ID=Q9PF41; Match level="QueryCoverage=98%, HitCoverage=49%, E-value=1e-131, Identity=56%"; Hit description =Organic solvent tolerance protein precursor
GTRVDEVAVEEDDHAIVGHQIAGADAGQILALVLRVPLVGGAQGPAVVDHVVAVGDPGRLALLHRCAARRGADPRFVEVLDLADRGREAFLAGGLVDEAGAQCQGQLVGIVLAVGAGIARVAEQLAPAEGEVTGVEDRQLVLVAIGRAQAGIKAADRQAAAGRFVAAQLLRRGGVRVDALRGQHVAADAVSEALVQVVAGVAVGQGRGDVPGRATDRERHVRLHVQARAAVHALGLAVARVLQVGPRIGAVLEVDVVVGEAHGFGIDAGFQPRQDRLVPVEVQARLAVVRQRAFIERVVGQLPAVGHDAGRPVPAGAVQAHGALQVRGSHPDQAVGEVLDIALVTDPGQVGAGLPVAVHVVVTAEHHPAAVAVAQLVIGHERGQQFAAAAV

SEQ ID NO: 185763 - protein, 260 aa, Glycine max
  Coding DNA Sequence Number=SeqID_68985
  Gene Ontology: Mol. function=acyltransferase activity; Biological process=metabolic process
  Homolog annotation: Hit_ID=UPI0000E69147; Match level="QueryCoverage =89%, HitCoverage=40%, E-value=9e-59, Identity=48%"; Hit description =phosphate acyltransferase family protein
MYIGDEHCAPVRRQVAFALVRPDRTQVHFDQAVDRIAEVRVHAEGEEARATGFTQIGVLAVQRGHAGAKCGQVGLEHIERGACIQLAETGRRGEVLERAVRFDQASSTAVIALVVRHQLLARIAWQRRADRHGAEQVTDTRPALQVGADALPQVIQAAAAPVIGHHEAAAQFQALGDVGDGIVGIAEQRRTVEPGQAVPGQRMGAAHDPVRAGDALRGRVPDHDVLVPQVVVVQVAAAPGALAHLAERQFAQAAQLQQQR

SEQ ID NO: 185764 - protein, 223 aa, Glycine max
  Coding DNA Sequence Number=SeqID_68986
MAASWSAYSVSTVGPWVHQEIPQAHLQHPMHRIYHGCTGILWYRRRVRMYRRYETCVLHCKYGIEHRVSQLQTRGGGGNPNIAGFCPRLVKKASAQPTCLRTRAAKLWALQLLQLAFVMWLEGKRPFILSFVRELKPFGIREAYWWMINVEQYFTKGLSQRALHGRARARLTGALSKGGKMRGVATNEGISTSHVDKSGALAPTYPPSKRKSDLRSSFLCMDQ

SEQ ID NO: 185765 - protein, 89 aa, Glycine max
  Coding DNA Sequence Number=SeqID_68987
  Gene Ontology: Mol. function=nucleic acid binding
MRTLCFPQGIVEDLLIKVRKFIFPVDFMILDIEENEVTPIILGKLFLNTIGTLIDVKEGKLTWCLGDEEEVFKATNKIKVIFSSNTHKP

SEQ ID NO: 185766 - protein, 74 aa, Glycine max
  Coding DNA Sequence Number=SeqID_68988
  Homolog annotation: Hit_ID=Q9FI46; Match level="QueryCoverage=96%, HitCoverage=33%, E-value=3e-07, Identity=49%"; Hit description =Arabidopsis thaliana genomic DNA, chromosome 5, TAC clone:K3K7
MGTDSDSDANGWNRARGLALKTLLLFGGALLVKRLRKSTTRWDHAHFVSKSLAGEKNAYMPRSGASGWFQGFVF

SEQ ID NO: 185767 - protein, 105 aa, Glycine max
  Coding DNA Sequence Number=SeqID_68989
  Gene Ontology: Mol. function=protein phosphatase type 2C activity
  Homolog annotation: Hit_ID=Q9M3V0; Match level="QueryCoverage=74%, HitCoverage=19%, E-value=1e-35, Identity=88%"; Hit description =Protein phosphatase 2C
VSRSIGDVYLKKAEFNREPLYAKFRLREPYKMPILSSEPSISVHHLQPHDQFIIFASDGLWEHLSNQEAVDIVQNSPRSVRYIFFYCARLCYVINRKIKVDTCMD

SEQ ID NO: 185768 - protein, 87 aa, Glycine max
  Coding DNA Sequence Number=SeqID_68990
MENLHEISHGNVSEALQKRLGLETIFFTNFKRIVNTRRAERNYSALFPLFIGKKREVVAAQLAQASWVASTRRHRLLLEHPGRGGIL

SEQ ID NO: 185769 - protein, 162 aa, Glycine max
  Coding DNA Sequence Number=SeqID_68991
  Gene Ontology: Mol. function=lysine permease activity; Cellular component=membrane; Biological process=amino acid transport
  Homolog annotation: Hit_ID=Q390W0; Match level="QueryCoverage=93%, HitCoverage=73%, E-value=8e-25, Identity=40%"; Hit description =Lysine exporter family protein
  Pfam annotation: Domain name=LysE; Domain location=16-162; Score =26.2; E_value=7e-05; Accession=PF01810.9; Description=LysE type translocator
MVIELSTLGLFALSAAVLTLIPGADMLCALSNAVSQGTKAGLITVLGAVTGVICHVCFAIVGVTALIASSPLLYQLFVIGGALYIMWVGLGIFTQANAIGLENHGERKSRKRLYSQGFLTNLLNPKDIIFMLAFIPQFIRVEAGRPGIQMLILALNSSSSCF

SEQ ID NO: 185770 - protein, 187 aa, Glycine max
  Coding DNA Sequence Number=SeqID_68992
  Homolog annotation: Hit_ID=Q1SKA6; Match level="QueryCoverage=31%, HitCoverage=7%, E-value=7e-09, Identity=50%"; Hit description =Rad21/Rec8 like protein, C-terminal; Rad21/Rec8 like protein, N- terminal
MVYPSGTRHESLKHVVKGLNPDECIYGENLVEREIPLMSANRIFYKKVEYVLEDCNEVLVKINKFVVNKEGLVCVETLCMPVTKPERFELDAFELDEPEDAGSKCNLILCKRHSSFPFPTECHHTLLIAHCVQRQRESPITYCALCCLEIVETPRMLDVPESQDFDIPIFIEIKSFWNLPKQMKCLI

SEQ ID NO: 185771 - protein, 118 aa, Glycine max
  Coding DNA Sequence Number=SeqID_68993
MEAMKEQMTTMMEAMMSMRKMMEVNMATVVAASTAIEVRKVKHWEVRAAPILCRSRGSIPSHHMACLLTIHHPMLHTLPMRMSTTPHPYSLRANNPYLIMHMPLNPWGRHMKHPKTTI

SEQ ID NO: 185772 - protein, 104 aa, Glycine max
  Coding DNA Sequence Number=SeqID_68994
MGETHEAPQDHNLADFEPHLEYAAEGQTFCGVPLSNTFGGPQYCPQPQPLHFAVGRVPPAMVEIKKFDHIKERLRVIEGGENYAFADMAELCLVPDVVIPPKFK

SEQ ID NO: 185773 - protein, 116 aa, Glycine max
  Coding DNA Sequence Number=SeqID_68995
  Subcellular localization annotation: CTP_CleavageSite=58; ConfidenceScore=5.22e-01
MNHYPFEGHQSDTSASKHSFGGVAKTYPNFSWPTMTASQQHDAPIATPNAPLGTTVPRAITDMDGLLGVDLRHQFSSEADQVEAGRHRGRRNPDRQTRRWERPCGTSSRHHGHHNE

SEQ ID NO: 185774 - protein, 307 aa, Glycine max
  Coding DNA Sequence Number=SeqID_68996
  Gene Ontology: Mol. function=binding; Cellular component=cell outer membrane; Biological process=hemolysis by symbiont of host red blood cells
  Homolog annotation: Hit_ID=Q0BRJ1; Match level="QueryCoverage=91%, HitCoverage=6%, E-value=1e-44, Identity=37%"; Hit description =Hemolysin
  Pfam annotation: Domain name=Haemagg_act; Domain location=12-150; Score=122.9; E_value=9.1e-34; Accession=PF05860.3; Description =haemagglutination activity domain
MFKFKLTYVALAAALSSTVVYADPSTYTHLSGATVVDIEAPNAAGVSHNLYREFNVGSNGLILNNSDSDINHATFGNIAKNNNLTNGGASVILNEVTSNKASSLNGFIEVAGLKADVVIANPNGITCSGCSFVNTNKAILTTGQVNLTDEGAIGSYTITNGKITIDENGMNAANSYAALLADAIKINGKVQAKNALVSAGNFTMDNSSGAVTSAGKKATLIEMTINPQYSIDVSSLGGITANSISMIGNNIGFGVRNNGSIISNSSLQLTSYGNLINKGTIKGNGLLSQVSTSQVSPMKAVSAEPII

SEQ ID NO: 185775 - protein, 253 aa, Glycine max
  Coding DNA Sequence Number=SeqID_68997
  Gene Ontology: Mol. function=RNA-directed DNA polymerase activity; Biological process=RNA-dependent DNA replication
  Homolog annotation: Hit_ID=Q1SDI2; Match level="QueryCoverage=71%, HitCoverage=33%, E-value=5e-19, Identity=26%"; Hit description=RNA -directed DNA polymerase
NVDQSLKNDVISVLEMTKGNDGGKYLGFPFFVGRIKKAIFNFIKDKELGGLGFPNIYAFNLAMLEKQGWRFRSKPNALSTRVFKAKYFPIGDFMGADIESWLRHKGHAVIRTSLINGSEDLKVSILMNKEALCWNCMLLKQIFEAEDVESAYKVIMNKLEDNEHLAILGDWRLIWKVNVPPRDIKSSKKFLFTLFLKLQNKGKIKWLSCYEAYRGGGMTSKKFLFTVFMKLQKKGKINGYLAMKHMEGGRNDK

SEQ ID NO: 185776 - protein, 68 aa, Glycine max
  Coding DNA Sequence Number=SeqID_68998
MRILQSIRELNVSFKSFEGILEGLSHLFYCDDETRLRKLEPVPGFLAKHKVQKAINERVFKRKRGKRE

SEQ ID NO: 185777 - protein, 120 aa, Glycine max
  Coding DNA Sequence Number=SeqID_68999
MSRNFTYCATKGVKYLEAVNQRLHAIKQWSPDEIRVVISFLMVSRGIIPFEKHITAAGTTSNNMLSKRKTLDEGSLLSSKSETQHDHRFTSTPYVPMDTSIGPLFNLPCVQKGVGVVYIK

SEQ ID NO: 185778 - protein, 115 aa, Glycine max
  Coding DNA Sequence Number=SeqID_69000
  Homolog annotation: Hit_ID=Q1SKA8; Match level="QueryCoverage=85%, HitCoverage=36%, E-value=2e-08, Identity=36%"; Hit description=Zinc finger, CCHC-type
TAIPESKDLTNMSLATLFGKLQEHEMKLMRLNQHEENYKKKKGIALKSSSSIHEESDKEDMNEQNNLEEDDDFSLFVKRFNKFLRNKEIKGDRTLVQRRKEKIPSQFQNAMNAIN

SEQ ID NO: 185779 - protein, 70 aa, Glycine max
  Coding DNA Sequence Number=SeqID_69001
VNPLSSLEREVVPPSPPLIIIFDASSDEAAAPPNSPARETADLPTSPVRGIADLSDLSSGEVVTLTDSPV

SEQ ID NO: 185780 - protein, 125 aa, Glycine max
  Coding DNA Sequence Number=SeqID_69002
TTVHHIHLCHDQVKVGLEEVRDADSPILVPTEEVQLMRQTLDTFVAWPTHLVKRLSEQGDVGLAKPPNRLDHDVDDPLYLMTLTIPQLFLKPLQVMWGAIVFGVFNDNFPLYIKHEDLSEIEHGG

SEQ ID NO: 185781 - protein, 142 aa, Glycine max
  Coding DNA Sequence Number=SeqID_69003
PLAREDALYGNPHTLICYSSDSESGSMQRLTSSSAPLDNESDDMRGYRMVICTFHQPEANEPVDTDSESDDMRRYRMVIRAFCQLEENEPIDTDSESDDMRGYRMIIRTFHQPRRTRTLAGTIEFDSMWKRRGYPVLSLSRH

SEQ ID NO: 185782 - protein, 114 aa, Glycine max
  Coding DNA Sequence Number=SeqID_69004
  Subcellular localization annotation: CTP_CleavageSite=36; ConfidenceScore=5.36e-01
MTTKAITESSNVNHKKCGDLGHVAPLPHKNSSRSVISSSIWGSSVSPGDSTGSSPVWASGQSPGHATSAPKCSGDAILPRKGPVTRTMSKRLQEDWARAAEEGPRVLMNLRVDF

SEQ ID NO: 185783 - protein, 127 aa, Glycine max
  Coding DNA Sequence Number=SeqID_69005
CLHFSGENTETFSSLTSYPELRRSEFLIGGYVGARASLLSTTPPFVAMTQELVARGDTLRLSAPRHSVIPSVIDEQRPIWSSAPFPEMSAFSDGDFSSLTSYPELRRSEFLIGGYVGARALLLSAAP

SEQ ID NO: 185784 - protein, 82 aa, Glycine max
  Coding DNA Sequence Number=SeqID_69006
MARRDQVWSFCTHDTRRYPMVIRTPLPFRHSRVRWHAETKFGADTVFCTFCSSGNNKVIYMRKFHGRPRLSSTERSEISVIH

SEQ ID NO: 185785 - protein, 131 aa, Glycine max
  Coding DNA Sequence Number=SeqID_69007
  Gene Ontology: Mol. function=nucleic acid binding; Biological process= RNA-dependent DNA replication
MPLSMCRRLGELEIMPTRMTLQLAYRSITRPYGVIEDVLVRVKHFIFPADFVVMDICEDTDIPVILGRPFIPFAKRKPRAKRIFVHALSRKSQALSNQRWHLRLIWSAKLAKAELSQFQINLNSAKRWPNH

SEQ ID NO: 185786 - protein, 394 aa, Glycine max
  Coding DNA Sequence Number=SeqID_69008
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-47, Identity=31%"; Hit description= UPI00006A17C9 related cluster
LHALTFRGLHVLAFRGLHVHIFGGQHAFSFRGLHVLAFRGLHVLAFRGLHILAIRGLYALAFRGLHVLAIRGPHPFTFRGPHVLTIRGLHALSFRGLHVLAIRGFHALTFRGLHVLAFRGLDAVIFGGQHALTVRGLHVIAFRGLHVLAFRGLHVLAFGGRHIHACRGLHVLAIRRLYALAIRGLHVLTIRGPHALTFRGLHVLAIRGLHAITFRGVRVLTIRGPHALTFRGLHVLAIRGLHAISFRGLRVVTIKGLHALTLRGLHVLAIRGLHAFTFRGLHLFAIRGLHVLTFRGLHILAFRELDVITLKVLHVLAFRGVHVLAIRGMHAVTFRGLHVLAIRGLHTLTFRTLHVVPFRGLHALIFGGLHALTFRGLHVLAFRGLHVLAFSGRN

SEQ ID NO: 185787 - protein, 69 aa, Glycine max
  Coding DNA Sequence Number=SeqID_69009
EVVAAQLAQASQVASSRSNSLLEEYSGGPKKWESLGETKKNTLIIKNMQRYPQLPKILSIVSLDNIRVH

SEQ ID NO: 185788 - protein, 111 aa, Glycine max
  Coding DNA Sequence Number=SeqID_69010
RSFSIGANVISSFGYRKERDGSWVKKDAPVQAAEDRSPSPHSHRDDSSSLMHNILDRLDGLHTFVGERFDSLDSRIDAMDARFAGMDTRITKLEEDVSYVRQCFDLPPPSS

SEQ ID NO: 185789 - protein, 153 aa, Glycine max
  Coding DNA Sequence Number=SeqID_69011
TEFEIPEAFDSRTKKKVLQIVGERWRKFKSDLTRKWALAADKDEHMLVAKKTKKRLEEAAQSGSTEGVIDPPSPIKRYDLLTAAIGQPKHPGRVPAAGANVTIKQYFGLAPRNSHSSSFMPPEELEQLTQQIRDQLEELITEKVTQQLMLSLS

SEQ ID NO: 185790 - protein, 105 aa, Glycine max
  Coding DNA Sequence Number=SeqID_69012
MCCSTPGNNIERIPLEAIVKTMPLLECMVDDKVFQTKGNFCASWQHILLSKIPSMMIALNQFVDFLSRAIDFQGGNKDIQLLVHVHALGMQKSFNMSQGATHICK

SEQ ID NO: 185791 - protein, 109 aa, Glycine max
  Coding DNA Sequence Number=SeqID_69013
  Gene Ontology: Mol. function=serine carboxypeptidase activity; Biological process=proteolysis
  Homolog annotation: Hit_ID=Q9FMX9; Match level="QueryCoverage=59%, HitCoverage=13%, E-value=2e-14, Identity=64%"; Hit description =Serine carboxypeptidase II-like protein
MAYLGTTIGISSAKWRLTVPSLPKGFNEIDFVAVAVILLITLIICYSQEILAEQEVDRVHGLRAQHPVKFNNMVVISLSMKLKEEHCSIGFSRPLTNQNKNSFSYGSTE

SEQ ID NO: 185792 - protein, 97 aa, Glycine max
  Coding DNA Sequence Number=SeqID_69014
  Gene Ontology: Mol. function=nucleic acid binding
MQLGLDQTLEDERLVSINETEWTKIQRRIMSTIRLALALKIKHVLKETTSKASWEKLENIYASKSLTNCLYLKIEFYQLKMETIGDLHYHINKFIYL

SEQ ID NO: 185793 - protein, 35 aa, Glycine max
  Coding DNA Sequence Number=SeqID_69015
MASSLLLAVVFVLDLVAFALAVAAEQRRNTSLLLL

SEQ ID NO: 185794 - protein, 159 aa, Glycine max
  Coding DNA Sequence Number=SeqID_69016
MQSQLQSLIQSQGLALPPEPEVGPSAARVNTKGSCVDPSPTNPDTGDSDKCRLYIEENPSRLVALGRVYEGSTSVHNIPLLHGQVKVGVEEALNTFLPWSTHLVKHLSEQVVVSPTKPPDRPDPEPLQVMWDATVFGVFNEDFPLYIKHKDLFEIAHGG

SEQ ID NO: 185795 - protein, 96 aa, Glycine max
  Coding DNA Sequence Number=SeqID_69017
MSHNGQVRSLSLSEIIGRSVRVTLFCENAPIMWDRHRLTGALKPDDPQGLHSEESVRASPSLFSAPQVINSSDSHSGSHHNSSRINSSPLKSLTVV

SEQ ID NO: 185796 - protein, 423 aa, Glycine max
  Coding DNA Sequence Number=SeqID_69018
  Gene Ontology: Mol. function=tetracycline:hydrogen antiporter activity; Cellular component=integral to membrane; Biological process=tetracycline transport
  Homolog annotation: Hit_ID=Q1QT68; Match level="QueryCoverage=96%, HitCoverage=87%, E-value=9e-85, Identity=43%"; Hit description=Major facilitator superfamily MFS_1
  Pfam annotation: Domain name=MASE1; Domain location=41-314; Score= -61.4; E_value=0.093; Accession=PF05231.5; Description=MASE1 domain
  Pfam annotation: Domain name=MFS_1; Domain location=2-378; Score =119.4; E_value=1e-32; Accession=PF07690.6; Description=Major Facilitator Superfamily
  Pfam annotation: Domain name=Sugar_tr; Domain location=1-349; Score= -165.0; E_value=0.1; Accession=PF00083.14; Description=Sugar (and other) transporter
  Pfam module annotation: Pfam domain module=MASE1::MFS_1::Sugar_tr; Domain location=41-314::2-378::1-349
MQVPANVAVWFANGYLLSAAMTLAIFAALAARVGYRPVFLTGLATFTLTSLGCALAKTPDVLIGMRILQGIGGAATLSIAPAILRSVFPGRLLGRVLGLHAMLIASSTAIAPVLGGTILNALSWQWLFAINLIPGCIALLLAWRALPKESAGDKSSFDAPGAVLSATFLGATIMTANSLQRVTQHINHEAIGWGLLALMSALAFTWRIRRASHPLLPPVIFKNGRFTLAALTSLASFVSQGITFVALPFLFQSVYGYSPVVSALLFTPWPIGIVLIAPHAGRWADTISAPLISTLGLMIFVGGLVVLATLHESPSVWNICLRSLVCGIGFGCFQSPNNREMLANVTRDYASYASGVSSIVRTFGQCLGADTVGVLLAATPGQNLDDRIVHVALWIAVIASTGAVLFSASRLRPAALCLHGPTR

SEQ ID NO: 185797 - protein, 54 aa, Glycine max
  Coding DNA Sequence Number=SeqID_69019
MESYFHGKFYSPQPDVSVANLMNIGKLSNDHKVIGRLFRNGAYGYEMTERKTIL

SEQ ID NO: 185798 - protein, 93 aa, Glycine max
  Coding DNA Sequence Number=SeqID_69020
MEKKKKKKGFGLGCRASVHDAFAKRRLGLRLTEIVVLVRVLRRVAVDLEIAYETVLWRYRERENCGFAVPSPFCGEVSPMRCPTRLLLGGPKI

SEQ ID NO: 185799 - protein, 95 aa, Glycine max
  Coding DNA Sequence Number=SeqID_69021
  Gene Ontology: Mol. function=calcium ion binding
  Homolog annotation: Hit_ID=O82062; Match level="QueryCoverage=87%, HitCoverage=23%, E-value=1e-14, Identity=50%"; Hit description=39 kDa EF-Hand containing protein
MGSRNGSGYEAEMVSIFSQIESPDRSLHDHIIEALGKLTVEQRIPYVTKKVLSNIVEPALLSQDGSDLDKPVSQETFLEEFKIVTMSVANRVNVN

SEQ ID NO: 185800 - protein, 164 aa, Glycine max
  Coding DNA Sequence Number=SeqID_69022
  Homolog annotation: Hit_ID=Q42191; Match level="QueryCoverage=24%, HitCoverage=9%, E-value=2e-09, Identity=68%"; Hit description=Inner membrane protein OXA1, mitochondrial precursor
MAENMPSFKHGGAYWFVDLTTPDAFYILAVLTALSFLLTVEFREPSIENEGQKYGWMIPHVSEQWGAQMLLAFKGRVMGSLTGKVARAPAWTVVAAEKCAEKGEISPERRAASKSTHRNAEIGHWKEDDKWKGLQWSTILVIRLPRITYALIPYNNVLLCNVVT

SEQ ID NO: 185801 - protein, 169 aa, Glycine max
  Coding DNA Sequence Number=SeqID_69023
MRLVCELHAPGPYMGLCAGTAHLQRNLHTNVFVRGTLVNAIMEAEYEGILEFRSHEKSAKQGTGLGHRREEKPNVAVVGLWVRRCFGCWRGAILWVWLHWRKEDLAVFMRSEKRTQKEIKEWCMMAVAVVTDKALEKEKGLLEDGQRAERSTWDLVPDGEPLSLFLCQE

SEQ ID NO: 185802 - protein, 140 aa, Glycine max
  Coding DNA Sequence Number=SeqID_69024
  Subcellular localization annotation: CTP_CleavageSite=38; ConfidenceScore=5.30e-01
KKYLLVLSKISNRYKALQHVSTQLQRFQISFKGRGTCQGATTSGRAWQATTSGRAWGPPLLVAPGALPLLVAPGRPPGRQTRPPLSHRLVQSRHVSRSGRTRSSEVVALPLKVGCGVCRELSDEDNSGRMGNEGKDRIGI

SEQ ID NO: 185803 - protein, 73 aa, Glycine max
  Coding DNA Sequence Number=SeqID_69025
  Homolog annotation: Hit_ID=Q2VY14; Match level="QueryCoverage=90%, HitCoverage=12%, E-value=2e-08, Identity=46%"; Hit description =CONSTANS interacting protein 5
MGLTEEEFYAKQFEINNDIPEPLMTTCTPAPPPSPCPYRGSMDQEELAFIRKAHKVQARRVMLEEVESFQYWI

SEQ ID NO: 185804 - protein, 127 aa, Glycine max
  Coding DNA Sequence Number=SeqID_69026
  Gene Ontology: Mol. function=protein domain specific binding; Cellular component=nucleus; Biological process=intracellular signaling cascade
  Homolog annotation: Hit_ID=Q96299; Match level="QueryCoverage=87%, HitCoverage=42%, E-value=9e-39, Identity=71%"; Hit description=14-3 -3-like protein GF14 mu
  Pfam annotation: Domain name=14-3-3; Domain location=1-126; Score =11.5; E_value=0.00018; Accession=PF00244.10; Description=14-3-3 protein
MVLNISASHICTTRQGNELNAKQIKEYRQKVELELSNICNDVMRVIDEHLIPLAAAGMLKCSACKKGDYYCYLAEFKSGNEKKEAVDQSMKAYESATTAAEVDLPPTHPIRFGLALNFLVFYYEILP

SEQ ID NO: 185805 - protein, 109 aa, Glycine max
  Coding DNA Sequence Number=SeqID_69027
MGRDKGIPVDIARAADDDDEGHFAVEGNGIEGVGGGKGGDDGVEGGIDKFSVEEIMVFQMTTFQCRDEVEEGGGDEGVMKEGGLGGVGVEQGGEEVRVEREEECMDASF

SEQ ID NO: 185806 - protein, 62 aa, Glycine max
  Coding DNA Sequence Number=SeqID_69028
MEVGDLDKWKVEGWVRLRENGDVVKPTHRQAYCGWGYNEPTSYPHYLHAPQHNIPTSLFHTD

SEQ ID NO: 185807 - protein, 175 aa, Glycine max
  Coding DNA Sequence Number=SeqID_69029
  Gene Ontology: Mol. function=zinc ion binding; Biological process =defense response to fungus
  Homolog annotation: Hit_ID=Q9FJ71; Match level="QueryCoverage=87%, HitCoverage=11%, E-value=4e-16, Identity=37%"; Hit description =Arabidopsis thaliana genomic DNA, chromosome 5, P1 clone:MTE17
MSSGKVGDKKFENISRSNISRKKINKASRCLNENKRSTISKETKKSDGAENRQSLGAKLFALMQNNSEHINSSNEADDVANNTLVVKPTKKLSSTLPALDADSKRLFALFKEATSSVTLENVVKEHIFAATHTHSLKSVMEKTITLGKLEGSVKAVRTTLRILEDEHNIRDAEAV

SEQ ID NO: 185808 - protein, 129 aa, Glycine max
  Coding DNA Sequence Number=SeqID_69030
GTDGQLESDFYGMLSDIIQFEYTGIPLMKLVLFKCDWFDNTPYIGTQADKKYDIVEAPYQDDELVGLQEVLELDPDVINESLADVDGGGEEIDADLLKQLDLVELDEDECMLSENDHDIESDFDDTDTS

SEQ ID NO: 185809 - protein, 105 aa, Glycine max
  Coding DNA Sequence Number=SeqID_69031
MVKVWKPWCVLISVLHLFLHTTSSDFIVKNLPVIDRQSWLLIADHQLSIANRRWSEMLVALVNRQSSIIDHRSSIVDHQCNDHNHRSSVVDPQQLSRSPINGCDC

SEQ ID NO: 185810 - protein, 84 aa, Glycine max
  Coding DNA Sequence Number=SeqID_69032
MTTEWRRKKDDWRHYFKEKMSQKQAHYHRKPWIRALSLLIQDQVQDSPLSVLRCHDTCKALRTCTKCGYMMWQWGVASKCSPPP

SEQ ID NO: 185811 - protein, 67 aa, Glycine max
  Coding DNA Sequence Number=SeqID_69033
MGLNRGWEEAASMFSRAAVELKTSNPALLETAGKSWDKKPNNSNSSIQVVKINNGEIVEKKSTPVEE

SEQ ID NO: 185812 - protein, 102 aa, Glycine max
  Coding DNA Sequence Number=SeqID_69034
IAPARHPVDPEKSNRVLGFLALIMGLCVGRDTTTAKGWPAVGNRRTVATSRAPQLIYKGWSVAYDPWPTSRQPSPKPKISKITMPMTDKSSRVRLKTLKKRY

SEQ ID NO: 185813 - protein, 227 aa, Glycine max
  Coding DNA Sequence Number=SeqID_69035
  Pfam annotation: Domain name=Transposase_24; Domain location=109-227; Score=-21.2; E_value=0.039; Accession=PF03004.5; Description=Plant transposase (PttaEnSpm family)
RESSPTTPVRDASPSAPDDSLTPEYPLDPNCEHIVDQRPFIRAYKGEFQPTYGCSNFISNIIREKFDELAASWLKVSVDLRDRWFGEFKKEYRWHPQEKRAIRAVFETKALDEHWGSTDFLNKSSTAKVNRSVDRGASTYYGGSVSIETHFEKLSKEFQRPPTTWKVMEKTKKLKSGEWVNDKSREFAKKEGTATQDSSNTATSVNDNEIYLNVVGGPNYKGNMYGL

SEQ ID NO: 185814 - protein, 295 aa, Glycine max
  Coding DNA Sequence Number=SeqID_69036
  Gene Ontology: Mol. function=transcription factor activity; Biological process=regulation of transcription, DNA-dependent
  Homolog annotation: Hit_ID=P0C093; Match level="QueryCoverage=66%, HitCoverage=99%, E-value=8e-94, Identity=88%"; Hit description=HTH -type protein slmA
  Pfam annotation: Domain name=TetR_N; Domain location=112-159; Score =39.4; E_value=1.2e-08; Accession=PF00440.13; Description=Bacterial regulatory proteins, tetR family
  Pfam annotation: Domain name=dUTPase; Domain location=1-92; Score =71.2; E_value=3.3e-18; Accession=PF00692.10; Description=dUTPase
  Pfam module annotation: Pfam domain module=TetR_N::dUTPase; Domain location=112-159::1-92
MRDPSLAAVILPRSGLGHKHGIVLGNLVGLIDSDYQGQLMVSVWNRGQDSFTLQPGDRLAQLVFVPVVQAEFNLVEDFDASDRGAGGFGHSGRVLKVMAEKKVAKRNRREEILQALAQMLESGDGSQRITTAKLAANVGVSEAALYRHFPSKTRMFDSLIEFIEDSLITRINLILKDEKETMARLRLIVQLLLGFGERNPGLTRILTGHALMFEQDRLQGRINQLFERIEVQLRQVMKEKKMRDGEGFQTDETLLASQLLAFCEGLLSRYVRSEFRYRPTADFDSRWPLIAAQLV

SEQ ID NO: 185815 - protein, 252 aa, Glycine max
  Coding DNA Sequence Number=SeqID_69037
  Gene Ontology: Mol. function=transferase activity, transferring glycosyl groups; Cellular component=cytosol; Biological process =pyrimidine nucleotide biosynthetic process
  Homolog annotation: Hit_ID=P0A7E3; Match level="QueryCoverage=64%, HitCoverage=76%, E-value=7e-74, Identity=85%"; Hit description =Orotate phosphoribosyltransferase
  Pfam annotation: Domain name=Pribosyltran; Domain location=1-123; Score=99.7; E_value=8.6e-27; Accession=PF00156.17; Description =Phosphoribosyl transferase domain
LLGRFYAQALVDGGVDFDLLFGPAYKGIPIATTTAVALADHHDRDVPYCFNRKEAKDHGEGGLLVGSPLQGKVMLVDDVITAGTAIRESMDIINAHNATLAGVLISLDRQERGRGEISAIQEVERDYQCKVTAIITLSELIDYLAEKPEMADHLAKVKAYRKEMFERRVRIDAHLVAKVKAYRKKMFERRVRINAHLVAKVGAIAKSTAFKVCRGRHEWRPYSRRMPGRRVRIDAHLVAKVGAIAKSTVFKV

SEQ ID NO: 185816 - protein, 42 aa, Glycine max
  Coding DNA Sequence Number=SeqID_69038
ADGALDKARKHKKRQLQDTLNLVIKKRRIVLYLCAVHNYVLS

SEQ ID NO: 185817 - protein, 307 aa, Glycine max
  Coding DNA Sequence Number=SeqID_69039
  Gene Ontology: Mol. function=nucleic acid binding
MDVDGAKGGSHDENEVLGTGVQDTKIEVLETRVETKPEVVGIETELNNDADDDEVKEHDGGTEFSDHSESDPDYVYVSPKDDGQSSDTLADSYQSKEFQSLPNSDDEGDSNSKIMYPQYNPTSSFGQVQLKARMEFDTIKMFIKAIRDFTIFHGRDLKWVKVNNIRARARCKQVGCSWEIYCSWFEVIRSFQIKTFLEEHICVRVFKNKQATMKWVAKKVADKLRFHPNLNHVETHEHHREHYGVHIDERKMFRTIKEARSLVEGLLLAMQEVMLGVKHKYCVMHLWRNFSKQWKGNRLRGIVWKCA

SEQ ID NO: 185818 - protein, 207 aa, Glycine max
  Coding DNA Sequence Number=SeqID_69040
MVAVMVPSPLCFPSSSSSIWILKSGTQMCDEITLILHHNDKFIQNANGALSMSVVNSVSGKKLKHICVEKVVEAVPEDSTENGTEDMDVDGANNVGKETEVVGIETQVNNGADADEVKEHDEDVNFSYHSKSDLDYVYMSLEDDGQSSGTSNDNYHSEEFQSLPNSDDERDTNSKIVYHQCNPRSCFGQVHLKVGMEFNTINMFVEV

SEQ ID NO: 185819 - protein, 121 aa, Glycine max
  Coding DNA Sequence Number=SeqID_69041
MVPLRPTKNNIKKMTYTYKKSDEKRRKMSEQTKKCKPGCAIEKKKMLWRSSSGTQCVKKGSTLGKEAMEVCEKKNKSQRWERNAKRRKRGVMGEREETSRKRGASNQVVTLPLTNPTAKNL

SEQ ID NO: 185820 - protein, 130 aa, Glycine max
  Coding DNA Sequence Number=SeqID_69042
MKGRIRVFVLYRNRKPSWQIPLWLKDSSRCGFSMENNDGLWWLMVAVGDGESSWNFRNGFGRKKEEEMTHLLKDSNGQIMHNCLVKLQTKFGEDPTVNEGWAAFLPRQLHVVFSRSFIKRLPPEASLRGF

SEQ ID NO: 185821 - protein, 165 aa, Glycine max
  Coding DNA Sequence Number=SeqID_69043
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=1e-52, Identity=61%"; Hit description=Chromo
  Pfam annotation: Domain name=RnaseH; Domain location=21-142; Score= -32.4; E_value=0.06; Accession=PF00075.14; Description=RNase H
AFDNLKAAITKAPVLALPDFSKAFTLETDASGIGIRAVLSQEQHPIAFFTKKFTPRMQRQSAYIRESYAITEAVAKFRHYLHGHRFVIKTDQRSLKSLTEQAIQTPEQQKWLHKLLGYDFSIENKLDNENLVADSLSRSFFMAWSEPKLKLIQLLKEAIQADSQL

SEQ ID NO: 185822 - protein, 223 aa, Glycine max
  Coding DNA Sequence Number=SeqID_69044
  Gene Ontology: Mol. function=transporter activity; Cellular component= periplasmic space; Biological process=transport
  Homolog annotation: Hit_ID=Q926H2; Match level="QueryCoverage=84%, HitCoverage=45%, E-value=6e-63, Identity=59%"; Hit description =Putative sugar uptake ABC transporter periplasmic solute-binding protein
  Pfam annotation: Domain name=SBP_bac_1; Domain location=5-207; Score =36.7; E_value=8.2e-08; Accession=PF01547.15; Description=Bacterial extracellular solute-binding protein
MKNQMKGCFAAVLFACAGSAAAATTTLNALFMTQAAYSENDIRAMTQAFQTAHPDVQVNLEFVPYEALHDKIVAARGAGGNGYDVVLFDAIWPAEFSKFDLLQDVSSRISADEKEKIFPGAMNTVVFKGKTLGMPWILDTKYLYYNKAMLEKAGIKDLPQTWQQVLDDARIIKQKNIVKYPLVWSWSQAEALVCDYTTLVSGFGGKFYNNGKLDFSTPASLQR

SEQ ID NO: 185823 - protein, 347 aa, Glycine max
  Coding DNA Sequence Number=SeqID_69045
  Gene Ontology: Mol. function=methyltransferase activity; Biological process=metabolic process
  Homolog annotation: Hit_ID=Q7P120; Match level="QueryCoverage=58%, HitCoverage=94%, E-value=3e-39, Identity=42%"; Hit description =Probable methyltransferase protein
  Pfam annotation: Domain name=Methyltransf_11; Domain location=179 -274; Score=56.4; E_value=9.5e-14; Accession=PF08241.2; Description =Methyltransferase domain
  Pfam annotation: Domain name=Methyltransf_12; Domain location=179 -272; Score=37.0; E_value=6.5e-08; Accession=PF08242.2; Description =Methyltransferase domain
  Pfam module annotation: Pfam domain module=Methyltransf _11::Methyltransf_12; Domain location=179-274::179-272
MSTKQIVDANYRFIAAYQEINVRIAQRQQALAILVTLTVSLLAALVALKPGAGASPLPVECYKAERAITNLRQFLSELEQLENANTCLPSYNTDPRASAHYLADCDCCLGGFSRLVVDSTLELSAELNVRAQMSNIAIASYYSARAQEYDRVYLKPERQADLREIERWLPSVFKGHHLIEMACGTGYWTQFLAPVVRALVGIDASPEALAIANTRVTAPHVQFLIGDAYRPAVRPSHFSAAFAGFWLSHVPREHLGLFLNALHQTLMPGARVVFLDNRYIEGSNTPISEQDACGNTYQIRCLEDGTTHHILKNFLTEHELRSVVESSATQLQFHSWQHFWAVEYVLA

SEQ ID NO: 185824 - protein, 493 aa, Glycine max
  Coding DNA Sequence Number=SeqID_69046
  Gene Ontology: Mol. function=alkanesulfonate monooxygenase activity; Biological process='de novo' pyrimidine base biosynthetic process
  Homolog annotation: Hit_ID=Q1H135; Match level="QueryCoverage=48%, HitCoverage=67%, E-value=3e-82, Identity=59%"; Hit description =Alkanesulfonate monooxygenase
  Pfam annotation: Domain name=Pribosyltran; Domain location=371-489; Score=85.3; E_value=1.9e-22; Accession=PF00156.17; Description =Phosphoribosyl transferase domain
MTASLQRATGGRALYNVITGGGGPQTVVGRPGIWAGGPFSYNGQFYQVEDAGLPDPLSKEEYPEIYFSGSSDAALASASKHADYYLSWLEPLDLIKEKFARVKERTDHLGRKIKCSIRVDIVARPTEEEAWREVSRGFDNIPKEVLDRYKAQNAGDSVGANRQRGLRPQTINSYKDFILSPNIWTGFSLLRGGQTLGIVGSYENVAARLDELVQLGTDAFILASTPHLEEAYRVGEEVLPLSGAVTISGVSHITFVVRDIERAAEIWIEELGAEEGDPGSRSYRHVALQADSADLFEVENRLRLLGVEIAPGRNGLTAIKKGDMTDAVMLSSQYRIEKRMSIPAAIKRTSRLTGDFLLRSGQHSHTYFDKYRFEADPVLLKQIAQAMVPLIPEGTQVLAGLELGGIPIATVLSQLTGIPTAFIRKAAKPYGTCRYAEGAELKDKRFVLIEDVVSSGGAILEAIKLLSDDGLTVDSAICVIDREAGGHAALQSA

SEQ ID NO: 185825 - protein, 275 aa, Glycine max
  Coding DNA Sequence Number=SeqID_69047
  Gene Ontology: Mol. function=catalytic activity; Biological process =cellular metabolic process
  Homolog annotation: Hit_ID=Q6EPQ1; Match level="QueryCoverage=97%, HitCoverage=98%, E-value=1e-124, Identity=72%"; Hit description=DTDP- D-glucose 4,6-dehydratase-like
  Pfam annotation: Domain name=Epimerase; Domain location=16-212; Score= -1.2; E_value=3.9e-06; Accession=PF01370.11; Description=NAD dependent epimerasedehydratase family
  Pfam annotation: Domain name=RmlD_sub_bind; Domain location=15-265; Score=-153.0; E_value=0.00047; Accession=PF04321.7; Description=RmlD substrate binding domain
  Pfam module annotation: Pfam domain module=Epimerase::RmlD_sub_bind; Domain location=16-212::15-265
MGFPANGASAAQPLNFLIYGRTGWIGGLLGSLCRAQGISFHYGSGRLENRASLETDIALLKPSHVFNAAGVTGRPNVDWCESHKVETIRTNVVGTLTLADVCRDHGLILINYATGCIFEYDSDHPLGSGIGFKETDSPNFTGSFYSKTKAMVEDLLKNYDNVCTLRVRMPISSDLLNPRNFITKITRYEKVVDIPNSMTILDELLPISIEMGKRNLTGIWNFTNPGVVSHNEILEMYRDYVDPNFTWNNFTLEEQAKDSLIKYVFEPNQKVKAQV

SEQ ID NO: 185826 - protein, 62 aa, Glycine max
  Coding DNA Sequence Number=SeqID_69048
MFSLTYSHQERREKQKERSKEVKSYFSPLRRKSKHTGEKSSYRERYMSSYGERILNTTTGSK

SEQ ID NO: 185827 - protein, 218 aa, Glycine max
  Coding DNA Sequence Number=SeqID_69049
  Gene Ontology: Mol. function=heat shock protein binding; Cellular component=integral to membrane; Biological process=protein folding
  Homolog annotation: Hit_ID=Q1SQA8; Match level="QueryCoverage=84%, HitCoverage=68%, E-value=7e-16, Identity=31%"; Hit description=Heat shock protein DnaJ, N-terminal
  Pfam annotation: Domain name=DnaJ; Domain location=160-218; Score =38.4; E_value=2.4e-08; Accession=PF00226.21; Description=DnaJ domain
MYLSNVLFGFPLLLFTEPKIFNGLLPIHPAIIKALSWKQGIDRDDPSSSRGTSWFKKQYSDGASGRYRNSNKGSSHRYRRDPSFCEDDFDVETILRSAFGGNRFFYWSFINEENPQWRRSERFSNFEKSWSWRYRNENDYDSSSESDSLDSDLVSDRLALGLSASGSLKLEDVKNAYRVCALKWHPDRHQGSSKAIAEEKFKLCSAAYQSLCDKLALD

SEQ ID NO: 185828 - protein, 253 aa, Glycine max
  Coding DNA Sequence Number=SeqID_69050
  Gene Ontology: Mol. function=transcription regulator activity; Cellular component=nucleus; Biological process=regulation of transcription
  Homolog annotation: Hit_ID=Q9LET0; Match level="QueryCoverage=69%, HitCoverage=74%, E-value=1e-50, Identity=60%"; Hit description =Putative HLH DNA binding protein
  Pfam annotation: Domain name=HLH; Domain location=72-121; Score=46.4; E_value=9.6e-11; Accession=PF00010.16; Description=Helix-loop-helix DNA-binding domain
MMHRQIEMENSELFQFLTNTNDAFFNTASYGLPAAPAASTMQHSFSGSFSYYPLEASHDHHAPSHEDKALAALRNHKEAEKRRRERINSHLDKLRTLLPCNSKTDKASLLAKVVQRVRELKQQISSLSDSEAFPSETDEVSVLSTSGDNDDHGGCDDNDGRLIFKASLCCEDRSDLIPELIEILRSLRLKTLKAEMATLGGRTRNVLVVATDKDHSGESIQFLQNSLKSLVERSSNSNDRSKRRRVLDRKFIA

SEQ ID NO: 185829 - protein, 107 aa, Glycine max
  Coding DNA Sequence Number=SeqID_69051
MGSISNEGFNGFQHQCGSSYTERATGKSLHFAIPTPSSYCSHTATNHIRREDKILCWVVGLKQQLCQLPSGVGSFNCLQPTGLCLRGTKSQKELQDHETMVMMVFNG

SEQ ID NO: 185830 - protein, 137 aa, Glycine max
  Coding DNA Sequence Number=SeqID_69052
  Gene Ontology: Mol. function=manganese ion binding; Cellular component=chloroplast; Biological process=isoprenoid biosynthetic process
  Homolog annotation: Hit_ID=P93740; Match level="QueryCoverage=76%, HitCoverage=39%, E-value=2e-29, Identity=60%"; Hit description=Nudix hydrolase 23, chloroplast precursor
  Pfam annotation: Domain name=NUDIX; Domain location=23-130; Score =59.3; E_value=1.3e-14; Accession=PF00293.18; Description=NUDIX domain
MDLQDDCCATRFSNLCLLEKNCIMIVVGCLIEHDNKVLLCKRSIQPSHGLWTLPAGYLEIGESAVEGAIRETREEANADVEVISPFAQLDIPLIGQVENFDHDYGMFEAELHDILSKAEEAPFFTWLFSLNIMYCLV

SEQ ID NO: 185831 - protein, 83 aa, Glycine max
  Coding DNA Sequence Number=SeqID_69053
MCAIEFRTTYPNFMKLQRYYFEILNGENVRNWVENIVLKFHDDPTVDESEIIIFLRQVWWAAGKRKSFERRRGKMKMRPKRGT

SEQ ID NO: 185832 - protein, 60 aa, Glycine max
  Coding DNA Sequence Number=SeqID_69054
MEKLQHHREKALSGAGDGYRSDDTDGGHKSDNTRESRDNNGERALSDTDGGYKRGDTQER

SEQ ID NO: 185833 - protein, 454 aa, Glycine max
  Coding DNA Sequence Number=SeqID_69055
  Gene Ontology: Mol. function=kinase activity; Biological process =intracellular signaling cascade
  Homolog annotation: Hit_ID=Q9FM39; Match level="QueryCoverage=37%, HitCoverage=70%, E-value=3e-19, Identity=30%"; Hit description =Arabidopsis thaliana genomic DNA, chromosome 5, P1 clone:MNF13
  Pfam annotation: Domain name=C1_2; Domain location=151-180; Score =27.9; E_value=3.5e-05; Accession=PF03107.7; Description=C1 domain
  Pfam annotation: Domain name=C1_2; Domain location=34-63; Score=3.1; E_value=1.3; Accession=PF03107.7; Description=C1 domain
  Pfam annotation: Domain name=C1_2; Domain location=98-125; Score =21.3; E_value=0.0034; Accession=PF03107.7; Description=C1 domain
  Pfam annotation: Domain name=C1_3; Domain location=150-180; Score =32.8; E_value=1.2e-06; Accession=PF07649.3; Description=C1-like domain
  Pfam annotation: Domain name=C1_3; Domain location=33-63; Score=13.5; E_value=0.013; Accession=PF07649.3; Description=C1-like domain
  Pfam annotation: Domain name=C1_3; Domain location=97-125; Score =12.9; E_value=0.016; Accession=PF07649.3; Description=C1-like domain
  Pfam annotation: Domain name=PHD; Domain location=98-158; Score=5.2; E_value=0.017; Accession=PF00628.19; Description=PHD-finger
  Pfam module annotation: Pfam domain module=C1_2::C1_2::C1_2::C1_3::C1_ 3::C1_3::PHD; Domain location=151-180::34-63::98-125::150-180::33 -63::97-125::98-158
MGSLHKDPNVFHFSHPHPLDCTTPPSTENNNIVSCFGCKLKVKHGEDYYQCKTCAFSLHHVCYKMPLITNHPSHPSHDLVLLAIPLSSSSPYTKATLNCVACGNHVTGFCYHCAECSIFFHSLCLALPLSLEITFHPHKIKLEFSPPYDFFCDLCNKPSYNNGWLYRCNMCEFDTHIVCAFENLEPHLFQNPSFPQSSPLLRQLTSYQVEHKRVSASVGDSCKGYEYEIMSLVAQQIGGGIRENSDGAVVGWDKRLYSSPRKKHNKTGSGKMKIISELELQEKELSPAELLLKLEERTPLRDKLTPLSDHSETPFSNQYSDSYFSIDLAKSYSTHHGRRSQVPREVGSDQIIRAVTMPERVIVSNSGQREEPFGLVYWPFNDSYHVGQQNKVNNAAFYIKEGPTTDFGKSTSSQRIVKKNPNQNIAKRSVDQDQTIAKSESLKDKNHSTYSIHI

SEQ ID NO: 185834 - protein, 72 aa, Glycine max
  Coding DNA Sequence Number=SeqID_69056
MSVYVYNSNADCKTSLNLSFCNATTYQFDMVGPQEQLRNSQIYKGLTCLSRLMNAYGDPVYRHEYQKDLYPA

SEQ ID NO: 185835 - protein, 147 aa, Glycine max
  Coding DNA Sequence Number=SeqID_69057
  Gene Ontology: Mol. function=serine-type endopeptidase activity; Biological process=negative regulation of enzyme activity
  Homolog annotation: Hit_ID=Q9LLL8; Match level="QueryCoverage=62%, HitCoverage=13%, E-value=8e-10, Identity=40%"; Hit description=Xylem serine proteinase 1 precursor
  Subcellular localization annotation: CTP_CleavageSite=9; ConfidenceScore=5.04e-01
MVPVLAILVCSLINSRSRCYNYPAMQFGLESNKGIRVRFFRRRVTNVDPAPTIYSATIRSRKGVEITVKPTSLIFSKNLQKMSFKVQSSCDCESHIYCKSPRYPIDPALLPSPETFFYLGLTDEQSKTSKLRKSQPRISHVPPTNTR

SEQ ID NO: 185836 - protein, 567 aa, Glycine max
  Coding DNA Sequence Number=SeqID_69058
  Gene Ontology: Mol. function=zinc ion binding; Cellular component =intracellular; Biological process=intracellular signaling cascade
  Homolog annotation: Hit_ID=Q9FK70; Match level="QueryCoverage=92%, HitCoverage=91%, E-value=5e-66, Identity=31%"; Hit description=CHP -rich zinc finger protein-like
  Pfam annotation: Domain name=C1_1; Domain location=121-171; Score =2.5; E_value=0.013; Accession=PF00130.12; Description=Phorbol estersdiacylglycerol binding
  Pfam annotation: Domain name=C1_1; Domain location=174-223; Score =3.4; E_value=0.01; Accession=PF00130.12; Description=Phorbol estersdiacylglycerol binding
  Pfam annotation: Domain name=C1_1; Domain location=6-58; Score=13.4; E_value=0.0007; Accession=PF00130.12; Description=Phorbol estersdiacylglycerol binding
  Pfam annotation: Domain name=C1_2; Domain location=192-221; Score =20.7; E_value=0.0052; Accession=PF03107.7; Description=C1 domain
  Pfam annotation: Domain name=C1_2; Domain location=27-54; Score=20.4; E_value=0.0065; Accession=PF03107.7; Description=C1 domain
  Pfam annotation: Domain name=C1_2; Domain location=276-305; Score =27.7; E_value=4.1e-05; Accession=PF03107.7; Description=C1 domain
  Pfam annotation: Domain name=C1_2; Domain location=333-360; Score =33.1; E_value=9.4e-07; Accession=PF03107.7; Description=C1 domain
  Pfam annotation: Domain name=C1_2; Domain location=385-412; Score =2.0; E_value=1.7; Accession=PF03107.7; Description=C1 domain
  Pfam annotation: Domain name=C1_2; Domain location=441-470; Score =36.0; E_value=1.3e-07; Accession=PF03107.7; Description=C1 domain
  Pfam annotation: Domain name=C1_2; Domain location=83-110; Score =17.7; E_value=0.032; Accession=PF03107.7; Description=C1 domain
  Pfam annotation: Domain name=C1_3; Domain location=132-161; Score =11.7; E_value=0.022; Accession=PF07649.3; Description=C1-like domain
  Pfam annotation: Domain name=C1_3; Domain location=191-221; Score =27.2; E_value=5.7e-05; Accession=PF07649.3; Description=C1-like domain
  Pfam annotation: Domain name=C1_3; Domain location=26-54; Score=35.4; E_value=1.9e-07; Accession=PF07649.3; Description=C1-like domain
  Pfam annotation: Domain name=C1_3; Domain location=275-305; Score =35.4; E_value=1.9e-07; Accession=PF07649.3; Description=C1-like domain
  Pfam annotation: Domain name=C1_3; Domain location=332-360; Score =15.0; E_value=0.0088; Accession=PF07649.3; Description=C1-like domain
  Pfam annotation: Domain name=C1_3; Domain location=384-412; Score =13.9; E_value=0.012; Accession=PF07649.3; Description=C1-like domain
  Pfam annotation: Domain name=C1_3; Domain location=440-470; Score =23.4; E_value=0.00083; Accession=PF07649.3; Description=C1-like domain
  Pfam annotation: Domain name=C1_3; Domain location=502-532; Score =3.6; E_value=0.19; Accession=PF07649.3; Description=C1-like domain
  Pfam annotation: Domain name=C1_3; Domain location=82-110; Score =14.5; E_value=0.0099; Accession=PF07649.3; Description=C1-like domain
  Pfam annotation: Domain name=PHD; Domain location=133-215; Score= -0.4; E_value=0.063; Accession=PF00628.19; Description=PHD-finger
  Pfam annotation: Domain name=ZZ; Domain location=328-370; Score=6.6; E_value=0.034; Accession=PF00569.8; Description=Zinc finger, ZZ type
  Pfam annotation: Domain name=ZZ; Domain location=78-123; Score=13.1; E_value=0.0051; Accession=PF00569.8; Description=Zinc finger, ZZ type
  Pfam module annotation: Pfam domain module=C1_1::C1_1::C1_1::C1_2::C1_ 2::C1_2::C1_2::C1_2::C1_2::C1_2::C1_3::C1_3::C1_3::C1_3::C1_3::C1 _3::C1_3::C1_3::C1_3::PHD::ZZ::ZZ; Domain location=121-171::174 -223::6-58::192-221::...
  Pfam module annotation: Domain location=27-54::276-305::333-360::385 -412::441-470::83-110::132-161::191-221::26-54::275-305::332-360::384- 412::440-470::502-532::82-110::133-215::328-370::78-123
MEKMEHFSHIHPLLLKQEDSNYNNQVLCSGCEKLISGPVFCCVQCNYVLHKKCAQIARHVKHPFHPQHPLVLLSTTPYEGPYICDSCRGLFINFVYHCYHCNYDLDVSCGSQFNPDDGHKHEFLSVTNPQSFVCYACGMHANEGLACLCTICQIWVHSSCAELPLAIRIKGHDHPLKLTYTLHVYGFWGNLTCGVCNEAMSPAFAGYFCSTCKFAVHLKCPQQYLRGEYEDEESFTGYETEESQDIDFTFSFFGHEHLLKFTEEESDDDVKYFDKLCDACVRPIMPPFFSCEEENCGFFLHQSCAELPRTKQHPFHTHPLTLQSKAPYDGIYKCDGCRRLSNGFVYRCDVCQFDLDVCCGTLEERIEHESHVHPLFLKKTSVSRQCKGCHLWSKLVYVCDVCEDFSVDCGCATLPSKTWHMYDKHPLSLNYFVEGSLREHECGICNEKMSPKQWFYYCDDCDSGAHPSCVVGKSRRVKFGGSFKYDVHSHPLALVEETEQNNECGACGERCNGWTLECGQCKGYFHREGQCFWKEFKKSAKYLELSGMMRHRYAANVLASTPNATTN

SEQ ID NO: 185837 - protein, 95 aa, Glycine max
  Coding DNA Sequence Number=SeqID_69059
MDSAERLIEDLESYIHNHLRNGVSTNSTRDGNVTATDSTPAAFTSHFSRNVDTTADIGLEIQTTDKEAFVFQLQRKFQMIAEEGDQDEGLLCKEM

SEQ ID NO: 185838 - protein, 274 aa, Glycine max
  Coding DNA Sequence Number=SeqID_69060
  Homolog annotation: Hit_ID=P93743; Match level="QueryCoverage=49%, HitCoverage=34%, E-value=5e-23, Identity=47%"; Hit description =Expressed protein
  Pfam annotation: Domain name=WRC; Domain location=136-181; Score =70.6; E_value=4.9e-18; Accession=PF08879.1; Description=WRC
DEVVRREGESGEDSGEKGNHSRKGRSFGSEKTQAELLPPLSPSSTQDGRWYEGEKAIPLKKRRGNFEENNNNNAATHSKKMKAKMKTKMNKKCSTRNKEDSMGEELDEEDEEEKKVEETKAEVNIVSKKRARGSALMEGSRCSRVNGRGWRCCQQTLVGYSLCEHHLGKGRLRSMTSVRSRSIASTAPKEVHVHHLPDPSSSSSSPPPSFCSLDHENQIECVDNAEPFGDEEKKPEIIMTKKRMKLGMVKARSISSLLGQTNTQIAAVAHENSK

SEQ ID NO: 185839 - protein, 89 aa, Glycine max
  Coding DNA Sequence Number=SeqID_69061
  Subcellular localization annotation: CTP_CleavageSite=23; ConfidenceScore=5.16e-01
MTNAKKRNSSKNRRMSLYVTATRYSLVKGERIVRFVAITRLRNFERLEAFFFIPSIVIFLSVHYTMWALIRSIDKHTRLVLVVSFFPHC

SEQ ID NO: 185840 - protein, 211 aa, Glycine max
  Coding DNA Sequence Number=SeqID_69062
  Gene Ontology: Mol. function=cation transporter activity; Cellular component=integral to membrane; Biological process=cation transport
  Homolog annotation: Hit_ID=Q6ICY4; Match level="QueryCoverage=83%, HitCoverage=48%, E-value=4e-76, Identity=72%"; Hit description=Metal tolerance protein C2
  Pfam annotation: Domain name=Cation_efflux; Domain location=5-211; Score=-95.9; E_value=0.00081; Accession=PF01545.11; Description =Cation efflux family
MSKLCTLCACMLVLCALLKLFLLFMSFSLAVEALHAFIQDESEHKHYLIVSAVTNLFVNLVGVWFFRNYARINLAYRNAEDMNHHSVFLHVLADSIRRVQNAEVLCLGLVSVAVFMLVLPLFRATGGILLQMAPPSIPTTALNKCLRQISAREDVMEVSQARFWELVPGYVVGSLIIQVKKGTNDRPILEFVHGLYHDLGVQDLTVQTDDA

SEQ ID NO: 185841 - protein, 105 aa, Glycine max
  Coding DNA Sequence Number=SeqID_69063
  Subcellular localization annotation: CTP_CleavageSite=57; ConfidenceScore=5.25e-01
MRIRKRPVLFPSWLSPLRLSDPHLINRSPVVVQLSDATSTAPKLSSSSAAAVFPHHAASAPSSSLDRCQPSDQPLPSIGKRSNGSDDPSGIGESGAHGQHNKQDP

SEQ ID NO: 185842 - protein, 172 aa, Glycine max
  Coding DNA Sequence Number=SeqID_69064
MVIDNNDDDDNESDTGGVGDVDGGDSNDMVVIAVLVMAVNGGDDNIGGGNDDIGDIVGNGGGSDNNSDINDNGYGNISGDDNNNDNCGDDSNVGGDTKWRRRDGDGSCYDTGGSNNYRSGGGNNNDDSDINGGGSNAGGDNDDDGDGNISNCDDDSDNDNDDDDNKKCHCQM

SEQ ID NO: 185843 - protein, 64 aa, Glycine max
  Coding DNA Sequence Number=SeqID_69065
MTIVRSCVRIGKDVKVVNEPLLRSGEEKSESAIMAKVHKRERQWLDGILPIIDDVNMAKHFLRG

SEQ ID NO: 185844 - protein, 331 aa, Glycine max
  Coding DNA Sequence Number=SeqID_69066
  Gene Ontology: Mol. function=oxidoreductase activity; Cellular component=vacuole; Biological process=response to oxidative stress
  Homolog annotation: Hit_ID=Q9XFL6; Match level="QueryCoverage=99%, HitCoverage=98%, E-value=1e-131, Identity=70%"; Hit description =Peroxidase 5
  Pfam annotation: Domain name=peroxidase; Domain location=43-293; Score=488.4; E_value=8.3e-144; Accession=PF00141.13; Description =Peroxidase
  Subcellular localization annotation: CTP_CleavageSite=47; ConfidenceScore=5.65e-01
MSSFTYSLFTTIFLVLTIFLHPSNAQLSSTFYSSTCPNVSSVVRSVVQQALQSDPRIAASLTRLHFHDCFVNGCDGSILLDVGGNITLSEKNAGPNNNSARGFDVVDNIKTSVENSCPGVVSCADILALAAEASVSLGGGPSWNVQLGRRDGLIANQSGANTSIPNPTESLANVTAKFAAVGLNVTDLVALSGAHTFGRAQCRFFNQRLFNLSGTGSPDPTLNATYLATLQQNCPQNGSGNTLNNLDPSSPDTFDNNYFQNLLSNQGLLQTDQELFSTNGAATISVINNFAANQTAFFQAFAQSMINMGNISPLTGSRGEIRSDCKRVNGS

SEQ ID NO: 185845 - protein, 92 aa, Glycine max
  Coding DNA Sequence Number=SeqID_69067
MQHNLFVSVMDNTYMVHKMQTQMGLLTSNDLAGYCNSAVPSHNHQHKLTLECCFKTIKSLRVNLFSLHALNSHSNTRPPYLTIPLTLTQLQR

SEQ ID NO: 185846 - protein, 87 aa, Glycine max
  Coding DNA Sequence Number=SeqID_69068
MVTGILSKAQVEKDEDRSGKGRSPKWRRMKVQVDKDKGPSGEGRKIQTYQGNPCGIYPDLSSFIGSGVIQISVACIKRSAPSQDHII

SEQ ID NO: 185847 - protein, 292 aa, Glycine max
  Coding DNA Sequence Number=SeqID_69069
  Gene Ontology: Mol. function=sequence-specific DNA binding; Cellular component=nucleus; Biological process=regulation of transcription, DNA-dependent
  Homolog annotation: Hit_ID=P46665; Match level="QueryCoverage=81%, HitCoverage=89%, E-value=5e-54, Identity=47%"; Hit description =Homeobox-leucine zipper protein HAT14
  Pfam annotation: Domain name=HALZ; Domain location=182-226; Score =84.4; E_value=3.5e-22; Accession=PF02183.8; Description=Homeobox associated leucine zipper
  Pfam annotation: Domain name=Homeobox; Domain location=127-181; Score= 61.3; E_value=3.1e-15; Accession=PF00046.19; Description=Homeobox domain
  Pfam module annotation: Pfam domain module=HALZ::Homeobox; Domain location=182-226::127-181
MELALSLGDTPKPFSLPAKNDSVSFKIALGDDKRVSSDPPVQLDLLPSTPVLPSSRLRIPWLSDALGMERVTSEIPVRAVDDTDDGAALSSPNSAVSSFQMDFCFRNSRKSCEGASDEDDENGSTRKKLRLSKQQSVFLEESFKEHTTLNPKQKLALAKQLNLRPRQVEVWFQNRRARTKLKQTEVDCEYLKRCCESLTEENRRLQKELQELRALKTCQPFFMQLPATTLTMCPSCERVATNTTTTGAAAAAATTNNYNNVASAPMATNNNSVSQISAVLSVDRQARNIALT

SEQ ID NO: 185848 - protein, 615 aa, Glycine max
  Coding DNA Sequence Number=SeqID_69070
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q69T67; Match level="QueryCoverage=60%, HitCoverage=43%, E-value=1e-150, Identity=64%"; Hit description =Lustrin A-like
  Pfam annotation: Domain name=DUF231; Domain location=437-601; Score =247.5; E_value=2.8e-71; Accession=PF03005.6; Description=Arabidopsis proteins of unknown function
  Subcellular localization annotation: CTP_CleavageSite=56; ConfidenceScore=5.23e-01
MADATKYVPIGGGNVATDLKSLSFILKTKKTVAAAYAFILAFVAFTVFLAFSPSPNASSPWFTNIFSPASTTDGSYKPQIPNIFSLLFPNSSDPLHNNTNSSRSPYPNTTTESQTLKETSLENRTQTTLVNSTQDAVPVPTTNQTTDSHAPSLEVKFPPPLASKEPPGVVKNQTFNSGEAKPMSTNQTTNATATATNVSVSFPVQNVPNQNTSSNSSVKVDSVKGVVVSNDNYTASLARKQSNGKKDHAKGSDESMESLMKCDFFDGEWVKDDAYPLYKPDSCSLIDEQFNCIRNGRPDKDYQKYKWKPKDCTLPRLDAHRMLQLLRGKRLVFVGDSLNRNMWESLICILRNAVKNKHNVFEANGRVHFRGEAAYSFIFKDYHFSVELFVSPFLVQEGEMTDKNGTKKETLRLDLVGKSSSQYKDADILVFNTGHWWTHDKTSKGQDYYQEGSHVYAELNVLEAFRRALTTWSKWVDANINPSKTMVFFRGYSASHFSGGQWNSGGQCDSETDPIDNEKYLTEYPDKMKVLEKVLKNMKTHVTYQNITRMTDFRKDGHPSIYRKQNLSPEERKSPLRFQDCSHWCLPGVPDLWNEVLYAELLLREYQNQHEQKHR

SEQ ID NO: 185849 - protein, 140 aa, Glycine max
  Coding DNA Sequence Number=SeqID_69071
MESPYQLGWDHELKGDKAAKSGEIEAESGDEHNYTENHKPCNMSKESGNSIPIPHKGQGIAEKLTLEFTFHLWCLMGLHGTSSSQCGVRKLDLQCTEKTQQQTIEISAFGRFYLQLILWHTYLCKYLRKLMAYDMSIMCF

SEQ ID NO: 185850 - protein, 65 aa, Glycine max
  Coding DNA Sequence Number=SeqID_69072
MGPHSDQVFFWVVVSLGGRDILQINHPVGPFGTKFFSAIETSKCDLYIPVSKLKQTCARRFNMRQ

SEQ ID NO: 185851 - protein, 38 aa, Glycine max
  Coding DNA Sequence Number=SeqID_69073
MGRVNLGLKVRMVVMTCGKAWTEQMRKMSDQSESKSHF

SEQ ID NO: 185852 - protein, 57 aa, Glycine max
  Coding DNA Sequence Number=SeqID_69074
MVSKVWSFNGQQWWMRRGEEKQREKVRRASEIFAEFQSLAFLCTRRGPFSKLWISLR

SEQ ID NO: 185853 - protein, 106 aa, Glycine max
  Coding DNA Sequence Number=SeqID_69075
MVGYSPSSFANLVFVGKRIEVGLKRGEFDYPALTNKKPGANREDEKEEGTHAVTVALTWPNFPPAQQCHYSANISPSHYPPSNQPQSLPAAHPIPNSTLNTNQNTN

SEQ ID NO: 185854 - protein, 365 aa, Glycine max
  Coding DNA Sequence Number=SeqID_69076
  Gene Ontology: Mol. function=protein-tyrosine kinase activity; Cellular component=membrane; Biological process=protein amino acid phosphorylation
  Homolog annotation: Hit_ID=Q709M0; Match level="QueryCoverage=99%, HitCoverage=100%, E-value=1e-172, Identity=81%"; Hit description =Protein kinase 2
  Pfam annotation: Domain name=Pkinase; Domain location=72-350; Score =97.5; E_value=3.9e-26; Accession=PF00069.15; Description=Protein kinase domain
  Pfam annotation: Domain name=Pkinase_Tyr; Domain location=72-350; Score=137.5; E_value=3.6e-38; Accession=PF07714.7; Description =Protein tyrosine kinase
  Pfam module annotation: Pfam domain module=Pkinase::Pkinase_Tyr; Domain location=72-350::72-350
MLCCGGAEEESSGPPANQYPTAPPRGGSTYGGGNDRGEPRGNVAKSGAPQKVLPIEIPSMPLDELNRLTGNFGTKAFIGEGSYGRVYYAKLSDGTDAAIKKLDTSSSAEPDSDFAAQLSIVSRLKHDNFVELIGYCLEADNRLLVYQYASLGSLHDVLHGRKGVQGAEPGPVLSWSQRAKIAFGAAKGLEFLHEKVQPSIVHRDVRSSNVLLFNDYEAKIADFSLTNQSSDTAARLHSTRVLGTFGYHAPEYAMTGQITQKSDVYSFGVVLLELLTGRKPVDHTMPKGQQSLVTWATPRLSEDKVKQCVDPKLNNDYPPKAIAKLGAVAALCVQYEADFRPNMTIVVKALQPLLNAKPAGPDSHA

SEQ ID NO: 185855 - protein, 37 aa, Glycine max
  Coding DNA Sequence Number=SeqID_69077
MGGALFKHPGRRILSLLTTLKYAADMELNNIICQETS

SEQ ID NO: 185856 - protein, 842 aa, Glycine max
  Coding DNA Sequence Number=SeqID_69078
  Gene Ontology: Mol. function=structural constituent of cytoskeleton; Cellular component=microtubule organizing center; Biological process= microtubule cytoskeleton organization and biogenesis
  Homolog annotation: Hit_ID=Q9FG37; Match level="QueryCoverage=99%, HitCoverage=99%, E-value=0.0, Identity=68%"; Hit description=Gamma -tubulin interacting protein-like
  Pfam annotation: Domain name=Spc97_Spc98; Domain location=180-676; Score=659.0; E_value=3.8e-195; Accession=PF04130.4; Description =Spc97  Spc98 family
MEEEEDQQKLPDLVKALVHHLLSLNLPPNSPPLNPNSPEFRNSLRYALRILSSRLTPSVAPDAAAIADSIKRRLASHGHSSQALSFADLFSKFASKAQSVDKKWALIYLLKIISEDRHNNTTATTLLPNLNFSEPATSNKPSNNGGVLLVSKDPENRRDIAFLEFVKLVREENEVSEEVLVQDVLYACQGVDGKFVKLDSESKRYVIPVSITVPRAPRSMVYNLCELGVLFRKVSGYISRSMDRFPNEDVGTVGQAFCSALQDELSEYYKLLAVLEAQASNPIPLVSESASSRNYLSLRRLAVWLAEPLVKMRLMADLVEKCRVLRGGAMVGAIHLHAQHGDPLVHEFMRRLLQRVCSSLFEMVRRWVLEGELEDIFAEFFIVGRPVKAESLWREGYRLHDAMLPLFISPSLAQRILRTGKSINFLRVCCEDRGWADAATEVVADHGTMARRGGFGYGETDTLEFLVDEASKRIDKHLLDVIFKRYKFKEHCLAIKQYLLLGQGDFVQYLMDIVGPELSEPANTISSFKLSGLLETAIRASNAQYDDPDILDRLRVKMMPHESGDRGWDVFSLEYDARVPLDTVFTESVMTRYLRIFNFLWKLRRVEHALTGAWKTMKPNCITSNSFTRLQHAVKMQLVSTLRRCQVLWVEINHFISNLQYYIMFEVLEVSWSNFLAEMELAKDLDDLLAAHEKYLHSIVEKSLLGELSQSLYKSLFVIFDLILRFRSCADRLYEGIHELQARITESSISSRDQNKSRSQKQLSEKSAEQGSWIADGRKALTQRAGEFLRNMEQDLDAIAKEYSSLQEGFISQLPVQQHVDLKFLFFRLDFNEFYRRLCPSM

SEQ ID NO: 185857 - protein, 354 aa, Glycine max
  Coding DNA Sequence Number=SeqID_69079
  Gene Ontology: Mol. function=chaperone activator activity; Cellular component=endoplasmic reticulum; Biological process=response to stress
  Homolog annotation: Hit_ID=Q9LHL7; Match level="QueryCoverage=99%, HitCoverage=100%, E-value=1e-141, Identity=66%"; Hit description =Arabidopsis thaliana genomic DNA, chromosome 3, P1 clone: MEC18
  Pfam annotation: Domain name=AHSA1; Domain location=227-285; Score =26.9; E_value=6.9e-05; Accession=PF08327.1; Description=Activator of Hsp90 ATPase homolog 1-l
  Pfam annotation: Domain name=Aha1_N; Domain location=29-165; Score =160.4; E_value=4.8e-45; Accession=PF09229.1; Description=Activator of Hsp90 ATPase, N-terminal
  Pfam module annotation: Pfam domain module=AHSA1::Aha1_N; Domain location=227-285::29-165
MARYGEGDKRWIVEDRPDGTNVHNWHWSETNCLDWSKTFFSNLLSNLPILHGEANLFLKTTSLRSLDGEAYVNVRKGKIIPGYEISLTLNWQGEAKDSQGTSLLKVDGTVEIPYISDENADEDPEVRVTVNDEGPVGMRIKDAMLSKGKPLILEKVRVWVQSMAKGGPVKDELEPKKVAPSLSPSPPTTTTTTTTTTTATKKEEKKEKEKEKEKKGRKSIGMTERFNCRAKDLYEILMDENRWKGFTQSNARISKEVGGEFSIFDGSVTGTNLELQEAKLIVQRWRFGSWNDGVQSTVRLVFEEPEAGVTVVKLTHTDVPEEDRYGNATVVENTERGWRDLIFQRIRAVFGFGI

SEQ ID NO: 185858 - protein, 46 aa, Glycine max
  Coding DNA Sequence Number=SeqID_69080
MPGLAQRNEHLTNGSSTPTCSLSANGFWSKNSDDVSYNQLQKVLDL

SEQ ID NO: 185859 - protein, 193 aa, Glycine max
  Coding DNA Sequence Number=SeqID_69081
  Homolog annotation: Hit_ID=Q33BI2; Match level="QueryCoverage=93%, HitCoverage=13%, E-value=7e-42, Identity=50%"; Hit description =Expressed protein
MYCSRCNGLLLEGFLQIAMYGKSLQQEGLDAHFPCNRSGGLRKLNNDRSSIINGCQDEIQDPSIHPWGGLTTARDGSLTLMSCYLYSKSLKGLQIVFDEARARERERELLYPDACGGGGRGWISQGIVSYGRGHGTRETCALHTARLSCDTLVDFWSALGDEMRLSLLRMKEEDFIERLMYRCLSIFSFLTLS

SEQ ID NO: 185860 - protein, 1066 aa, Glycine max
  Coding DNA Sequence Number=SeqID_69082
  Homolog annotation: Hit_ID=Q33BI2; Match level="QueryCoverage=23%, HitCoverage=21%, E-value=8e-81, Identity=62%"; Hit description =Expressed protein
MPIRFDSKRFCRDCRRNVIREYKELKELKRIRREPRCTSWFCVADSAFQYEVSDDSVQADWRQTFADAAGTYHHFEWAVGTTEGKSDILEFENVGLNGCVRASGLDLGGLSACFVTLRAWRLDGRCTELSVKAHSLIVGDGYVTITKGESIRRFFEHAEEAEEEEDDDSVDKDGNELDGECSRPQKHAKSPELAREFLLDAATVIFKEQACLALVEKAFREGTARQNAHSIFVCLALKLLEDRVHVACKEIITLEKQMKLLEEEEKEKREEEERKERRRTKEREKKLRRKERLKGKEKEKKCSESNDALGSPEISKEELSAVADMEQNNPISCRSLVIEANETNLLGDDSPNIEDEEFSSECNTLKPHDLSHDDCGEEISNTKDEMGQSTIEQSMLSHRRLRCRKEFQLDMPMKWSDRRRYAVVSENSVMVGRSEPRHYGESFVISSRVMNGLSRQSRINVPTKSNCRNVGPPKYNEKFYSSKNRTNDRCDIHSCSCSLNSEYKTRVEQHSPMTRVSRETKPISQSESAGDTSKQFCRGNKNNQVDYMHESNGRAKSKIISGNYPSRDLFQSKKVWEPTESQKKYLRSNSDSDVILRATKVQGAQSDLIKLSIGEAVDSGENDDEECNSKRFSGVDERCQDDFHVEAKGSCSSTEIALEESGICPTGGFALNNSSDSTQSSTFSSDNCSSCLSEGDNNTTSSSHENTESSITSDSEDASRQSELRNNLDCVETVLSHCHDVSIVNSQNANGEGLTRNPSSLISSSLDGTRNYALGNPIVETAQNFDNCFSTTNVCSQSQSMLPPVSNQNIHFPVFQAPSAMGYFHQNPVSWPAAPTNGLIPFPHSNPYLYAGPLGYGLNEDHRFCLQYGALQQPTSLFNPGVPVYQPVASANVLNAEERTRVSKTASLPEHLNGSFAERVFPAGPISKKPASHGEVRHDNSAKSLENNNDFSLFHFGGPVALSTGCKSAFTSLNGDTVGDFSSKSSADHVEKVHNCNKKETPAMEEYNLFATSNNLRLIGSGINTFQNDPSLVRPYLLYSTFFGAFAFLRRKFRNILKVIFVRIEV

SEQ ID NO: 185861 - protein, 127 aa, Glycine max
  Coding DNA Sequence Number=SeqID_69083
MAEIEEVQEQMKADIEALKDQMASIVEAMLSRKRMMESNTVPVVATSVATEADPTHPSAINQANQPISDMVDQGGEVLGSIGGPHIGHNKNAYPYSLPPNYTPPNVVPMPNENANRAVPVPFEGQQP

SEQ ID NO: 185862 - protein, 109 aa, Glycine max
  Coding DNA Sequence Number=SeqID_69084
MEMQRKTKEKRTGCSGMPQPNIVGASQHRPLQPLRFSVGRLPPSVEGREKWELIEERLMAIEGFGDYPFTDMAKLYLMLDVVIPPKFKVPDFDKYKGTTCPKNHLKIYC

SEQ ID NO: 185863 - protein, 471 aa, Glycine max
  Coding DNA Sequence Number=SeqID_69085
  Gene Ontology: Mol. function=oxidoreductase activity; Cellular component=cellulose and pectin-containing cell wall; Biological process=lignin catabolic process
  Homolog annotation: Hit_ID=Q655H5; Match level="QueryCoverage=95%, HitCoverage=83%, E-value=0.0, Identity=72%"; Hit description =Putative PS60
  Pfam annotation: Domain name=Cu-oxidase; Domain location=158-296; Score=219.5; E_value=7.6e-63; Accession=PF00394.12; Description =Multicopper oxidase
  Pfam annotation: Domain name=Cu-oxidase_2; Domain location=376-471; Score=22.0; E_value=4e-06; Accession=PF07731.4; Description =Multicopper oxidase
  Pfam annotation: Domain name=Cu-oxidase_3; Domain location=32-148; Score=189.5; E_value=8.2e-54; Accession=PF07732.5; Description =Multicopper oxidase
  Pfam module annotation: Pfam domain module=Cu-oxidase::Cu-oxidase _2::Cu-oxidase_3; Domain location=158-296::376-471::32-148
MSYSRILNSLLLVVLLVTCASGEDPYRFYTWNVTYGDIYPLGMKQQGILINGQFPGPQIESVTNDNLILHVFNSLDEPFLISWNGVQQRRNSWQDGVYGTNCPIPPGKNFTYVLQVKDQIGSYFYFPSLAFHKAAGGYGGFKIASRSVIPVPFPPPAGDFTILAGDWYKRNHTDLRAILDGGSDLPFPDGLIINGRGSNAYAFTVDQGKTYRFRISNVGLTTSINFRIQGHKMLLVEVEGIHTLQNTYDSLDIHLGQSYSVLVTADQPPQDYYIVVSTRFTSQVLTATSILHYSNSPTSVSSPPPGGPTTQIDWSLDQARSLRRNLTASGPRPNPQGSYHYGLINTTRTVRLQNSAGIINGKQRYAVNSVSFIPADTPLKLADYFKIPGVFNLGSIPENPTGSDCYLQTSVMAADFRGYAEIVFENPEDTVQSWHVDGHHFYVVGMDGGQWSTSSRSNYNLRDTISRCTVQ

SEQ ID NO: 185864 - protein, 78 aa, Glycine max
  Coding DNA Sequence Number=SeqID_69086
QNPRILSDVAGSYNAVNVSVFGAIEHGPVLLDDFWDGNEGRALGEGNGGVEAVEDGLVFGLKKGAELACWRGSEDEGT

SEQ ID NO: 185865 - protein, 98 aa, Glycine max
  Coding DNA Sequence Number=SeqID_69087
  Gene Ontology: Mol. function=cation transporter activity; Cellular component=membrane; Biological process=cation transport
  Homolog annotation: Hit_ID=Q84ND6; Match level="QueryCoverage=57%, HitCoverage=13%, E-value=6e-11, Identity=59%"; Hit description =Cation diffusion facilitator 8
MAGHYIPLVVLLVPMRLTPVFDMMFFRKIYLQKMLREKEYYERQFATLRSFEEVDSTESSNVIEDGSVDAEQVQSERAMKISNWANVFLLAFKSLIRN

SEQ ID NO: 185866 - protein, 61 aa, Glycine max
  Coding DNA Sequence Number=SeqID_69088
  Subcellular localization annotation: CTP_CleavageSite=17; ConfidenceScore=5.18e-01
MAMLSTFMLCSFPKNSRQMRRAYTKLFYCCNVPQYSSRYASSLNLKELSFFGSYYLTSARY

SEQ ID NO: 185867 - protein, 257 aa, Glycine max
  Coding DNA Sequence Number=SeqID_69089
  Gene Ontology: Mol. function=cation transporter activity; Cellular component=membrane; Biological process=cation transport
  Homolog annotation: Hit_ID=Q84ND6; Match level="QueryCoverage=71%, HitCoverage=44%, E-value=3e-71, Identity=71%"; Hit description =Cation diffusion facilitator 8
  Pfam annotation: Domain name=Cation_efflux; Domain location=14-243; Score=13.7; E_value=1.6e-09; Accession=PF01545.11; Description =Cation efflux family
MEKRSQLHHIFKKLTIIERENSLAIFKKLEMNPKKLFQTVFLQALALGCLISTSLFVETLSVQDFCSTLTKNHTLLVFATVKSGSIAIAASTLDSLLDLMAGEDHYFDVITNIVGLVAAVLGDKFSWWIDPIGAILLALYTISNWSKTVLENVVSLVGQSAPPEVLQKLTYLVLRYHPQITRIDTVRAYTCGVLYFVEVDIELPEDLPLKEAHAIGESLQIRIEELPEVERAFVHLDTECEHKPEHSVLSTLPSSQI

SEQ ID NO: 185868 - protein, 37 aa, Glycine max
  Coding DNA Sequence Number=SeqID_69090
MNRGTWGRARMDARPMINRSLSHVQLRTIEKRYWEAA

SEQ ID NO: 185869 - protein, 107 aa, Glycine max
  Coding DNA Sequence Number=SeqID_69091
MWLCFGNRQCPESPICDGIMVARLRVEAHSARFHYSAGFPSKLASVSIFLPPSKTENPPFSVAAGDPFASYKDGNTRVGLLRAYQTYMLVTKWHQQGGALDWIHRMV

SEQ ID NO: 185870 - protein, 83 aa, Glycine max
  Coding DNA Sequence Number=SeqID_69092
MAVISICGSKSKMILRGINYSAAGSGVRHMEQYPRGTVDVLSQMKARAPASMLVPRENPPIETLAEWAASLRFENGMWIEPEA

SEQ ID NO: 185871 - protein, 90 aa, Glycine max
  Coding DNA Sequence Number=SeqID_69093
MEVAITRLPPETLLAEELSAVKKKLERIRADDERTKKILNEKHALLDAWMKELKYHCMRVSPMRTLREKEQGKIVNEAPSQSESIEESEN

SEQ ID NO: 185872 - protein, 212 aa, Glycine max
  Coding DNA Sequence Number=SeqID_69094
  Gene Ontology: Mol. function=transferase activity; Cellular component= integral to membrane; Biological process=lipopolysaccharide biosynthetic process
  Homolog annotation: Hit_ID=Q11QS4; Match level="QueryCoverage=88%, HitCoverage=60%, E-value=4e-40, Identity=45%"; Hit description=B -glycosyltransferase, glycosyltransferase family 2 protein
  Pfam annotation: Domain name=Glycos_transf_2; Domain location=25-188; Score=69.8; E_value=8.7e-18; Accession=PF00535.16; Description =Glycosyl transferase
MGEYAMRAEAGNQNPPDSGPTPDVSVVVPVYGCEGCLEQLSERVAGAISGMGLTHELILVDDQGPDQSWQRICELGKLSSRVRGLRLSRNFGQHAAISAGLQYAQGSRVIVMDCDLQDVPEEIPSLLAGLEGDNEIVLGQRVERQDTWLKRSGSSAFYKALGWLTDTDYDPSTANFGAYSRKAVDAMNAMPETDRFLPLMARWTGFKTLRVP

SEQ ID NO: 185873 - protein, 99 aa, Glycine max
  Coding DNA Sequence Number=SeqID_69095
MKNVVQDAYSQYMVEYAFIDDGNMHSSLTLGLVNMYSSVTITTKAITMTMHIIRNDFIMSMPGDFFLGYSMPCKKNFSYFVSNSLRHMLSYMAINSMTG

SEQ ID NO: 185874 - protein, 130 aa, Glycine max
  Coding DNA Sequence Number=SeqID_69096
MIKWENVKIPHSKAHIVIVNLKDEDHDLSKNSSQRLSSNDDTKDEVEDTELEDSEDSLPTTESPRIVLRRISTFPSGMGPTLRPTVGVEEAMTSIKVVLRIHESEEEKNPEMMEEAPKEALGNDLPKGSI

SEQ ID NO: 185875 - protein, 134 aa, Glycine max
  Coding DNA Sequence Number=SeqID_69097
  Gene Ontology: Mol. function=oxidoreductase activity; Cellular component=integral to membrane; Biological process=electron transport
  Homolog annotation: Hit_ID=Q75LK7; Match level="QueryCoverage=100%, HitCoverage=27%, E-value=4e-51, Identity=69%"; Hit description =Putative cytochrome P450
MTGREASKILLTGKDGIVSLNLFYTGQQVLGPTTLLQTTGEAHKRLRRLIGEPLSIDGLKKYFHFINTQAMETLGQWQGRKVLFTLKVIGHMIMSLEPSGEEQEKFRSNFKIISSSFASLPFKLPGTAFHHGIK

SEQ ID NO: 185876 - protein, 1508 aa, Glycine max
  Coding DNA Sequence Number=SeqID_69098
  Gene Ontology: Mol. function=RNA-directed DNA polymerase activity; Cellular component=chromatin; Biological process=chromatin assembly or disassembly
  Pfam annotation: Domain name=Chromo; Domain location=1410-1457; Score= 28.2; E_value=2.9e-05; Accession=PF00385.14; Description='chromo' (CHRromatin Organisation MOdifier
  Pfam annotation: Domain name=RnaseH; Domain location=890-1011; Score=- 22.0; E_value=0.0064; Accession=PF00075.14; Description=RNase H
  Pfam annotation: Domain name=rve; Domain location=1146-1292; Score =45.1; E_value=2.5e-10; Accession=PF00665.16; Description=Integrase core domain
  Pfam annotation: Domain name=zf-CCHC; Domain location=371-388; Score =7.0; E_value=0.07; Accession=PF00098.13; Description=Zinc knuckle
  Pfam annotation: Domain name=zf-H2C2; Domain location=1091-1128; Score=19.1; E_value=0.001; Accession=PF09337.1; Description=His(2) -Cys(2) zinc finger
  Pfam module annotation: Pfam domain module=Chromo::RVT_1::Retrotrans _gag::RnaseH::rve::zf-CCHC::zf-H2C2; Domain location=1410-1457::653 -822::166-256::890-1011::1146-1292::371-388::1091-1128
MTNTDEWITTGTIPTDSNRATPEEDTEEATDINTGEAPGPRSQQPEHEYRTNLVLSLLFTMVDPEPASFSSDKLEDVLSRLTKQQLYLGESVNAMTLKIDELIQRVSPVFSTTPPTPPPLPPPAPTPIHRLKLDVPRFDGSDPLGWIYKITQFFEYHGTPDSDKLTIASFYMEGRALAWFQWMNTSEQFPSWPAFLHALRTRFAPSQFEDPSGALSKLTQTGTVTQYLSDFEDLANRTTGLPSTFLLSCFISGLIPEIRREVQAHQPATLVQAAGLARLQEEKFSEMRQHPRPRPSPLPQFQRSPSVFPSFPQVNPTAPVSSPPLSPILKTPSPPLSSTLPPLLPPPPPRPPPQTWKRLSPEEIASRRERGLCFNCEEKFHRGHRCSSRFFLLITDEEDPPLSHIPNFDPPITLTHDPVPIQPTDPPESPLSYSAQISLNSLAGHVAPETIRFIGAISGHPLLLLVDGGSTHNFVQQQLVTQLGLSCRTTSPLRVMVGNGQYLECHSICDAISVQIQNHSFTVDLHVLPISGANVGDPEASLSSMTSSQFCRLCRTQPQGLYFQITVLSDDTPPSSPDTLPPSLQALLTKYDVLFQPSPTLPPPRPTDHHIHLLPLSTPVNVRPYRYPHFQKQEIELQVDSMLQKGLIQPSTSPFSSPVLLVKKHDGSWRFCVDYRALNSLTVKDRFPIPTIDELLDELGGAQCFSKLDLLQGYHQIRMHSEDIPKTAFRTHHGHYEFRVMPFGLCNAPSSFQATMNLIFRPFLRRFVIVFFDDILIYSSSFDDHLHHLDLTFQVEYLGHLVSQRGVEPMPDKIVAIVNWPQPHSTRAVRSFLGLAGFYRRFIRGYAMIADPLVKATSDPFRWTPQAQQAFEDLKSALSTTPVLALPDFQEPFTVETDASGNGMGAVLSQRGHPIAYFSKPFPKKLLRASTYVRELFAITSAVKKWRQYLLGHSFTIVTDHRSLKELLTQVIQTPEQHMYLARLMGFDYQIQYRSGKHNQAADALSRSPEFTPSLSLLLSIPCLSFLDELRQQLTNNSQYCQHRQDIINSPTTYPDYTLSQNFILYKGKIWLPRELPLIQTLMLEYHATPMGGHMGVAKTIARLSENFTWPGLRSDVATFVANCSDCQFTKYETKRTAGLLCPLPVPFRPWEDLSLDFITGLPSYQGKTVLLVVVDRFSKGIHLGTLPTAHTAHMVASLFIDIVVKLHGQPRSLVSDRDPLFLSTFWQELFKLSGTRLRMSSAYHPQSDGTGSTPYEITFGRKPFSFPDYITGSSKLDAVDDTLKHREEVFLCIRQKLLKAQATMKRTADTKRREVDYEVGNWVLLKLRPYRQRSAKDAQHSSGKLAKRFYGPFKILERIGKVAYCLELPEGTRIHPIFHCSLLKPFHGDPAISQTPSLPDQFFNNQPIISPLAILDTRRAATTEGPWEVLVQWKGLLPDDTSWEDWDQLKRTYHLEDKVILQGPREDDSNRATPEEDTEEATDINTGVPTAKPKRKITRPAYLRDYA

SEQ ID NO: 185877 - protein, 231 aa, Glycine max
  Coding DNA Sequence Number=SeqID_69099
  Gene Ontology: Mol. function=oxidoreductase activity; Cellular component=integral to membrane; Biological process=electron transport
  Homolog annotation: Hit_ID=Q75LK7; Match level="QueryCoverage=54%, HitCoverage=23%, E-value=2e-45, Identity=71%"; Hit description =Putative cytochrome P450
EEHRQIVINRKSGTDLTWAEVNNMPYTAKVSNNNFSLQVISETLRRATILPWFSRKASQDFEIDGYKIKKGWSVNLNVVSIHHDPEVFPDPEKFDPSRFDETLRPFSFLGFGSGPRMCPGMNLAKLEICVFIHHLVNRYNWRPLEKDNSVQPTLVRMPKNKYPIIVEALGHDSSRNYKQTTEEKIAQKNVVYEQNHLCKWYGTRARVAGFEGQGPPKKKKRDKGSHEGISA

SEQ ID NO: 185878 - protein, 1103 aa, Glycine max
  Coding DNA Sequence Number=SeqID_69100
  Gene Ontology: Mol. function=protein binding; Cellular component =integral to membrane; Biological process=protein amino acid phosphorylation
  Homolog annotation: Hit_ID=Q9ZTJ6; Match level="QueryCoverage=94%, HitCoverage=94%, E-value=1e-152, Identity=37%"; Hit description=Hcr2- 5D
  Pfam annotation: Domain name=LRRNT_2; Domain location=27-79; Score =29.1; E_value=1.6e-05; Accession=PF08263.3; Description=Leucine rich repeat N-terminal domain
  Pfam annotation: Domain name=LRR_1; Domain location=110-133; Score =4.9; E_value=35; Accession=PF00560.23; Description=Leucine Rich Repeat
  Pfam annotation: Domain name=LRR_1; Domain location=135-157; Score =7.8; E_value=9.8; Accession=PF00560.23; Description=Leucine Rich Repeat
  Pfam annotation: Domain name=LRR_1; Domain location=159-175; Score =3.0; E_value=79; Accession=PF00560.23; Description=Leucine Rich Repeat
  Pfam annotation: Domain name=LRR_1; Domain location=186-208; Score =0.7; E_value=2.1e+02; Accession=PF00560.23; Description=Leucine Rich Repeat
  Pfam annotation: Domain name=LRR_1; Domain location=210-233; Score =5.4; E_value=27; Accession=PF00560.23; Description=Leucine Rich Repeat
  Pfam annotation: Domain name=LRR_1; Domain location=234-258; Score =10.8; E_value=2.7; Accession=PF00560.23; Description=Leucine Rich Repeat
  Pfam annotation: Domain name=LRR_1; Domain location=259-281; Score =19.0; E_value=0.017; Accession=PF00560.23; Description=Leucine Rich Repeat
  Pfam annotation: Domain name=LRR_1; Domain location=283-305; Score =22.0; E_value=0.0022; Accession=PF00560.23; Description=Leucine Rich Repeat
  Pfam annotation: Domain name=LRR_1; Domain location=307-331; Score =17.2; E_value=0.059; Accession=PF00560.23; Description=Leucine Rich Repeat
  Pfam annotation: Domain name=LRR_1; Domain location=333-354; Score =22.8; E_value=0.0012; Accession=PF00560.23; Description=Leucine Rich Repeat
  Pfam annotation: Domain name=LRR_1; Domain location=356-378; Score =21.5; E_value=0.003; Accession=PF00560.23; Description=Leucine Rich Repeat
  Pfam annotation: Domain name=LRR_1; Domain location=380-402; Score =23.2; E_value=0.00095; Accession=PF00560.23; Description=Leucine Rich Repeat
  Pfam annotation: Domain name=LRR_1; Domain location=404-426; Score =18.7; E_value=0.021; Accession=PF00560.23; Description=Leucine Rich Repeat
  Pfam annotation: Domain name=LRR_1; Domain location=428-450; Score =12.9; E_value=1.1; Accession=PF00560.23; Description=Leucine Rich Repeat
  Pfam annotation: Domain name=LRR_1; Domain location=452-474; Score =14.8; E_value=0.31; Accession=PF00560.23; Description=Leucine Rich Repeat
  Pfam annotation: Domain name=LRR_1; Domain location=476-498; Score =16.2; E_value=0.12; Accession=PF00560.23; Description=Leucine Rich Repeat
  Pfam annotation: Domain name=LRR_1; Domain location=500-522; Score =14.0; E_value=0.57; Accession=PF00560.23; Description=Leucine Rich Repeat
  Pfam annotation: Domain name=LRR_1; Domain location=524-545; Score =13.3; E_value=0.9; Accession=PF00560.23; Description=Leucine Rich Repeat
  Pfam annotation: Domain name=LRR_1; Domain location=546-568; Score =17.0; E_value=0.067; Accession=PF00560.23; Description=Leucine Rich Repeat
  Pfam annotation: Domain name=LRR_1; Domain location=570-593; Score =12.1; E_value=1.5; Accession=PF00560.23; Description=Leucine Rich Repeat
  Pfam annotation: Domain name=LRR_1; Domain location=595-618; Score =3.2; E_value=70; Accession=PF00560.23; Description=Leucine Rich Repeat
  Pfam annotation: Domain name=LRR_1; Domain location=621-641; Score =3.0; E_value=78; Accession=PF00560.23; Description=Leucine Rich Repeat
  Pfam annotation: Domain name=LRR_1; Domain location=644-666; Score =7.3; E_value=12; Accession=PF00560.23; Description=Leucine Rich Repeat
  Pfam annotation: Domain name=LRR_1; Domain location=667-686; Score =7.9; E_value=9.6; Accession=PF00560.23; Description=Leucine Rich Repeat
  Pfam annotation: Domain name=LRR_1; Domain location=690-712; Score =9.2; E_value=5.5; Accession=PF00560.23; Description=Leucine Rich Repeat
  Pfam annotation: Domain name=LRR_1; Domain location=714-733; Score =13.1; E_value=1; Accession=PF00560.23; Description=Leucine Rich Repeat
  Pfam annotation: Domain name=LRR_1; Domain location=738-761; Score =8.4; E_value=7.7; Accession=PF00560.23; Description=Leucine Rich Repeat
  Pfam annotation: Domain name=LRR_1; Domain location=762-785; Score =14.1; E_value=0.51; Accession=PF00560.23; Description=Leucine Rich Repeat
  Pfam annotation: Domain name=LRR_1; Domain location=787-809; Score =15.8; E_value=0.16; Accession=PF00560.23; Description=Leucine Rich Repeat
  Pfam annotation: Domain name=LRR_1; Domain location=837-860; Score =10.7; E_value=2.9; Accession=PF00560.23; Description=Leucine Rich Repeat
  Pfam annotation: Domain name=LRR_1; Domain location=84-103; Score =5.1; E_value=31; Accession=PF00560.23; Description=Leucine Rich Repeat
  Pfam annotation: Domain name=LRR_1; Domain location=905-927; Score =8.2; E_value=8.5; Accession=PF00560.23; Description=Leucine Rich Repeat
  Pfam annotation: Domain name=LRR_1; Domain location=929-951; Score =13.1; E_value=1; Accession=PF00560.23; Description=Leucine Rich Repeat
  Pfam annotation: Domain name=LRR_1; Domain location=953-975; Score =20.4; E_value=0.0065; Accession=PF00560.23; Description=Leucine Rich Repeat
  Pfam annotation: Domain name=LRR_1; Domain location=977-998; Score =12.8; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =27-79::110-133::135-157::159-175::186-208::210-233::234-258::259 -281::283-305::...
  Pfam module annotation: Domain location=307-331::333-354::356 -378::380-402::404-426::428-450::452-474::476-498::500-522::524 -545::546-568::570-593::595-618::621-641::644-666::667-686::690 -712::714-733::738-761::762-785::...
  Pfam module annotation: Domain location=787-809::837-860::84-103::905- 927::929-951::953-975::977-998
MESWMWCFLLCSHLLILYFSPSHSLCHPHDTSALLHFKNSFIIYEDPYYDACDTAGYFSKTRTWENGTDCCSWAGVTCHPISGHVTDLDLSCSGLVGNIHPNSTLFHLSHLHSLNLALNDFDESHLSSLFGGFVSLTHLNLSGTYSEGDIPSQISHLSKLVSLDLSYNGLKWKEHTWKRLLQNATVLRVLLLDENDMSSISIRTLNMSSSLVTLSLRENGLRGNLTDGSLCLPNLQHLDLSYNRALKGQLPEVSCRTTSLDFLDISNCGFQGSIPPSFSNLIHLTSLDLSDNNLNGSIPPSFFNLTHLTSLDLSDNNLNLNGSIPPSFSNLIHLTSLDLSGNNLGSIPPSFFNLTHLTSLDLSFNNLNGSIPPSFSNLIHLTSLDLSGNHLNGSIPPSFSNLIHLTSLDLSYNNLNGSIPSSLLTLPRLNFLYLYDNQLSGQIPDAFPQSNSFHELHLSDNKIEGELPSTLSNLQHLIHLDLSYNKLEGPLPNNITGFSNLTSLWLNGNLLNGTIPSWCLSLPSLKQLDLSGNQLSGHISAISSYSLETLFLSHNKLQGNIPESIFSLVNLIFLGLSSNNLSGSVKFHRFSKLQYLEELHLSWNDQLSLNFESNVNYNFSNLMLLNLSSMVLTEFPKLSGKVPILESLYLSNNKLKGRVPHWLHEISLSELDLSHNLLTQSLHQFSWNQQLGYLDLSFNSITGDFSSSICNASAIQILNLSHNKLTGTIPQCLANSLSLQVLDLQLNKLHGTLPSIFSKDCRLRTLDLNGNQLLEGLLPESLSNCIHLEVLDLGNNQIKDVFPHWLQTLPELKVLVLRANKLYGPIVGLKIKHGFPRLVIFDVSFNNFSGPIPKAYIQKFEAMKNVVIDTDLQYMEISIGAKMYSDSVTITTKAITMTMDKIPKGFVSIDLSKNGFEGEIPNAIGELHALRGLNLSHNRIIGPIPQSMGNLTNLESLDLSSNMLTGGIPTELSNLNFLEVLNLSNNHLAGEIPRGQQFSTFTNDSYEGNSGLCGLPLTIKCSKDPEQHSPPSTTLRREGGFGFGWKPVAIGYGCGMVFGVGMGCCVLLIGKPQWLVRMVGGKPNKKVKRKTRMRSNENGSRMN

SEQ ID NO: 185879 - protein, 272 aa, Glycine max
  Coding DNA Sequence Number=SeqID_69101
MDKENAFNFPDNESTGSNGDNDVTTPFTECQICSNPIPPNPNEQTSSKHSLQGLIPPPRSLSINANNSLAGVIPSPPQPNAYRTYAEVVRSLPPPRTNRTTPAVSIGSQDPIHAALWMNDNAAGSSGTAAAAAFPISPQPAALGSFDFDKAARSGESLYHIFHPYLRQMDPQPPARTVDLLSRLGAVRSEPPHSRQMDEQPLRTVDFLSNVNNQPWGTVDYLAQMEAASSAPAAQVPRENPPIETIVQWASSLRVGDGRRRKVDLNLKLKMV

SEQ ID NO: 185880 - protein, 66 aa, Glycine max
  Coding DNA Sequence Number=SeqID_69102
MKNVVIYANPQYMETSVIVSDTNNIDHETNYADSVTAYWSYSPIHVKFDKFRIIGSLLKYAHWRDT

SEQ ID NO: 185881 - protein, 174 aa, Glycine max
  Coding DNA Sequence Number=SeqID_69103
  Gene Ontology: Mol. function=protein binding; Cellular component =integral to membrane; Biological process=protein amino acid phosphorylation
  Homolog annotation: Hit_ID=Q2QVT4; Match level="QueryCoverage=65%, HitCoverage=10%, E-value=2e-26, Identity=57%"; Hit description =Leucine Rich Repeat family protein
  Pfam annotation: Domain name=LRR_1; Domain location=51-73; Score =11.4; E_value=2.1; Accession=PF00560.23; Description=Leucine Rich Repeat
  Pfam annotation: Domain name=LRR_1; Domain location=75-97; Score =19.9; E_value=0.0091; Accession=PF00560.23; Description=Leucine Rich Repeat
  Pfam module annotation: Pfam domain module=LRR_1::LRR_1; Domain location=51-73::75-97
MKNVVIYANPQYMETSVMVSDTNNTDHETNYADSVTICRRDIPNAIGELHSLRGLNLSHNRFIGPILQSIGNLTKLESLDLSSNMLTGGIPRELSNLNFLEVQNLSNNHLAFVGEIPQGKQFSTFSNDSYGRNLGLCGLPLTAECSKDLEQHSPPSLTVGGEQGVGFGWKPVAM

SEQ ID NO: 185882 - protein, 76 aa, Glycine max
  Coding DNA Sequence Number=SeqID_69104
KDPEQHSPPSTTFRKEGGFGFGWKAVAIGYGCGMVFGVGMGCCVLLIGKPQWLVRMVGGKLNKKRDMALEAEVQGA

SEQ ID NO: 185883 - protein, 813 aa, Glycine max
  Coding DNA Sequence Number=SeqID_69105
  Gene Ontology: Mol. function=protein binding; Cellular component =integral to membrane; Biological process=protein amino acid phosphorylation
  Homolog annotation: Hit_ID=Q4VSU4; Match level="QueryCoverage=89%, HitCoverage=84%, E-value=1e-112, Identity=36%"; Hit description=Hcr9- OR2B
  Pfam annotation: Domain name=LRR_1; Domain location=112-134; Score =17.7; E_value=0.043; Accession=PF00560.23; Description=Leucine Rich Repeat
  Pfam annotation: Domain name=LRR_1; Domain location=136-158; Score =16.8; E_value=0.079; Accession=PF00560.23; Description=Leucine Rich Repeat
  Pfam annotation: Domain name=LRR_1; Domain location=160-182; Score =13.5; E_value=0.77; Accession=PF00560.23; Description=Leucine Rich Repeat
  Pfam annotation: Domain name=LRR_1; Domain location=184-206; Score =15.0; E_value=0.28; Accession=PF00560.23; Description=Leucine Rich Repeat
  Pfam annotation: Domain name=LRR_1; Domain location=208-230; Score =14.9; E_value=0.3; Accession=PF00560.23; Description=Leucine Rich Repeat
  Pfam annotation: Domain name=LRR_1; Domain location=232-253; Score =13.3; E_value=0.9; Accession=PF00560.23; Description=Leucine Rich Repeat
  Pfam annotation: Domain name=LRR_1; Domain location=254-277; Score =19.9; E_value=0.009; Accession=PF00560.23; Description=Leucine Rich Repeat
  Pfam annotation: Domain name=LRR_1; Domain location=278-301; Score =12.6; E_value=1.2; Accession=PF00560.23; Description=Leucine Rich Repeat
  Pfam annotation: Domain name=LRR_1; Domain location=303-326; Score =3.2; E_value=70; Accession=PF00560.23; Description=Leucine Rich Repeat
  Pfam annotation: Domain name=LRR_1; Domain location=329-349; Score =7.3; E_value=12; Accession=PF00560.23; Description=Leucine Rich Repeat
  Pfam annotation: Domain name=LRR_1; Domain location=352-374; Score =7.3; E_value=12; Accession=PF00560.23; Description=Leucine Rich Repeat
  Pfam annotation: Domain name=LRR_1; Domain location=37-56; Score=6.2; E_value=19; Accession=PF00560.23; Description=Leucine Rich Repeat
  Pfam annotation: Domain name=LRR_1; Domain location=375-394; Score =7.9; E_value=9.6; Accession=PF00560.23; Description=Leucine Rich Repeat
  Pfam annotation: Domain name=LRR_1; Domain location=398-420; Score =8.8; E_value=6.4; Accession=PF00560.23; Description=Leucine Rich Repeat
  Pfam annotation: Domain name=LRR_1; Domain location=422-441; Score =13.5; E_value=0.76; Accession=PF00560.23; Description=Leucine Rich Repeat
  Pfam annotation: Domain name=LRR_1; Domain location=446-469; Score =5.6; E_value=26; Accession=PF00560.23; Description=Leucine Rich Repeat
  Pfam annotation: Domain name=LRR_1; Domain location=470-493; Score =13.5; E_value=0.78; Accession=PF00560.23; Description=Leucine Rich Repeat
  Pfam annotation: Domain name=LRR_1; Domain location=495-517; Score =15.8; E_value=0.16; Accession=PF00560.23; Description=Leucine Rich Repeat
  Pfam annotation: Domain name=LRR_1; Domain location=519-542; Score =1.3; E_value=1.6e+02; Accession=PF00560.23; Description=Leucine Rich Repeat
  Pfam annotation: Domain name=LRR_1; Domain location=545-568; Score =11.6; E_value=1.9; Accession=PF00560.23; Description=Leucine Rich Repeat
  Pfam annotation: Domain name=LRR_1; Domain location=615-637; Score =9.2; E_value=5.4; Accession=PF00560.23; Description=Leucine Rich Repeat
  Pfam annotation: Domain name=LRR_1; Domain location=63-86; Score=6.9; E_value=14; Accession=PF00560.23; Description=Leucine Rich Repeat
  Pfam annotation: Domain name=LRR_1; Domain location=639-661; Score =15.1; E_value=0.25; Accession=PF00560.23; Description=Leucine Rich Repeat
  Pfam annotation: Domain name=LRR_1; Domain location=663-685; Score =20.7; E_value=0.0054; Accession=PF00560.23; Description=Leucine Rich Repeat
  Pfam annotation: Domain name=LRR_1; Domain location=687-708; Score =12.8; E_value=1.1; Accession=PF00560.23; Description=Leucine Rich Repeat
  Pfam annotation: Domain name=LRR_1; Domain location=88-110; Score =16.4; E_value=0.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1; Domain location=112- 134::136-158::160-182::184-206::208-230::232-253::254-277::278 -301::303-326::329-349::352-374::37-56::375-394::398-420::422 -441::446-469::470-493::...
  Pfam module annotation: Domain location=495-517::519-542::545 -568::615-637::63-86::639-661::663-685::687-708::88-110
MEFMSFGLGIDVNLCSWENGTDCCSWAGVTCHPISGHVTQLNLSCNGLYGNIHPNSTLFHLSHLHSLNLAFNDFDESHLSSLFGGFVSLTHLNLSNSYFEGDIPSQISHLSKLVSLDLSDNNLNGSIPSSLLTLTHLTFLDLSYNQLSGQIPDVFPQSNSFHELHLNDNKIEGELPSTLSNLQHLILLDLSDNKLEGPLPNNITGFSNLTSLRLNGNLLNGTIPSWCLSLPSLKQLDLSGNQLSGHISAISSYSLETLSLSHNKLQGNIPESIFSLLNLYYLGLSSNNLSGSVKFHRFSKLQYLEELHLSWNDQLSLNFESNVNYNFSNLRLLNLSSMVLTEFPKLSGKVPILESLYLSNNKLKGRVPHWLHEISLSELDLSHNLLTQSLHQFSWNQQLGSLDLSFNSITGDFSSSICNASAIEILNLSHNKLTGTIPQCLANSSSLLVLDLQLNKLHGTLPSIFSKDCQLRTLDLNGNQLLEGLLPESISNCIHLEVLDLGNNQIKDVFPHWLQTLPELKVLVLRANKLYGPIAGLKIKDGFPSLVIFDVSSNNFSGPIPKAYIQKFEAMKNVVIDTDLQYMEISFSYGGNKYSDSVTITTKAITMTMDRIRNDFVSIDLSQNGFEGEIPNAIGELHSLRGLNLSHNRLIGPIPQSMGNLTNLESLDLSSNMLTGRIPTELTNLNFLEVLNLSNNHLAGEIPRGQQFNTFSNDSYKGNLGLCGLPLTTECSKGPEQHSPPSTTLRREAGFGFGWKPVAIGYGCGVVFGVGMGCCVLLIGKPQWLVRMVGGKLNKKVKRKTRMRSNENGSRMN

SEQ ID NO: 185884 - protein, 142 aa, Glycine max
  Coding DNA Sequence Number=SeqID_69106
  Pfam annotation: Domain name=zf-CCHC; Domain location=98-115; Score =26.0; E_value=5e-05; Accession=PF00098.13; Description=Zinc knuckle
MELEENVNKEVVEEVPKEEDGDHKLDRPIIALSNMELLRWASPCVSFGKFLKIDKLTSIQSRGKFASIYVELDLEKPRETHIYVKGHKLFLEYEDLHSICFKCGRVGHKKDDCTELQMMMTEDQMGKAMELTDNNEVTSRAI

SEQ ID NO: 185885 - protein, 110 aa, Glycine max
  Coding DNA Sequence Number=SeqID_69107
  Homolog annotation: Hit_ID=Q1SKJ3; Match level="QueryCoverage=70%, HitCoverage=8%, E-value=7e-09, Identity=33%"; Hit description=Zinc finger, CCHC-type; Endonuclease/exonuclease/phosphatase
MDISSTFSMEDGSSKGKRCNAISHPDGIWCIWNPEDWTMNVLMNPHQLVHMKVRWRSTSEWLLTAIYGAPQVARRQMLWHKLNDISFDVTGGSGVIGDFNSTLSPLKVLD

SEQ ID NO: 185886 - protein, 305 aa, Glycine max
  Coding DNA Sequence Number=SeqID_69108
  Gene Ontology: Mol. function=transcriptional activator activity; Cellular component=nucleus; Biological process=regulation of transcription, DNA-dependent
  Homolog annotation: Hit_ID=Q67UE2; Match level="QueryCoverage=41%, HitCoverage=34%, E-value=2e-35, Identity=59%"; Hit description =Putative homeodomain leucine zipper protein CPHB-3
  Pfam annotation: Domain name=HALZ; Domain location=198-243; Score =55.7; E_value=1.5e-13; Accession=PF02183.8; Description=Homeobox associated leucine zipper
  Pfam annotation: Domain name=Homeobox; Domain location=143-197; Score= 68.8; E_value=1.8e-17; Accession=PF00046.19; Description=Homeobox domain
  Pfam module annotation: Pfam domain module=HALZ::Homeobox; Domain location=198-243::143-197
MSFHDTSNTGLGLGLGLGLVSFHDQSENCMKSTNDPLREIHKIKKVENPSKCNSTYPSLTLGPPDDDDDDDDEVNNQPPSSKTESYEYFRPHVSSPSAVSSFSNYSSIKRERDQVLWEKEFEVEVEKVPTRVGDVDEDGNPRKKLRLTKEQAAVLEENFREHSTLNPKQKQELAMKLNLRARQVEVWFQNRRARTKLKQTESDCELLKKCCDTLTEENKKLQKELQELKSIQATPMPLYMQIPAATLCICPSCERICGGNNNSDGGNNNNGSSHTTSLLIGSKTHHHSFYKSNKYPFPHSSSAAC

SEQ ID NO: 185887 - protein, 57 aa, Glycine max
  Coding DNA Sequence Number=SeqID_69109
MVVHHGRGQFMRVVVNHEDLSQSTTPQSFDATFDHNCGEFYQCRSASFQSDIFRKDC

SEQ ID NO: 185888 - protein, 151 aa, Glycine max
  Coding DNA Sequence Number=SeqID_69110
  Gene Ontology: Mol. function=RNA-directed DNA polymerase activity; Cellular component=mitochondrion; Biological process=RNA-dependent DNA replication
MDILDLLPIVKVNKDIFNEKNKRIGKAKGLWVEDLPNKLWAYHCTPESTTRETSFRLTYVIDAMIPVEIGEPSARRAYFEETLNNESLAFQLDMIDEVIEHAQIQEETCNRKATQKHESKLKRKEFSECDLVWKMREKASKDHAKGKLAPK

SEQ ID NO: 185889 - protein, 107 aa, Glycine max
  Coding DNA Sequence Number=SeqID_69111
MSNIRHSLRRRKLHVHGIAEGNEWQGHLPTRAVVVDSGAILEGSQIYESWSSSAMLMLAWSEPSVRGPLQLAADAQPLLAKIGVLVEDLTLLPLLNMARRSKSRGWR

SEQ ID NO: 185890 - protein, 39 aa, Glycine max
  Coding DNA Sequence Number=SeqID_69112
MVQNFRSEWLDATEVWKATHMRSNGTWCIPKGEEIMRKL

SEQ ID NO: 185891 - protein, 275 aa, Glycine max
  Coding DNA Sequence Number=SeqID_69113
  Gene Ontology: Cellular component=chloroplast thylakoid membrane
  Pfam annotation: Domain name=Methyltransf_11; Domain location=92-188; Score=10.2; E_value=0.0054; Accession=PF08241.2; Description =Methyltransferase domain
  Subcellular localization annotation: CTP_CleavageSite=48; ConfidenceScore=5.14e-01
MSRRPGNPTRRFGDNGGGLFSSKSRSPPVLSIALVIVGGLFLIGYMYRGSGGSSSRIDSVSRVEGDYLCSGEVQQAIPLLQKAYGDSMHKVLHVGPDTCYVVSKLLKEDETDAWGIEPYDIEDADNNCKALIRRGSVRVSDIKFPLPYRPKSFSLVIVSDALDYLSPRYLNKTLPDLVRVASDGVVIFTVNNLLGVSLTSDNIYNEGFPTTQKAKVADVSKFGKAAKMRSSSWWVKFFLQINLEENEAAVKKFELASSKSSYVPKCQIFHLKSLH

SEQ ID NO: 185892 - protein, 177 aa, Glycine max
  Coding DNA Sequence Number=SeqID_69114
MADHNEPSEVKMQIGIMREKLKEAMPVSVQEFPWKKAEQILLDRLLNLAQETVKWSLVLFFIFSSVSDVVYTFSINRELVIPIGLFVGLLVAGFLKEISQDLFHRPEEKDLKWHLLGMYCIFVFAKFMSTWFATLPRVFLLHVANGGLIQALWHSTNFMEDEKNKQETSSSSSLHAS

SEQ ID NO: 185893 - protein, 116 aa, Glycine max
  Coding DNA Sequence Number=SeqID_69115
MRVRTKHAKKSRVGLWGQSLILEVTKAYYRGLKKGYLWKEFWSEIDVGDGGDMTISGTILENIVGLSALNPRKEREQLDFAIIMDFPRRMDIKAILNFPYCGNVEKALEGEYCVKI

SEQ ID NO: 185894 - protein, 66 aa, Glycine max
  Coding DNA Sequence Number=SeqID_69116
MSIACLKQGIIVSVPMEVAAGQGTSAKLQKHGGVGEDDREPIEDVGIDGDEGTSHITVLPPHSTDQ

SEQ ID NO: 185895 - protein, 143 aa, Glycine max
  Coding DNA Sequence Number=SeqID_69117
MKKKKSAETVGVGWWNPTVRAEPVIDNQPGLIGNGPFVAQYVEKLNRMMWCHVIVLIRINNINNRTGSEMNKDESDRNEKKAQDIKLWGVFIFGLIGATVTAFSLSRSQAKGGSSFRTAFQEEAWKRYNKRLQEEYEEEMERV

SEQ ID NO: 185896 - protein, 55 aa, Glycine max
  Coding DNA Sequence Number=SeqID_69118
CSHPLKDLKVSSLNFQISYNAIGSKTPNSLSCWFIQSSQIVPAPLSLGGLICRYS

SEQ ID NO: 185897 - protein, 57 aa, Glycine max
  Coding DNA Sequence Number=SeqID_69119
MGDPISRLSFPENNETFSSLTSYPELRRSEFLIGGYVGARASLLSTTPPFVAITQEL

SEQ ID NO: 185898 - protein, 131 aa, Glycine max
  Coding DNA Sequence Number=SeqID_69120
  Gene Ontology: Mol. function=structural constituent of ribosome; Cellular component=ribonucleoprotein complex; Biological process =translation
  Homolog annotation: Hit_ID=Q947H2; Match level="QueryCoverage=72%, HitCoverage=54%, E-value=2e-45, Identity=90%"; Hit description =Ribosomal protein
  Pfam annotation: Domain name=Ribosomal_L22; Domain location=17-122; Score=91.3; E_value=3e-24; Accession=PF00237.9; Description =Ribosomal protein L22pL17e
MVKYSREPDNPTKSCKARGADLRVHFKNTRETAFAIRKLPLVKAKRYLEDVLAHKQAIPFRRFCRGVGRTAHAKNRHSNGQGRWPVKSAKFILDLLKNAESNAEVKAAAAESATTERNATNGEYQNSLFQR

SEQ ID NO: 185899 - protein, 477 aa, Glycine max
  Coding DNA Sequence Number=SeqID_69121
  Gene Ontology: Mol. function=protein binding; Cellular component =integral to membrane; Biological process=protein amino acid phosphorylation
  Homolog annotation: Hit_ID=Q1T435; Match level="QueryCoverage=77%, HitCoverage=36%, E-value=5e-55, Identity=37%"; Hit description =Leucine-rich repeat; Leucine-rich repeat, cysteine-containing type
  Pfam annotation: Domain name=LRRNT_2; Domain location=38-80; Score =53.9; E_value=5.3e-13; Accession=PF08263.3; Description=Leucine rich repeat N-terminal domain
  Pfam annotation: Domain name=LRR_1; Domain location=113-129; Score =6.2; E_value=20; Accession=PF00560.23; Description=Leucine Rich Repeat
  Pfam annotation: Domain name=LRR_1; Domain location=138-160; Score =17.6; E_value=0.046; Accession=PF00560.23; Description=Leucine Rich Repeat
  Pfam annotation: Domain name=LRR_1; Domain location=162-185; Score =11.1; E_value=2.4; Accession=PF00560.23; Description=Leucine Rich Repeat
  Pfam annotation: Domain name=LRR_1; Domain location=187-209; Score =14.9; E_value=0.29; Accession=PF00560.23; Description=Leucine Rich Repeat
  Pfam annotation: Domain name=LRR_1; Domain location=211-233; Score =15.1; E_value=0.26; Accession=PF00560.23; Description=Leucine Rich Repeat
  Pfam annotation: Domain name=LRR_1; Domain location=260-285; Score =3.3; E_value=69; Accession=PF00560.23; Description=Leucine Rich Repeat
  Pfam annotation: Domain name=LRR_1; Domain location=288-311; Score =8.3; E_value=8; Accession=PF00560.23; Description=Leucine Rich Repeat
  Pfam annotation: Domain name=LRR_1; Domain location=317-339; Score =8.0; E_value=9.2; Accession=PF00560.23; Description=Leucine Rich Repeat
  Pfam annotation: Domain name=LRR_1; Domain location=342-363; Score =10.1; E_value=3.7; Accession=PF00560.23; Description=Leucine Rich Repeat
  Pfam annotation: Domain name=LRR_1; Domain location=365-388; Score =9.4; E_value=4.9; Accession=PF00560.23; Description=Leucine Rich Repeat
  Pfam annotation: Domain name=LRR_1; Domain location=390-415; Score =7.7; E_value=11; Accession=PF00560.23; Description=Leucine Rich Repeat
  Pfam annotation: Domain name=LRR_1; Domain location=419-442; Score =6.7; E_value=16; Accession=PF00560.23; Description=Leucine Rich Repeat
  Pfam annotation: Domain name=LRR_1; Domain location=445-467; Score =15.7; E_value=0.17; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1; Domain location=38-80::113-129::138-160::162-185::187-209::211 -233::260-285::...
  Pfam module annotation: Domain location=288-311::317-339::342 -363::365-388::390-415::419-442::445-467
MSCYSLKLFYALLLLLLHAAGSILGFNSLPNSAEIKCIESERQALLNFKHGLKDDSGMLSTWRDDGNNRDCCKWKGIQCNNQTGHVEMLHLRGQDTQYLRGAINISSLIALQNIEHLDLSYNAFQWSHIPEFMGSFANLRYLNLSYCSFGGSIPSDLGKLTHLLSLDLGNNYLLQGQIPYQLGNLTHLQYLDLSGNYLDGELPYQLGNLSQLRYLDLGWNSFSGALPFQVGNLPLLHTLGLGGNFDVKSKDAEWLTNLSSLTKLKLSSLHNLSSSHHWLQMISKLIPNLRELRLFDCSLSDANIQSLFYSPSNFSTALNILDLSSNKLTSSTFQLLSNFSLNLQELYLGDNNIVLSSPLCPNFPSLLILDLSYNNLTSSVFQGGFNFSSKLQNLDLQNCSLKDGSFLMSSSFIMSSSSSLVSLDLSSNLLKSSTIFYWLINSTTNLHNLLLYNNTLEGPIPDGFGKLMNSLEVLHLT

SEQ ID NO: 185900 - protein, 232 aa, Glycine max
  Coding DNA Sequence Number=SeqID_69122
  Pfam annotation: Domain name=Extensin_2; Domain location=9-231; Score= 87.5; E_value=4e-23; Accession=PF04554.4; Description=Extensin-like region
MGSLMASLTLTLVLAIVSLSLSSQASADKYDYSSPPPPVYKYKSPPPPYKYSSPPPPPKKPYKYPSPPPPVYKYKSPPPPYKYPSPPPPPKKPYKYPSPPPPVYKYKSPPPPVYKYKSPPPPPKKPYKYPSPPPPVYKYKSPPPPYKYPSPPPPPKKPYKYPSPPPPVYKYKSPPPPYKYSSPPPPPYKYPSPPPPAYYYKSPPPPPKKPYKYPSPPPPHYVYASPPPPYHY

SEQ ID NO: 185901 - protein, 64 aa, Glycine max
  Coding DNA Sequence Number=SeqID_69123
  Gene Ontology: Mol. function=heat shock protein binding; Cellular component=integral to membrane; Biological process=protein folding
  Homolog annotation: Hit_ID=Q6ATJ1; Match level="QueryCoverage=87%, HitCoverage=23%, E-value=3e-17, Identity=71%"; Hit description =Putative DnaJ protein
  Pfam annotation: Domain name=DnaJ; Domain location=3-63; Score=32.2; E_value=1.8e-06; Accession=PF00226.21; Description=DnaJ domain
MTSHIEQFRTTPYTEAEIKTAFRTKAKQYHPDQNQDNREAAEAKFKEVICSYEAIQQERKNQNL

SEQ ID NO: 185902 - protein, 196 aa, Glycine max
  Coding DNA Sequence Number=SeqID_69124
MVDLVTRNLNNLHKLLNSNFVVIHFKSILCDNNDNDCDTNNNVDDRHTSGGHRSSDNANGGGSDDMLVIVVLGLTTSDESGGGNVSNDGNNKGGISDASGGDVMAVVVVKTLVVIVVAVTVTEVVLLIVVTMTMTITLMWCWWWQQVVVMRGCGGDNNDDRDTHGVDNNNTGGDDDDSDSENFVGGSDTDDDGDGG

SEQ ID NO: 185903 - protein, 90 aa, Glycine max
  Coding DNA Sequence Number=SeqID_69125
MTPPQRVRESESDSVRVRRSASKNERGRKKLLNQSNRTIKVIMCPIRLFKYLAQKPQVSTSQVNRILLGLAQATVSMTWHKDSHPIKYIK

SEQ ID NO: 185904 - protein, 193 aa, Glycine max
  Coding DNA Sequence Number=SeqID_69126
  Gene Ontology: Mol. function=amino acid-polyamine transporter activity; Cellular component=membrane; Biological process=amino acid transport
  Homolog annotation: Hit_ID=Q6YUT5; Match level="QueryCoverage=77%, HitCoverage=32%, E-value=6e-44, Identity=54%"; Hit description =Putative amino acid transporter A1
MTLPLSDRKSRRSPKTYHQNLISDAAIQCGSSFSGAVFNLSTTIVGAGIMALPAAVKQLGLIPGLVMIILCAMLTESSISMLVRFTRASKSSTYSGVVRDAFGGLGRNLLLLCIIVNNVGMLVVYMVIIGDVFSGSWSEGVHYSGVVEEWFGQRWWSTRPVLLFLTAILVLVPLASFRRVGTSVSSFHGINTE

SEQ ID NO: 185905 - protein, 192 aa, Glycine max
  Coding DNA Sequence Number=SeqID_69127
  Gene Ontology: Mol. function=amino acid-polyamine transporter activity; Cellular component=integral to membrane; Biological process=amino acid transport
  Homolog annotation: Hit_ID=Q9FNZ8; Match level="QueryCoverage=93%, HitCoverage=40%, E-value=3e-58, Identity=57%"; Hit description =Putative Na+-dependent neutral amino acid transporter
MKAIVRTSLLLCSSVYIATSLFGFFLFGDNTLDDILANFDGDLGVPYGSFLTDIVRVSYGIHLILVFPIVFYSLRLNIDGLMFPHAIPLAFDTQRFYLVTTVLMAFIFVGANFVPSIWDAFQFIGATAAISAGYIFPAAIALRDTRGVATKKDRLLSWFMILLGVSCSTVAIFSDLYSVYNSSEAEVAEKWA

SEQ ID NO: 185906 - protein, 74 aa, Glycine max
  Coding DNA Sequence Number=SeqID_69128
  Gene Ontology: Mol. function=structural constituent of ribosome; Cellular component=intracellular; Biological process=translation
  Homolog annotation: Hit_ID=Q1RUG6; Match level="QueryCoverage=94%, HitCoverage=67%, E-value=2e-17, Identity=52%"; Hit description =Ribosomal protein L7Ae/L30e/S12e/Gadd45
MVVLHVSFMKVQKGSRSMLCNCVLAEDYDQPDYLCKIDSEGKAKKVTGCSGVVVKDFGEEHEAYNVVLQHVKSQ

SEQ ID NO: 185907 - protein, 90 aa, Glycine max
  Coding DNA Sequence Number=SeqID_69129
MSCKADKNPETAQIQGPMMRITFGIFIKFGENFSQGSLLNQSQTYQGNHCGVYPDLSSFTGSGVIQISVAYIKRFAPSQDHIIWYQSFDS

SEQ ID NO: 185908 - protein, 496 aa, Glycine max
  Coding DNA Sequence Number=SeqID_69130
  Gene Ontology: Mol. function=glycerol-3-phosphate O-acyltransferase activity; Cellular component=membrane; Biological process =phospholipid biosynthetic process
  Homolog annotation: Hit_ID=Q8P3E3; Match level="QueryCoverage=99%, HitCoverage=57%, E-value=0.0, Identity=78%"; Hit description =Glycerol-3-phosphate acyltransferase
  Pfam annotation: Domain name=Acyltransferase; Domain location=324 -467; Score=129.5; E_value=9.1e-36; Accession=PF01553.11; Description= Acyltransferase
  Subcellular localization annotation: CTP_CleavageSite=34; ConfidenceScore=5.28e-01
NPLPFPGEESQSTPADTVPASPSTGTGPNPVPPPAHARPAGRRPLWARLLGRLVEPWLSLKIEPEDPGQYNDGRPVMYVLEDYGLSNALILDKACRQAGLPSPLVPLAGDPTGRKRAYLALSRRSSSNSLIPEQRGAKTHSDSLAKVLQAHRVRDDLDVHLVPVSIFVGRAPDKQSGWFAVLFSENWALVGRFRRLLAVLLNGRSTIVRFAPPISLRSIIDEGLEPERTVRKLQRVLRTHFRRIRESVIGPDLSTRRLLVDQVLAAEPVREAIASQAKRDNSKPADAWKKAHAYAWEIAADYSSPVVRSASFMLSHVWNRIYAGVLVHHLDKFKAAAPGHEVVYVPSHRSHMDYLLLSYLLYDRGIVPPHIVAGINLNLPVVGTLLRKGGAFFIRRSIRGNALYSAVLSEYVAQLVAGGYSLEYFVEGGRSRTGRLLQPKGGMISMTLRAFLRQPRKPVLFQPIYIGYEKLMEGGSYLDELSGRPKEKESIWSLLW

SEQ ID NO: 185909 - protein, 673 aa, Glycine max
  Coding DNA Sequence Number=SeqID_69131
  Gene Ontology: Mol. function=protein-methionine-S-oxide reductase activity; Cellular component=membrane; Biological process=protein metabolic process
  Homolog annotation: Hit_ID=Q9ZQB9; Match level="QueryCoverage=99%, HitCoverage=100%, E-value=0.0, Identity=64%"; Hit description =Putative glucosyltransferase
  Pfam annotation: Domain name=Chitin_synth_2; Domain location=185-586; Score=-365.1; E_value=0.027; Accession=PF03142.5; Description=Chitin synthase
  Pfam annotation: Domain name=Glycos_transf_2; Domain location=216 -391; Score=30.3; E_value=3.5e-06; Accession=PF00535.16; Description =Glycosyl transferase
  Pfam module annotation: Pfam domain module=Chitin_synth_2::Glycos _transf_2; Domain location=185-586::216-391
MATSLKWWGKESHRGTPVVVKMENPKWSMLELEGPSDEDFIIGNDNDNNNNNRDNKGRGKNAKQLTWVLLLKAHKAAGCLASVAPALLGLVAAVKRRVAAGRTDADTDGGGGGGGREKENPTVKSRFYNCIKVFLFVSLMLLFFEVAAYFKGWHFEAPRFWGVKGVFDWAYLMWSLDRLVLCLGCFWIRFKKIKPVPKGGDVDLESGEKGFFPMVLVQIPMCNEREVYQQSIGAVCNLDWPKSKLLIQVLDDSDDITTQSLIREEVQKWQKEGANIVYRHRVIRTGYKAGNLNSAMNCSYVKDYEFVAIFDADFQPTPDFLKRTIPHFKDNDELGLVQARWSFVNKDENLLTRLQNINLAFHFEVEQQVNGVFINFFGFNGTAGVWRIKALEDAGGWLERTTVEDMDIAVRAHLHGWKFIFLNDVECQCELPESYEAYRKQQHRWHSGPMQLFRLCLPDIIRSKISIWKKFNMIFLFFLLRKLILPFYSFTLFCIILPMTMFVPEAELPALVVCYIPATMSLLNILPAPKSFPFIVPYLLFENTMSVTKFNAMISGLFHLGSAYEWVVTKKSGRSSEGDLVSLIEKGPKHHQRGSSAPDLAEIKEEIQLQEKKVGSKKKHNRIYMKELALAFLLLTASARSLLSAQGIHFYFLLFQGISFLLVGLDLIGEQVD

SEQ ID NO: 185910 - protein, 88 aa, Glycine max
  Coding DNA Sequence Number=SeqID_69132
MGKLRIIPKLSPRYYGPFQVLSRVEEVTYKLQFSDSARIHPVFHVSQLKRSVKSGSTTTTLPRRLAVAEYKPPSLEASLATQLFSLPA

SEQ ID NO: 185911 - protein, 578 aa, Glycine max
  Coding DNA Sequence Number=SeqID_69133
  Gene Ontology: Mol. function=zinc ion binding; Cellular component =intracellular
  Homolog annotation: Hit_ID=Q69L44; Match level="QueryCoverage=97%, HitCoverage=77%, E-value=0.0, Identity=71%"; Hit description=SWIM zinc finger family protein-like
MAIVESVGKIPLQDPPEEEFCAADLTWTKFGNAEHHDEVALIPYDRVDAFIIGECTNVECPTRFHIERGRKRTIGSLKEYKDDEYLEYRLYWCSFGPENYGEGGGILPSRRYRLNTRNRAARPQSMRGCTCHFVVKRLYAQPSLALIVYNERRHINKSGFICHGPLDRDAIGPGAKKIPYICNEIQQQTMSMIYLGIPEENILEKHIEGIQRYCGSDAKVSSLASQYVHKLGMIIKRSTHELDLDDQASIRIWIERNRKSVFFHQDTSESDPFILGIQTEWQLQQMIRFGHRSVVAADSTFGVKRLKYPLFTLLVFDSRQHALPVAWVITRSFTKPDVSKWLKALIDRARSVEPGWKVSGFLIDDAAAEIDLLRDIFCCPVLFSLWRVRRSWLRNIVKKCSNIEIQREIFKRLGRIVYNIWGGINASLALEQFLLDFVDQTAFMEYFKVMWLPKLEMWLSTMRNFPLASQEASGALEAYHVKLKAKLFDDSHLGALQRVDWLVHKLTTELHSSYWLDRYADESDSFQNVKEKYIASTSWHRALQIPDYAVSLDDKDHLFAKVVSQKDSSLTHSVESRI

SEQ ID NO: 185912 - protein, 120 aa, Glycine max
  Coding DNA Sequence Number=SeqID_69134
MNCVFIHPSSTHEFGAMRSDCLVQFSILNPFPEPMNCVFVHVSSTHEFGALRSDCLVQFSIFNPFLEPMNCVFVHAFSTHEFGAMRSDCLVQFSILNIFSEPHELRFRSCVLHLRVWSHA

SEQ ID NO: 185913 - protein, 297 aa, Glycine max
  Coding DNA Sequence Number=SeqID_69135
MATYSWSTEIFSFLVLTLLSTSSHTMVAGARNLLESTLSKPEVPTLPKPHELPPLPEIPELPKFESPKIPALPKPELPKVPELSKPDMSKVPELPKVPERLKVPEISKILELSKPELPKGPELLKPELPSVPNIPKVPELPKPELPEVPKLPKPELPKVPELPKPELPKVPEIPELPNLELPKVPELSKPELPKAPEIPKVPEFPKPELPKVPELPKPELPKIPEIPKVPEFPKPELPKVPEVPKPELSKVPKLPKSELPKVPEIPELPKSELPKIPEIPKVPEFPKVPKAFSTTNP

SEQ ID NO: 185914 - protein, 66 aa, Glycine max
  Coding DNA Sequence Number=SeqID_69136
MEAPIGRDEDIPELEDRNQPPEAARLRNINNAGKTGNKINSAVISGGQESQSKRSCETSTMRKALS

SEQ ID NO: 185915 - protein, 117 aa, Glycine max
  Coding DNA Sequence Number=SeqID_69137
  Gene Ontology: Cellular component=cell surface
  Homolog annotation: Hit_ID=Q9LXB8; Match level="QueryCoverage=98%, HitCoverage=89%, E-value=9e-20, Identity=46%"; Hit description =Periaxin-like protein
MSKVPELSKRELPKVSELLKPELPKVPKLPEISELPKPELTKVPELPKVPESFKLELTKIPELTKVSELSKVPELPKPTFPKVPKPELPMVLELPKLELSKIPKIPKVPEFLKLLKS

SEQ ID NO: 185916 - protein, 1285 aa, Glycine max
  Coding DNA Sequence Number=SeqID_69138
  Gene Ontology: Mol. function=RNA-directed DNA polymerase activity; Cellular component=chromatin; Biological process=chromatin assembly or disassembly
  Pfam annotation: Domain name=RVP_2; Domain location=333-456; Score= -44.0; E_value=0.0027; Accession=PF08284.2; Description=Retroviral aspartyl protease
  Pfam annotation: Domain name=rve; Domain location=1095-1251; Score =91.2; E_value=3.1e-24; Accession=PF00665.16; Description=Integrase core domain
  Pfam module annotation: Pfam domain module=RVP_2::RVT_1::Retrotrans _gag::rve; Domain location=333-456::579-748::99-189::1095-1251
MADNTCSHTLSRLEEAVTLLTQNQTTLTATQNSLHTRLDEVLARLQSLEASSPSMSPRPSTPRMNLDIPRFDGTNALAWIFKITQFFDYHRTPEDDRLQVASFYLEGAALSWFQWLYRNDQLPSWSSFIQALELRFAPTLYDDPRGALFKLSQHGSVSSYLAEFESLANRIVGLPTPFLLSSFISGLHPDIRREVLALQPLSLVQEVALARLQEDKLFDARRSSRPKPSPLTFPANPQPLTTITPPPLLPSPPKPTYKRLTQAEMASRRKRGLCYHCDERYGPNHRCRAKFFLLIAPQDDDDPFPPDSPDTIDTNPPPPPPPDPDPAQLTLYALSGQPTPATLRVIGTIKGHDTVILVDGGSTHNFVHDRLAHFLNLNPQTIPLLPVMVGNDTEVHCDKVCRNVAISIQGCHFTLDLHVMTLGGPDIVLGVAWLKLLGPITTDYSHLTMTFHHQGKPITIHGELTSGPIEIPHDQVRSLLTTNRVAALFHIQLLSPDPPSPTLPSTPPPLRSLLTKYSTLFQPPAHLPPTRPTYHSIHLEPNSQPVNVRPYRYPYSHKCEIERQVDDMLRRQLIRPSRSPYSSPVLLVKKKDGTWRFCVDYRALNSLTIKDRFPLPTIDELLDDLGNSSWFSKMDLAQGFHQIRMEEQDIPKTAFRTHQGHYEYIVMPFGLCNAPSTFQATMNELFRPFIRKFMLVFFDDILVFSSDFQAHLHHLECVFRTLQQGQFHLKASKCIFGQRRIEYLGHFVSSQRVEPDPSKIKAMLQWPPPTTPKQLRGFLGLTGFYRRFFHRYAQIAEPLTQLLRKDGFKWTPEAQTAFAKLKEAMTATPVLALPDFTIPFVLETDASGSGMGDVLMQRGHPIAYFSKQFCPKLLRSFTYIRELHTITTAVKRWRQYLLGHTFVILTDHKSLRELMTQPVQTPEQHVYLAKLLGYNYSIQYKAGRNNVVADALSRLHEPDSVAACFQIISMPHPQFLDELKRELSGSDEFKTLMLQVRNHPSDYPGFKIRDNLLLFQGSIWLNQGNPFIPLLLEEYHKSPLGGHMGLAKTLGRLQQSFFWEHMRRDTQNFIKQCSNWLQTKYTPKKPAGHFQPIPPPSRPWEDLALDFITGLPISNGATVIMTVVDRFSKGGHFGTLPTHFTAHMAAHLFIDLICKLHSFPRSLISDRDPLFLSKFWRELSKLSGTKLRMSMAYHPQSDGQSEVLNRVVEQYLRSFVHAKPANWHKFLSLAEWCYSTSRHSATGLTPYEVTYGKPPPAIPDYLPGTSDVEAVDFLLTSRQDMFTTL

SEQ ID NO: 185917 - protein, 381 aa, Glycine max
  Coding DNA Sequence Number=SeqID_69139
  Gene Ontology: Mol. function=nucleoside-triphosphatase activity; Cellular component=membrane; Biological process=ion transport
  Homolog annotation: Hit_ID=Q1LDS1; Match level="QueryCoverage=82%, HitCoverage=95%, E-value=5e-78, Identity=48%"; Hit description=ABC transporter related
  Pfam annotation: Domain name=ABC_tran; Domain location=86-268; Score =224.4; E_value=2.5e-64; Accession=PF00005.17; Description=ABC transporter
  Pfam annotation: Domain name=TOBE_2; Domain location=311-379; Score =2.7; E_value=0.093; Accession=PF08402.1; Description=TOBE domain
  Pfam module annotation: Pfam domain module=ABC_tran::TOBE_2; Domain location=86-268::311-379
QHHLDAAYAADKNAAGGAGRQLCLNATGSGIGLHADLYSADSAAAADAQRGGGMNPAAVTVTLRHCARHFNHQLALQPLDLTVQPGETLVLLGPSGCGKTTTLRIISGLERCDDGGEVWFDDRNVTALPIEKRNVGMVFQNYALFPHLNVAQNVAYGLKVQGVARAERDARVQEMLALVDLSALAQRSIDKLSGGQKQRVALARALAARPKVLLFDEPLAALDARLRDRLRLEIGALLKQLAITAVYVTHDQQEAMALGDRIAVMEQGRLVQIDTPQNIYQRPASQFVADFVGAINCVGVDARGNPQHFCRPEDVLLAADQRYARPGFILGTTFLGAAQRLSIDIGLAAPIQVDRHAREAWHAGQPVSWTLAQDAALHFSA

SEQ ID NO: 185918 - protein, 885 aa, Glycine max
  Coding DNA Sequence Number=SeqID_69140
  Gene Ontology: Mol. function=signal transducer activity; Cellular component=membrane; Biological process=signal transduction
  Homolog annotation: Hit_ID=UPI00005F964F; Match level="QueryCoverage =53%, HitCoverage=95%, E-value=1e-117, Identity=45%"; Hit description= COG2199: FOG: GGDEF domain
  Pfam annotation: Domain name=AhpC-TSA; Domain location=6-135; Score =175.4; E_value=1.5e-49; Accession=PF00578.11; Description=AhpCTSA family
  Pfam annotation: Domain name=Redoxin; Domain location=5-151; Score =77.9; E_value=3.1e-20; Accession=PF08534.1; Description=Redoxin
  Pfam annotation: Domain name=SCO1-SenC; Domain location=1-137; Score=- 43.3; E_value=0.0012; Accession=PF02630.5; Description=SCO1SenC
  Pfam module annotation: Pfam domain module=AhpC-TSA::Redoxin::SCO1 -SenC; Domain location=6-135::5-151::1-137
MNPLKAGDTAPKFSLPDQDGEQVNLADFQGQRVLVYFYPKAMTPGCTTQACGLRDNMDDLKKAGVEVLGISTDKPEKLSRFVEKELLNFTLLSDEDHQVCEQFGVWGEKTFMGKTYDGIHRISFLIGGDGKVEKAPVFLSCCDAARLIARNRAGQRFLPGDHHAVPSGVFRLIQRIIGLLQNLFLTAVRWLPAGDTNRNGDLPDRINPAAGNAGAHALRNHPRFIRGGGGKQHQKLLAAVAAHHIGLTRALAQRARHLFDHLVANIMPEVIIHPFEVVNIQRQHGKRLLHGIEIVEHRAQAAAIEQAGADHANFTGNALGIHLAGFTRQLPQWQGNQPGQNHRHQQCQQRKRHRILQHLEQQPGERRQRDVCRLERHHHPAGGGHHSVARQLRRALFRQLNFAIAVLLALTIADDARHVFANQLIVLVIQHAVFAIQHINMGAVTIVLLAEQYVENALFLQINSATDVAKIAPIGAPYRPGNKHQQVIGGRNGGPADHRLALRQRFARRLAGELHAFQHQRFRRNGFNHAVAVDNRHRVKAAGLFAQSVHFLLQQFGIIEIFTQLIGAVVQLRLRQLEKHFGGGRQFGGVSAIGFEGAFDQHHALYAPGGVQRISQCNDDTGDRQQRNQRAQISVYPGTLFYCAITGANQLNPAHRKTATVLDNRRLRTDAYSSPAAAASDAAENRAVPAQSSPDRGHANPVPPDATHRAPRRPACRQNAPAPSGAGGRSTLVPPGDADQRWQPAPPDCAAAADPYGQCRSGTADDAAAPASANPAHAPAALPAIAAVRHRRSPTADAVVMLRKRGAQLLAIVVIARHQQERQLQMAQRLAQRLVLFRSAKIHQVAGNHHRIRSRHQLIQRVDHPQQRSVRIHFFIGETAMGLDV

SEQ ID NO: 185919 - protein, 1212 aa, Glycine max
  Coding DNA Sequence Number=SeqID_69141
  Homolog annotation: Hit_ID=Q6D7R3; Match level="QueryCoverage=23%, HitCoverage=98%, E-value=1e-125, Identity=78%"; Hit description =Dihydrodipicolinate synthase
  Pfam annotation: Domain name=DHDPS; Domain location=67-356; Score =519.7; E_value=3.2e-153; Accession=PF00701.12; Description =Dihydrodipicolinate synthetase family
  Pfam annotation: Domain name=Lipoprotein_18; Domain location=346-674; Score=510.7; E_value=1.7e-150; Accession=PF06804.2; Description =NlpBDapX lipoprotein
  Pfam annotation: Domain name=SAICAR_synt; Domain location=696-929; Score=377.3; E_value=2.4e-110; Accession=PF01259.9; Description =SAICAR synthetase
  Pfam annotation: Domain name=Zn_peptidase; Domain location=971-1212; Score=480.5; E_value=2e-141; Accession=PF04228.4; Description =Putative neutral zinc metallopeptidase
  Pfam module annotation: Pfam domain module=DHDPS::Lipoprotein _18::SAICAR_synt::Zn_peptidase; Domain location=67-356::346-674::696 -929::971-1212
  Subcellular localization annotation: CTP_CleavageSite=37; ConfidenceScore=5.32e-01
MAFQLPESSIIKVNSSPSIARRLSSILQPQLLTWRVMVLTIPGRSTPRAVITRWCGCDCGKMAFPPMFTGSIVALITPLNEKGDVCRASLKKLIDYHVASGTAAIVSVGTTGESATLSHEEHGDVVMQTLELADGRIPVIAGTGANATAEGISLTKRFTGTGVVGCLTVTPYYNRPTQEGLYQHFKAIAESTDLPQMLYNVPSRTGCDMLPETVARLAEIKNIIGIKEATGNLSRISQIQQLVGDEFIIVSGDDATALDSMQLGGKGVISVTANIAAREMVELCALAQEGKFAEARRLNQRLMHLHQTLFCEPNPIPVKWAAKQLGLIADDTLRLPMTPLTEAGQAKTAQALIQAACSSDQRYKRQVSGDESYLQAPELHDLKAPAGMILPLQNGDYDVPHSVAKGALGKELDIRPPAQPLALMNGTRAQFTGNTGVLAVDSSRGSIWSQVVNVVQSYKFPVAQRDDAAQQLTTDWVQWNRADEDNQYRGRYQISVQNQGYQQVLTVRLLELQQQGQTVTTPVQVQRYTGQMLNDISTGLDKIDTASQDAAAGRASGQIDVQSGADDTGLPLLVLRSPFNVTWQRLPAALKRMGMEVTDDNRSQGSLKVTYKQPGSSAFDAIGAKDPELPNGDYKLQVGDLDNRSSLQFIDPKGHVLTQAQNDALVAVNDCVRQSSRGETPLNTGSFMFGVNKMQKRAELYRGKAKTVYSTDNPDLLVLEFRNDTSAGDGARIEQFDRKGMVNNKFNHFIMTKLQEAGIPTQMEALLSDNEALVKKLEMVPVECVVRNRAAGSLVKRLGVEEGMLLNPPLFDLFLKDDAKHDPMVNESYCETFGWVSKANLARMQELTFKANEVLSKLFDDAGLILVDFKLEFGLFKGEVTLGDEFSPDGARLWDKETMDKMDKDRFRQSLGGLIEAYEEVAHRLGSSDANLSAHEGRPGWRPFLLSVYGLHAAPCAQSRSAGIALLEQAMRWQGRRESDNVEDRRGDSPGFSSGGRQIRLPRGKGGIILLIVVAVAGYYGYDLTALLEGGAPVSQQQQRQVNSAQDNEAAKFTSVILATTEDTWGKLFQQMGKQYAPPKLVMYRGATRTSCGTGQSAMGPFYCPADQTVYIDLSFYDDMKTKLGAGGDFAQGYVIAHEVGHHVQKLLGIEPKVRQMQQGATQAQVNQLSVKMELQADCFAGVWGHYMQQENILEVGDLQEALNAAEAIGDD

SEQ ID NO: 185920 - protein, 107 aa, Glycine max
  Coding DNA Sequence Number=SeqID_69142
MEQENQFFSLSDPNLILRLSLSMGGSIENTRFGASDDDATKVEDDFVFDIDPSLLVDSRKLLIGELITEHSHSIVYHGWWVIMHELEKDGKGSMRRRVGWLEKMQSS

SEQ ID NO: 185921 - protein, 72 aa, Glycine max
  Coding DNA Sequence Number=SeqID_69143
  Subcellular localization annotation: CTP_CleavageSite=55; ConfidenceScore=5.13e-01
DPATGEPGTESFPRPPFFSARLFALKNTGFYGRSATPGCRRRPWGDLVVPTGEIVHQAVRKGQLDPLPQDPK

SEQ ID NO: 185922 - protein, 100 aa, Glycine max
  Coding DNA Sequence Number=SeqID_69144
  Gene Ontology: Mol. function=protein serine/threonine kinase activity; Cellular component=membrane; Biological process=protein amino acid phosphorylation
  Homolog annotation: Hit_ID=Q0ZCC5; Match level="QueryCoverage=96%, HitCoverage=4%, E-value=5e-23, Identity=56%"; Hit description=CCHC -type integrase
MNYKKKLRGISKSEKALETNLHCFNYKELQRATNGFQKELGRGSFGVVYERVINIGSAIPIAVKKLNNLLFQQVEKEFKNELQVIGLTHHKNLVRLIGYL

SEQ ID NO: 185923 - protein, 72 aa, Glycine max
  Coding DNA Sequence Number=SeqID_69145
MGNLFFKTPKVPFNYLLRRCMSKASEASLTGASSKGGKCAESPPTFIERKMLEKPKETGHEEYSRFGSYLYV

SEQ ID NO: 185924 - protein, 133 aa, Glycine max
  Coding DNA Sequence Number=SeqID_69146
MMAHRNPPYLAFGTPGQNETKNKIQGYERETNQNIHIFLNEHQGMKGMAFEKQHFIQHVQHLTNIQLSFKTRKGKQGSKGLSKELIQGKSIWLEAYKNKIASVISKYACELGSINKNQAKAIVQAINGTKHTK

SEQ ID NO: 185925 - protein, 147 aa, Glycine max
  Coding DNA Sequence Number=SeqID_69147
  Homolog annotation: Hit_ID=Q2HRE1; Match level="QueryCoverage=76%, HitCoverage=39%, E-value=3e-13, Identity=50%"; Hit description =Lipopolysaccharide-modifying protein
  Pfam annotation: Domain name=DUF821; Domain location=1-141; Score= -229.3; E_value=2.9e-07; Accession=PF05686.3; Description=Arabidopsis thaliana protein of unknown function (DUF821)
IGFENHKRGSTNQTCQVNALIDIRCTLKVLLGQSVKNTFCHVTLPLYVYGYMFHLLNSYAKLFRYKPSISANATELCVESMVCGAEGSVKKFMMESLVKVPANTDPCTMPAPFDPPTLYATLQRKESSIQQVESFEKSCWDNQTITS

SEQ ID NO: 185926 - protein, 63 aa, Glycine max
  Coding DNA Sequence Number=SeqID_69148
MGNLITRDPALKLMQTTNITHSTKQPENAQKNIVDSQLTGRKVRPALIPLNVTTRLVATISTL

SEQ ID NO: 185927 - protein, 115 aa, Glycine max
  Coding DNA Sequence Number=SeqID_69149
  Homolog annotation: Hit_ID=Q5MP56; Match level="QueryCoverage=27%, HitCoverage=14%, E-value=4e-08, Identity=87%"; Hit description =Barren stalk1
MVPGGSKMDTVSMLEEAIQYVKFLKTQIWLHQTMINFMDNDNYNINDNNESSSLLYPNNDCCYFPSEHFVSPQQNATFDYSNMQDLQHLQPLAAQCGFQGEDSNYFDASLKYWPA

SEQ ID NO: 185928 - protein, 36 aa, Glycine max
  Coding DNA Sequence Number=SeqID_69150
VMLQKHNAEAHMIQYRNGLHCTARILKTEGVWLIDL

SEQ ID NO: 185929 - protein, 34 aa, Glycine max
  Coding DNA Sequence Number=SeqID_69151
VQGVTPQQPEVGRQRAIGAPPPPLEFTSVHPQKG

SEQ ID NO: 185930 - protein, 67 aa, Glycine max
  Coding DNA Sequence Number=SeqID_69152
MVTSILQLDSMNLFVKARAWFNPITQEMAILIANTSSTIHRDERLGNMHAMYGKFEGENARVTHEQT

SEQ ID NO: 185931 - protein, 121 aa, Glycine max
  Coding DNA Sequence Number=SeqID_69153
  Subcellular localization annotation: CTP_CleavageSite=64; ConfidenceScore=5.52e-01
MAKPSSPANLASAIICFFASKKFPHRLKASPGKVCKAKPFTTPFRHGPCSWIFQSGVVLAEVLLADSRFTRPDMGFHPTKLNFVPSDADEAPLDVSICLHAFGIVGCGSFSGVKSCEREGA

SEQ ID NO: 185932 - protein, 245 aa, Glycine max
  Coding DNA Sequence Number=SeqID_69154
  Homolog annotation: Hit_ID=Q1RXS1; Match level="QueryCoverage=39%, HitCoverage=23%, E-value=6e-09, Identity=35%"; Hit description=Zinc finger, CCHC-type; Peptidase aspartic, catalytic
  Pfam annotation: Domain name=zf-CCHC; Domain location=72-89; Score =22.8; E_value=0.00017; Accession=PF00098.13; Description=Zinc knuckle
DNVEANLVWEIRVEQQLKKKSTSKSYGSHSYPKKDQGQGILGVTPSKPKDDKGKTIEKQAPKASMQEKTSSIKCFKCLGRGHITSQCPTIKTMIIRGQDIYSSQDEATTSPSSSESEEAKWEESSEEIYPQEEGQPLVVKEKCKETLASIATPLGLEFIPQVKKLLDEGLVRKSLNPCALLVPKIAPLIELVRNHVLSWEDAQEMGVEGRSPEYEEPRDLRSNPFQGGGNDVILSPQGHWVEDSK

SEQ ID NO: 185933 - protein, 354 aa, Glycine max
  Coding DNA Sequence Number=SeqID_69155
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=2e-26, Identity=28%"; Hit description= UPI00006A17C9 related cluster
IQFLTLEGSHALTVERASRPRHQRIACPHPQRTARAHLQRTARPHPQRTARPHLQSTARPHPQRAARPHLQKTTCPRLESATRPRLGGLHVLTIRGLHALTSRGLHVLALGTSYPHLQRTTRPRLERTTRPHHQRAARPHHQRTARPRLRLHALAIRGLNVLTFVGIHALTVERASRPRHQRTACPHPQRTARPHPQRTARPHLQRTARPHPQRTARPHLQRTARPHPQRAAHPHLQRTTCPRLERATRPRLGGLHVLALRGLHVLTIRGLHALTSRGLHVLALGTSYPHLQRTTHPRLERTTRPHHQRAARPHHQRTARPRLRRATCPHIRGLHVLTFRRLRVLILEDYTPSP

SEQ ID NO: 185934 - protein, 196 aa, Glycine max
  Coding DNA Sequence Number=SeqID_69156
  Homolog annotation: Hit_ID=Q1T1F7; Match level="QueryCoverage=57%, HitCoverage=24%, E-value=3e-10, Identity=33%"; Hit description=IMP dehydrogenase/GMP reductase
MGKAHMTGIKGAPYRRRLDALTVIDVCWMPYGEHRGVRAFDLISSFTRQLRWGQIVVYVRLERVLRQFGYLQTVPPPPVCDSLMGDDIDDRWLHFSDHLVPSGELCVVPGHYMEWFFQISHPFVTWIEETIAPRHPFVSVATDLPTHSVVHCEGCQGMAQDLGAIAEDLERVINLRMVTEGTDLHDIMTRCLRRAR

SEQ ID NO: 185935 - protein, 198 aa, Glycine max
  Coding DNA Sequence Number=SeqID_69157
  Gene Ontology: Mol. function=serine-type endopeptidase inhibitor activity; Cellular component=cellular_component; Biological process =biological_process
  Homolog annotation: Hit_ID=P01070; Match level="QueryCoverage=92%, HitCoverage=93%, E-value=2e-43, Identity=50%"; Hit description =Trypsin inhibitor A precursor
  Pfam annotation: Domain name=Kunitz_legume; Domain location=27-182; Score=153.6; E_value=5.3e-43; Accession=PF00197.9; Description =Trypsin and protease inhibitor
MKSPTIFILFLLSAFYTSLLPSATAQVVVDMEVIESSYGGIRVAATGKERCPLTVVQSADPYDKGIATIISTPYRVPVIREGFPLNITFGNFAVILPCVPLRSEWTVVNGQPEGPAVKIGSPPNAENGWFEIEKLLTSGYKLVFCTRPERSYCQDIGIHVDDENHARLVLTNDDPLVVEFLKYDPFWPQNNLVLPTSQ

SEQ ID NO: 185936 - protein, 109 aa, Glycine max
  Coding DNA Sequence Number=SeqID_69158
MLLNVNHYEAPVAELVEMNRNITVFLNPVSLTASPPSGYSAAVYYYSLQNLVCSSIFKRVAISPSVSTKSPAVAEDHYSHLCKLRIMNLEHIKLRIEGEMVCKGKNIGR

SEQ ID NO: 185937 - protein, 101 aa, Glycine max
  Coding DNA Sequence Number=SeqID_69159
IGARPTTQYDPRRFHSLDAWSRYTDNIFGSSILPERKVEIYHTEFDDFKTELERCNLHKCLTNLADGTILCIPNPQGHWIEDSKKIGLEMQETTLRFSRDL

SEQ ID NO: 185938 - protein, 71 aa, Glycine max
  Coding DNA Sequence Number=SeqID_69160
MSRNFTDYATILSLTFGMLQNFTDCAIMLPFDSRNVTELHRLPNNGCQVPRSGSSEGCIPPNRWSPDEIRV

SEQ ID NO: 185939 - protein, 57 aa, Glycine max
  Coding DNA Sequence Number=SeqID_69161
MAQQTKNKLKRLLKRLALTDPLKLLQEHNKVKGNFTKEKKHRVFTMLKLNMRYPSHV

SEQ ID NO: 185940 - protein, 101 aa, Glycine max
  Coding DNA Sequence Number=SeqID_69162
MSVRKDDRLRFKAPPDDANRTFPNRHYPHNIQGFNRKYNSRHREKISHPRTKNYDSPLLIKRNASRRRSGKMTDRGLEKKHHRMTPIEQFPIDIIQIIFRD

SEQ ID NO: 185941 - protein, 161 aa, Glycine max
  Coding DNA Sequence Number=SeqID_69163
MEESSGFPVLFGGENSNPPDDGGKDKILGLQLSARLQNNGLKDKIFLGLELIARLQHRTRGLRHLTRIHGVDLTNETQDTCPKRSIKKEIYEEVLGISYSTVSQSEKVVAHDLKEPHSGAIKTMSASRKLNTGEKTVLSWMIETGTILQHEKVHAKMTQQY

SEQ ID NO: 185942 - protein, 121 aa, Glycine max
  Coding DNA Sequence Number=SeqID_69164
MDGNQSPTYGSQAHSHLDNTLAIAAYFCLLHSIIMKIECWECEMSLKCQRFLPIDWQGGKDCRREGVLDDLVDMCRNVPFGRRATRGLTGASSKKGKCTESPPTFIRGKRRKNWKDVVYKL

SEQ ID NO: 185943 - protein, 118 aa, Glycine max
  Coding DNA Sequence Number=SeqID_69165
MCFDFLRIQSFTLVFKYNSKDLVQWWFGRAYLMKVVVWTNKYGEWDVGGGPGVVLESRSGEEEASGAAVVVWASKSDEQEAGGGVVVVYMNISAKWEVGGGTMVVLVSGSNEGRSVRV

SEQ ID NO: 185944 - protein, 156 aa, Glycine max
  Coding DNA Sequence Number=SeqID_69166
YIYVWDRGCHRLRLGRCCTCAHCWIYEHFPFVGSAIPAENFDDGRPCACRWTYGKALPISTYRRRLDRLTLDVTILPHPAVSSLSAEEIDDSWMQFSEYIAPVGKLCVVLGHCSPNYMDWFYMISHPFMSPAQLGDPHSVPPIRQYEDFVEANVYQ

SEQ ID NO: 185945 - protein, 180 aa, Glycine max
  Coding DNA Sequence Number=SeqID_69167
MEAHLGLPEGSKRRRCLLVEATLLAWASWAATSSLFLPINRGKRAELKGLAHLTTPFWFFRRFPQINVGGDSARLPPLEDAPVSLTSPSRRMGPIAFNHEEYNGSLPTLILRPQSWTKEKKTRRVNSSTTVNNTPVVIDLTFLRRAFQPPTLTFPKTTTGVIYTDVEMLNNNNRCHRHRR

SEQ ID NO: 185946 - protein, 189 aa, Glycine max
  Coding DNA Sequence Number=SeqID_69168
  Gene Ontology: Mol. function=protein kinase activity; Biological process=protein amino acid phosphorylation
  Homolog annotation: Hit_ID=Q2QZ78; Match level="QueryCoverage=97%, HitCoverage=38%, E-value=2e-40, Identity=46%"; Hit description=AT hook motif-containing protein, putative
MPYLEGANPASCLENSLILSELNYNNDEARSEFENLFLSMTGTGKTYIWRTLASSLRAKNQIVIMVASSGIASLLLPGGKTAHSKFKIPVSIFKDSTCNILQGSQLAELLNQTNLIIWDEAPMAHKFFFDALDQTLRDIIKEKKSQSNFWRQSYCIWWRFLTNFASHSKRKSFRHYKCNNQFIISAALL

SEQ ID NO: 185947 - protein, 332 aa, Glycine max
  Coding DNA Sequence Number=SeqID_69169
  Gene Ontology: Mol. function=nucleic acid binding
  Homolog annotation: Hit_ID=Q1T493; Match level="QueryCoverage=73%, HitCoverage=46%, E-value=5e-36, Identity=34%"; Hit description =Nucleic acid-binding, OB-fold, subgroup
  Pfam annotation: Domain name=DUF223; Domain location=108-203; Score= -15.2; E_value=0.075; Accession=PF02721.5; Description=Domain of unknown function DUF223
MSLVVVVSFLFVSQFGLALLFGWFLFLKFSFAEVDWEKLSFSLVDNFVLQFSFAKLDPEKLRVCDYKVMARVADKIKLIDGSRETLKLSVRITDLWFIGILGKTEQAEMVVVDSDGDEIHVVCKQDQLKSRKADLKENLTYVMHNFKVIKNDGKFRVCDHEYKLYFIGVTVVSLCDMEQLPFRKFRFVDFSSVIAGHFKIGLLVDVIGVIDEVVFRYVSSKNTRVVLNLKDLSGQVLSYTLWENYCLQFLSYLNDIEDERPIVILLTHARIKEAQGSYLASVSNSFKASKLMINDLVLEIQEFRESLLDLGIEVRSILAPIGQRSSQVSGSS

SEQ ID NO: 185948 - protein, 91 aa, Glycine max
  Coding DNA Sequence Number=SeqID_69170
MDCYPTDRIILQNNDDSQIRTEFYVPNPAFQKEEDLVEDNLALEQDLEDYNAQLMEELLHKKRYPYYHPMYGSLTRSEVQQYNLSLSTRSD

SEQ ID NO: 185949 - protein, 124 aa, Glycine max
  Coding DNA Sequence Number=SeqID_69171
  Subcellular localization annotation: CTP_CleavageSite=35; ConfidenceScore=5.27e-01
MKRNCYLDLRFRPSSASSPHDSIKNKRSLFLAFVVSMSKKVVAIPQSRRHMLDVTELQARVILWLASQEREGNTGPASATSLSLQSQALLMHAPQGSSVKRSLRNFLQKRKKRFQKSHPHCFSQ

SEQ ID NO: 185950 - protein, 73 aa, Glycine max
  Coding DNA Sequence Number=SeqID_69172
MKNKKVAAVGVSLSETYALSEQYPLSETSARLVSEENLPCMHALSTPSARPAKLDRAGLDNCMSGHGVQGFSF

SEQ ID NO: 185951 - protein, 88 aa, Glycine max
  Coding DNA Sequence Number=SeqID_69173
MDAPSSKVAPTQQHPLFILIAPKATDYGHQALPLTKDDVYNVGMIMMQCGLTNQWPSYPPGLHIRHTASINFRPDRIAPRLPPLDLRK

SEQ ID NO: 185952 - protein, 125 aa, Glycine max
  Coding DNA Sequence Number=SeqID_69174
MDFKYLSEYDTMVDILPNALVLHHFGSKAVEENLGHQHFGVFKEVMDAIQQEMGIDDIANAFQRVDVEEMLDMNSWFLVFHCDFGSENSHRCRPSNLNKGTFLRWRERLGCKEVSERESVKRLHK

SEQ ID NO: 185953 - protein, 105 aa, Glycine max
  Coding DNA Sequence Number=SeqID_69175
MESVFALMYCDGDMVPSYEGIMFECPSDPKVITINKVMSLVALRKIIFDANKGCAEYNCMELKRDDDVGKMFFIYSEFSTEGPIELNAIFGHSPDETIALMRQLL

SEQ ID NO: 185954 - protein, 270 aa, Glycine max
  Coding DNA Sequence Number=SeqID_69176
  Gene Ontology: Mol. function=RNA-directed DNA polymerase activity; Biological process=RNA-dependent DNA replication
MGDKWCIVGDFNPVRTMEEMRDQEHTSRVDLIDSLRQVSGFKGHKPFKVLNYCILEQGLRRKRKTCGTHDVQGRATYVLKEKLKLLKKDLKKWNLENFGNLEKQSKGIGNTNFFHNIINWRRRKNDIKGLHIEGHWIEDPIKVKRGILEFFDKKFQQPYFEIPTLDGVPFNQIGKEDNVTLCWRFSEIEVKEIVRECGGDISLRLDGINFNFMKKCWNTLKGDVMGRNMLDSVLVASEVMDDVKRRKQSYPVFKVDFEKAYDCVRWNFLL

SEQ ID NO: 185955 - protein, 99 aa, Glycine max
  Coding DNA Sequence Number=SeqID_69177
MGERSNVSECWEEDGFCKDGSLVTVKLEIKGISVNNSASPEVWQETKLHENGNDEEIKGVEGEKKVEFDMEKRERWLMMTKKMHINRVRMGTKPWLAEM

SEQ ID NO: 185956 - protein, 509 aa, Glycine max
  Coding DNA Sequence Number=SeqID_69178
  Gene Ontology: Mol. function=RNA-directed DNA polymerase activity; Cellular component=chromatin; Biological process=RNA-dependent DNA replication
MVRSTHLKSNLDRREDAIAKLTTTQLLMSTKLDDLFQKLAVMESTQHSLVSFAVHPASPSLPIPPYWMKLEVLRFDGFDPIGWLLKINQFFDYHATPKNEWLMIASFYMDGSTLACQTQVDVPSTCTTKDVPSNVLRQSSQAVKPLKLCEWGYKRILRREKGDTKEFRRLVLRSFGKGRRETQKEFRRLVLGEFFLAKGEENEKMNSTSFQGLENQKTLESFWHKEEEEVQRDSRLELAMYREKRLCFSCDDKFSRGHRCSAKIFLLIAYDDNISWEEIPPDDAFLVAKEHDDQSLAQISFHAIYGHLAPETLRLVSSVSDKKVLILVDGGSTHNFIQEHLVTTLDLYVQSTQPLHVMVGNGNEIACKLGPWCSMAQVLGSSFNELYRLDYEVHAPRASHQTQGQTPYRYPHFEKQEIEVQVEAMLRSQSPFSSLALLVKKRDKSWCFCVDYRALNAITIKYCFPIPIIDEFLDELGGARWFTKLDLLQGYHEILMREEDMHKIAFCTH

SEQ ID NO: 185957 - protein, 347 aa, Glycine max
  Coding DNA Sequence Number=SeqID_69179
  Gene Ontology: Mol. function=chromatin binding; Cellular component =chromatin; Biological process=chromatin assembly or disassembly
  Homolog annotation: Hit_ID=Q1SAV4; Match level="QueryCoverage=83%, HitCoverage=99%, E-value=3e-61, Identity=37%"; Hit description =Integrase, catalytic region
MEIVLAGRFLLYTHCSIRNDVHRFVGQCLDCQHTKYVTKKPAGLLEPLPLPTRLWEDLSLDFIVRLSLYQGNTTILVVVDKFSKVIHLGLLPTQYSIYQVANLFLDIVAKHHDTPKSLTYHPQSDGQTKVMNDIIEQYLRAFVHHKPSTWETTNDPSVYHGLFCSGSSRYFAVIMGAVFDSLHRKILKAQAKMKHFVDNNRREVSFQEGDWVLVKLRPYYQSSVTRPNPTKLTKCYYGPFKVLDRIGTVATSSFFSKDLIFIMSSIGPKDALCLQVLVQWAGLHVDYTSWEDWVFLKEDYHLKDKVVFDGSGSDRPSKMQEAQNERSKRKSSSMFPRLRLVIGVAGT

SEQ ID NO: 185958 - protein, 58 aa, Glycine max
  Coding DNA Sequence Number=SeqID_69180
MDAMKNEMKFMQDNDALDLIELLEGVKNIGCKWILKTKKDSKGIKILRDRSQGILRLS

SEQ ID NO: 185959 - protein, 125 aa, Glycine max
  Coding DNA Sequence Number=SeqID_69181
MTRQTTHWQVRSLSLGKIIGRPVRVTLFCENAPTMWDRHKLKEALKLGDPQGLHSEESIRDLSFNSSPLKGLSINSSPLKGLSINSLPLKGLSINSSPLKGLSINSLPLKGLGINSSPLKGLIVV

SEQ ID NO: 185960 - protein, 70 aa, Glycine max
  Coding DNA Sequence Number=SeqID_69182
MPTSSRRLDGSSPESYTLYPAAVILLPWTMFAIITGDQPRAQRSSLPGDKPPQYKVHSATVILFPVSYEL

SEQ ID NO: 185961 - protein, 126 aa, Glycine max
  Coding DNA Sequence Number=SeqID_69183
MAVSKLRMMQRVPLSVGFQRRTMEVCGGYWWLWVMEKELGMKRYSHARRRIEDRNGQIVDKCPVKRQTKFQEDPMVNEGWALFLPRQLHVDSLRNFIKRLPRGFFEKLFSRGFFEKLDPYLPIPLY

SEQ ID NO: 185962 - protein, 118 aa, Glycine max
  Coding DNA Sequence Number=SeqID_69184
  Gene Ontology: Mol. function=protein-tyrosine kinase activity; Cellular component=cellulose and pectin-containing cell wall; Biological process=protein amino acid phosphorylation
  Homolog annotation: Hit_ID=Q9LVM0; Match level="QueryCoverage=54%, HitCoverage=9%, E-value=2e-24, Identity=80%"; Hit description =Receptor-like protein kinase
MASIGRAPTEKDQKLKEDFGSGVQEPERNKLVFFEGCSYNFDLEDLLRASAEVLGKGNYGTTYKAILEDGTAMVVKRKIEGENEGMSTPGSRTVRQPRVVVQTTSDIDILDDGYRWRS

SEQ ID NO: 185963 - protein, 80 aa, Glycine max
  Coding DNA Sequence Number=SeqID_69185
MMKSEKMGLTEKKEEDMGHGAEKGKQHSRREQKGHGGERDDGHNQSVTAETGSGMMAMMALVVDTGSRMMAVTALAANMG

SEQ ID NO: 185964 - protein, 92 aa, Glycine max
  Coding DNA Sequence Number=SeqID_69186
MLKNGRESSHNYSRKRYGSASALDFLHGNNFTQQFRENKKCYEGRTPFFFTPPPIYSKIGEELATQLAQANKVASSKSNSLLEEESGRPKWT

SEQ ID NO: 185965 - protein, 105 aa, Glycine max
  Coding DNA Sequence Number=SeqID_69187
MEKDASHEDSTTITFRRHVSPLRDTCRHVMVDCDTMMWKQSYHDDSPRCFDDAKVQRVVSRLENQAFKIPLKDSRIKRRNQEASSHVKVGSKNYFSKTSNSTLFV

SEQ ID NO: 185966 - protein, 355 aa, Glycine max
  Coding DNA Sequence Number=SeqID_69188
  Homolog annotation: Hit_ID=Q1SAJ3; Match level="QueryCoverage=19%, HitCoverage=16%, E-value=5e-22, Identity=69%"; Hit description=WD-40 repeat
  Subcellular localization annotation: CTP_CleavageSite=70; ConfidenceScore=5.07e-01
MLQPYGISIGLKEHSNPMTPKAYTPKSPSGPLPPDSGSRVFQQQQRHLYRSPEIPPVFPPTALIEFPNVRETEKGLKPPLNSRNWAANVVLKFHDDPTVNESEIVVLLRQLLPPSPSSSVHCVHGEGACSRAWYAGAGAGCRVAFAWCHCSSRVVVPTCAAHPFCMRKSGYLDKSGMLFVVREIILPSVRELRPLGIVRCKPSKFCKLGTVSRGEIPYISDKIPRFNHSAQARNGKDIQGIPWEMLNISRERYKLTRLEQYRNFEDILTSGDVVGKQMEKGGNYYEFFYHRRMVKPTVATYPSTGGRRETQGSVFQQKKRAGVATNVYSRKMLEKPKGGLRILRIKVRELFTCGE

SEQ ID NO: 185967 - protein, 185 aa, Glycine max
  Coding DNA Sequence Number=SeqID_69189
MPHHNLADFEPCLGYATEWQAVGGIPMPNTLEDPQFRPQPHPSHSTAIKSPHAMAEMGKLDHLEERLRAIEGGKDYAFANLEELFRVPNIITPPKFKVLDFDKYKGTTCPKNHLKMYCRKMGAYTKDEELLIHSFQESLTGVAVTWYTNLEPSRVHSWKDLMVAFVRQCQYNSDMAPDRMQLQNM

SEQ ID NO: 185968 - protein, 347 aa, Glycine max
  Coding DNA Sequence Number=SeqID_69190
  Gene Ontology: Mol. function=transferase activity; Cellular component= membrane; Biological process=metabolic process
  Homolog annotation: Hit_ID=Q9FFN2; Match level="QueryCoverage=92%, HitCoverage=76%, E-value=1e-106, Identity=58%"; Hit description =Similarity to limonene cyclase
  Pfam annotation: Domain name=Exostosin; Domain location=85-346; Score= 225.6; E_value=1.1e-64; Accession=PF03016.6; Description=Exostosin family
MACRGESNFVNKMLIEKQIEDDRKLEKVEASLAKARALIKEALLLRTNATVLQDDTSDYIPEGDIYRNAVAFHRSYQLMEKVFKIFVYEEGEPPLFHYGPCKNIYSMEGIFINSLEINSQFRTQNPDEAHVYFLPFSVVMILEHLFHPVIRDKAVLERTIGDYVHIISHKYKYWNRSYGADHFMLSCHDWGPRATWYVKELYFIAIRVLCNANISEHFNPKKDASFPEINLVNGETRGLIGGYPPCNRTILAFFAGQMHGRIRPVLFQHWEGKDKDVLVYEKLPDGVPYHETMKKSKYCICPSGFEVASPRIVEAIYAQCVPVIISQQYVLPFSDVLNWDSFSVQIL

SEQ ID NO: 185969 - protein, 121 aa, Glycine max
  Coding DNA Sequence Number=SeqID_69191
MTFTKCTHTLLKHHQASQRPIMECTKRERVLKNTNADLQKVKRVDLDLVNTDKVLTWQSNHHPKWQGSERPDPTHNYATGLENPACLTQKTAQPKGNHHGGWCPAPGTISARFSDARPPQG

SEQ ID NO: 185970 - protein, 105 aa, Glycine max
  Coding DNA Sequence Number=SeqID_69192
RSFLISAVVVVSFGYRKERDGSWVKKGAQPNDDEGQLPVEGDSSLLQSILERFDGLQTYVGERFDALEQQVDTRFDEMDSRITKVEEDFTIIRDYLNLPPPPLSV

SEQ ID NO: 185971 - protein, 130 aa, Glycine max
  Coding DNA Sequence Number=SeqID_69193
MYQLLDSGFIGLIFSCYSEDVNKVGRIQVIAFQSSDGKHNHMSRPVPLSPVNRSPVIDIDSSPSSSENVSTRPGYFKAENAEQDTGDSRSVVVSKFVSREFCRRLCVFGKLHDGCYSILYLTSLTIGVLS

SEQ ID NO: 185972 - protein, 113 aa, Glycine max
  Coding DNA Sequence Number=SeqID_69194
  Subcellular localization annotation: CTP_CleavageSite=42; ConfidenceScore=5.52e-01
MYTGSVTSRTYVQSSTSEHSRDPFSMCSGNSQFKRQQSLDLNKSLKKTRPLSPSPSLSLSHDLPHPQRLINKEIFRVLLQKLILHPKDLSTIFIARSVQDQILSTRSLFKILH

SEQ ID NO: 185973 - protein, 50 aa, Glycine max
  Coding DNA Sequence Number=SeqID_69195
MAIYRKIHLGQGKLTQASYLLRAEAEEYMPRGFQIGGAKRKSDRALVTLN

SEQ ID NO: 185974 - protein, 78 aa, Glycine max
  Coding DNA Sequence Number=SeqID_69196
  Subcellular localization annotation: CTP_CleavageSite=59; ConfidenceScore=5.41e-01
MVIVVRWNSDDSVLKSKPTNSTTTRKSGRWQRRRQRRWRRQNDGDDGHSSGGTMVVEVTLVMVVATGGGGNDNNVGLE

SEQ ID NO: 185975 - protein, 78 aa, Glycine max
  Coding DNA Sequence Number=SeqID_69197
MNSLSEHVMLNEFINTHCMLALSEELAKRTYRAKRVHLLRMNTYPLPELPMESRKRARMEDIPSSSTPAPSSITGGQD

SEQ ID NO: 185976 - protein, 516 aa, Glycine max
  Coding DNA Sequence Number=SeqID_69198
  Gene Ontology: Mol. function=pseudouridine synthase activity; Biological process=RNA processing
  Homolog annotation: Hit_ID=Q1SBD2; Match level="QueryCoverage=87%, HitCoverage=94%, E-value=0.0, Identity=73%"; Hit description =Pseudouridine synthase
  Pfam annotation: Domain name=PseudoU_synth_2; Domain location=225 -394; Score=17.8; E_value=8e-08; Accession=PF00849.12; Description =RNA pseudouridylate synthase
  Subcellular localization annotation: CTP_CleavageSite=50; ConfidenceScore=5.59e-01
MTSVAMTVASMLFSGSCRSLAMPAAARAVRISRAALVNNRNKHPPSWCCRSSHNSNTALAGEAEFLTTDAGILNATSSSDSFRKYDRLLPCPSHKTPPRIEHLVVSEGGPVLEHICKALDLPPLYVSDLIQFGAVYYALVCPQPPPNATEEQIRVFKEVTEPSVLRKRASIKGKTVREAQKTFRVTHVDQFVEPGTYLRVHVHPKRSPRCYEIDWRSRIITVAESYVVLDKPAGTSVGGTTDNIEESCATFATRALGMTTPLMTTHQIDNCTEGCVVLARTKEYCSVFHGKIREKKVKKFYLALAAFPLPTGIITHYMRPIDMAPRLISEDFIKGWHLCQLEVLECRKVPWPATAIQDKYCIEDCGWPSQDYAYECKINLLTGKTHQIRAQFAAYKAPLIGDSMYMPAAIANMSNPGLNPFGKYKKDFSSESEKETAVVNWIAQHGKEPSVAIGLQAYADIQKVEEWSRITVCWFLLLWHRNAIFSCCRGEGNENIAGLKRETQINGKEEELHIGI

SEQ ID NO: 185977 - protein, 174 aa, Glycine max
  Coding DNA Sequence Number=SeqID_69199
GVSLKAESQYFATVNDDNPRLCKWIDSNLDVQTDDFIFTLVGLKKLAYQNEPFIMAEQANRVFYVQDPCDERHMVTPPSSLPLESTYSPSMSKRTTKATQLRSLSAKLVEVERPLVHVDPTTRKADGSCNLEGFDLGGHSERKEDNDDKVYEKYKIGKEKWNQFCQSHKDPSWE

SEQ ID NO: 185978 - protein, 172 aa, Glycine max
  Coding DNA Sequence Number=SeqID_69200
  Gene Ontology: Mol. function=transition metal ion binding; Cellular component=chromatin; Biological process=proteolysis
  Pfam annotation: Domain name=Transposase_21; Domain location=1-118; Score=-42.6; E_value=5.7e-11; Accession=PF02992.5; Description =Transposase family tnp2
PRQPGNDIDVYLSPLIEDLRKLWDKGVDVFDGNRYETFKLRAMIFCTINDFPAYGNLNGYNIKGHHACPIYEEDISYVQVLEHVENINSIFGNTQKKLTSKTYIWKKRLIFFDLAYWSDLDVRHCIDVMHVEKYMCDSSISTLLNILGKTKDGLNTHQDLAEMDIHDQLHPR

SEQ ID NO: 185979 - protein, 99 aa, Glycine max
  Coding DNA Sequence Number=SeqID_69201
NLGYEGYKYTWSNKSKYPETVEQRLDRYMATDILKRKKTKRYKFEKVWLNDVEACQADTKGSWCKDEELDKLLKLEEEVWLQRSRDIWLEGEIETQILP

SEQ ID NO: 185980 - protein, 51 aa, Glycine max
  Coding DNA Sequence Number=SeqID_69202
  Subcellular localization annotation: CTP_CleavageSite=13; ConfidenceScore=5.09e-01
MNPRLLAVASSSKCSKIMSLRLAPLSCLARVCGFGLGANVALSLARGRRLA

SEQ ID NO: 185981 - protein, 296 aa, Glycine max
  Coding DNA Sequence Number=SeqID_69203
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-39, Identity=36%"; Hit description= UPI00006A17C9 related cluster
MSSPSEEYISSPPEDYTSSPQEDYTSSPPEDYTSSPSKDYTSSPSEDYTPSPSEDYMSSPLEEYMSSPSKDYTSSPLEDFTFSPSEEYTSSPLELYALTFRGLHALAFRGLHVLPFRGVHFLTFRGIHVHAFRGLHVLTFRGLHILTFRGLHTVTFRGLHVLTFRGLHALTFRELHVLAFRGLHVLAFRELHALTFSGLHVLAIRGLHGLTFRGLHALTIKGLHTHPFRGLHTLAFRGVHTLAFRGLHVLAFRALDALTFRGLHVLPFRGLHVLAFRGLHALAFRGLHVLPFRGLQ

SEQ ID NO: 185982 - protein, 78 aa, Glycine max
  Coding DNA Sequence Number=SeqID_69204
  Subcellular localization annotation: CTP_CleavageSite=22; ConfidenceScore=5.01e-01
MFIRITTWVFPPVNVTQMLFVLQTAKKNVYTDNHSGISARQRDSNVSMTDLVSAEDDVNLRVSTGLSAAIDEGCRRRH

SEQ ID NO: 185983 - protein, 98 aa, Glycine max
  Coding DNA Sequence Number=SeqID_69205
  Gene Ontology: Mol. function=transporter activity; Cellular component= membrane; Biological process=transport
  Homolog annotation: Hit_ID=Q56R06; Match level="QueryCoverage=60%, HitCoverage=11%, E-value=2e-16, Identity=65%"; Hit description =Putative permease I
MDVWSFADDKFMIRVPYPFQWGPLSFSADVIFAIVAASLVAIVESTGTFIAAWRLSKATPIPPSVLGRGVGWLVMTKSSKIKNEFKIESSFKIQASKN

SEQ ID NO: 185984 - protein, 82 aa, Glycine max
  Coding DNA Sequence Number=SeqID_69206
MGKAKEAAVVAGALAFTWLLIELAFKPFLTKARASIDNSDPSRDPDDDALPKTTINDVPNVADSKPAGDVPTAVDTITTDPV

SEQ ID NO: 185985 - protein, 79 aa, Glycine max
  Coding DNA Sequence Number=SeqID_69207
  Gene Ontology: Mol. function=DNA binding; Cellular component=nucleus; Biological process=regulation of transcription
  Homolog annotation: Hit_ID=Q0PJD8; Match level="QueryCoverage=81%, HitCoverage=20%, E-value=3e-10, Identity=52%"; Hit description=MYB transcription factor MYB187
MMMSALGLLTFLGVFKKGAREAESTEIGRNKGMRSKMFLNQCLEASGKEGFKQIFTWPKNHLVKHSHQTRHHHNHHQPC

SEQ ID NO: 185986 - protein, 112 aa, Glycine max
  Coding DNA Sequence Number=SeqID_69208
FAMHKLQWLSARKNPEEDELSSLLSAPLQDIKCTTSAHPLSETSALSQNPLMRAKRSRSALSTKARTRPHPRGKGDILTTCVFAVFHFVLLFVGKEVFRLWKAKSSVGSSLE

SEQ ID NO: 185987 - protein, 121 aa, Glycine max
  Coding DNA Sequence Number=SeqID_69209
MKAKGNQKWLEGARTASLRVARPVKETANTKDTGLPCSDVLCLFSAGKGQRSVGRNPIPTCIRPYVPVSRKQKIQWLIVSGHRLASVDFRSRLVSTSNRDLRRPCPCYHKICMCMCMYECS

SEQ ID NO: 185988 - protein, 128 aa, Glycine max
  Coding DNA Sequence Number=SeqID_69210
MPEHCTRQVTTGKLEEAVKSLSQDNSTLNNKINTIHASLTAKIEALFDRFATITVNSPPPPPPTPLHASPAPHRHHMKLEVPRFDRHDPLVWIFKISQFFYYQGIPDHERLTVASFYMEGPALSWYQW

SEQ ID NO: 185989 - protein, 74 aa, Glycine max
  Coding DNA Sequence Number=SeqID_69211
  Subcellular localization annotation: CTP_CleavageSite=49; ConfidenceScore=5.14e-01
MEADYKLLSLAHQWAKRTSTTKCSFNALSAIEESGRASSSRLFAKREISARSAAVVFSQAKHTTGPKLKSTYSH

SEQ ID NO: 185990 - protein, 104 aa, Glycine max
  Coding DNA Sequence Number=SeqID_69212
  Subcellular localization annotation: CTP_CleavageSite=33; ConfidenceScore=5.29e-01
MPLKAGVTQGLSGKQRAALPGTSQPVGSLFRVTVMAQPPYHPDMQNALTMKKILQQWLARLAASKAATPDGREFDPGEHIDLLIPISQLYGVEFHPSVYRYYER

SEQ ID NO: 185991 - protein, 353 aa, Glycine max
  Coding DNA Sequence Number=SeqID_69213
  Gene Ontology: Mol. function=electron carrier activity; Cellular component=integral to membrane; Biological process=cytochrome complex assembly
  Homolog annotation: Hit_ID=Q3KEH4; Match level="QueryCoverage=99%, HitCoverage=88%, E-value=2e-77, Identity=42%"; Hit description =Cytochrome c biogenesis protein, transmembrane region precursor
  Pfam annotation: Domain name=AhpC-TSA; Domain location=206-330; Score= 24.8; E_value=4.3e-06; Accession=PF00578.11; Description=AhpCTSA family
  Pfam annotation: Domain name=DsbD; Domain location=3-165; Score= -65.4; E_value=0.02; Accession=PF02683.6; Description=Cytochrome C biogenesis protein transmembrane region
  Pfam annotation: Domain name=Redoxin; Domain location=205-347; Score =27.2; E_value=3.9e-05; Accession=PF08534.1; Description=Redoxin
  Pfam module annotation: Pfam domain module=AhpC-TSA::DsbD::Redoxin; Domain location=206-330::3-165::205-347
  Subcellular localization annotation: CTP_CleavageSite=72; ConfidenceScore=5.13e-01
MVLMFTLVALLVSLTSHWVSQVTSIGRDLALLFLAIAALTLISTRIAQRVTRPFVALGNRLNDASQRRSGVLAALLAGLATGLLWSPCAEPELGAILSLAVVGDHPLSDGVLLLAYGSGAALMLALLYFAGRSLVARLRPGLAMSARLLQAAGELMLASLGVIVTGSQSQLQAAPAFALKLEQQLSQWLTTPAPKVRLEPVSLPQASSALPSLEGGTAWLNGAPVTPATLKGKVVLVDFWTWDCINCQHTLPYVRDWASKYQRDGLVVVGVHTPEYPWERDEKVLKRAITRWQLPYTVVADNNYSIWNRFGNQYWPAHYIFDAHGQLRYTAFGEGNYEEQERVIQQLLKEARA

SEQ ID NO: 185992 - protein, 115 aa, Glycine max
  Coding DNA Sequence Number=SeqID_69214
  Subcellular localization annotation: CTP_CleavageSite=27; ConfidenceScore=5.09e-01
MLLSSNVIYICVRVVMLVRMVRTLLFAAARVKSCPSMHSSCVIASLSGCARTVGPPPISGGGPGTVKRKLLARACSPLKFRTCRLSKARECSPMMARTCNPLKVRACPPLKMGNM

SEQ ID NO: 185993 - protein, 1030 aa, Glycine max
  Coding DNA Sequence Number=SeqID_69215
  Gene Ontology: Mol. function=RNA-directed DNA polymerase activity; Cellular component=chromatin; Biological process=chromatin assembly or disassembly
  Pfam annotation: Domain name=Chromo; Domain location=737-791; Score =17.0; E_value=0.0097; Accession=PF00385.14; Description='chromo' (CHRromatin Organisation MOdifier
  Pfam annotation: Domain name=rve; Domain location=448-587; Score =58.0; E_value=3.2e-14; Accession=PF00665.16; Description=Integrase core domain
  Pfam annotation: Domain name=zf-H2C2; Domain location=395-430; Score =5.0; E_value=0.08; Accession=PF09337.1; Description=His(2)-Cys(2) zinc finger
  Pfam module annotation: Pfam domain module=Chromo::RVT_1::rve::zf -H2C2; Domain location=737-791::167-378::448-587::395-430
SFTVDFYVLPIAGANVILGVQWLRSLGPVLTDYTNLRMQFFYDGRLVELQGDPEAHRSMLSSPQFRRLCRHQQNLCFHITVLPEEPEHKIPDDIDPAVHHLLHQFSALFQDPNTLPPARDTDHNIHLLPQATPVNVRPYKYPYYQKREIETQVEAMFQKGIIQPSTSPFSSLVLLVKKSDGTWRFCVDYRALNALTIKDRFPIPTIDELLDELGGARCFSKLDLLQGYHQIHMQPPDIPKTAFRTHHVHFEFKVMPFGLSSPSVITSITCRPLELHYSQRLPQRLPQLHYSHGPLELERINDTADALSRLPEIDSQACLILSVPCLTFMTELHSQLHSNSTFQQQMKKVQDHPDQFPDFSIADKLLLYKGRIWLPKGLPIITTLLHEFHTTPIGEHAGIAKTIARLMHNFYWPDLQDDVSHFVTNCVDYQVTKYETKKSTGLLCPLPVPSRPWEDLSLDFIGGLPPYHGNSVLLVVVDRFSKGIHLDLVVKIHGILRSLVSDRDPLFISHLWQELFRSSGTQLRMSSAYHPQSDRQTEVLNRVIEQYLRAFVHRKPTSWGRLLPWIEWSHNTSWMANRGTSPYEITFGRKPFNIPDYVTGSSKVAAVEDLLSKREATFQIIKKKLVKAQERMKHYADQHRRDIQYAIGDWVLIKLRPYRQSSAKAAHEVGGKLARRYYGPFKIIAKIGSVAYRLELPEGMRVHPVFHCSNLKLFRGDPESTTPPPLPPHFHENHPLISPLTILGSRRASSDPQSPWEVLVQWQGLSPDETSWENWQQLCRDVTGIEAEGHCAHEEEETQGIAEVYEDEEEETQGIAEVGKAGVQEVCWLLTLSLGPVLVCCVANNTPFIENNLVLKVVKNTNRVSNPELRRGGQQGDYRWNAVARKLARLEEGRDDPLKGRRGRRGGFTNIPARGVYRPRVQYAPTNIHPVAHHEGNVTAVLIRRELHKLLGSLKTARQLSVNLHASGKQRINGVVGGLTAKIVDYHRWGLTVDRLKRLLNVLFKSAVEHLRLPVGLRVVSGAHSELGAA

SEQ ID NO: 185994 - protein, 106 aa, Glycine max
  Coding DNA Sequence Number=SeqID_69216
MGITVRADINGRGVREKVNVMLDIAGRWQCGGFNKDGRVVAEDRGNWRWDGVGGDARRRGGQEIVRGVHLLEGTKSAPHKGKWNKSRVKVWSWIESESARKRANLD

SEQ ID NO: 185995 - protein, 381 aa, Glycine max
  Coding DNA Sequence Number=SeqID_69217
  Gene Ontology: Mol. function=RNA-directed DNA polymerase activity; Cellular component=chromatin; Biological process=chromatin assembly or disassembly
MLEWPQPTCPTSFRGFLGLTGFYRKFVKGYAAIAAPLNSLLRKDSFLWSSEAQHAFHQLQQAMTQTPVLANPNFLLPFTLETDASGTTMGAVLLQEAHPIAYYSKVLCPRLQRASAYVRELHAITSAVHKWRHYLLGNSFIILTDHKSLKDLMSQTIQTPEQQTYLSKLLGFDYTIKYKPDTANVVADALSRIVPAEVTTHSMCISSRTFVSTLQRTPNSRPTSSFLFGRVAFGFPLKHHSRVLYWKNSTLLPSPVIRAWPRPSTASVRTSTGLKLRPTSATMSPNEPHVNRRSTKQRKAPVSSNLFPSPLILHTGIASFPLLNGRITRPYIQQSFEAVYGKAPPMIVNYLRGQSSNDAVDSLLSTRVQIHAQLTRRLQRA

SEQ ID NO: 185996 - protein, 336 aa, Glycine max
  Coding DNA Sequence Number=SeqID_69218
  Gene Ontology: Mol. function=RNA-directed DNA polymerase activity; Cellular component=chromatin; Biological process=chromatin assembly or disassembly
MADSSNDRIEASLDRLASRIEDLLQHVTPYASPPFPPRSLVPANLHRLKLDVPRFDGTDSLGWIFKITQFFEYHGTPDHDRITIAAFYMEGRALAWFQWMSSNGQFTSWPVFLQALQSRFAPSQYEDPSGSLFKLTQRSTVADYLSEFETLANRVIGLPAPFLLSCFVSGLVPEIRREVMVNQPLTVAQAAGLARLHKEKLCDLCHDFHELASRRERGLCFSCDEKFHKGHRCAPRVHLLIADEDDPVETAGSNIDPQDPIPSPIDLPNPPAHISLNSLAGHIAPETIRLVGNIVGNSILVLIDGGSTHNFIQEQLVAQLGLPCRTTTPLRVMVGN

SEQ ID NO: 185997 - protein, 70 aa, Glycine max
  Coding DNA Sequence Number=SeqID_69219
MKMNLMERIQKSTSSDNSQGWLHVTLLASRDIILLGNNIVAVGTTSDNASPKKENSRLGFTVIKRVGNLT

SEQ ID NO: 185998 - protein, 127 aa, Glycine max
  Coding DNA Sequence Number=SeqID_69220
MVIDQSLFYDLTQLSSDGVPFEGALDDDWKFDFLCMMPVERDGSLVKNGAQPNDDERHLPVEGDSSLLQSILDRFDGLQTYVGERFDSLERQVDTRFEEMNSRIAKVEEDVTIIRDYLDLPPPPPSV

SEQ ID NO: 185999 - protein, 443 aa, Glycine max
  Coding DNA Sequence Number=SeqID_69221
MWRQVKATSQDESIGRRRNINPVHVAFIVDKYLCDNNFLSTRSIFHNEASSLFATSSINQLPKTLEEMLNEYIFLKKQNVVLNQERVMVMEEKNRIQILLQGMQNALNTYNAFQRSPSLNVAGMNANFAVVPQPRVYNKTPQGVSTITSIAAAMQNTSNTQLLTRPVNTNVDTGNFSTPMISVSDKKRKDTEAVNGPIVAKKPRGRPPGRKNQVQGENTSPQSSNAVNNQVVSWPSSSATQSSSGNCAPSGSLVQGSNAVKGSFNHPPLFVPDNSPIPKTPTTQSSQSDTYVSPTKIYPAASCNGEASPTCCTMNPTNKVMVGPETQMAYKENSHCNSPIEVDTGKSSKKDDVRSKLNFDASNMPESLDKSLSNEVYTSESDKEVDISDIDFSNLMDCCPFLGITSEDFSYHPVPTHSKDNASTSSHECNANHLTYHQTANNH

SEQ ID NO: 186000 - protein, 256 aa, Glycine max
  Coding DNA Sequence Number=SeqID_69222
  Subcellular localization annotation: CTP_CleavageSite=56; ConfidenceScore=5.16e-01
MIHMLRQGIQKAVDVYNTFQSPPSPNVEMMNTNYAVVPQSRLCNETPPGQNTMLPSSNTINNQVISRPPSPIQSSYGNFAPNKSRAQGSIVTQCSYVSHPKISPVATCNGEASPSCCNIIQTKRVMVSPTNQMSYTESSRSISPVNTDSDMASKRNRVRDRLDASDKHKSLDKSDIECSDWEKILLSDVLGNREMHYEAIFLTIQPRLISRIMLQILMNAMLSLNNSYSSTQKDMNIQDCLHIFSISILIGLFLQM

SEQ ID NO: 186001 - protein, 66 aa, Glycine max
  Coding DNA Sequence Number=SeqID_69223
DSFEEQASQGSFVPHGRQDVLTTTIGHPEHPRHVRAAGAGVTIKKYFGSAPRMSRSSSSLSPEELQ

SEQ ID NO: 186002 - protein, 539 aa, Glycine max
  Coding DNA Sequence Number=SeqID_69224
  Gene Ontology: Mol. function=oxidoreductase activity; Cellular component=cytoplasm; Biological process=electron transport
  Homolog annotation: Hit_ID=Q83JJ4; Match level="QueryCoverage=59%, HitCoverage=95%, E-value=1e-152, Identity=84%"; Hit description =Hypothetical protein ygjR
  Pfam annotation: Domain name=DUF335; Domain location=82-201; Score= -77.9; E_value=0.085; Accession=PF03926.4; Description=Putative metallopeptidase (SprT family)
  Pfam annotation: Domain name=DUF45; Domain location=15-172; Score= -60.3; E_value=0.012; Accession=PF01863.8; Description=Protein of unknown function DUF45
  Pfam annotation: Domain name=GFO_IDH_MocA; Domain location=174-293; Score=132.0; E_value=1.7e-36; Accession=PF01408.12; Description =Oxidoreductase family, NAD-binding Rossmann fold
  Pfam annotation: Domain name=Semialdhyde_dh; Domain location=177-278; Score=-23.0; E_value=0.046; Accession=PF01118.15; Description =Semialdehyde dehydrogenase, NAD binding domain
  Pfam module annotation: Pfam domain module=DUF335::DUF45::GFO_IDH _MocA::Semialdhyde_dh; Domain location=82-201::15-172::174-293::177 -278
IADAVRCVFRQRTAQRAKGIIQDQNRAADFSLIQLLQQIFIRRFPRLKRVNVVRLRKTFKLTYLQGYPEHLLSQVRTLIAEQKLGAVLEKRYPGTHDVATDKALWQYTQDLKKPGGKLKAKAEIRVATVFRNAPEAFLRMIVVHELAHLKEKEHDKAFIPCAATWSRSTTSWSLIPAFIGTNWITRQFVDAAHETGKLKLTAVYSRSLEQAQSFANDYLVEHLFTSLDDMAQSDAIDAVYIASPNSLHFPQTKLFLSHKKHVICEKPLASNIEEVEATIALARENQVVLFEAFKTASLPNFLLLQQSLPKIGKVRKAFINYCQYSSRYQRYLDGENPNTFNPAFSNGSIMDIGFYCLASAIALWGEPHGVTATASLLESGVDAHGVVVLDYGDFSVTLQHSKVSDSVLPSEIQGEAGSLVIEKISECQKVSFVPRGGKAQELTQPQHINTMLYEAEVFARLVEDNEVNHPGLAVSRTTAKLQTEIRRQTGVVFPADGVGAEAIAGVTSSPVDRHYDACKIASGRRATFVVVSETLPEGE

SEQ ID NO: 186003 - protein, 58 aa, Glycine max
  Coding DNA Sequence Number=SeqID_69225
MAACCLNKLWDDKMVHRISSYLAIQRVVALGTLCALELKAEGNNVEYKFINFILSPFQ

SEQ ID NO: 186004 - protein, 410 aa, Glycine max
  Coding DNA Sequence Number=SeqID_69226
  Gene Ontology: Mol. function=sulfuric ester hydrolase activity; Cellular component=integral to membrane; Biological process =metabolic process
  Homolog annotation: Hit_ID=UPI000068D718; Match level="QueryCoverage =99%, HitCoverage=61%, E-value=4e-69, Identity=36%"; Hit description =Sulfatase
  Pfam annotation: Domain name=Sulfatase; Domain location=156-410; Score=-6.0; E_value=5.4e-05; Accession=PF00884.13; Description =Sulfatase
MLGADLFYYNKDEIKQILRASGMLNLKNIALLIVLIAICIIPLWMAVKSALKSKYIGIAFLSLGLIAFFVPSNMFQSKELNQTNNTFGQTASKSKWNYFFTSNKENFISDHPEIGEIINGEESFAADAEMLDKSFPFWRKENTPDFLGSYFSRSDEVPNLVFIVMEGFGHAYTSPKGYVGNFTPFLDSLSNKSLYWENCLSSAGRTFGALPSLTGSLPFGKNGFLEIEKTPENFNLFNILKANGFETGFHYGGNLLFDGYRNFLEYSKVDHIVDIGSYGGAYKRLPANNGDSWGYEDQAVFRKMLETQKLQQRPYFKMLLTLSTHNPFLINNKEYYEKLYNERLQSNLLNPEQKKWAAGFKNQLVAVLNADDALKNFFENYSKRPDFQRTIFVITGDHSMPEITLESKID

SEQ ID NO: 186005 - protein, 275 aa, Glycine max
  Coding DNA Sequence Number=SeqID_69227
  Homolog annotation: Hit_ID=UPI00006DBBAE; Match level="QueryCoverage =47%, HitCoverage=65%, E-value=6e-26, Identity=47%"; Hit description =COG1434: Uncharacterized conserved protein
  Subcellular localization annotation: CTP_CleavageSite=50; ConfidenceScore=5.61e-01
TPRAGCRARRWPGPARPSRPRRLAGSRRSAGCARAGSGPGRARPASAACRCRAGAGRPARTPAAPGSRGRARACRGTFRGGHRVCRGRGCGRYARQFAQDRIQVARFGVAGVSRADLGDAVAMQRQPGARHMEVLRDGHGAGVAAGPHVGAGVAGGGPGVCAGAVGDDAVGGNAACFQVGAHGRRLVAARRVDAAADEDLAAAGGGIAIVGPVQPRRQARRGAAVGRDGVAQHHGDVGIGIVGQQAGRHQRGRGRQHAGGQRDGRARDDRGRAAM

SEQ ID NO: 186006 - protein, 214 aa, Glycine max
  Coding DNA Sequence Number=SeqID_69228
MAAGALPGGPGGRTPEVGALRGPENRQICLRAATAHAHARTVVVGARPPGHAALRSRRPLHAACDEPWPGRRDTGVAAHLAAVHGCAGAPHLAALVPARAGHAGAAAQSGRRHAGLPRLCRRRAAARAIRRRCAPRCRLGRRPGGLASGRRRQAGLPGQRRQWPLCALLSGPGARPLSPGRGADRPGLAGGTGLFQPDRGRPAVPQAALNADSA

SEQ ID NO: 186007 - protein, 54 aa, Glycine max
  Coding DNA Sequence Number=SeqID_69229
MSLLSTSHPSSKIVHALSHQIGRLANDAQWLREFMKSALHQSCLFYLKLKWNDH

SEQ ID NO: 186008 - protein, 162 aa, Glycine max
  Coding DNA Sequence Number=SeqID_69230
MSREPCPLQAWRSRQIERMWSCQEIDQMQCPSLSITVGPSTFLGDSHLARELEWFEDFNFYLGMEVPHDAQQFKATLVRFDARGAKASLKMFWVVTGGRRWWRRSVKVLDERLERISLSELISLSKIPLLALSVISRAEQITSSGWNCPLCVCLAKRVVQRC

SEQ ID NO: 186009 - protein, 66 aa, Glycine max
  Coding DNA Sequence Number=SeqID_69231
  Subcellular localization annotation: CTP_CleavageSite=23; ConfidenceScore=5.15e-01
MELSKVKRGVVAVVCAVLVASVRAVLVVAVGRRYRLRPVCTGFRGRTFLLELGGGLRSDSTLRGRG

SEQ ID NO: 186010 - protein, 75 aa, Glycine max; identical to SEQ ID NO: 181857
  Coding DNA Sequence Number=SeqID_69232
  Homolog annotation: Hit_ID=Q153F8; Match level="QueryCoverage=78%, HitCoverage=17%, E-value=2e-21, Identity=78%"; Hit description =Pectin acetylesterase

SEQ ID NO: 186011 - protein, 120 aa, Glycine max
  Coding DNA Sequence Number=SeqID_69233
MDQLKHLSIPSGMLRFSNHASYPRLGHPTRKISMQQGQADILIARFPDPNYGVKTIPFCACSLIPHKPLPCQNEGDLVWISENKASNSALGQTPTSLHERAESISGFTKERHLEIPTMPM

SEQ ID NO: 186012 - protein, 386 aa, Glycine max
  Coding DNA Sequence Number=SeqID_69234
  Homolog annotation: Hit_ID=UPI00005F72E0; Match level="QueryCoverage =57%, HitCoverage=35%, E-value=7e-74, Identity=63%"; Hit description =COG3519: Uncharacterized protein conserved in bacteria
  Pfam annotation: Domain name=DUF879; Domain location=168-386; Score= -321.2; E_value=0.00054; Accession=PF05947.2; Description=Bacterial protein of unknown function (DUF879)
  Pfam annotation: Domain name=GPW_gp25; Domain location=59-174; Score =71.2; E_value=3.3e-18; Accession=PF04965.4; Description=GPW  gp25 family
  Pfam module annotation: Pfam domain module=DUF879::GPW_gp25; Domain location=168-386::59-174
MSRDNSSHNDGYAQLHGGFRARKNRDALTARDKLQSSLLDRLTDNAPDKQSEASNTTLISHSTLRRHVLRDLQWLFNTINNEAQQDLSAFGEVQRSVWNFGVAPLAGQNISDIEWQDMQRKMTDAILHFEPRILPQGLQVRCVSDLKSLSLHNVLSIEIKGRLWLIMDSKLLDYYNRELAYLRELGAEFAARYPKVAGRLGMRGIEVTDPYVERLMEGFAFLTSRVQLKMDAEFPRFSQRLLEMIAPSYLSPTPSMAIAQLTPDSRKRRHQQWLPRAARHHDGEPAPEKKRRNLQLHHGPRCHAASAAHQRRFTRRRAGRSAAGRTEAQWSRCRQRAARAYRLRRHLVAQPAECRRFNAVSQRSGHSGAETAGAADAAPRRHRAAI

SEQ ID NO: 186013 - protein, 290 aa, Glycine max
  Coding DNA Sequence Number=SeqID_69235
  Gene Ontology: Mol. function=oxidoreductase activity; Biological process=electron transport
  Homolog annotation: Hit_ID=UPI00005FA1BD; Match level="QueryCoverage =54%, HitCoverage=90%, E-value=3e-69, Identity=79%"; Hit description =COG2249: Putative NADPH-quinone reductase (modulator of drug activity B)
  Pfam annotation: Domain name=Flavodoxin_2; Domain location=16-189; Score=177.0; E_value=4.7e-50; Accession=PF02525.7; Description =Flavodoxin-like fold
MEKCLIFFTFKESFMSRILVLTAHRTPDESRINQALIEAVRPLPNVTVHELIRAYPDYRIDVAREQELLESHDAVVMMFPFFWYSSPAILREWQDAVLTYGFAYGSEGTKLHGKPLQLVVSTGGNAQAYTPAGYNRYPVQDLLLPFHALANLTGMDYLPPHLVQGVSDMSDEQLAQAAAGGAALAAPCGVSLRAATTPLRTAAASALAADPPSRCSCSSADATARRLPRPPPPRPAVRGSGWPPPAGAGRSSCADSTTAPGVKHRVEIGQRRVGVDLRVVLGAADPRRAD

SEQ ID NO: 186014 - protein, 72 aa, Glycine max
  Coding DNA Sequence Number=SeqID_69236
  Homolog annotation: Hit_ID=UPI00005F93F3; Match level="QueryCoverage =100%, HitCoverage=24%, E-value=2e-19, Identity=66%"; Hit description= COG0583: Transcriptional regulator
  Pfam annotation: Domain name=HTH_1; Domain location=8-67; Score=71.8; E_value=2.2e-18; Accession=PF00126.17; Description=Bacterial regulatory helix-turn-helix protein, lysR family
  Pfam annotation: Domain name=MarR; Domain location=3-69; Score=-4.0; E_value=0.084; Accession=PF01047.13; Description=MarR family
  Pfam module annotation: Pfam domain module=HTH_1::MarR; Domain location=8-67::3-69
  Subcellular localization annotation: CTP_CleavageSite=34; ConfidenceScore=5.11e-01
MSLPFDVHRLLPAFLAAAQAQNFSAAARQLGVTPAAVSKNIRALEEKLALRLFQRNTHNVLLTDEGKALLAQ

SEQ ID NO: 186015 - protein, 95 aa, Glycine max
  Coding DNA Sequence Number=SeqID_69237
  Homolog annotation: Hit_ID=Q1T010; Match level="QueryCoverage=85%, HitCoverage=6%, E-value=3e-08, Identity=37%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLSTNGGNIPAQLLVLDRKNWERWHIQMKALFEFQDVMEVVKNGVAAEPAEPTTEAVRNAYKDSKKKDAKAIFFLHQSVDDANFNLISKATSAK

SEQ ID NO: 186016 - protein, 96 aa, Glycine max
  Coding DNA Sequence Number=SeqID_69238
MTMEENEKIVDFFARVKVVTNQMATQVTRILATVTEEEVVLEEEVLVGTIEEEVAMFLVVEEARIMLKINLISRREAGAEATIEVVAMVEEEVVGK

SEQ ID NO: 186017 - protein, 52 aa, Glycine max
  Coding DNA Sequence Number=SeqID_69239
MGSQDYSRQFYHHSQHLARAAGPPLPSQMVNDGAGAYALLQVSLRLCLPRIG

SEQ ID NO: 186018 - protein, 134 aa, Glycine max
  Coding DNA Sequence Number=SeqID_69240
  Gene Ontology: Mol. function=protein disulfide oxidoreductase activity; Biological process=cell redox homeostasis
  Homolog annotation: Hit_ID=Q2HVR5; Match level="QueryCoverage=99%, HitCoverage=36%, E-value=1e-21, Identity=41%"; Hit description =Glutaredoxin
MGCANSKPKGCQHCHCNTPYYSSSMARSFSVHVHHPPQTKGDSYHVVALTSTTLGSLDQDVPHNNNYHGNGLRFPNGKVIGSDSFRPQNQDHDDDDDDDEVEVEEKKNEPKTWSEMIEQMLPKAMMKSPISTPP

SEQ ID NO: 186019 - protein, 264 aa, Glycine max
  Coding DNA Sequence Number=SeqID_69241
  Gene Ontology: Mol. function=protein disulfide oxidoreductase activity; Biological process=cell redox homeostasis
  Homolog annotation: Hit_ID=Q2HVR5; Match level="QueryCoverage=79%, HitCoverage=44%, E-value=5e-44, Identity=47%"; Hit description =Glutaredoxin
  Pfam annotation: Domain name=Glutaredoxin; Domain location=101-171; Score=52.1; E_value=1.9e-12; Accession=PF00462.14; Description =Glutaredoxin
HVDVADVDPPLIQNGNDSAKPISVSDSDDEPQENQESMDRKRFFSIEEEMISDDVVSSFKKSSQEKQEGMDRKGFSVGEEKISDDDDVVVDLKSCGKDKVVLYFTSLRGVRKTYEDCCHVRLILKGLGVRVDERDVSMHSGFKEELKELLGHGYGKGGLGLPRVFVGRNYIGGAEEIQQLHEEGKLEKLLDCCGKIEDGIDGDGLCEACGDVRFMPCETCYGSCKIYYEGDEEEDYDGEVVRFCLYSEVLVWLIMLEKKKEIKE

SEQ ID NO: 186020 - protein, 253 aa, Glycine max
  Coding DNA Sequence Number=SeqID_69242
  Homolog annotation: Hit_ID=Q2HRX8; Match level="QueryCoverage=59%, HitCoverage=21%, E-value=2e-14, Identity=42%"; Hit description=IMP dehydrogenase/GMP reductase
  Pfam annotation: Domain name=DUF1723; Domain location=93-142; Score =50.0; E_value=8.1e-12; Accession=PF08330.1; Description=Protein of unknown function (DUF1723)
MRSKRFTKLLNMLQLMMLHLKMVCLVINLRTNQSLLNMLIVWLVNYGMDWPWKVEASSTWKEVEGFAPPPNKEIMQVVQDSGLLPLTECSYETADNGLLFAFTERWHHETNTFHLAVEEMTITLDDVSSLLHIPIIGGFYSYLHTSKEVTIALLMELLLVNQEDTFLETKQCRRGNACLSWLQGIHANRCRDEQWDQTARAYLLDLVALNLVQKKLIASCGMPPMIYLASSHAQARPCVYLMIHNGRCQHQQT

SEQ ID NO: 186021 - protein, 141 aa, Glycine max
  Coding DNA Sequence Number=SeqID_69243
MSDEVDMEVDMNNDVRIDEDIHKDYDQETGKTVDCSKAFITTKAWDQIMDAWGSSVKDCPTQSEYEGRIKMLKIVCSPWKYFVKVESAHWSLKRFIQNSMGNLCKCWDAINNLIRLYALNHIEDELDRVKFVGVDSDHCGS

SEQ ID NO: 186022 - protein, 265 aa, Glycine max
  Coding DNA Sequence Number=SeqID_69244
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-35, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVFAFSGLHVLDFRGLHVLALRGLHVLAFRGLHVLALRGLHILCFSGLHILAFRRLHILAFIWLHILAFRWLHVLDFKGLDVLIVKGLYVLAFRGLHTLAFRGLNVLAFRGLQVLALRRPHILAFKGLLHAVAFNGLHVLGFRGLYTHAFRGLHILAFRGLHVLTFRGLQALTIRGQHVLALRGLHPLAFRGLHVLTLRGPHVLTFRGQHAFAFRGLHILASRGQHVLSLRGLYILAFRGLHVLAFRGLHVLALRGLHVLSIRG

SEQ ID NO: 186023 - protein, 239 aa, Glycine max
  Coding DNA Sequence Number=SeqID_69245
  Gene Ontology: Mol. function=transcription factor activity; Cellular component=intracellular; Biological process=regulation of transcription, DNA-dependent
  Homolog annotation: Hit_ID=Q4ZT08; Match level="QueryCoverage=95%, HitCoverage=95%, E-value=1e-50, Identity=46%"; Hit description =Regulatory protein, GntR:Bacterial regulatory protein, GntR
  Pfam annotation: Domain name=FCD; Domain location=95-222; Score=97.7; E_value=3.6e-26; Accession=PF07729.2; Description=FCD domain
  Pfam annotation: Domain name=GntR; Domain location=10-73; Score=64.9; E_value=2.5e-16; Accession=PF00392.11; Description=Bacterial regulatory proteins, gntR f
  Pfam module annotation: Pfam domain module=FCD::GntR; Domain location= 95-222::10-73
MEKPSRFLANSSTALEQLRGLINQHESTPGTPLPTERELSETLGVGRREVRRALDVLEEEGRIWRKQGKGTFIGPSAPVEPLALQGLVQQTNLLEVMEARLQLEPGLARLAALRATRENLALMQRMLERIDKVSPDDRDLNELWDSAFHRAIAEAAGNRLMLGLFDAIDAVRREPGWQHLRELARTPERVDNYNDHHHKIMSAIIHRQPNEAAAAMREHLLSLQTALIHAIHLEDDFTL

SEQ ID NO: 186024 - protein, 165 aa, Glycine max
  Coding DNA Sequence Number=SeqID_69246
DDRSGGGSDIDCGCDTNGGDNMVVATNGSDIGSGGGGGGGDRGVVVSMSMCWCDGGGFDNGGGGCGDNSGSYDDIGGGCGGDVRGGIIGSGGGDSNSDIDGGDGDSSVGDDDDLTLVLVVIPSGDSGCDNIGNSCGGDDNDNESDTNATNYSSDNDDDDDSMWYW

SEQ ID NO: 186025 - protein, 358 aa, Glycine max
  Coding DNA Sequence Number=SeqID_69247
  Gene Ontology: Mol. function=transcription factor activity; Cellular component=nucleus; Biological process=regulation of transcription
  Homolog annotation: Hit_ID=Q96304; Match level="QueryCoverage=98%, HitCoverage=54%, E-value=1e-99, Identity=53%"; Hit description =SCARECROW
  Pfam annotation: Domain name=GRAS; Domain location=1-261; Score =311.6; E_value=1.4e-90; Accession=PF03514.5; Description=GRAS family transcription factor
MECAVAISVDNLGEAHRMLLELTQMASPYKASCAERVVAYFAKAMTSRVMNSWLGVCSPLVDHKSINSAFQVFNNISPFIKFAHFTSNQAILEAVSHCDSIHIIDLDIMQGLQWPAFFHILATRMEGKPKVTMTGLGASMELLVETGKQLTNFARRLGLSLKFHPIATKFGEVIDVSMLHVKPGEAVAVHWLQHSLYDATGPDWKTLRLLEELEPRIITLVEQDVNHGGSFLDRFVASLHYYSTLFDSLGAYLHNDDSNRHRVEHGLLSREINNVLAIGGPKRSGEDNFRQWRSELARHCFVKQVPLSDNSMAQAQLILNMFSPAYGYSLAQVEGTLRLGWKDTSLYTASAWTCCNSS

SEQ ID NO: 186026 - protein, 367 aa, Glycine max
  Coding DNA Sequence Number=SeqID_69248
  Gene Ontology: Mol. function=protein serine/threonine kinase activity; Cellular component=plasmodesma; Biological process=protein amino acid phosphorylation
  Homolog annotation: Hit_ID=Q8LPJ1; Match level="QueryCoverage=92%, HitCoverage=71%, E-value=1e-160, Identity=79%"; Hit description =Protein kinase ADK1-like protein
  Pfam annotation: Domain name=Pkinase; Domain location=4-265; Score =59.0; E_value=1.6e-14; Accession=PF00069.15; Description=Protein kinase domain
LIVLTTHDILHFKFLTIPSCSVKKFQEPVKTRHPQLHYESKLYMLLQGGTGIPHLKWFGVEGDYNVMVIDLLGPSLEDLFNYCDRKFTLKTVLMLADQLINRVEYMHSRGFLHRDIKPDNFLMGLGRKANQVYAIDYGLAKKYRDLQTHRHIPYRENKNLTGTARYASVNTHLGIEQSRRDDLESLGYVLMYFLKGSLPWQGLRAGTKKQKYDKISETKVSTSIEVLCKSYPSEFVSYFQYCRSLQFEDKPDYSYLKRLFRDLFIREGYQFDYIFDWTMLKYPQISGSSRGRHGTGKAAMHAGPHVQKAEKISVGKEIREKFSGAVEAFSRRNPANASPCGDHTKHRSFEDVPVQKDLVILFNNKNI

SEQ ID NO: 186027 - protein, 371 aa, Glycine max
  Coding DNA Sequence Number=SeqID_69249
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=94%, HitCoverage=85%, E-value=1e-121, Identity=55%"; Hit description=TBC domain, putative
  Pfam annotation: Domain name=TBC; Domain location=94-275; Score= -32.0; E_value=2.6e-05; Accession=PF00566.9; Description=TBC domain
MANRNSLRCMTSYSPQGLIHLGVHPSIKGEVWEFLLGCYDPNSTLEERNELKQRRRGQYDMWKAECQKMVPVIGSGKFITTPLIDDEGQPIDPSLVGVQTSDKKVVQWMQLLHQIGLDVHRTDRALDFYETEANQAKLFHVLAVYAWLDNDIGYVQGMNDICSPLIILVENEADCYWCFDRAMRRMRENFRSSASSMGVQSQLATLSQIMKTVDPKLHHHLEDLDGGEYLFAFRMLMVLFRREFSFADTLYLWELMWAMEYNPYIFTKYEDPDRAKTKGPSPATNNKHLKQYGKFERKNVKTGHTEENSALSVFLVASVLEIKNRRILNEAKGVDDVVKILGDITSNLDAKKALNEALKIQKKYLSKAKKA

SEQ ID NO: 186028 - protein, 79 aa, Glycine max
  Coding DNA Sequence Number=SeqID_69250
MMRLRENGSSRKELKHSLGKPPIIDVTINHHGCGAYFVGVREITSDDDGCRRVVEVPWETPRGRVHRRRKEDNYNQVKG

SEQ ID NO: 186029 - protein, 465 aa, Glycine max
  Coding DNA Sequence Number=SeqID_69251
  Gene Ontology: Mol. function=succinate-CoA ligase (GDP-forming) activity; Cellular component=mitochondrion; Biological process =tricarboxylic acid cycle
  Homolog annotation: Hit_ID=O82662; Match level="QueryCoverage=97%, HitCoverage=97%, E-value=0.0, Identity=78%"; Hit description =Succinyl-CoA ligase [GDP-forming] beta-chain, mitochondrial precursor
  Pfam annotation: Domain name=ATP-grasp_2; Domain location=29-238; Score=284.4; E_value=2.2e-82; Accession=PF08442.1; Description=ATP -grasp domain
  Pfam annotation: Domain name=Ligase_CoA; Domain location=324-460; Score=282.2; E_value=1e-81; Accession=PF00549.10; Description=CoA -ligase
  Pfam module annotation: Pfam domain module=ATP-grasp_2::Ligase_CoA; Domain location=29-238::324-460
MVRGLLNKLVSRSLSVAGKWQHNQLRRLNIHEYQGAELMSKHGVNVPRGVAVSSVEEVRKAIKDLFPNENELVVKSQILAGGRGLGTFKSGLKGGVHIVKTDQVEDIAGKMLGQILVTKQTGPQGKIVSKVYLCEKLSLVNEMYFAITLDRTSAGPIIIACSKGGTSIEDLAEKFPDMIIKVPVDVFEGITDEDAAKVVDGLALKVADRNKSIEQVKNLYKLFVDCDCTLLEINPIAETADNQLVAADAKLNFDDNAAYRQKEIFALRDTTQEDPREVCLIINWVGLCPGPKIGLTNILGGFMLINPVQSVPHTPVSLTHVTAAKADLNYIGLDGEIGCMVNGAGLAMATMDIIKLHGGTPANFLDVGGNASEGQVVEAFKILTADDKVKAILVNIFGGIMKCDVIASGIVNAAKEVALKVPVVVRLEGTNVDHGKRILKESGMALITAEDLDDAAQKAVKAAYK

SEQ ID NO: 186030 - protein, 261 aa, Glycine max
  Coding DNA Sequence Number=SeqID_69252
  Gene Ontology: Mol. function=protein binding; Cellular component =integral to membrane; Biological process=multicellular organismal development
  Homolog annotation: Hit_ID=Q657S8; Match level="QueryCoverage=97%, HitCoverage=56%, E-value=9e-30, Identity=37%"; Hit description =Putative disease resistance protein
  Pfam annotation: Domain name=LRR_1; Domain location=113-136; Score =0.5; E_value=2.3e+02; Accession=PF00560.23; Description=Leucine Rich Repeat
  Pfam annotation: Domain name=LRR_1; Domain location=138-157; Score =5.1; E_value=31; Accession=PF00560.23; Description=Leucine Rich Repeat
  Pfam annotation: Domain name=LRR_1; Domain location=16-38; Score =18.9; E_value=0.018; Accession=PF00560.23; Description=Leucine Rich Repeat
  Pfam annotation: Domain name=LRR_1; Domain location=160-182; Score =1.7; E_value=1.3e+02; Accession=PF00560.23; Description=Leucine Rich Repeat
  Pfam annotation: Domain name=LRR_1; Domain location=40-62; Score =12.4; E_value=1.3; Accession=PF00560.23; Description=Leucine Rich Repeat
  Pfam annotation: Domain name=LRR_1; Domain location=64-82; Score=7.4; E_value=12; Accession=PF00560.23; Description=Leucine Rich Repeat
  Pfam annotation: Domain name=LRR_1; Domain location=89-111; Score =14.1; E_value=0.5; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=113-136::138-157::16-38::160- 182::40-62::64-82::89-111
NNLSGEIPSSLGLLRNLKVLDLSGNKFEQCLPHSLGNLSHLLKLDLSFNGFSCRIPESLRGLQSLHFLDLSFNRFGNFGVPLFLREIPTLKEVYLSGNFLSGVIPEIWENLGGVEKLGFSEMGLVGNIPASMGVHLKKLTYLGLDNNKLDGPVPYGLLEYASEINLENNKLSGRVEFSTTKVGQKVKLAGNTGLCVDNNKVGCKRRSGDGVLGQQLKACKKTDVVPDDAVVFSGASSLLRFDSLAGVLFVFTGFRWFGYYV

SEQ ID NO: 186031 - protein, 191 aa, Glycine max
  Coding DNA Sequence Number=SeqID_69253
QVICGITSWLPAPFIKPGANEPVDAKRLTSSSTLFAIQGHQVRWQAEIPYGHRRLSSIEGNDFDGIRMMLAVRDDRVRWRREVSWLFYLVVFKTLKGMQIAIRPTWAFQDVPTEGSAYWWKQPSSPGRQPSPDENPEIGQIQAKGPSNPCGVYPDLSSFTGSSVYPDLSSFTGSGVYRDLSSFTGSGIIQI

SEQ ID NO: 186032 - protein, 313 aa, Glycine max
  Coding DNA Sequence Number=SeqID_69254
  Homolog annotation: Hit_ID=Q66D25; Match level="QueryCoverage=48%, HitCoverage=49%, E-value=2e-65, Identity=76%"; Hit description=ABC periplasmic phosphonate binding protein, phnD precursor
AFKKEFGGTVDDKYNNTFSSVTFSGGHEQDILGVLNGQFDGAVTWTSLIGDYNSGYTSGAFGRLIRMDHPDLMKQIRIIWQSPLIPNGPILVSNNLPADFKAKVVAAIKKLDKEDHSCFVKAVGGAQHIGAASVADYQNIIDMKRDLMKGARGPLPGGEGAARATGQFPRRWQERGPHVLPDNSLSRWRERVRVRAIPRHQQRISPLTDFEHYYQRIRRQQKRDTLLWSLLLVALYLAAGNVAEFNLVTVWQSLPHFFDYIGATLPGAAPAAAVRGRQNRGFAGLLGLSPALSAAADLGNPAAGAVLHPDCGY

SEQ ID NO: 186033 - protein, 49 aa, Glycine max
  Coding DNA Sequence Number=SeqID_69255
MTLFFTRLPIESKIKRGVGYRQSRTTLNGNLKGRDTKNGFSFADSPLPC

SEQ ID NO: 186034 - protein, 78 aa, Glycine max
  Coding DNA Sequence Number=SeqID_69256
MVNEYEIVVFLRQVWWYAGKREGFGRRMENEIERKMRRKEYRQSKTDLRCLYLYLGCLAPIIRQFVKFRDMPENKRKY

SEQ ID NO: 186035 - protein, 103 aa, Glycine max
  Coding DNA Sequence Number=SeqID_69257
MKSWACTSQRCNESIWQFKHSTQFMASSTSNLQFASLVVHEAKIHEENPPRLVALGRVYEGSKTIHNIPLLLDQVKVGVEEVKDADAPVPVPTNKVNLVGADT

SEQ ID NO: 186036 - protein, 41 aa, Glycine max
  Coding DNA Sequence Number=SeqID_69258
MTTMAIFNGCEVTSAGKTKSRGERVFDERRRKTGFGELMKH

SEQ ID NO: 186037 - protein, 160 aa, Glycine max
  Coding DNA Sequence Number=SeqID_69259
  Gene Ontology: Mol. function=RNA-directed DNA polymerase activity; Biological process=RNA-dependent DNA replication
MEVASLAVDEDINIEVNIITEEIDTEINKGKSNTKPTSQINRKVEAQDPSKEVNKRDEVNQKPTYVSKPIVMSWEKLIALFHEFKDYFAWDYDDKSGLSRDLVEHRLSVQEGNKTIKQAPQRFAHDIDLKIKEEIERLLNANFICTIMCNLSKSYEFHLS

SEQ ID NO: 186038 - protein, 76 aa, Glycine max
  Coding DNA Sequence Number=SeqID_69260
  Gene Ontology: Biological process=multicellular organismal development
  Homolog annotation: Hit_ID=Q9SHE9; Match level="QueryCoverage=81%, HitCoverage=36%, E-value=2e-23, Identity=77%"; Hit description=LOB domain-containing protein 4
  Pfam annotation: Domain name=DUF260; Domain location=13-75; Score =57.4; E_value=4.6e-14; Accession=PF03195.5; Description=Protein of unknown function DUF260
MKESGRKQGTMSPCAACKLLRRRCTPDCAFAPYFPADEPQKFDSVHKVFGASNVNKMLKSTPMMMTTPWHIFCQVA

SEQ ID NO: 186039 - protein, 142 aa, Glycine max
  Coding DNA Sequence Number=SeqID_69261
MVSRLKRTPCSWKYGVGIDLRGFEPFSGSLLLMTNDVRHARHLTNDVSYGRCGGDIENMDHVFRLCPIACQSCLISVIPCFKAPSFYIQVLSSWLLKNLEDESEVDVDAIANSVLWVANFTNIRAPLANRDVVHPELWFHPE

SEQ ID NO: 186040 - protein, 111 aa, Glycine max
  Coding DNA Sequence Number=SeqID_69262
MSGVTTNVYLRKTLEKPKIRRSMDFENEGLGVAYLQGRVLCPDVLQHKHSRIQGSTHNITKSINTQALCNIYTKTQSYMQCGTMLVKNLVGRLGVHDKTNHTLASQVTLTR

SEQ ID NO: 186041 - protein, 75 aa, Glycine max
  Coding DNA Sequence Number=SeqID_69263
MTMWVSTERFLADFGREEKENNNFRQEDDKEKSWKMPLWLPVSISNGERKRELQFQFMEKLRLLHVGFLVGVKEF

SEQ ID NO: 186042 - protein, 54 aa, Glycine max
  Coding DNA Sequence Number=SeqID_69264
MAKESDGAIRAWECMFLKQGHGKRGRVPMQTCYNDRFFIQRHQCLYLNYDYATA

SEQ ID NO: 186043 - protein, 129 aa, Glycine max
  Coding DNA Sequence Number=SeqID_69265
  Gene Ontology: Mol. function=transcription regulator activity; Cellular component=nucleus; Biological process=regulation of transcription
  Homolog annotation: Hit_ID=O82398; Match level="QueryCoverage=97%, HitCoverage=42%, E-value=2e-11, Identity=29%"; Hit description =Putative bHLH transcription factor
IDKATILSEAITHVKRLKERVRELEEQRKKTRVESVSFVHQRSHIATVKGTTSGAMNSDECCRTNEALPTVEARVFKKDVLLRIHCKIQSGILIKILDHLNSLDLSTISNSVMPFGSSTLDISIIAQVH

SEQ ID NO: 186044 - protein, 45 aa, Glycine max
  Coding DNA Sequence Number=SeqID_69266
TDKTSILANASSYVKQLQQRVRELEQLQEVQSNVTSNEGATSSCE

SEQ ID NO: 186045 - protein, 58 aa, Glycine max
  Coding DNA Sequence Number=SeqID_69267
  Homolog annotation: Hit_ID=Q1SYF1; Match level="QueryCoverage=88%, HitCoverage=15%, E-value=4e-08, Identity=53%"; Hit description=Basic helix-loop-helix dimerisation region bHLH
MLKILSQLENVNLSIVNSSVLRFGKSTLDITIVAQMGEGYKMTVGELVKTLRVAILTH

SEQ ID NO: 186046 - protein, 328 aa, Glycine max
  Coding DNA Sequence Number=SeqID_69268
  Gene Ontology: Mol. function=transcription regulator activity; Cellular component=nucleus; Biological process=regulation of transcription
  Homolog annotation: Hit_ID=Q1PF17; Match level="QueryCoverage=73%, HitCoverage=81%, E-value=7e-36, Identity=41%"; Hit description=Basic helix-loop-helix family protein
  Pfam annotation: Domain name=HLH; Domain location=143-192; Score =50.9; E_value=4.2e-12; Accession=PF00010.16; Description=Helix-loop -helix DNA-binding domain
MEEPWENWHLHMEMDCGNDFSGKCHGTHDDEFLRDILLQQPPAAFSSESESDHSFRPVVQNTTITNDGAVKSNSSQISSKRPRPLSTPRTYILSFDNSTMLPASPEPRLRSSNNNSPWPPESPGPEPRRPITGGAKKTRTSSQTIDHIMAERRRRQDLTERFIALSATIPGLSKTDKASVLRAAIDYLKQLQERVQELEKQDKKRSKESVIFNKKPDPNGNNNEDTTTSTETNCSILPEMEVRVLGKEVLIEIHCEKENGVELKILDHLENLHLSVTGSSVLPFGNSSLCITITAQMGDGYQMTMNDLVKNLRQVLSKSHLLSDSDPY

SEQ ID NO: 186047 - protein, 139 aa, Glycine max
  Coding DNA Sequence Number=SeqID_69269
MKDLFKRWTEHLDSTRSRVSHLPPEIHAGKSYSMENYQWEQELQPYNQYEEERSSNLDNLLMQFKETIESTQRAFKSLEIQVGKLAKEVTKFVATREENFVEVEAYEESLVEEHDSREKDEEKSEEKAQQWDECSQVEI

SEQ ID NO: 186048 - protein, 728 aa, Glycine max
  Coding DNA Sequence Number=SeqID_69270
  Gene Ontology: Mol. function=protein-methionine-S-oxide reductase activity; Cellular component=nucleus; Biological process=regulation of transcription
  Homolog annotation: Hit_ID=O80933; Match level="QueryCoverage=92%, HitCoverage=90%, E-value=0.0, Identity=51%"; Hit description =Putative SCARECROW gene regulator
  Pfam annotation: Domain name=GRAS; Domain location=330-635; Score =434.9; E_value=1.1e-127; Accession=PF03514.5; Description=GRAS family transcription factor
MDPRLCGPPNEIQLGNQRFENGFFDQSREFGYLQSNLVPTDTPSSSSVWTHEEPSPEDCEFSDGILSYISQILMEEDMEDKTCMRQDSLDLQIAERSFYEVIGEKYPSTPLGHPSSVDPDDGSGEHNLSENYGTCSYNDGDLSSIFTNNFLRRNLGELPNQNFRGNSISQSSYSSSNSVKSSVEGPVDSPSSILQVPDLNSETQSILLFQKGVEEASKFLPSGNGLFANLDVANFSKLKPRVGSDELPVKVEKDEGESFPAGSKIRKHHHMEEEDVEENRSSKQAAIFSEPTLRSSMIDIILLHSLGDGKKHFMARREALQTKNDQIVVSNGKSKASNGGKGRSKKQNGKKEVVDLRTLLVLCAQAVAADDYKSAHELLKRIRQHSNPFGDGNQRLAHIFADGLEARLAGTGSQIYKGLVSKRTSAADFLKAYHLYLAACPFRKMTAFISNVTIRKSSANSPRLHIIDFGILYGFQWPTLIQRLSLAGGAPKLRITGIDFPQPGFRPAERIVETGCRLAAYAESFKVEFEYNAIAKKWETIQLEELKIDRDEYLVVTCFYRCKNVLDESVVVDSPRNKFLSLIRKVNPNIFIHGITNGAFNAPFFVTRFREALFHYSSLFDMLETIVPREEWERMLIEKEIFGREALNVIACEGCERVERPETYRQWQARILRAGFLQQPFEREIVKRAIEKVTTSYHKDFVIDEDSQWLLQGWKGRIIYALSCWKPA

SEQ ID NO: 186049 - protein, 470 aa, Glycine max
  Coding DNA Sequence Number=SeqID_69271
  Gene Ontology: Mol. function=phospholipid binding; Cellular component= intracellular; Biological process=steroid metabolic process
  Homolog annotation: Hit_ID=Q93Y40; Match level="QueryCoverage=85%, HitCoverage=86%, E-value=0.0, Identity=79%"; Hit description =Oxysterol-binding protein
  Pfam annotation: Domain name=Oxysterol_BP; Domain location=7-392; Score=112.0; E_value=1.7e-30; Accession=PF01237.9; Description =Oxysterol-binding protein
MGMCLLNLDVVHFSNLSGQERDSYWKMMQKYVGSDITSMVTLPVIIFEPMTMLQKMAEYNLIGCNIFSQLMEYSYLLDMADKTEDPYMRLVYASSFFISVYYAYQRTWKPFNPILGETYEMVNHGGITFISEQVSHHPPMSAGHAETEHFTYDVTSKLKTKFLGNSVDVYPVGRTRVTLKRDGVVLDLVPPPTKVSNLIFGRTWIDSPGEMILTNLTTGDKVVLYFQPCGWFGAGRYEVDGYVYNSADEPKILMTGKWNEAMNYQVCDSEGEPLPGTELKEIWRVADTPKKDKFQYTHFAHKINSFDTAPKKLLASDSRLRPDRMALEKGDLSTSGYEKSSLEERQRAEKRNREAKGHKFTPRWFDLTDEVTPTPWGDLEVYQYNGKYTQHCAAVDSSECIEVPDIRPEFNPWQYDNLDAEYALLSDKTKEDTEPNIIGHSLGIGEGDLRAFHDNERLVHPLLEIGGLVH

SEQ ID NO: 186050 - protein, 606 aa, Glycine max
  Coding DNA Sequence Number=SeqID_69272
  Gene Ontology: Mol. function=DNA binding; Cellular component=nucleus; Biological process=protein modification process
  Homolog annotation: Hit_ID=Q9FNS1; Match level="QueryCoverage=99%, HitCoverage=98%, E-value=1e-105, Identity=39%"; Hit description=MYB -like DNA-binding protein
  Pfam annotation: Domain name=Myb_DNA-binding; Domain location=514 -564; Score=20.0; E_value=0.0085; Accession=PF00249.21; Description =Myb-like DNA-binding domain
MVLQKRLNYGFNGYQVPVIPRASRSARGRGTIKKKPDNNQIQAFEMLASVAGNFLQKNESSDPKNVVFVEDPCSFCGTNIKDKYEDERRSFMRDSFDHGACSEIASAFVPSMQGKHDNHRGMGDSSFLDNHLEGQGQNVLEREDERIKRRSVNGKTIHIKGCSDGLIEPCHKVSKHCSLANNAEKPSLECRKHLDSFPNGFTSRKLVNRDDDENLVRCTQLNSKNNNTSGAPPDMPKLKDASPIMSDENNSRDIFEFENLQRMYPFKKRKFFNQNSSSTSDRGSQCQGMFDSSDTTRVNGTNHAIEESSSIVGQQAHSGSRACNVKLSIKSFKVPELFIDIPETATIGSLKRTVMEAVTTILGDELHVGILLQGKKVRDDSKTLIQTGISQDDKRHRLGFMLEPRHTPISPTSYNDDPCFLTTSSRKKLSRQSTSLTLQQGTYNVSKERSMIKIESCAKGDLNIVSSLEDTSTNNNMSKCRALVAVPAINMEALAVVPFWRKSGNPDFAQRRIRRPFSVLEVEALVQAVEKLGTGRWRDVKQRAFDHAKHRTYVDLKDKWKTLVHTARISPQQRRGEPVPQELLDRVLAAHAYWSQHQCKHQLKPL

SEQ ID NO: 186051 - protein, 86 aa, Glycine max
  Coding DNA Sequence Number=SeqID_69273
MKSMSTLVYYDGDMIPSYEGIVFEFPSNPKVITIKAKLHGESKVIQRCFDDNNDDDKGDDKKLKDQSKNKFKSSRIKKNSRLKKKV

SEQ ID NO: 186052 - protein, 58 aa, Glycine max
  Coding DNA Sequence Number=SeqID_69274
  Gene Ontology: Cellular component=extracellular region; Biological process=cellulose and pectin-containing cell wall organization and biogenesis
  Homolog annotation: Hit_ID=Q8GZD2; Match level="QueryCoverage=83%, HitCoverage=18%, E-value=4e-20, Identity=97%"; Hit description =Expansin
MAAIVFIHIASLVSLFVATSARIPGVYTGGPWQSAHATFYGGSDASGTMANVTIIAIA

SEQ ID NO: 186053 - protein, 120 aa, Glycine max
  Coding DNA Sequence Number=SeqID_69275
MEQQKLAQAMVGAGEKEKHRSSHGTNANQNTKQYTIAKDKKQEEEDSLTSKAKPPQQENAPSPTRRKAITSNHGQPTTTREKEEEEAVRKKKRKKKQCGKWIMNSDLYGRVTMRFLYERM

SEQ ID NO: 186054 - protein, 248 aa, Glycine max
  Coding DNA Sequence Number=SeqID_69276
  Gene Ontology: Mol. function=serine-type endopeptidase activity; Cellular component=integral to membrane
  Homolog annotation: Hit_ID=Q53MA5; Match level="QueryCoverage=95%, HitCoverage=64%, E-value=9e-55, Identity=46%"; Hit description =Rhomboid family, putative
  Pfam annotation: Domain name=Rhomboid; Domain location=16-159; Score =91.7; E_value=2.2e-24; Accession=PF01694.12; Description=Rhomboid family
MVNWLRNMGALDVNKVVHRHQGWRLITCMWLHGGIFHLLANMFGLLVIGIRLEKEFGFVVLQCLLDCYLLFLNLEVACFLLFSLGKESLLVLLVLFFDLLGGMLSELLTNWSLYEKKLGALFIAINLAVGVLPHVDNFAHIGGFLSGFLVGFVFLIRPQFGWIKQRNAPQPHSPTLIKSKFNKYQCISWILALILLIFGFTTGLISLLRCVDANDYCSWCHYLSCIPTSRWNCNPKASSSVVLVRNWE

SEQ ID NO: 186055 - protein, 96 aa, Glycine max
  Coding DNA Sequence Number=SeqID_69277
MLKLDKQGWEENALGRKKQVKVRGEMVWESEACVCAPKKEQSRGSEGAKEKGLVEEGPKLKCYPYRGRPIIVGGGFVKGRLYAQMVIKRIREGQGR

SEQ ID NO: 186056 - protein, 48 aa, Glycine max
  Coding DNA Sequence Number=SeqID_69278
MEILWDGLHWIIAALSFCDLLARELDEGRTRNRDYSKNYIALGILMEE

SEQ ID NO: 186057 - protein, 1069 aa, Glycine max
  Coding DNA Sequence Number=SeqID_69279
  Gene Ontology: Mol. function=zinc ion binding
  Homolog annotation: Hit_ID=Q1RX12; Match level="QueryCoverage=69%, HitCoverage=77%, E-value=0.0, Identity=55%"; Hit description=Zinc finger, RING-type; Transcription factor jumonji, jmjC; Cupin region; Zinc finger, FYVE/PHD-type
  Pfam annotation: Domain name=JmjC; Domain location=717-823; Score =26.6; E_value=3e-06; Accession=PF02373.13; Description=JmjC domain
  Pfam annotation: Domain name=ZZ; Domain location=241-282; Score=5.0; E_value=0.055; Accession=PF00569.8; Description=Zinc finger, ZZ type
  Pfam module annotation: Pfam domain module=JmjC::ZZ; Domain location =717-823::241-282
MEQGSTDTRVDANPSLSSHEEIQSLDFDTECETKMTNSAGNGAGGSSYVEEGVRKKRGRKSKKEMGKMLDATAMEGGVSEQRPSRKRKKYDEMAEFEMSGTEKKYGLRGCKQEMEPKANRRKAKCDEEGPLTCHQCKRNDKGRVVRYPHLKENDIAEKCPVCRGNCNCKACLSCDELIKQMREFAKADKEEKVELCMYLLQVLLPYLRQLDEEQLIENETEAKIQGLSVSKLNLAKADYSMEERVYCDNCKTSIFDYHRSCTKCSFDLCLICCRELRGGQLVGGADPIELEFVWQGRGYLHAEKKDEEVKQNASDDDCKPEVREWSRSGWLAQSDGSIPCPKVNDECNHGFLELRSILGQHFVSELVCKAKELVQAYKLQNVVKTADNFCSCLKLDRNTDVSYSNMRKAASREDLTDNYLYCPKAVDLQYKDLRHFQWHWEKGEPVIVSNVLECTSGLSWEPLVMWRALRHVTNTKRGQHLAEKTIDCLDWTEGEINIHQFFTGYTNGRKDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVNVLTHIAEVKLDSDQLTIIEKLKQKHLEQEKRELLGDDQDGGTNVDMLNNSSSTINALDKQSSVEVMEQEGGLCDGKEVDQFHQPSRSNEVAIANEDGISYGSELIEDVPKLQEYLKKHFREFRHVHCCPLKQGKAAYNIPPPYLRIAKSLWAMGYEVIHPIHDQTFYLTMEHKRKLKEEYGIEPWTFIQKLGDAVFIPVGCPHQVRNLKSCIKVAMDFVSPENVGECFRLTEEFRTLPINHRSTEDKLECKIAFAKQGGNGTGGNEAGVWGLSGGSRINSKNSSRDEEQASIGDFVGDDRDGKRKRVEGFPNVRENEKELKSPFVLSSYDSFFSLHEYYLVNSNGEALGFCGKGKGYDAKCISLSSDMISKFPTVKRLGIELQTWCLNFTMIQRDPKDELGSCFGPAYKPPSYNNIRLKLLKKKVVRTDKILEEHRTIWKKTGCTIMIDGWIDRSIGKCLFEIN

SEQ ID NO: 186058 - protein, 71 aa, Glycine max
  Coding DNA Sequence Number=SeqID_69280
MGIQSTLRHVIGSVQIMSYFCRLVMGEENDNICNGRCDWKVGESKALDSIIACEIEDCYSIYRSGLTKGPE

SEQ ID NO: 186059 - protein, 627 aa, Glycine max
  Coding DNA Sequence Number=SeqID_69281
  Gene Ontology: Mol. function=RNA-directed DNA polymerase activity; Cellular component=chromatin; Biological process=chromatin assembly or disassembly
  Pfam annotation: Domain name=rve; Domain location=327-466; Score =78.4; E_value=2.3e-20; Accession=PF00665.16; Description=Integrase core domain
MALRDSVLTIETLISRQLRTGYNQVRMKDSDIHKTAFKTHGGHFEYLVMPFGLTNTPTTFQERVEYLGHFITKDGVSTDPAKIMAVKNWPIPTSLKQLRGFLGLAGYYRRFVRGFGGIARPLTNMLKKNNFHWSDEAKVAFQSLKDSLIQSPVLALPDFSKVFVVEVDASGTVSSSLCSPKVEALSIEYSLYYQNRPQKLAVYTKPKVDDILPTEMADLDIQKLIQDLQTDASSHKHHTWNHNELRRKGRLVVGKDLTLWTDLLQWIHAGPTSGHSGREATLKRLKSVVYWRGMTKDVRIFVLNCEVCQKCKYDKFAYSGLLQPLPIPERIWQHITMDFIEGLPNSKGKQVIYVVVDILIAQSFLDNVFKLHGFPNSITSDRDPIFVSQFWKDLMAFQGVHLQLSSTYHPQTDGQSEVVNRCLETFLRCMCCDVPHERSKWLPLAEWWYNTNHHISIQCSPYEVMFGQPPPIYLPYLSSESKVEVIDRSLQKREEALKLVKFHMKRAQERMKQLADKKRSDRSYEIGDFVYVKLHLYKQISVAFRPNAKLAPKYFGPFQIEDKIGAIAYKLKLPQGSKIHDVFHVSQLKRHVGEAPVSNFLPTDSDGVMVGKEPELILDRARLSQRS

SEQ ID NO: 186060 - protein, 41 aa, Glycine max
  Coding DNA Sequence Number=SeqID_69282
MAPPKEIATVIYYNGHIADNPVQGSVYTWSDTLYLSTTTQQ

SEQ ID NO: 186061 - protein, 76 aa, Glycine max
  Coding DNA Sequence Number=SeqID_69283
MELPWEATMGSDVDLGARHGIKVSIGKESTWGHLSMVTAPKKKMGSVGWPQGNQSWMRKGRLPPLEGGREGTEAQD

SEQ ID NO: 186062 - protein, 65 aa, Glycine max
  Coding DNA Sequence Number=SeqID_69284
MDKDCCFLKVVVMIDPGGIVHHFQTMNKSNLLSSETLPKEDEGADDQDALVDSLDAMPDEEEDPE

SEQ ID NO: 186063 - protein, 98 aa, Glycine max
  Coding DNA Sequence Number=SeqID_69285
MRYQVHDCNSMAQPLITLPTSDDAWHSSLYSNGECKMLNNHVSFNAAPLRAFSGGTSPSLHCLTNAVINAGSILHYSIREICWNPVDDNNGIIYGSDS

SEQ ID NO: 186064 - protein, 357 aa, Glycine max
  Coding DNA Sequence Number=SeqID_69286
  Gene Ontology: Mol. function=protein serine/threonine kinase activity; Cellular component=chloroplast; Biological process=protein amino acid phosphorylation
  Homolog annotation: Hit_ID=Q10BD9; Match level="QueryCoverage=77%, HitCoverage=70%, E-value=1e-111, Identity=66%"; Hit description =Protein kinase APK1B, chloroplast, putative, expressed
  Pfam annotation: Domain name=Pkinase; Domain location=50-302; Score =106.5; E_value=7.9e-29; Accession=PF00069.15; Description=Protein kinase domain
  Pfam annotation: Domain name=Pkinase_Tyr; Domain location=50-302; Score=68.6; E_value=2.1e-17; Accession=PF07714.7; Description =Protein tyrosine kinase
  Pfam module annotation: Pfam domain module=Pkinase::Pkinase_Tyr; Domain location=50-302::50-302
MEEPSEIIFDDNVQNSIEGSLLEVSAGVAMTSAQIAGAHQPPYPSLLGVRGGFGSVFKGWIDEHSLAATKPGIGMIVAVKRLNQDGFQGHREWLAEINYLGKLQHPNLVRLIGYCFEDEHRLLPFSWSLRMKIALGAAKGLAFLHSTEPKVIYRDFKTSNILLDTNYSAKLSDFGLARDGPTGDKSHVSTRVMGTHGYAAPEYLATGHLTTKSDVYSFGVVLLEMISGRRAIDKNQPTGEHNLVDWAKPYLSNKRRVFRVIDPRLEGQYLQSRAQAAAALAIQCLSIEARCRPNMDEVVKALEQLQESKNMQRKGADHKQHHVRNSGPGRSNGGNGGSDVPRKASAYPRPSASLLRG

SEQ ID NO: 186065 - protein, 233 aa, Glycine max
  Coding DNA Sequence Number=SeqID_69287
MREAIVEECEWARITSSNLKYKRKKTWHANQGFVSVSLRVFLCDGDNNDNDGNVSNNDDDRNISDGLNCSSGDDGGGDDVGGSDADGGDIDNVVAIAMLVVTVNGGDVGGDKGGIIDNDNNIGGDNDKNGISGGGGGGSNVNCISDNIGDNDSGGHVMVVIMTIAVIVTRAVTGFMGVGFMGQAYRMPISSSDTNGVSGCGGGNNASDNDILMIVVMIMSITMVVITIRWWWW

SEQ ID NO: 186066 - protein, 1239 aa, Glycine max
  Coding DNA Sequence Number=SeqID_69288
  Gene Ontology: Mol. function=ubiquitin-protein ligase activity; Cellular component=nucleus; Biological process=ubiquitin cycle
  Homolog annotation: Hit_ID=Q9LZ95; Match level="QueryCoverage=30%, HitCoverage=31%, E-value=5e-86, Identity=46%"; Hit description =Ubiquitin-protein ligase E3-alpha-like protein
  Pfam annotation: Domain name=zf-C3HC4; Domain location=575-629; Score= 5.6; E_value=0.042; Accession=PF00097.15; Description=Zinc finger, C3HC4 type (RING finger)
MLTLIIQIVKERRFSGLTTAECLKRELIYKLSIGDATHSHLVKSLPRDLSKFEQLQDILDTVAVYSNPSGFNQGMFSLRWSFWKELDLYHPRWNSKDLQVAEERYLRFCSVSALTTQLPQWTKIHPPLRGIARVATCKVVLHIIRAVLFYAVFTFKSSESRAPDSVLLPALHLLSLSLDICFQQKESSENTCHDVSHLPIIALSGEIIESSFGEQSLLSLLVLLMEMHRKENVDNFVEAGGCSLYSLIESLLKKFAEIDNRCMTKLQKLAPEVVSHISECVPTRDSSVSSSASDSEKRKAKARERQAAIMEKMRAQQSKFLASIDSTVDDGSQLGHEGDLDTEQDVEESDSKQVVCSLCHDHNSKHPISFLILLQKSRLVSSVDRGPPSWAQLCRSDKDRTPIINTNEMDTLPINCNSVSLGSTSSSHLSQFVQNAAKELASCGKPGEVLTFLQYVKNKFPALSNFQLPDTYYHDKENTPYTFETLEQGMYFSVRDEMHDLLLSSNLLNEDEKVSTVGGNSNFIIDTGSVLLGKYTADLVQEMSEVSSVSENASNETASVESTSQHPAYDGFGPTDCDGVHLSSCGHAVHQGCLDRYLSSLKERSVRRIVFEGGHIVDPDQGEFLCPVCRRLANCVLPTLPGELQKPFKQSTILSTSSINTAPPLAELSELTYSLRLHLGLKLLQSAANAVGKDKFLNAIPLHHIDRTRTNLEKFIWGLSKMYSPCKEEKLSRFSRLNHSMLMWDTLKYSLTSMEIAARCGKTSFTPNFALSALYEELKSSSGFILSLMLKLVQKTRSNNSLHVLQRFRGVQLLAESICSGVSLNYANNDESGRGDMLSILKQIEMDLSNTNISFWSQASDPVLLHDPFSTLMWVLFCLPHPFLSCEESLLSLVHVFYIVAVTQAIILYYEKSKDKPSRESALSDCLITDIYNVMDESGYAQQYFVSNYFDPNVDIKNAIRRFTFPYLRRCALLWKILYSSIPAPFCDEENILDRSWNAPKDIMDWANIEIFEVAKIQELEKMFKIPSLDMVLKDELSRSTVSIWCHHFCKEFDLRRIQQNMHVTPAVPFELMRLPNVYQDLLQRCIKQRCPECKSVLDDPALCLLCGRLCSPSWKSCCRESGCQTHAVTCGAGTGVFLLIKRTTILLQRSARQAPWPSPYLDAFGEEDFEMHRGKPLYLNEERYAALTYMVASHGLDRSSRVLGQTTIGSFFLESVNEGVRLARWAGIVEEIGHILPI

SEQ ID NO: 186067 - protein, 129 aa, Glycine max
  Coding DNA Sequence Number=SeqID_69289
MRLDHYRVIKTKCTGDAAVLKEIIEHDRVYDFLVEWGQKGERSARKNELTHVAVAGTNEENKPESTDLDQEEIERDKHLRMMFGHGRVSNDLYYLEESNLSTMVKNSLPHTFMSDSMLSNKKNFLYHCW

SEQ ID NO: 186068 - protein, 77 aa, Glycine max
  Coding DNA Sequence Number=SeqID_69290
  Gene Ontology: Mol. function=transcription regulator activity; Cellular component=nucleus; Biological process=regulation of transcription
MKVDARVVWDDEDKAMLGAVWASALMAVGSEEGLQNKLSDLVEHPNVSNFSWNYSIFWLLGWGDGCCRKPSEEEEEH

SEQ ID NO: 186069 - protein, 123 aa, Glycine max
  Coding DNA Sequence Number=SeqID_69291
  Subcellular localization annotation: CTP_CleavageSite=72; ConfidenceScore=5.79e-01
MLGAPSNIAGAPSNSMKGQFCPSVKKIKSIFFLPGSILSFSHCVSFAKSFFSSLFPDKLLLRELLRQPLDPFAFEVGGLLLSFGFVMHYIRTKPRVEDERGEDERTPEKMAEIADGGVFRKTP

SEQ ID NO: 186070 - protein, 57 aa, Glycine max
  Coding DNA Sequence Number=SeqID_69292
MVEVHTWGRQDNVDKNIAAQHRYREGELMARHIRVDSTCYDNARLDLTRWLGGHPVP

SEQ ID NO: 186071 - protein, 34 aa, Glycine max
  Coding DNA Sequence Number=SeqID_69293
MGAQSSKLCTLPVNKLIVLYVVFKLYVVLKALFL

SEQ ID NO: 186072 - protein, 226 aa, Glycine max
  Coding DNA Sequence Number=SeqID_69294
MHETSPFLAEVSCARKGLTLTMTLTLETEIRALGSFLGVQDLMVGFGVAAIEDRKKKDYSKKRLNFRKIFIFLIAKDGGISSRVRPTIIRFGHIDDDDDKEVDDAIVVEESRENNNDESEYNYNHVVYQDSQRYDSENLSLEDLFDNDGLTQDSCFEVSSKENREFMTNRTESLSEVENGAFGESQNEEAMKSRVNEIQNEGVEEVKIEDLKCVFDLNEVPIEGCK

SEQ ID NO: 186073 - protein, 537 aa, Glycine max
  Coding DNA Sequence Number=SeqID_69295
  Gene Ontology: Mol. function=sequence-specific DNA binding; Cellular component=microtubule associated complex; Biological process =microtubule-based movement
  Homolog annotation: Hit_ID=Q1S664; Match level="QueryCoverage=94%, HitCoverage=80%, E-value=0.0, Identity=72%"; Hit description=Kinesin, motor region; Helix-hairpin-helix DNA-binding, class 1; DNA polymerase beta, N-terminal-like
  Pfam annotation: Domain name=HHH; Domain location=464-493; Score =22.3; E_value=0.0017; Accession=PF00633.13; Description=Helix -hairpin-helix motif
  Pfam annotation: Domain name=Kinesin; Domain location=1-248; Score =185.5; E_value=1.3e-52; Accession=PF00225.13; Description=Kinesin motor domain
  Pfam module annotation: Pfam domain module=HHH::Kinesin; Domain location=464-493::1-248
MGAEVVDLKKFIHSWDLDSLNLWYLVGTEEQPGLMPLAMSAILSICQSTGCTAQISYYEVYMDRCYDLLEVKAKEISVWDDKDGQIHLRGLSQVSINTMSEFQDVFSCGVQRRKVAHTGLNDVSSRSHGVLVISVSTPSADGTGTVVCGKLNLIDLAGNEDNRRTCNEGIRLQESAKINQSLFALSNVIYALNNKKPRVPYRESKLTRILQDSLGGTSRALMVACLNPGEYQESVHTVSLAARSRHVSNFVPSAHKQETPKVKVDMEAKLRAWLESKGKTKSSQRLGPLNSPLPKKTPSSIVTPAKRSITFNSSVKKGGRTAINLDAQHTNERAFAVAFGNLLDVEGSFDSCMENAPSGVKENDDKGTEHDANKPAWKSYKNLPVESLSKGVNSITIKSKDAAQSPLRKALSPININGNQKPLESQTPFLATCSTNKGPQKNDTPLGKFSTRSSTLKNCLVQEYIDFLNNASREELLELKGIGEKMAEYIIDLREESPLKSLNDLEKIGLSSKQAHNLFTKAAKTLFEDKAEDSILS

SEQ ID NO: 186074 - protein, 45 aa, Glycine max
  Coding DNA Sequence Number=SeqID_69296
MTKVSNGYCNDYYLRFYEKLWKSKWVDVMEAGHWADVTRFENLTI

SEQ ID NO: 186075 - protein, 602 aa, Glycine max
  Coding DNA Sequence Number=SeqID_69297
  Gene Ontology: Mol. function=protein phosphatase type 2C activity; Cellular component=protein serine/threonine phosphatase complex; Biological process=protein amino acid dephosphorylation
  Homolog annotation: Hit_ID=Q1SBX2; Match level="QueryCoverage=99%, HitCoverage=100%, E-value=1e-142, Identity=51%"; Hit description =Protein phosphatase 2C, putative
  Pfam annotation: Domain name=PP2C; Domain location=266-565; Score =65.4; E_value=1.8e-16; Accession=PF00481.12; Description=Protein phosphatase 2C
MGNRIGNLCLCSSGDASGRFENRASFLSKQLQNSLGNSICYVRSETCRFSDDDVTLLTFRSVSGATVSANTSATPSTSLDDSLQHSVVLDSSASFESSGSFTSTLVPFQNQHMPRGFSVEGSTERGLYSGLRDSVMNGEGSIEKGSSEVAIKKGKRSKRDLKKVLSRAFLSIRRISIKKNDNANARVSCSTSLSAEMSLHGSEGDNDNKYLDGDECDVLMGCENLHWAQGKAGEDRVHIVICEDHGWVFVGIYDGFNGPDATDFLLNNLFYAVNDELKEILCGHNKFESMVMDSDTLELDENVFLSCNGNGGADGGCSSSENKENYPIENEELNLECASEGEEGMNGINSEKVGLSHSDVLEALSEALRKTEDAFMKTVDEMIGHNPVLAMMGSCVLVMLMKGQEVYLMNVGDSRAALATHTGESLQLTMDHGTHVKEEVYRIRREHPDDPLAVTKGRVKGHLSVTRAFGAGFLKQPKQNNAVLETFRVSYIGESPYITCFPSLHHHKLSTNDKFLILSSDGLYQYFTNEEAAAKVESFITMFPDRDPAQLLIEEALGRAAKKAGMEFHELLDIPHGERRNYHDDISIVIISLEGKIWRSLV

SEQ ID NO: 186076 - protein, 528 aa, Glycine max
  Coding DNA Sequence Number=SeqID_69298
  Gene Ontology: Mol. function=helicase activity; Cellular component =mitochondrion; Biological process=embryonic development ending in seed dormancy
  Homolog annotation: Hit_ID=Q9FFE3; Match level="QueryCoverage=91%, HitCoverage=93%, E-value=1e-139, Identity=50%"; Hit description=Salt- inducible protein-like
  Pfam annotation: Domain name=PPR; Domain location=106-140; Score=4.9; E_value=2; Accession=PF01535.11; Description=PPR repeat
  Pfam annotation: Domain name=PPR; Domain location=173-207; Score =40.4; E_value=6e-09; Accession=PF01535.11; Description=PPR repeat
  Pfam annotation: Domain name=PPR; Domain location=208-242; Score =35.7; E_value=1.6e-07; Accession=PF01535.11; Description=PPR repeat
  Pfam annotation: Domain name=PPR; Domain location=243-277; Score =40.0; E_value=8.4e-09; Accession=PF01535.11; Description=PPR repeat
  Pfam annotation: Domain name=PPR; Domain location=278-312; Score =46.1; E_value=1.2e-10; Accession=PF01535.11; Description=PPR repeat
  Pfam annotation: Domain name=PPR; Domain location=313-347; Score=6.5; E_value=1.3; Accession=PF01535.11; Description=PPR repeat
  Pfam annotation: Domain name=PPR; Domain location=348-381; Score=9.9; E_value=0.5; Accession=PF01535.11; Description=PPR repeat
  Pfam annotation: Domain name=PPR; Domain location=382-416; Score =39.9; E_value=8.6e-09; Accession=PF01535.11; Description=PPR repeat
  Pfam annotation: Domain name=PPR; Domain location=417-451; Score =54.5; E_value=3.6e-13; Accession=PF01535.11; Description=PPR repeat
  Pfam module annotation: Pfam domain module=PPR::PPR::PPR::PPR::PPR::PP R::PPR::PPR::PPR; Domain location=106-140::173-207::208-242::243 -277::278-312::313-347::348-381::382-416::417-451
  Subcellular localization annotation: CTP_CleavageSite=19; ConfidenceScore=5.49e-01
HPFSTATAAAITANSVPATAALPSSSFRSQPPIYPWPRRLTPHNLASLISRQHDPDLSLQIFHHAHPSLSHAPQPLHALFLKLSRARRFYHLESLLTHLPNPPPEPPLTTLIRAYGLAGKPLSALRIFLKFQPLGVRSLNALLNALVQNKRHRLAHSVFKSSTEKFRLVPNVVSCNILLKALCKRNEVDVAVRVLDEMSLMGLVPNVVSYSTVLGGFVFKGDMESAMRVFGEILDKGWMPDVTSYTVLMSGFCRLGKLVDAIRMMDLMEENRVQPSEVTYGVMIEAYCKGRKPGEAVNLLEDMVEKGLVPSSVLCCKVVDLLCEEGSVERACEVWRGVVRKGWRVGGAVVSTIVHWLCKEGKVVEARGVLDELEKGEVASLMTYNTLIAGMCERGQLCEAGRLWDEMVEKGRVPNAFTYNVLMKGFCKVGDVKEAIRVLEEMVESGCLPNKSTFSILVDGISLSGGKKEEIDKVVLLAMTTGVDGEWWDLFLKLVVGNLDGNASELDRILTENAVISFVVCPRLEMDD

SEQ ID NO: 186077 - protein, 183 aa, Glycine max
  Coding DNA Sequence Number=SeqID_69299
MVSTKGASKGSTGDMSKIQGYDEVILLVSFDSLMLRSIQGFSAFLDQLRERVSDNIEVAVATDTGHPVEVPQACPTTTRIRLVTIELMVEVGLWLKLAQIGMLFALLVGIGYPRHPTTPFPLPLLSKHLVHGMLLLILLCRLGRNQGERTKTSIGIERGVVATTKVAQGNHPGTRMAACITRS

SEQ ID NO: 186078 - protein, 81 aa, Glycine max
  Coding DNA Sequence Number=SeqID_69300
  Homolog annotation: Hit_ID=Q153F5; Match level="QueryCoverage=42%, HitCoverage=9%, E-value=3e-07, Identity=62%"; Hit description=Pectin acetylesterase
MGGVCAGEGVRVWSGAFGKYQLATTKRSEIHIVASGAARKRRAVNALYCFSVKVPITNGFSNGLLQRQGNNSGSTTMDYMW

SEQ ID NO: 186079 - protein, 113 aa, Glycine max
  Coding DNA Sequence Number=SeqID_69301
MLVFAKKISLEIELKIKEAYEKKKVVNNAAFGVEKDDDEVEALEETNNIRAGKRPAAAGSTVAFAVKGDTGNDHMDLHTLKSPEASNKLTGAMAKRKTAYKILVLKKQSCILL

SEQ ID NO: 186080 - protein, 156 aa, Glycine max
  Coding DNA Sequence Number=SeqID_69302
MKGDWNVYRFLLCPLPEMDVTWHSPNSPKTNDKSYETLNRGEGGFGACQKVPLEIKLKIKEASEKNKVVNDVAVGLEKGDDDEVEALEEIYYVRVGKRFASTDSNLAPAAKRNNVKDHMDLHMLKSSEASNKLTMAKRKQTYGMLVLKKKGLEPFL

SEQ ID NO: 186081 - protein, 100 aa, Glycine max
  Coding DNA Sequence Number=SeqID_69303
LKDGLNWYREKLLVTPEKTHVCELFNVSSTGLCKLADGDPNHGVGYWKGFRRSDGGQQWPENLSKFCHRGQWVLTVFEMPLSDSGLHVKKGNGPKSCAWS

SEQ ID NO: 186082 - protein, 97 aa, Glycine max
  Coding DNA Sequence Number=SeqID_69304
  Gene Ontology: Cellular component=cellulose and pectin-containing cell wall
  Homolog annotation: Hit_ID=Q8LAE9; Match level="QueryCoverage=66%, HitCoverage=16%, E-value=7e-12, Identity=50%"; Hit description =Pectin acetylesterase
MEKLIPFSGILSSDPAQNTGCVNVCREEVGCSSEARSYGKLLWMNSYQLACLKQSRLCFQDALLEDWQLLYTDNFRQVLPKEATVECLADAGFFLDE

SEQ ID NO: 186083 - protein, 135 aa, Glycine max
  Coding DNA Sequence Number=SeqID_69305
  Gene Ontology: Mol. function=protein-tyrosine kinase activity; Cellular component=integral to membrane; Biological process=protein amino acid phosphorylation
  Homolog annotation: Hit_ID=Q1RSY3; Match level="QueryCoverage=84%, HitCoverage=19%, E-value=2e-23, Identity=49%"; Hit description =Protein kinase
  Pfam annotation: Domain name=LRRNT_2; Domain location=28-69; Score =28.8; E_value=2e-05; Accession=PF08263.3; Description=Leucine rich repeat N-terminal domain
MKPTTKNFNVLPIFLGSLFCLFLAGLDAESDVYCLQTIKKLDQFNHLSSWDFKSNTEGDMCRFSGVECWNNVKVIGLSLSNKGLKGQFPSCVENFAWLQTLNLSHNELSGYILSDISTSQLTYLTSLDLSNNNFY

SEQ ID NO: 186084 - protein, 52 aa, Glycine max
  Coding DNA Sequence Number=SeqID_69306
  Gene Ontology: Cellular component=extracellular region
  Homolog annotation: Hit_ID=Q9XFB4; Match level="QueryCoverage=84%, HitCoverage=25%, E-value=8e-18, Identity=97%"; Hit description=PR1a precursor
MGYMCIKISFCVMCVLGLVIVGDVAYAQDSAEDYVNAHNAARAERAMLINAK

SEQ ID NO: 186085 - protein, 203 aa, Glycine max
  Coding DNA Sequence Number=SeqID_69307
  Gene Ontology: Mol. function=protein kinase activity; Biological process=protein amino acid phosphorylation
  Homolog annotation: Hit_ID=Q1RSY1; Match level="QueryCoverage=46%, HitCoverage=19%, E-value=2e-15, Identity=43%"; Hit description =Protein kinase; Peptidase M, neutral zinc metallopeptidases, zinc- binding site
MSILSPPEASLFITTKLFLIDGHGVKGSVEKDVYDFGIILFELITGKRLSSTTDSSDSVNGQLMNYISNNLFTDPADFYDTIDESIIGKGFDDKILGLLKVACDCVKGSLKQRPKMVDMHKTIRAMWEGYKPWFDSERLKLSLGCSDHITCISEIECSALPLIRHFRTMNVCLFIYNTVKLKLCNFMIQIEQNKESFNEDEDF

SEQ ID NO: 186086 - protein, 281 aa, Glycine max
  Coding DNA Sequence Number=SeqID_69308
  Gene Ontology: Mol. function=peptidase activity; Cellular component =extracellular region; Biological process=response to biotic stimulus
  Homolog annotation: Hit_ID=Q9XFB4; Match level="QueryCoverage=59%, HitCoverage=95%, E-value=2e-94, Identity=98%"; Hit description=PR1a precursor
  Pfam annotation: Domain name=SCP; Domain location=35-160; Score =103.1; E_value=8.4e-28; Accession=PF00188.16; Description=SCP-like extracellular protein
MGYMCIKISFCVMCVLGLVIVGDVAYAQDSAEDYVNAHNAARAEVGSQSPRQTVIVPSLAWDDTVAAYAESYANQRKGDCQLIHSGGEYGENIAMSTGELSGTDAVKMWVDEKSNYDYDSNSCVGGECLHYTQVVWANSVRLGCAKVTCDNGGTFITCNYDPPGNFVATSVLVSFMVYYAPWTEFKKRRSNAIHPLMKKQNHQKNTRQEAELLPLAMQEQGSKERLIPRMSFKELCKATDYFSTDNVLGIGTTGIMYKAKAQKHSSIGRILHRKKRKDFGV

SEQ ID NO: 186087 - protein, 110 aa, Glycine max
  Coding DNA Sequence Number=SeqID_69309
  Subcellular localization annotation: CTP_CleavageSite=60; ConfidenceScore=5.12e-01
MKVKYSKGKRRTNVQDSGTNGASKIATTTGASLLQANLQRCNLNLGLRVHQVATTAGASKATSAKGKALLGMVLPWPRGSSLSKAPSALAPCMASYIQNNTPWEIPPKQP

SEQ ID NO: 186088 - protein, 1403 aa, Glycine max
  Coding DNA Sequence Number=SeqID_69310
  Gene Ontology: Mol. function=RNA-directed DNA polymerase activity; Cellular component=chromatin; Biological process=chromatin assembly or disassembly
  Pfam annotation: Domain name=Chromo; Domain location=1300-1349; Score= 37.6; E_value=4.2e-08; Accession=PF00385.14; Description='chromo' (CHRromatin Organisation MOdifier
  Pfam annotation: Domain name=RVP_2; Domain location=323-455; Score= -50.9; E_value=0.0093; Accession=PF08284.2; Description=Retroviral aspartyl protease
  Pfam annotation: Domain name=rve; Domain location=1006-1167; Score =89.6; E_value=9.8e-24; Accession=PF00665.16; Description=Integrase core domain
  Pfam annotation: Domain name=zf-H2C2; Domain location=978-1019; Score= 27.6; E_value=4.3e-05; Accession=PF09337.1; Description=His(2)-Cys(2) zinc finger
  Pfam module annotation: Pfam domain module=Chromo::RVP_2::RVT _1::Retrotrans_gag::rve::zf-H2C2; Domain location=1300-1349::323 -455::579-748::95-185::1006-1167::978-1019
MTGPHDPTSPNLETILTRLTDTMQSMNLKLDELLHRPASVFPPQPEPPPISPVPTTQHKMKLEVPRFDGTEPLGWIFKINQYFEYHGTPKRERLTIASFYMEGRALAWFQWMSSNAQFTSWPGFLQALQTRFAPSQYEDPTGILFKLTQKGTVSQYLSEFEDLANRVIGLPSPFLLSCFISGLTPEIRREVQAHQPLTLVQAAGHAKLQEEKFSDNRNPPRSRAPPPQPNPIRVLPTSAEPRPTLPPLLPAPPRPTPSLMKRLMPEELTSRRERGLCFTCDERYHRGHRCAARAFLLVTEEEEPSDSKIDPPDPPPDPPDEPDPFQAQISLNSFSGHLAPEALRMAGILADHRVVLLVDGGSTHNFVQPTLVTQLGLPCRSISPLRVMVGNGQHLDCSAICEGVSIIIQDVKFTLDLHVLPIVGANVVLGVQWLKTLGPILTDYGSLKMQFFYQNQLIELKGDTAIDSSFLTHHQLRRLCRTQTQASYFHIAIITDDPEPPHSQTLPPEIQALLTHFSNLFQSPSGLPPNRVTDHHIHLLPHTSPVNVRPYRYPHYQKKEIEQQVNDMLQKGLIRPSTSPFSSPVLLVRKQDGSWRFCVDYRALNAVTIRDRFPIPTIDELLDELGGAQYFSKLDLLQGYHQIRMHASDIPKTAFRTHHGHYEFKVMPFGLCNAPSSFQATMNSIFRQHLRHFIIVFFDDILVYSTSFEAHLHHLTITFQVLLDNNFVLKLSKCSFAQKQVEYLGRVVSHKGVEPVVSKIEAIQQWPTPKSAKAVKSFLGLAGFYRRFIRNYATIAAPLVRLTAKDSFDWSPQTQEAFDQLKTALSTAPVLALSDFTIPFTVETDASGIGMGAVLTQKGHPVAFFSKPFTPKLAVASTYVRELVAITTAVKRWRQYLLGQRFIIITDHRSLKELLTQVIQTPEQHKYLARLLGYDYEIRNEPDKHPSFSISQELILTGGRIWLPRDLPLTATLLQEYHTTPTGGHAGITKTLARISENFTWTGLREDVKQFVANCMDCQVTKFHCRPAGVSRKTTILVVVDRFSKGIHLGMLPTSHTAHMVASLFVDMVVKIHGIPRSLVSDRDPLFISKFWQELFKASGTHLRMSSAYHPQSDGQTEVLNRIVEQYLRAFVHKRPNRWGKLLPWIEWSHNTSWNAGTGTTPYEVTFGKKPFNFPEYITGTSNIEAVEHLLTDRDATFQTIRKKLLKAQEIMKRQADSKRRDVQYQKGPQPTAGKLAKRFYGPFQVEDRIGTVAYKLKLPESARIHPVFHCSKLKPFRGNPEQHSELNLPPTFIHDQPVVHPLAILDSRKNPATGTWEVLIQWEGLSPDETSWEDWEQLQQDFHLEDKVRLQGPKSVMNKEASGGDSMDITATTEGILTNKEVQKETTFKRRIKKPTYLKDFV

SEQ ID NO: 186089 - protein, 148 aa, Glycine max
  Coding DNA Sequence Number=SeqID_69311
  Homolog annotation: Hit_ID=Q9SIB4; Match level="QueryCoverage=43%, HitCoverage=26%, E-value=8e-26, Identity=84%"; Hit description =WUSCHEL-related homeobox 3
  Pfam annotation: Domain name=Homeobox; Domain location=5-66; Score =54.6; E_value=3.2e-13; Accession=PF00046.19; Description=Homeobox domain
MSPAGSPRWSPTTEQLMILEELYRSGIRTPSASQIQQITTHLSFYGRIEGKNVFYWFQNHKARDRQKLRRKLTKQLQLQQQQQQQLQLHHHCPKLNQDHFTNHFVGNFGYSTLRSTTHDFPFFNPPSLLFQGGAANTSSEQALSCKWN

SEQ ID NO: 186090 - protein, 39 aa, Glycine max
  Coding DNA Sequence Number=SeqID_69312
MKSWNNELELLGWCGAVFTDSGSCERKEIKSLDRSSGAT

SEQ ID NO: 186091 - protein, 83 aa, Glycine max
  Coding DNA Sequence Number=SeqID_69313
  Gene Ontology: Mol. function=metal ion binding; Cellular component =nucleus; Biological process=regulation of transcription from RNA polymerase II promoter
  Homolog annotation: Hit_ID=Q1SB28; Match level="QueryCoverage=54%, HitCoverage=31%, E-value=3e-21, Identity=93%"; Hit description=G10 protein; Cytochrome c and b562
MEKEAKRREKRWWLCVNCDGGREKKGDVGKRGEIDVHSVPASTALATTMNTLYNLLLPKVLGNSANTSGGKIVIAWLHTPQAA

SEQ ID NO: 186092 - protein, 864 aa, Glycine max
  Coding DNA Sequence Number=SeqID_69314
  Gene Ontology: Mol. function=oxidoreductase activity; Cellular component=integral to membrane; Biological process=electron transport
  Homolog annotation: Hit_ID=Q15FD2; Match level="QueryCoverage=91%, HitCoverage=94%, E-value=0.0, Identity=65%"; Hit description=NOX1
  Pfam annotation: Domain name=FAD_binding_8; Domain location=540-668; Score=141.8; E_value=1.9e-39; Accession=PF08022.2; Description=FAD -binding domain
  Pfam annotation: Domain name=Ferric_reduct; Domain location=341-498; Score=147.9; E_value=2.6e-41; Accession=PF01794.9; Description =Ferric reductase like transmembrane component
  Pfam annotation: Domain name=NADPH_Ox; Domain location=78-181; Score =160.1; E_value=5.5e-45; Accession=PF08414.1; Description=Respiratory burst NADPH oxidase
  Pfam annotation: Domain name=NAD_binding_6; Domain location=674-847; Score=247.3; E_value=3.3e-71; Accession=PF08030.2; Description =Ferric reductase NAD binding domain
  Pfam annotation: Domain name=efhand; Domain location=182-210; Score =26.9; E_value=7.2e-05; Accession=PF00036.22; Description=EF hand
  Pfam annotation: Domain name=efhand; Domain location=226-254; Score =10.9; E_value=0.85; Accession=PF00036.22; Description=EF hand
  Pfam module annotation: Pfam domain module=FAD_binding_8::Ferric _reduct::NADPH_Ox::NAD_binding_6::efhand::efhand; Domain location=540- 668::341-498::78-181::674-847::182-210::226-254
MSSQKGGKDESSTWILESIEIDPVVGRPKRDDEAPPNGSTVLKSPNDVAAVNNNNNNNNNNNNVRSRLGIRGSNGGRKMMRTESGAARGIKGLRFLDRTVTGRETDAWKSIEKRFTQNAVDGKLTKDKFGTCMGMGAESKDFAGELYEALARRRKVYAENGISLDEAKVFWEDMTNKDFESRLQVFFDMCDKNGDGKLSEDEVKEVIVLSASANKLGNLKMHADGYASLIMEELDPDHNGYIEIWQLETLLKEMVSSEEGTKKLDQCRAMTLSKAMIPSKYRTPVSKFLSKTTEFALDKWKKIWVFALWLAINLVLFIWKFKQYREKKAFQVMGYCLCFAKGAAETLKFNMALIVLTMCRRTLTKLRGSFLSRIIPFDDNINFHKTIAVAVVIGTFIHVMMHITCDFPRLISCPENKFFSIFGDGFNYEQPTYYTLVKSIPGLTGILMVLIMAFTFTLATHYFRKSVVKLPSPLHRLAGFNAFWYAHHLLIVVYILLIIHGYFLFLTKEWNKKTTWMYLVVPLALYAFERIHPFFRSKDHRVSIIKAIIYTGNVLALYMTKPQGFKYESGMYLFVKCPDISTFEWHPFSITSAPGDDYLSVHIRTLGDWTTELKNTFAQVCEPHNAQPRKGNLMRMETRAPNSTYNHPSKSRIRYPKILIKGPYGAPAQSYKNYDVLFLIGLGIGATPMISILKDMLNNMKSESPKEGTYMQDSVPSSNSDDQIKKGPERAYFYWVTREQSSFEWFKGVMDDIADYDCDNIIEMHNYLTSVYEEGDARSALIAMIQRLQHAKNGVDVVSESRIRTHFARPNWKKVFTELANAHQSSRIGVFYCGSPTLTKTLKELCHEFSLKSSTRFQFHKENF

SEQ ID NO: 186093 - protein, 1254 aa, Glycine max
  Coding DNA Sequence Number=SeqID_69315
  Gene Ontology: Mol. function=protein-tyrosine kinase activity; Biological process=protein amino acid phosphorylation
  Homolog annotation: Hit_ID=Q1S3M0; Match level="QueryCoverage=46%, HitCoverage=95%, E-value=1e-177, Identity=55%"; Hit description =Protein kinase
  Pfam annotation: Domain name=LRRNT_2; Domain location=667-713; Score =33.4; E_value=8.1e-07; Accession=PF08263.3; Description=Leucine rich repeat N-terminal domain
  Pfam annotation: Domain name=LRR_1; Domain location=764-787; Score =15.8; E_value=0.16; Accession=PF00560.23; Description=Leucine Rich Repeat
  Pfam annotation: Domain name=LRR_1; Domain location=789-811; Score =6.4; E_value=18; Accession=PF00560.23; Description=Leucine Rich Repeat
  Pfam annotation: Domain name=LRR_1; Domain location=813-832; Score =7.0; E_value=14; Accession=PF00560.23; Description=Leucine Rich Repeat
  Pfam annotation: Domain name=LRR_1; Domain location=834-856; Score =6.2; E_value=20; Accession=PF00560.23; Description=Leucine Rich Repeat
  Pfam annotation: Domain name=Pkinase; Domain location=967-1238; Score= 10.1; E_value=3.7e-09; Accession=PF00069.15; Description=Protein kinase domain
  Pfam annotation: Domain name=Pkinase_Tyr; Domain location=966-1238; Score=-36.9; E_value=3.3e-10; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=667-713::764-787::789- 811::813-832::834-856::967-1238::966-1238
MELLLPVLHLILQVLGCNAWLPKVILGSQGLFRRIAPSLAIVRNAKATGWSLAGIGSEPDNGGRDGCADGGVVGMGSEGSMADGGGMGCGVGMGDGGGMDGRVGMGEGVGMGSEVSKGVGRNCMSAENGGGVGMDGGGGSGDCTEEEGKVGQGGLKMVLGSGRKFKVPWKLRLASGVGGGSGSWYDSHGSSVWRVVWVVVVEVGMAAIHGREPWALNESTKMLGAAYGKIGFEGPTPLEEEEKKKKHLEFEDQATSKSKRKKRNYAIFSILEAQLQTCIYKLRRGQEPDKHDPILVVRFLYVRTLHEHGATATRVAPNPSSKNEGSSLQQAIGASAEAETMDTDAAAAIWKEIEASESYLVCSMYEEAAQLASSVLERLRHSHHDIDRDDMLESSAMVLLQAFNQLPSKTPHILNQLTLYFVSPKAIPSRLLLTGACFQIAQGSALSVQQFLHEFLNGWTLEHSQYSAVITEAASRDQSRRFILLPIVEYLQVVELYAVTLLATLQKNVDLAISWVENASLPEENRQSPTNSNEAYPLKEQNVSEGLPKALKSNEKYRSKEAVTKLSERIEACFWCFRGINLKIGTSKFVITSGKIMLGNGRKEGFGRFVAACVFLPSKSSGSCSTTVCYNTSSCPPSISNPCLLHTHHSKPAGTSGGRARGTILWAASDTESLLKFRDSLENNNALLSSWNASIPPCSDDDASSHWPHVQCYKGHVWGLKLESMRLKGVIDVQSLLDLPYLRTISLMNNDFDTAWPEINKVVGLKTIFLSNNKFSGEIPAQAFQGMQWLKKIHLSNNQFTGPIPTSLASIPRLMELRLEGNHFTGPIPNFQHAFKSFSVANNQLKGEIPASLHNMPASSFSGNEGVCGTPLSACSSSKKKSTVIFVVAVVLVIFGLIVIGAVILLVLRRRRRKQAGPEVASAEEAGSDKGSRMWMHSSSSSHGKRRFRLSFMRDERDDFDWRDLLKSSARILRSDGYSSSCKAVLLDGTEIVVKKFTQMNNVGRDEFREHMRRIGSFNHPNLLPLVAYYCIEEERVLITDFVPNGSLAARLHGSQPVGQASLDWGSRLKIVKGIAKGLENLYSEMPSLIAAHGNLKSSNVLLSESLEPLLTDYGLLPVINQDSAPKMMFIYKSPEYVQHGRITKKTDVWSLGILILEILTGNFPDNFLQDKGSDQQNLANWVHSQEWTSEMFDKDMMMETNNNNSEGEMIKLLKIALACCEWDEDKRWDLKEAVQRIHEVNEEDDNGHDSDGE

SEQ ID NO: 186094 - protein, 1120 aa, Glycine max
  Coding DNA Sequence Number=SeqID_69316
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=97%, HitCoverage=97%, E-value=0.0, Identity=63%"; Hit description =Transcriptional factor B3; Auxin response factor; Aux/IAA_ARF _dimerisation
  Pfam annotation: Domain name=AUX_IAA; Domain location=921-1100; Score= -94.0; E_value=0.0096; Accession=PF02309.7; Description=AUXIAA family
  Pfam annotation: Domain name=Auxin_resp; Domain location=255-348; Score=179.6; E_value=7.5e-51; Accession=PF06507.4; Description=Auxin response factor
  Pfam annotation: Domain name=B3; Domain location=128-233; Score =107.6; E_value=3.7e-29; Accession=PF02362.12; Description=B3 DNA binding domain
  Pfam module annotation: Pfam domain module=AUX_IAA::Auxin_resp::B3; Domain location=921-1100::255-348::128-233
MKTTQQPEAPQGDPCEEKKKSINPELWQACAGPLVNLPPSGTHVIYFPQGHSEQVAASLNKDPHSQIPNYPNLPSKLLCLLHNLTLLADPETDEVYAQITLQPVPSFDKDALLRSDLALKSSKPQPDFFCKQLTASDTSTHGGFSVPRRAADKIFPPLDYSMQPPAQELVARDLHDTVWTFRHIYRGQPKRHLLTTGWSLFVSGKRLLAGDSVLFIRDEKQHLLLGIRRANRQPTNISSSVLSSDSMHIGILAAAAHAAANNSPFTVFYNPRTSPSEFVIPLAKYYKSVYSHQPSLGMRFRMMFETEDSGTRRCLTFMSIYMKYMGTITGISDLDPVRWKNSQWRNLQVGWDESTAGEKRSRVSLWEIEPVTAPFFICPPPFFRSKRPRQPGMPDDELSDFDNIFKRTMPWLGDDMCMKDPQGLPGLSLAQWMNMQQNPALANSLQPNYAPSLSGSILQNIPGADISRQLGFSAPQISQSDNVALNTQRLLQTAQQLDHLQKLPSTSSTLGTVLLPQQQLGDITQQPRQNLANQTIPQGQVQSQLLHPQNMVQTNNILQQQQPSIQNHQLHRSLSQNPSQQQTTIGQNQPQNLIQSPMPDHVQQLQMSDNQIQLQLLQKLQQQKQTLLAQQTALQQPTQLTQIQDQQRQLLDKTHNLSRALTPGQVLEIPHIIQNSLPEANSISNQMTKANCQSNIQFSQQPKLQQQQQPGMVSEMPGHMALLPTATTNQLSAGGSSIVTGAGGAGQSVITDDVPSRSTSPSTNNCTNALPQLINSRFPRSTMVGDDMAHSAATILSSSALETSSSNANMLKDLQPKFEVKPSLNISKIQNQGHFAPHTYLNGNAAHTDCLDTSSSTTSVCLSQSDAHMNQNSNPLSYNRQSMLFRDNNQDGEVQADARSNIPYANNIDSQIGMPLNPDSLLTKGTLRLGKYLSNNFSSEGMLGNYENNRDAQQELSSSMVSQTFGVPDMAFNSIDSTIDDSNFLNSGPWAPPPAPPPLPPAQFQRMRTYTKVYKRGAVGRSIDITRYSGYEELKKDLARRFGIEGQLEDRQRIGWKLVYVDHESDVLLVGDDPWEEFVNCVRCIKILSPQEVQQMSLDGDFGNGGLQNQACSSSDGGNT

SEQ ID NO: 186095 - protein, 235 aa, Glycine max
  Coding DNA Sequence Number=SeqID_69317
MSVIRGGGEVVDNDNPGLDVGEVAGTEHEAEEGGSIERVVDLGDGDNEEAEAIGVEAVKLAFIAEACDDGLGMRERIECVMVRKLKGQVIETGGVREVHGVRVGEPNFFNFTVMKEGEKLVIVGSKEVLAVARWKGESGGYLLSKKLTVSLNGHNTLPFSQTNAGITSTIWTLLPATLARLLLGVAYGKAGFEGPTPPEEEEEKKKHLEFEDQATSKSKRKKRNSSIFSMLEAQL

SEQ ID NO: 186096 - protein, 804 aa, Glycine max
  Coding DNA Sequence Number=SeqID_69318
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=99%, HitCoverage=100%, E-value=0.0, Identity=59%"; Hit description =Protein kinase; UspA
  Pfam annotation: Domain name=Pkinase; Domain location=464-739; Score =71.1; E_value=3.5e-18; Accession=PF00069.15; Description=Protein kinase domain
  Pfam annotation: Domain name=Pkinase_Tyr; Domain location=464-733; Score=39.8; E_value=6.5e-15; Accession=PF07714.7; Description =Protein tyrosine kinase
  Pfam annotation: Domain name=Usp; Domain location=13-152; Score=45.9; E_value=1.4e-10; Accession=PF00582.16; Description=Universal stress protein family
  Pfam module annotation: Pfam domain module=Pkinase::Pkinase_Tyr::Usp; Domain location=464-739::464-733::13-152
MSRMNSEKKLGAGRVVAVAIENNKTSQHAAKWAVDNLLPKDQCLLLIHVRQRASSAPSSDHLSEAVADKESKELFESFRVFCNRKSIQCKEVLLEDMDISKALIDAISTNTIELLVLGAPSRSGLVRRFRTTDVPSTVSKGAPQFCTVYIISKGKISSVRSATAPLALKKAAIAAASPRNQLQPQQQQPHPQTMPSPERFSDPQLPRNYPPRPTSERAAPHGSHGARPTMMDEDDIISPFTRAGKTYESSKLLDSDISFVSSGRPSVDRMFPTMYEDMDSAMSGIAPGRFSDYDGRSSFASSYSSQSQGMDDCYSFSSQSRLSDCSTDDVEFEMRRLKLELKQTMEMYSSACKEAMTAKQKAMELKRLKVEEQKKLEESSSLSSGGEAAAAASSMALMMEMEKEKIREEALQKIAALEEQKRMSLQMERKIKPEKNVSVSSFGHGTASYRRYSIEEIEEATNMFSESLKIGEGGTNLKPAPLPPRCELDCTQVAIKVLKPDAAQGREQFQQEVEVLSCIRHPNMVLLLGACPEYGCLVYEYMANGSLDECLFPRGKSRPPLPWQLRFQIAAEIATGLLFLHQTKPEPLVHRDLKPGNILLDRNYVSKISDVGLARLVPPSVADTVTQYRMTSTAGTFCYIDPEYQQTGMLGIKSDIYSLGIMLLQLVTAKPPMGLTHHVGRSIEKGTFAEMLDPAIQDWPLEQALHFAKLSLGCAEMRRKDRPDLGKVVLPELNKLRLFAEQNMSPMMMFGLRSTGGGGAAGYVPRNSNSSIHSGLSSSTQGMSEVSGFSGYESRSSTSSLGRI

SEQ ID NO: 186097 - protein, 145 aa, Glycine max
  Coding DNA Sequence Number=SeqID_69319
  Gene Ontology: Mol. function=sequence-specific DNA binding; Cellular component=nucleus; Biological process=regulation of transcription
  Homolog annotation: Hit_ID=Q2PJS1; Match level="QueryCoverage=90%, HitCoverage=70%, E-value=5e-48, Identity=75%"; Hit description=WRKY53
  Pfam annotation: Domain name=WRKY; Domain location=109-140; Score =2.9; E_value=0.00032; Accession=PF03106.6; Description=WRKY DNA -binding domain
MENYSMLFSVSNSSSYPIGVGSSQIGYSGQSSNAFLGLRPSNELASDDHEKRQGGGDGNMLMSQISGGSINVSDELGGSGNSNNNKKKGEKKVRKPRYAFQTRSQVDILDDGYRWRKYGQKAVKNNKFPSFYLVAMAPAKFDLEN

SEQ ID NO: 186098 - protein, 75 aa, Glycine max
  Coding DNA Sequence Number=SeqID_69320
  Subcellular localization annotation: CTP_CleavageSite=53; ConfidenceScore=5.24e-01
MAPAQDRGGSTLPLLVSEPYPAPRPRRRSSWGGRTYNRGRTIQSCETQKCTVRLEEEKGAMKASMSSRLKRTMKK

SEQ ID NO: 186099 - protein, 96 aa, Glycine max
  Coding DNA Sequence Number=SeqID_69321
MIELYLTLVVDGSGVGRRKEGVPIPKAMSPKLVSCRSQWFDHRLSNVFESKIPSFNEIDVLKKHIKHVVAKSARDEVLQTPTTKMTLDLKVMYSSQ

SEQ ID NO: 186100 - protein, 83 aa, Glycine max
  Coding DNA Sequence Number=SeqID_69322
MVLDDTSNKVYHDDDDPRIYEEAMRSLDCKKWQEAMESEMESMKINKLVVKGFTRKGLEQMGRSRPIKLALLPRDIIKRRYRL

SEQ ID NO: 186101 - protein, 64 aa, Glycine max
  Coding DNA Sequence Number=SeqID_69323
  Gene Ontology: Mol. function=hydrolase activity, acting on ester bonds; Cellular component=anchored to membrane
  Homolog annotation: Hit_ID=Q2R3Y3; Match level="QueryCoverage=86%, HitCoverage=73%, E-value=1e-15, Identity=64%"; Hit description =Expressed protein
  Subcellular localization annotation: CTP_CleavageSite=35; ConfidenceScore=5.25e-01
MQNKSLVLFVVFSPGLLFQLPGKGRPVDFCNFQTSGVSVFVHSLLFFGFMAIFLIAIDVHIGSG

SEQ ID NO: 186102 - protein, 65 aa, Glycine max
  Coding DNA Sequence Number=SeqID_69324
MRRQVDAEDHQLRETSLVDNVGYLPGFPGSIRVAVSGHVPVPHASRGGHVPRWVAAAALGYSSGA

SEQ ID NO: 186103 - protein, 121 aa, Glycine max
  Coding DNA Sequence Number=SeqID_69325
MKGRDRLRKQEERKRLTWKIPLQRDGPKNETAQHRQIGDKCSNIENQHQKSNPRQQQQPNEERDRPEKHEGQGHAQKQRRECCRGILGGSQRCPPVMSPRMRQRRRSARRRTWVRVYEVTG

SEQ ID NO: 186104 - protein, 61 aa, Glycine max
  Coding DNA Sequence Number=SeqID_69326
MHILFGRPSLKNFIVKHAWLGVIVGWATFQEVSQKACWLRRLRDDAIANASHGSYHTQPMM

SEQ ID NO: 186105 - protein, 153 aa, Glycine max
  Coding DNA Sequence Number=SeqID_69327
  Gene Ontology: Mol. function=calcium ion binding; Cellular component =oxygen evolving complex; Biological process=photosynthesis
  Homolog annotation: Hit_ID=Q5PYQ5; Match level="QueryCoverage=99%, HitCoverage=65%, E-value=4e-37, Identity=57%"; Hit description =Chloroplast oxygen-evolving enhancer protein
  Pfam annotation: Domain name=PsbQ; Domain location=27-153; Score =47.7; E_value=3.8e-11; Accession=PF05757.2; Description=Oxygen evolving enhancer protein 3 (PsbQ)
  Subcellular localization annotation: CTP_CleavageSite=54; ConfidenceScore=5.72e-01
MAQAMASMTSLHGSSQAMLEGSLGSVRLNVGSGSRVASVTHVGFTVKAQQQQVNGGEVQSSRRAMLSLVATGLATGSFVQVVLIDAKPIKVGPPPPPSGRLPGTLNSDEPRHLKLPLKDRFFLEPLSPTDVAQRAKESAKEIVGVKKLIEKKA

SEQ ID NO: 186106 - protein, 73 aa, Glycine max
  Coding DNA Sequence Number=SeqID_69328
MVELHWSSGVDYVILGDFRRRVADSQKNFVNRGYGSLNLRSFLPLFKDVFDFDICHCNHRHRAKSKGEVAPKV

SEQ ID NO: 186107 - protein, 91 aa, Glycine max
  Coding DNA Sequence Number=SeqID_69329
MATDEERRGHSDYHNSIEMDLFKGFMENMDLIGIPLLGKLFLWINLDGKQDILYHNLILFKDEVCNWGSKPFRFFSYWLEHLDFVKFIVEL

SEQ ID NO: 186108 - protein, 147 aa, Glycine max
  Coding DNA Sequence Number=SeqID_69330
MLHSMLQSIHREQFIIMQSLQGLGLPSIMSMHEFDAQVAWPGAQPSPSGGGGASAAQGPAPKEPATATIEGEDELTPPKPFYFDADANIAQEEGTSINQIHEPSPVPIPEETQPSAPVTEPKQPIQDSSAAPALDLNEHQPQDEQDV

SEQ ID NO: 186109 - protein, 255 aa, Glycine max
  Coding DNA Sequence Number=SeqID_69331
  Gene Ontology: Mol. function=sequence-specific DNA binding; Cellular component=nucleus; Biological process=regulation of transcription, DNA-dependent
  Homolog annotation: Hit_ID=Q1S5S6; Match level="QueryCoverage=48%, HitCoverage=41%, E-value=1e-38, Identity=60%"; Hit description=Zinc finger, GATA-type
  Subcellular localization annotation: CTP_CleavageSite=63; ConfidenceScore=5.72e-01
MSPETPPTPPPSPPSTAATPQFRAATTASPPPLSLAASPVILNSPENSAFRLVLRRGGAEDAAATLRRRRRVHRHWRETADAGVLLLHRHASAVRLRRHLAKRTVSPLGNASPGEGAQQALTGGAGGLVHAPAPPGRDGAGEAAAAKGGAGEEERRNECGVFRTQMPALRYGEDAAVENGTDGTEDAVQRVRRKVQVREAGAGVPTGGESNVHVNEAFEFASEGFGAEAAEGAAATAAPAIDESKFNFRRIQRWG

SEQ ID NO: 186110 - protein, 66 aa, Glycine max
  Coding DNA Sequence Number=SeqID_69332
MASLFSILCTASIVVFLAVKFAAAREFKMGGDLGWHEHAPTSLHFIIIGMQGTGSKLVTLWLRKIK

SEQ ID NO: 186111 - protein, 208 aa, Glycine max
  Coding DNA Sequence Number=SeqID_69333
  Homolog annotation: Hit_ID=Q5JM57; Match level="QueryCoverage=77%, HitCoverage=79%, E-value=5e-47, Identity=55%"; Hit description =Integral membrane protein-like
  Pfam annotation: Domain name=DUF588; Domain location=38-193; Score =140.8; E_value=3.6e-39; Accession=PF04535.3; Description=Domain of unknown function (DUF588)
MVNEQRIQEEAKVAALECSGTMSGPLVGAAASAGTRRRRRAEAMQLVLRALCMASSVVAISLMVTAKESSSVSIYGFLLPLHSKWSFSESYEYLVGVSAAVAAHSLLQLLIGISRFLRMSSMIPSRNHAWLIFAGDQAFAYALMSAGSAASGVTNLNRTGIRHTALPDFCKPLHNFCDHVAISIAFTFTSCFLLATSAVQDVIWLSQH

SEQ ID NO: 186112 - protein, 103 aa, Glycine max
  Coding DNA Sequence Number=SeqID_69334
MANTSCPIELEPRTLNQVQLTQAREVAAKVVQKLEPCEASALFIEGLMHPIQEVMHMDENGSLAEKLVDCMKKAESIPDDKACHCQCSCAAENPFKEPLSAPF

SEQ ID NO: 186113 - protein, 262 aa, Glycine max
  Coding DNA Sequence Number=SeqID_69335
MLCQLSECASLSQSLCFCVVTYNEFRQELERRQWHRALTRQLDGHIDVALVKEFYANLYDSEDKSPRQFRVRGKLIKFDVASFNTFLETPVVLEPGEHLTTYSRSPRPSGAFFQALSTLEAPEKGFDYPGADLERALILQPRPHLSHVPSEYGQGKIAQSNSSKLNFLALITALFIARGVVPDSLTFESLSPAINLAYIRKNCWNPGDPSIIFPGTRKTQVRGPKASSSAPLVPSSSAPPPLAPAPVPFDTSAQSAEILVPM

SEQ ID NO: 186114 - protein, 76 aa, Glycine max
  Coding DNA Sequence Number=SeqID_69336
MGVANRNFEILNWAFQTVFQIWIASEGSNPNRLGEKNCFREENPSRGASVTLSRCFRKQIREGFPSFFIRSSFFNG

SEQ ID NO: 186115 - protein, 114 aa, Glycine max
  Coding DNA Sequence Number=SeqID_69337
MLLGAPSMSQEKGIETDQAEVEFGAETKGSKEWEEKKRVKITWNEQNFKNQIKPRQRQAGGYIRGLQGPIFNMLSSKNKFFVTPPSSPSMPSFAPLAIATLVVMLLFIGFIAMA

SEQ ID NO: 186116 - protein, 278 aa, Glycine max
  Coding DNA Sequence Number=SeqID_69338
  Homolog annotation: Hit_ID=Q5QLQ8; Match level="QueryCoverage=88%, HitCoverage=72%, E-value=1e-47, Identity=44%"; Hit description =Cytochrome B561-like
MAGEETTGKKRVVTESLGWLTESSIMPKKHRAIAGVGASSILELKAELYKSQEDSKKSRELAGPDAEYQRAKNKIAPKDKFSVKNRGVDARAHKKTVVFVPQISPLGGEKPMPFVKFRGIKLIKVEVQGLKLTFSETIFGVRDKLELKAVSDGTASYAALERKAELYEKLVNGELSDEEDQEKYCVDFFRKGIEHDELPPPPLGRDVLLQNEDGPVNDDDDSLMFNMKPVGPGRTAGAVDNADYKRNIRLDSLGGFNVKLLRIEMILGIRIKGVKMKP

SEQ ID NO: 186117 - protein, 154 aa, Glycine max
  Coding DNA Sequence Number=SeqID_69339
MRIQGTNRLRTLCPNTLEGTSFVAQVEGTSTWVVILRTREGTFLVDQFKWKVHPLGCSKRTREGTSLVDLWLVKYFTRLKEISRTVGCLGTGLVDEVVSSTLVQEERKHQLPTYFTSSILHDVEKRYQMIENYVERRTPKYTQGLLLFTPYNDQ

SEQ ID NO: 186118 - protein, 115 aa, Glycine max
  Coding DNA Sequence Number=SeqID_69340
MQKGLRTRQYLNNTELSPKNTETIFSLTVIKNYVGMSSSSQIKDTFCGRAKARLTGALSKGGKMRGVATNVYLWKTSEKLKETGQNENSKFGSRILGELEVDEPWLGLWLPLNYQ

SEQ ID NO: 186119 - protein, 81 aa, Glycine max
  Coding DNA Sequence Number=SeqID_69341
  Homolog annotation: Hit_ID=Q1SF19; Match level="QueryCoverage=89%, HitCoverage=18%, E-value=3e-17, Identity=77%"; Hit description=This gene is cut off
MARSGDGYGVGVDESYSALPWLYLTFLSIWLLSACSWTVYTYKTHHSQFINEVVLLICEAVDTCFGSVDQSIAAHAVLSLL

SEQ ID NO: 186120 - protein, 38 aa, Glycine max
  Coding DNA Sequence Number=SeqID_69342
MQFWNLMAKQDLGELGFKESNVETPGGNITDRVDNQEQ

SEQ ID NO: 186121 - protein, 141 aa, Glycine max
  Coding DNA Sequence Number=SeqID_69343
MMNNDTLGYNGQRGSRNLGELASGDYLTFGALIWHEKLIGVHMMPVEHPDAMPTTIDYTITCYVPWCRNLPFGGRATRGSWVRLPWEENARSHHQHLFEENVGKTGKVWSTNFKCAKFGSCFLRTGKELAPHASVTRDDSL

SEQ ID NO: 186122 - protein, 204 aa, Glycine max
  Coding DNA Sequence Number=SeqID_69344
  Gene Ontology: Mol. function=protein dimerization activity; Cellular component=nucleus; Biological process=regulation of transcription, DNA-dependent
  Homolog annotation: Hit_ID=O22208; Match level="QueryCoverage=81%, HitCoverage=24%, E-value=4e-34, Identity=48%"; Hit description=BZIP family transcription factor
MLCLNRVCENTNNRETGLAIPENLDSALAIPKDLELEEAERKALGSGSTKALKDHMKSSATDDKMQQWFREGLAGPMFSSGICTEVFQFNVSPSPGAIVPATSVANVSTENCQNATSVKKTRNRRTLHELPEPLNGSSLNITKEQVKNLQKDHLHGNKSSMVVSVFVDPREAGDGDVDVDGMMRPRMKAQFVISSSVGSIIIFP

SEQ ID NO: 186123 - protein, 284 aa, Glycine max
  Coding DNA Sequence Number=SeqID_69345
  Homolog annotation: Hit_ID=Q1SF19; Match level="QueryCoverage=95%, HitCoverage=76%, E-value=1e-123, Identity=80%"; Hit description=This gene is cut off
MVVYDVHCQVTSMACSLWMSFGVYVTGVLFQTAAFVSFLLISHGYCIMCERLSLNERRSTAALACVFYLTLVGYKACVPYFSVLLLLNYFISFYIIFHHISQNLLVLREQLSIIEHEDIQAMHDAVYKKYTMFKKFQGAMQIVATAETVIYMNIDDSSENYWLRLLLREWAQFCIFVYIGWIFRSRDLAPNFSVMPTTKCKGETLVPPIYSIEMDAATFKEFSSHEWHIGVPTSTSYDESSRDEVLAIIQHPRAQRLRKLDAFSHRADCFVVSDLNTNSSPCPT

SEQ ID NO: 186124 - protein, 122 aa, Glycine max
  Coding DNA Sequence Number=SeqID_69346
MKSGDMRGYRMVIRTFRQPDANEPVDAQRLTSSSAPSVILTREVLLLSSRDIQVRQRARFFSARQGRSSSIACGNVMVIPFYRFRGIEDGVQIAIFKFSNLDLPEHFGSGVAYGGSNPARLG

SEQ ID NO: 186125 - protein, 502 aa, Glycine max
  Coding DNA Sequence Number=SeqID_69347
  Homolog annotation: Hit_ID=Q012Y1; Match level="QueryCoverage=18%, HitCoverage=16%, E-value=3e-08, Identity=30%"; Hit description=[S] KOG1043 Ca2+-binding transmembrane protein LETM1/MRS7
MKHPYLVQWFRETEMPRIAGYFIPLLKKWSVEYAGSAVVKLGARRICCPLFVLSLEDALVKLMDFSLNLAPVDKLHWLATEAGFELNFLSHFGGKVFPSEKTEDLEFWIGLAHKKLLKAFCKESITSKKQNFQQKIQADNLATLGLFTYLGKRTRIFLSAMGIKDLDGVVKNFLSYLECGILFIYPEFSSIRVYQCFMEVVTDEIGWLDFYGSYVQINCKEKRSKHNARQAEKEIISSVVFTVCYDVFSGFAHFNRTTQQSLDTASRSYLLRCESLNTVDHASFDNHTSYMGSINGPKLPLVFEVQQMSHDLTTEGCPKSDFRNSSIFKKCWAFSSRILTMMKAPISAIANKKTYEEDTCVNKSNPQHESFIKRYSIKLASTSADLWMGTVLLFIDIMVALELLVRQVHGCKASESQRKKLHRTMTDIIVLIPVTILMLIPVTAVGHAAILAAIKKYMPFLIPSSFSSERLDVVKLIKQTRKMGYQLHSAQFDLEDQPATIS

SEQ ID NO: 186126 - protein, 262 aa, Glycine max
  Coding DNA Sequence Number=SeqID_69348
  Gene Ontology: Mol. function=metal ion binding; Cellular component =integral to membrane; Biological process=ubiquitin cycle
  Homolog annotation: Hit_ID=Q9SLC3; Match level="QueryCoverage=68%, HitCoverage=70%, E-value=9e-27, Identity=38%"; Hit description=RING -H2 finger protein ATL2L
  Pfam annotation: Domain name=zf-C3HC4; Domain location=125-166; Score= 35.5; E_value=1.9e-07; Accession=PF00097.15; Description=Zinc finger, C3HC4 type (RING finger)
MDVFDNDHDHDEPFVRYHSNVNRTILYVSMVSFITVLFLVFALYLYARCVLRGRSRNRAAIRRLTIAALHVSDLDAAAAAHRHAEPPNAGLDPAIIASLPTFASRTKVLENGGDGGGGGATVVECAVCLSALEGEEKAKLLPNCNHFFHVDCIDKWLGSHSTCPICRAEVKPQLQPQHREGPVGLSLHSARTLLSRVDGDDDNNNNDNESSKINDSNSRLSSFRRILSRQRSSRRVQPSGHDDEDGGVDQDLERHDEHRREV

SEQ ID NO: 186127 - protein, 391 aa, Glycine max
  Coding DNA Sequence Number=SeqID_69349
  Gene Ontology: Biological process=intracellular protein transport
  Homolog annotation: Hit_ID=Q1SF28; Match level="QueryCoverage=97%, HitCoverage=53%, E-value=1e-157, Identity=74%"; Hit description =Epsin, N-terminal; ENTH/VHS
MGFVRMKAVCVLEAILRKKDDDHFSPVESYFTENKDVVLRCSESPQASLRERAMKCYVDLESTKVLGLLGGGQPNSSTVNSEKTVKTENATVAELPDLIDTGDSNDYHGTDDTLKGTSDQNIANLTSSTPLVDDLFGDFSASIGASQELKNDDPFADVSFHTNENKEHADDLFSGMTVGSNKQGDHESHRQGNITEPQLFDIFASNSEQGNHKEPVSDLMAGLSMDENTSSTKQKGTSPFMQSESLFSGLNNHIPDNTSGGMLSSQPMGFNVNPMFPTGPMPYNIQPGFMLNQPYSSQPLNYGAMGTLLAQQQFLATMANFQHLSNVNMQDDGVAQMAGPNGRSPLPDIFQPNFQTQTPSSMINTSRKEETKAFDFISDHMSSARDSRRMI

SEQ ID NO: 186128 - protein, 381 aa, Glycine max
  Coding DNA Sequence Number=SeqID_69350
  Gene Ontology: Mol. function=protein dimerization activity; Cellular component=nucleus; Biological process=regulation of transcription
  Homolog annotation: Hit_ID=Q1SP83; Match level="QueryCoverage=91%, HitCoverage=99%, E-value=1e-91, Identity=57%"; Hit description =AUX/IAA protein
  Pfam annotation: Domain name=AUX_IAA; Domain location=43-310; Score =355.4; E_value=9e-104; Accession=PF02309.7; Description=AUXIAA family
MTTPLEHDYIGLSEAPSMEKSCDKISSSVSSNLSSEDENTSSLNFKETELRLGLPGSESPENNKLGISLFGKDLQNNGYSSASSTPSNKNLKRGFSDAISSSSSSSRKWIFSQSDAAATEADLENGSNNTSARCNREVDMVPHYEKPAQVAATNDHATVPAPKAQVVGWPPIRSFRKNTMAYNLAKCNNETEEKPGVACLYVKVSMDGAPYLRKVDLKTYSNYIELSSGLEKMFSCFTIGQCNSRALPGKDGLSESAFRDIVDGSEYVLTYVDKEGDWMLVGDVPWEMFTESCNKLRIMKGSEAIGLGEKWQYIEYDTFSFYILNGRLANNMLSISLQLQGVWKNVGANTSTEHSAPPLGHSPKHIYKEGLEENFSLIKEK

SEQ ID NO: 186129 - protein, 166 aa, Glycine max
  Coding DNA Sequence Number=SeqID_69351
  Gene Ontology: Mol. function=RNA-directed DNA polymerase activity; Biological process=RNA-dependent DNA replication
DDDQLMWRFSHNGIDTVRSASNNIMEAMLDNDHLKVPGKWNIQAPPKIKHFVWRLLRGCLPTMQRLVQKGIDYVLQNAVSAATTLRMIGTSTSSSSNQKPLWTPPAAGIIKCNLDAAIFNYSQSFGVGICIRGEHGKFIQCKMETFGGIPNLPRLKVGLFIELSNG

SEQ ID NO: 186130 - protein, 77 aa, Glycine max
  Coding DNA Sequence Number=SeqID_69352
  Subcellular localization annotation: CTP_CleavageSite=50; ConfidenceScore=5.34e-01
MDICPINLQTKKIQRLTNTGGCFYRDSSNSFLEKLSLTSTTPNPSPTPTYVSAPTSTLIHSTMSNRRPPHTPPRFIS

SEQ ID NO: 186131 - protein, 68 aa, Glycine max
  Coding DNA Sequence Number=SeqID_69353
MVMYLTMPTFHMLDVVYVHGGGPVTLSDVPCVGNYSGNSLLAEVDNRGSGGVMVHDWVASTNTAWFPK

SEQ ID NO: 186132 - protein, 207 aa, Glycine max
  Coding DNA Sequence Number=SeqID_69354
MPTQSTIHVLLSYRERMRGEKGGERGRGEYKNLNRVRNEHRDHTSYYFTNFPESHNEEDFWKTFMRWGKVRDMFIAPRRNRGDKGETSRTTRKLSCERQILCTIHYYAEYNIELLQKILVGRLKKPKEIYNNNEILLMEGVCSLKMRYIGDNLVLLTAMDREDIVDVIKKPEEWLTDLFEIIGPWDVKATPANRLTWLRISGEQGVL

SEQ ID NO: 186133 - protein, 147 aa, Glycine max
  Coding DNA Sequence Number=SeqID_69355
MHKALRSGAPLPYPQLVTLFLQHFEIPLDSEPFVLVKRSFAIGAGAVTSFGYRKDVDGQWLKKDAQPLQDECTPSPPPQRDDSSVLMNEVLLELRGLCTYVGERFNSLDGRIDAIDARFEGMDTRITQLEKDVLWLFDVAKGGRNRV

SEQ ID NO: 186134 - protein, 310 aa, Glycine max
  Coding DNA Sequence Number=SeqID_69356
  Gene Ontology: Biological process=regulation of transcription
  Homolog annotation: Hit_ID=Q1SE50; Match level="QueryCoverage=90%, HitCoverage=97%, E-value=8e-87, Identity=56%"; Hit description=TCP transcription factor
  Pfam annotation: Domain name=TCP; Domain location=29-178; Score =147.3; E_value=4.1e-41; Accession=PF03634.4; Description=TCP family transcription factor
PPPTLNQAIKHTEHNRGGTITRGMRTGVGDIVQVEGGHIVRSTGRKDRHSKVYTSKGPRDRRVRLSAHTAIEFYDVQDRLGYDRPSKAVDWLIKKAKTSIDRLAELPPWHPPTHEEEKQNDAAGSTPKAIGAFSSTHADTDPINFQTNNSSEDLGLSLHCFQDHPGLIHWQSQQTGAHQTPPSNEHQIRTLFAGSTPGGFENHYQRSVTWNNEATTTDHVNRLGFILNSQPFIGQGSTSAYAQSGGTLQSSFSFPMTSPSELHRPQPVNQPSIFDSRFVSDGLADFCIPDRIQGVEENHGVASNRPSSSP

SEQ ID NO: 186135 - protein, 90 aa, Glycine max
  Coding DNA Sequence Number=SeqID_69357
  Subcellular localization annotation: CTP_CleavageSite=29; ConfidenceScore=5.44e-01
MVSYDWQITMSFKNYQKIFNFFSDLTLPRFAEASTSFFNRPRCWLLGTSSSGRIVTIQSLWTAATDEGLQATIVKSNSKQSKVCLLKENL

SEQ ID NO: 186136 - protein, 65 aa, Glycine max
  Coding DNA Sequence Number=SeqID_69358
MWDLFAVYHCYSAQISMQCQASPLSTFKHAPPEILYDMWMCLFHFGCFIASDAIAAHACILALNQ

SEQ ID NO: 186137 - protein, 109 aa, Glycine max
  Coding DNA Sequence Number=SeqID_69359
MNEYGNRVMKMNKEKREEPDERGGKEISIWGGGCGKCESKHRVKGESLRGGDGDDEFGWVLLCVHAPLLSLSVSLPLLLFSLEREREIRMFWSLGVALLLHYIPPCHGI

SEQ ID NO: 186138 - protein, 366 aa, Glycine max
  Coding DNA Sequence Number=SeqID_69360
  Homolog annotation: Hit_ID=Q6QPM7; Match level="QueryCoverage=53%, HitCoverage=77%, E-value=3e-13, Identity=33%"; Hit description=Tha8
  Subcellular localization annotation: CTP_CleavageSite=30; ConfidenceScore=5.31e-01
MAFSLFQNPTFLKLKPPTIATPRWGYVRVRCGGPRSQRSPLMKGRILSIEAIQAIQTLKRLHRTNPPNLSSLVSNTLTRLIKSDLLATLRELLRQQHCTIALRAFSTLRSEYGADLSLYAEIISALAAAAAAAEMTDHVDRLILDLEAENEEIKCDDHKGLASLIKAVVAARSRESTVRIYGLMKKSGYGSVTEPDEYVVKVLVNGLKSFGEEALARELQDEYKIALAMLNLAVTCYDLTESQCRLVDCLCFVVNCLKPIVHGSIARCSKRMEVIWKVTVSQKSILPPIFRSPFPGSHLSSMCSRLMWMDLTDRVGQTSACDGLIRDFKGKLSKASIKILIKVMSFGQNCGESIRVVHQLFVSRDL

SEQ ID NO: 186139 - protein, 99 aa, Glycine max
  Coding DNA Sequence Number=SeqID_69361
  Subcellular localization annotation: CTP_CleavageSite=36; ConfidenceScore=5.00e-01
MTNYVFPSPSNMDYTPPIVQPDDFLSNVFGTDCGMPASARECMHSLQNEVGNFTPPSFNLMFSQDVEVNNPSLHDIPYQCPCRNPGRNRKRPSCGTGHH

SEQ ID NO: 186140 - protein, 59 aa, Glycine max
  Coding DNA Sequence Number=SeqID_69362
MSGQKKVIKFEIIELKTNEDEMKVLIESNYWKNIGPIKILAIFSKPVPQMEDELSLSQN

SEQ ID NO: 186141 - protein, 99 aa, Glycine max
  Coding DNA Sequence Number=SeqID_69363
QNRGEACHPARPGEQGCFLQKQQPSGGRIWKAQVAFEEVTETHGSRKNTSFRFPPHHGTSRIARACFLLISDTSRDFIYCATKDAKYLKAANQRLHVIK

SEQ ID NO: 186142 - protein, 59 aa, Glycine max
  Coding DNA Sequence Number=SeqID_69364
MPHCFSMPHKENHDHEESSIYSSQEEATSSPSSSGNEGESKGDEHIEKVYPYEEGDLLM

SEQ ID NO: 186143 - protein, 74 aa, Glycine max
  Coding DNA Sequence Number=SeqID_69365
MAVLLTHLELGPSLYKIHLGPYMEGVCRQRIKLYTKDQAESFDDAKGLHESYASQRFTQDKAIRDIQDDNQDSL

SEQ ID NO: 186144 - protein, 58 aa, Glycine max
  Coding DNA Sequence Number=SeqID_69366
  Subcellular localization annotation: CTP_CleavageSite=23; ConfidenceScore=5.16e-01
MALYGSTLAYSNPLKPLLVSVPKYQKVGNNNVWQTVTASSSYLDWFLPLTLSRPLTIA

SEQ ID NO: 186145 - protein, 99 aa, Glycine max
  Coding DNA Sequence Number=SeqID_69367
  Gene Ontology: Mol. function=DNA binding; Biological process=DNA integration
MYLVERYMKILKGYTKNLHHPEASIVERYIIEEAIEFCSEYIEKAKPIGLPESRHDQRVGDLKKLTYQKSHSSWQTRLNKCFMFKILVMKNSQWFYTEK

SEQ ID NO: 186146 - protein, 78 aa, Glycine max
  Coding DNA Sequence Number=SeqID_69368
TDRAKDIKARAVHQLSVTFLGMCLGMGGWWGWERGRDGGGGAHRGIGITYSCCYHFAVVGEFFSAPQWTPDVPAQFQR

SEQ ID NO: 186147 - protein, 610 aa, Glycine max
  Coding DNA Sequence Number=SeqID_69369
  Gene Ontology: Mol. function=transporter activity; Cellular component= membrane; Biological process=oligopeptide transport
  Homolog annotation: Hit_ID=Q2HU45; Match level="QueryCoverage=99%, HitCoverage=94%, E-value=0.0, Identity=62%"; Hit description=TGF -beta receptor, type I/II extracellular region
  Pfam annotation: Domain name=MFS_1; Domain location=36-528; Score= -11.7; E_value=0.0011; Accession=PF07690.6; Description=Major Facilitator Superfamily
  Pfam annotation: Domain name=PTR2; Domain location=154-512; Score =146.4; E_value=7.9e-41; Accession=PF00854.12; Description=POT family
  Pfam module annotation: Pfam domain module=MFS_1::PTR2; Domain location=36-528::154-512
MEKELELSSAQSRMDSQRISQPQRCGKGGLVTMPFIIANEALARVATLGLLPNMILYLMGNYNLHLGKATKILLLSVATTNFMPLPGAFIADSYLGRFLAVGLGSFITFLITMSLKDVFRDSIPEDHVHVYRKASLCGERSVPQNLTGSKKNGMPLGMTLLWLTAMIPQARPPPCNSETERCESATPGQMAMLISSLALMSIGNGGLSCSLAFGADQVNRKDNPNNQRALEMFFSWYYASSAISVIIAFTGIVYIQDHLGWKLGFGVPAALMFLKLRLPHKISDGMYHRNKDSDLVVPSDKLRFLNKACFIKDSEKDIASDGSAYNRWSLCTVDQVEELKAIIKVIPLWSTGIMMYLNIGGSFGLLQAKSLNRHITPNFEVPAGSMSVIMIFTIFIWIALYDRVIIPLASKLRGKPVRISAKRRMGLGLLFSFLHLVTAAIVETTRRRRAISEGHINDTHAVLNMSAMWLFPQLCLGGIAEAFNAIGQNEFYYTEFPKTMSSIASSLFGLGMAVGYVLSSLVFSIVEKVTSRGGKDGWVSDNINKGRFDKYYWLLATMSAVNVLYYLVCSWAYGPTSDQESKVTEENGSNEEELPLIQSRTKGQFDKVSQ

SEQ ID NO: 186148 - protein, 235 aa, Glycine max
  Coding DNA Sequence Number=SeqID_69370
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=79%, HitCoverage=21%, E-value=1e-59, Identity=57%"; Hit description =Putative receptor kinase
  Pfam annotation: Domain name=B_lectin; Domain location=94-205; Score =105.7; E_value=1.3e-28; Accession=PF01453.15; Description=D-mannose binding lectin
MVNTKGETRRIIILNWCSSHMLSIFILYSFFFTFSFKHCSATDTISITINNFLQDGGGDTLVSKGENFELGFFTPNGSSSGKRYLGIWYYKLTPLTVVWVANRDKPLLDSCGAFGIAEDGNLKVLDKSGKFYWGTNLEGSHSQHRIVMLMDNGNLVVSDEVEDQGNHQVKILWQSFANPTDTFLPGMKMDDNLALTSWRSYEDPAPGNFSFEHDQGENQYIIWKRSIRYWKSSVS

SEQ ID NO: 186149 - protein, 653 aa, Glycine max
  Coding DNA Sequence Number=SeqID_69371
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=57%, HitCoverage=44%, E-value=1e-152, Identity=71%"; Hit description =Putative receptor kinase
  Pfam annotation: Domain name=Pkinase; Domain location=343-606; Score =168.7; E_value=1.5e-47; Accession=PF00069.15; Description=Protein kinase domain
  Pfam annotation: Domain name=Pkinase_Tyr; Domain location=343-606; Score=131.5; E_value=2.4e-36; Accession=PF07714.7; Description =Protein tyrosine kinase
  Pfam module annotation: Pfam domain module=Pkinase::Pkinase_Tyr; Domain location=343-606::343-606
TEKGRLGDSGDVVCWIWSEDLNNLEEEYEDGCDLHVRVAVSDIGGLHNENIKYEGHGIIVNHGSCIDSSSAESTGRNCGTCGTNFIPYPLSTGPSCGDPMYFSFHCNISTGELDFETPGGTYQVISINPEAQKFLIHRKNVLNCDQSSRDKFLPLNKSFPFHLTSNCYADPSIFSSNAPMKHGVEIELSWEQPLEPICSSLLDCKEWPNSTCNTSSDGKKRCLCNTNFLWDGLKLNCTLEGNHSYQPERQLSLPKIIVITLTTVIGLILLSTTSTCVYLRKRRQAKPQDSRGYVQKNSGINLYDSERYVRDLIESSRFKEDDAQAIDIPYFHLESILDATNNFANTNKLGQGGFGPVYKGKFPGGQEIAVKRLSSCSGQGLEEFKNEVVLIAKLQHRNLVRLLGYCVEGDEKMLVYEYMPNRSLDAFIFDWDVRFKIILGIARGLLYLHEDSRLRIIHRDLKTSNILLDEEKNPKISDFGLARIFGGKETVANTERVVGTYGYMSPEYALDGHFSVKSDVFSFGVVVLEIISGKRNTGFYQADHELSLLGYAWLLWKEGKALEFMDQTLCQTCNADECLKCVIVGLLCLQEDPNERPTMSNVVFMLGSEFNTLPSPKEPAFVIRRCPSSRASTSSKLETFSRNELTVTIEHGR

SEQ ID NO: 186150 - protein, 33 aa, Glycine max
  Coding DNA Sequence Number=SeqID_69372
MDMRAKEEINIVICPAVAGFRIAYLSPYMSLIR

SEQ ID NO: 186151 - protein, 244 aa, Glycine max
  Coding DNA Sequence Number=SeqID_69373
  Gene Ontology: Mol. function=transporter activity; Cellular component= membrane; Biological process=oligopeptide transport
  Homolog annotation: Hit_ID=Q2HU45; Match level="QueryCoverage=92%, HitCoverage=38%, E-value=2e-76, Identity=58%"; Hit description=TGF -beta receptor, type I/II extracellular region
MVSVNIGGSFGLLQAKSLNRHITSHFEIPAGSFAVVIVFIIFIWVALYDRVIIPIASKLRGKPVRISAKRRMGIGLVFSFLHLATAAIVENERRRRAIREGHINDTHAVLNMSAMWLVPQLCLSGMAEAFNAIGQNEFYYTEFPRTMSSIAACLFGLGMAAGNVLSSLIFSIVENATSRGGNEGWVLDNINKGRYDSWAYGPTVDQLFKVSDENSSNEKEFTQLGNMGQVDVSEGIGSNEKRVN

SEQ ID NO: 186152 - protein, 93 aa, Glycine max
  Coding DNA Sequence Number=SeqID_69374
  Gene Ontology: Mol. function=indole-3-acetic acid amido synthetase; Biological process=response to auxin stimulus
  Homolog annotation: Hit_ID=O81829; Match level="QueryCoverage=71%, HitCoverage=10%, E-value=1e-17, Identity=61%"; Hit description =Indole-3-acetic acid-amido synthetase GH3.5
MPEAPSQYLCNKPNGKLDDGGATNTSIIIEHNNKKALKYIEDVTSNADEIQKRVLAEILSCSAHVEYLQRHGLEGRTDRETFKKIMPVVTYED

SEQ ID NO: 186153 - protein, 136 aa, Glycine max
  Coding DNA Sequence Number=SeqID_69375
  Gene Ontology: Mol. function=catalytic activity
MVEKEMEDPSLEVIRKWIKGLSDGTYGQEFTSTTRVIRLVKAHKGFILCDLIIHSGLLDENGNWHVSAIATLVDIIASFTSYSVTSCLQEEVEVEAKVIRKKDELISVIVEVRKKHNGELVALGKLWMVARKNPRK

SEQ ID NO: 186154 - protein, 363 aa, Glycine max
  Coding DNA Sequence Number=SeqID_69376
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=1e-41, Identity=28%"; Hit description= UPI00006A17C9 related cluster
  Subcellular localization annotation: CTP_CleavageSite=44; ConfidenceScore=5.73e-01
MRTCSPLKTSMCSPLKVSASSPTKAKARTCCPLKVRTCSPQKVRACSPTKVKVKARMCCPLKARTCSPLKVRTCSPLKVRTCSPLKARMCSPPKVRACSPTKVKARTCCPLNVRTCSPQKVRACSPMKVKAKARMCCPLKARTCSPLKARTCSPLKVRTCSPLKVRTCSPLKARTCSLLKVRASSPLKAKARTCCPLNVRTCSPQKVRACSPTKVKAKARMCCPLKVRTCSPLKARMCSPLKVRTCSSLKARTCSPLKVRASSPTKAKGRTCCPLKVRTCSPRMVRACSPTKVKAKARTCCPLKVRTCSLLKVRTCSPLKVKTCSPLKLRTCSLLKVRTCSPLKARASSPLKTRVLVPKGPLL

SEQ ID NO: 186155 - protein, 149 aa, Glycine max
  Coding DNA Sequence Number=SeqID_69377
  Gene Ontology: Mol. function=oxidoreductase activity; Cellular component=mitochondrial inner membrane; Biological process=embryonic development
  Homolog annotation: Hit_ID=Q6K7S7; Match level="QueryCoverage=71%, HitCoverage=68%, E-value=6e-40, Identity=69%"; Hit description =Cytochrome c biogenesis protein-like
  Pfam annotation: Domain name=CcmH; Domain location=6-101; Score= -57.9; E_value=0.0034; Accession=PF03918.5; Description=Cytochrome C biogenesis protein
MSTSSFWKSLIRDEIQSGKTDKDIYKKLEDEFGETVLYTPKFDMQTAALWLLPLLIAGSAAGVWAYNRHKQKTNVHIMALNLVRGVPLTPKEKETMLDTLTPPHSQGARTPFWWRRWQALWATKLAKASIDFEDSNIVHAKNDLEDFIA

SEQ ID NO: 186156 - protein, 519 aa, Glycine max
  Coding DNA Sequence Number=SeqID_69378
  Gene Ontology: Mol. function=catalytic activity; Cellular component =peroxisomal membrane; Biological process=metabolic process
  Homolog annotation: Hit_ID=Q9LW70; Match level="QueryCoverage=97%, HitCoverage=87%, E-value=1e-172, Identity=56%"; Hit description=Long- chain-fatty-acid-CoA ligase-like protein
  Pfam annotation: Domain name=AMP-binding; Domain location=28-436; Score=226.5; E_value=6e-65; Accession=PF00501.18; Description=AMP -binding enzyme
MEVVKAIAKHEPAAPESVAIRADQKSYSYKQLITSAQKISNLLCGSDAQTGNLGGARIGIVAKPSAEFVAGILGIWLSGGVAVPLATSYPEVELLYVINNSVESHISKDVSAILSTEDHTEIMQSVANKSSSQFFHLPPVLNKSSEKSRDKHSQNGGIHTDKILLDKFGRSSEDPALILYTSGTTGKPKGVVHTHRSIISQVEFLPKFSVRGVWQRWRESYPTDGSKAEEAITVFTGVPTIYARLIQGYHAMDPELQAASVSAAKNLRLMMCGSSALPLPVMQEWEAITGHRLLERYGMTEFVMALSNPLKGERKPGTVGKPFPGIQVKIIADEESVNGNTGMGELCIKSPSLFKEYWKLPEVTKESFTDDGFFKTGDAVTTDEDGYFIILGRTNADIIKAGGYKLSALEIESVIIEASGYHFLIVVHPAVSECCVLGLPDKDYGEIVSAIVVPEADVKRKQDQESKPVLSLEELSNWAKDKIAPYKIPTQLIVWDKLPRNAMGKVNKKELKKLLVSEQ

SEQ ID NO: 186157 - protein, 512 aa, Glycine max
  Coding DNA Sequence Number=SeqID_69379
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=98%, HitCoverage=80%, E-value=0.0, Identity=69%"; Hit description=Indole -3-acetic acid-amido synthetase GH3.5
  Pfam annotation: Domain name=GH3; Domain location=1-480; Score=827.7; E_value=6e-246; Accession=PF03321.4; Description=GH3 auxin-responsive promoter
MPTIEEELERRSLLYSLLMPVMEQFVPGLDKGKGMYFLFIKSEAKTPGGLLARPVLTSYYRSSHFKNKTHCFDPYTNYTSPIETILCLDSYQSMYSQMLCGLSQNEHVLRVGAVFASGFIRALKFLEKHWVCLCRDIRNGTIGPEITDSSVREAIMRVLKPNPKLADFIEGECKKGLWKGIITRLWPNTKYVDVIVTGTMAQYIPMLDYYSNGLPLVCTMYASSECYFGLNLNPLCDPSEVSYTLVPTMAYFEFLPLNKTKEHANSISYTEQELLVDLVDVELGQEYELVVTTYAASNNYATMHNQTGLYRYRVGDILRVAGFKNNAPQFNFVCRKNVVLSIDSDKTDEVELQNAVKNGANHLTLFGASLTEYTSFADTSTIPGHYVLYWEISMNKNNNIDQNQNPIPSSVFEECCFAVEGSLNSVYRQGRVSESIGPLEIKIVENGTFDKLMDFALSQGASINQYKTPRCVKYAPIVELLDSKTVSNYFSPKCPLWVPGHKKWCMYPLDNK

SEQ ID NO: 186158 - protein, 67 aa, Glycine max
  Coding DNA Sequence Number=SeqID_69380
MAFEMQRLTERKRMMPIESEKLSKGSVIMAVEDEARVIGHVAVSVSVMCFTEKLIYICLLMNLQREL

SEQ ID NO: 186159 - protein, 434 aa, Glycine max
  Coding DNA Sequence Number=SeqID_69381
  Gene Ontology: Mol. function=sugar porter activity; Cellular component=integral to membrane; Biological process=carbohydrate transport
  Homolog annotation: Hit_ID=Q8GTR0; Match level="QueryCoverage=88%, HitCoverage=93%, E-value=1e-137, Identity=58%"; Hit description =Sugar transporter
  Pfam annotation: Domain name=MFS_1; Domain location=69-387; Score =31.1; E_value=3.8e-06; Accession=PF07690.6; Description=Major Facilitator Superfamily
  Pfam annotation: Domain name=Sugar_tr; Domain location=65-428; Score =126.9; E_value=5.7e-35; Accession=PF00083.14; Description=Sugar (and other) transporter
  Pfam module annotation: Pfam domain module=MFS_1::Sugar_tr; Domain location=69-387::65-428
  Subcellular localization annotation: CTP_CleavageSite=68; ConfidenceScore=5.32e-01
MVCNRNFSLNFKDFGLSQSATFVCNFLRSQGLQQNHNSDCNHSLKSYSSVRIPNAKPSWRCSLRHVIVASLSSFLYGYHIGVVNETLESISIDLGFSGNTMAEGLVVSICLGGAFIGSLFSGWIADGVGRRRSFQLCALPMIIGAGMSATAKTLWGMLLGRLFVGTGMGLGPPVAALYVTEVSPPAVRGAFGALTQIATCLGLMGSLFIGIPAKEIVGWHLSFFDFVQRGRTIEAEAAFEKLLGGVHVKPAMTELSKSDRGDGSDSVKLSELIYGRYFRGSVVAMILMDKLGRKVLLLGSFLGMGLSMGLQVIAASSFASGFGSMYLSVGGMLLFVLSFAFGAGPVPSLIMSEILPGNIRAKAMAICLAVHWVINFFVGLFFLRLLELIGAQLLYSIFGSCCLIAVVFVKKYILETKGKSLQEIEIALLAQEAN

SEQ ID NO: 186160 - protein, 314 aa, Glycine max
  Coding DNA Sequence Number=SeqID_69382
  Gene Ontology: Mol. function=ribonuclease H activity; Biological process=RNA-dependent DNA replication
  Homolog annotation: Hit_ID=Q1T2T2; Match level="QueryCoverage=51%, HitCoverage=29%, E-value=5e-23, Identity=37%"; Hit description =Ribonuclease H
  Subcellular localization annotation: CTP_CleavageSite=39; ConfidenceScore=5.28e-01
MASVVASLPPPLLLPARKSHMGNFPSSPVSLLSEKILIMLKAATSYFLSPWPCCLKATSSQLEDVFLAAVINTVWFLWISRNNASFRNGHFSHARIISEIIGAVSLSGNLSKGVMKNSISDFSMLRAFHISGHLSKAPRILQISWHPPLAGWCKCYTDRTARGSLGIAARGGIYRDFRGSFMGCFSLSLGDGVASSLVAEITGTMEAIELLSRKDGIACGRWNRVSFVVKASGESSESSTTLTVFKSVQNIWDQPEDRLGLIGLGFAAVAAFWASTNLIAAIDKLPLFPTVLELVGIFYSVWFTYRYLIFKPDR

SEQ ID NO: 186161 - protein, 66 aa, Glycine max
  Coding DNA Sequence Number=SeqID_69383
DVYEGYEAIAERLERVLNLRMVTAGTELHDIMQDCLTIARGVPVQMEVSGLDRDGAQSIDYCFYVL

SEQ ID NO: 186162 - protein, 285 aa, Glycine max
  Coding DNA Sequence Number=SeqID_69384
  Gene Ontology: Mol. function=sequence-specific DNA binding; Cellular component=nucleus; Biological process=regulation of transcription, DNA-dependent
  Homolog annotation: Hit_ID=Q5DWW4; Match level="QueryCoverage=100%, HitCoverage=69%, E-value=2e-64, Identity=51%"; Hit description =Mutant protein of GL2
  Pfam annotation: Domain name=Homeobox; Domain location=94-150; Score =85.8; E_value=1.3e-22; Accession=PF00046.19; Description=Homeobox domain
  Subcellular localization annotation: CTP_CleavageSite=39; ConfidenceScore=5.03e-01
MGVNMSNTPPHTKDLFSSSSLSLSLAGIFRHAGEAAETSGMEVAGGNEVRREDTVEISSDNSGPVRSRSEEDFDGEGLHEDDDDGDDKNRKKKKRKYHRHTAEQIREMEALFKESPHPDEKQRQQLSNQLGLAPRQVKFWFQNRRTQIKAIQERHENSLLKTELDRLREENKAMRETINKSCCPNCGMVTATIDASMSTEEKQLLIENAKLKAEVEKLRTALGKFSPRTTSPTTSSAGHHDEEENRSSLDFYNGIFGLDKSRIMDIANRATEELIKMANMGEPLW

SEQ ID NO: 186163 - protein, 274 aa, Glycine max
  Coding DNA Sequence Number=SeqID_69385
  Gene Ontology: Mol. function=sequence-specific DNA binding; Cellular component=nucleus; Biological process=regulation of transcription, DNA-dependent
  Homolog annotation: Hit_ID=Q39948; Match level="QueryCoverage=91%, HitCoverage=36%, E-value=1e-109, Identity=77%"; Hit description =Homeodomain protein 1
  Pfam annotation: Domain name=START; Domain location=1-147; Score =125.1; E_value=1.9e-34; Accession=PF01852.10; Description=START domain
NQWKEMFPCLISKAATVDVICNGEGSNRNGAVQLMFAELQMLTPMVPTREVYFVRCGKQLSDEQWAIVDVSIDKVEDNIDASLVKCRKRPSGCIIEDKSNGHCKVIWVEHLECQKSTIHTMYRTIVNSGLAFGARHWIETLQLQCERLVFYMATNVPMKDSTGVATLAGRKSILKLAQRMTWSFCHAVGASSFHTWTKVTSKTGEDIRISSRKNLNEPGEPLGVILCAVSSVWLPVSPNVLFDFLRDEARRNEVQYKCTTLLHPFFNKPRVFLG

SEQ ID NO: 186164 - protein, 123 aa, Glycine max
  Coding DNA Sequence Number=SeqID_69386
  Gene Ontology: Mol. function=RNA-directed DNA polymerase activity; Biological process=RNA-dependent DNA replication
MSKVLANRLKSLLDKCISSEQSTFLENRSVTGNALTTFETIIHHMKCKRKGKKDEVALKVDISKAFDKIKWSYPKGILRKMVFCQDKSRESACMKDILFTYARTSRQEINLAKYEIYSDNHTS

SEQ ID NO: 186165 - protein, 63 aa, Glycine max
  Coding DNA Sequence Number=SeqID_69387
  Homolog annotation: Hit_ID=Q6EPF0; Match level="QueryCoverage=64%, HitCoverage=5%, E-value=3e-09, Identity=65%"; Hit description=GL2 -type homeobox genes
MAFQILANPSPTTKLTMESVESVNNLVSCTLRNIRTSLQCEDGGEIHGWTLFYMENSSLNFDL

SEQ ID NO: 186166 - protein, 258 aa, Glycine max
  Coding DNA Sequence Number=SeqID_69388
  Gene Ontology: Mol. function=galactosylgalactosylxylosylprotein 3 -beta-glucuronosyltransferase activity; Cellular component=membrane
  Homolog annotation: Hit_ID=O23194; Match level="QueryCoverage=46%, HitCoverage=28%, E-value=6e-31, Identity=66%"; Hit description=UDP -glucuronyltransferase-like protein
  Subcellular localization annotation: CTP_CleavageSite=64; ConfidenceScore=5.25e-01
LLHPPPPRSQPPTQLARPCRLLPHPHPHPRTPQRLLHPPTPPASTTIHTRSYGTSISVCITPVKCSVWNVRTCVGITVIAVLGFFTPNSAPTLSALSRYAVRLHHLPEIRMRPRPDSDTVPPDYHESCGARHRRPRLVEKRKKTRREKWKSRTKLMRQQTLDYQPENRRQQLHCVVAGRIQLRQSSKVVRPARECKCPDTTIMCLDFILELYVVRSRIDRGLNLKRKVGDGADFRFEDHECVEPEPLQEVHRIQHDSE

SEQ ID NO: 186167 - protein, 538 aa, Glycine max
  Coding DNA Sequence Number=SeqID_69389
  Gene Ontology: Mol. function=kinase activity
  Homolog annotation: Hit_ID=Q5DK69; Match level="QueryCoverage=83%, HitCoverage=89%, E-value=1e-161, Identity=65%"; Hit description =Pollen-specific kinase partner protein
  Pfam annotation: Domain name=DUF315; Domain location=14-439; Score =705.0; E_value=5.2e-209; Accession=PF03759.4; Description=Domain of unknown function (DUF315)
MVKAMEQEQESVRSRLFHFKGMFENTGRHTKSLSIESASALDPSPSEEEPVSSRSQGSKPLNVLDKVPRPRISREEIVAKEAKDKMVQEMEQMKERFAKLLLGEDMSGGGKGVSSALALSNAFTNLAAAVFGEQKRLEPMPPERKARWRKEIDWLLSVTDYVVEMVPVQQKNKDGSTMEVMTTRQRTDLHMNIPALRKLDAMLIDTLDNFKDQNEFYYVSKDAENADRNNDTKWWLPTPKVPVEGLSDAARRFVQYQKDCVNQVLKAAMAINAQTLSEMEIPESYIESLPKNGRSSLGDLIYRSITDDFFDPDQLLSAMDMSNEHKIVDLKDRIEASIVIWRRKMNQKDSSKSAWGSAVSVEKREIFEDRAETILLLLKRRFPGTSQSALDISKIQFNRDVGQAVLESYSRILESLAFTVLSRIEDVLHADLQTQNPSQSGRKSLSRNPIPKPEKSPTPTPKKEVDKSGSEAMTLSDFMGWNNNQGDSDAKKEAFADSDDFYKDIDNGKPQKLPNVVTDKKVSYLETLGGMRSPTSRH

SEQ ID NO: 186168 - protein, 298 aa, Glycine max
  Coding DNA Sequence Number=SeqID_69390
  Gene Ontology: Mol. function=DNA binding; Cellular component =mitochondrion; Biological process=DNA integration
  Homolog annotation: Hit_ID=Q1S9T4; Match level="QueryCoverage=100%, HitCoverage=21%, E-value=1e-145, Identity=86%"; Hit description =Integrase, catalytic region
MAMTDEYNALIENKTWDLVPRPTDANVIRSLWIFRHKKKADGSFERYKARLVGNGSNQQTGVDCGETFSPVVKPATIRTVLSIALSKSWGLHQLDVKNAFLHGNLNETVYMYQPAGFRDPQYPDYVCLLKKSLYGLKQAPRAWYQRFTDFVATLGFSHSICDNSLFTYHNGNDTAYILLYVDDIILTASSDTLRQSIMSKLSSEFAMKDLGPLSYFLGISVTRHSSGMFLSQHKYAEEIIERASMSSCKPVSTPVDTKAKLSGTSGNPYHDPSEYRSLAGALQYLTFTRPDISYAVQQ

SEQ ID NO: 186169 - protein, 70 aa, Glycine max
  Coding DNA Sequence Number=SeqID_69391
MSVENKLNMSVKNIGYSSYALVVNLLLSCFAAVFKSLNDSMFEINDSKSVSENRSKKSRYAGLYGERWKA

SEQ ID NO: 186170 - protein, 417 aa, Glycine max
  Coding DNA Sequence Number=SeqID_69392
  Gene Ontology: Mol. function=DNA binding; Biological process=DNA integration
  Homolog annotation: Hit_ID=Q1SAI8; Match level="QueryCoverage=98%, HitCoverage=28%, E-value=1e-87, Identity=45%"; Hit description =Integrase, catalytic region
  Pfam annotation: Domain name=GRP; Domain location=215-289; Score= -15.2; E_value=0.0026; Accession=PF07172.2; Description=Glycine rich protein family
MAGSNPPSPPSSVTHPALTVPNITNFIKVKLDIEKSQYNTWSELFKIHARAYQVIDHIIPSSADDTRDISLQQTDPKLWSRLDAVVLQWIYGTISDDLLNTIIERDTTAEMAWNRLFEIFFDNKHSRALYLEQEFSRVQMEQFPNASSYCQHLKTLSDQLSNVGAPVSNERLVLQLISGLTDAYAAVGSQIRHGETLPPFYKARSMIVLEETAKAKKAATVTDNSAFLASQDVSTVNNSSQQNYNNTPNSTNHGGRGSDNTASNRGRGSNRGGRGNRGRGRNGGRNNRSQYYQYPQQQQWAVPPWAAPWQPWATPPCPYPTTPNWQHQSTPRQQGILGPKPPQAHMAATSANNAQPSYASTDIQAAMHTLSMAPPDDQWYMDTGATSHMTANGGNLTSYSNMSNNIIVGSGHNIPVI

SEQ ID NO: 186171 - protein, 911 aa, Glycine max
  Coding DNA Sequence Number=SeqID_69393
  Gene Ontology: Mol. function=mannosyl-oligosaccharide 1,2-alpha -mannosidase activity; Cellular component=membrane; Biological process=metabolic process
  Homolog annotation: Hit_ID=Q9SEH8; Match level="QueryCoverage=58%, HitCoverage=99%, E-value=0.0, Identity=89%"; Hit description =Mannosyl-oligosaccharide 1,2-alpha-mannosidase
  Pfam annotation: Domain name=Cation_efflux; Domain location=596-886; Score=112.9; E_value=9.1e-31; Accession=PF01545.11; Description =Cation efflux family
  Pfam annotation: Domain name=Glyco_hydro_47; Domain location=97-500; Score=551.6; E_value=8.3e-163; Accession=PF01532.11; Description =Glycosyl hydrolase family 47
  Pfam module annotation: Pfam domain module=Cation_efflux::Glyco_hydro_ 47; Domain location=596-886::97-500
MARGSRSVTSSSKWRYCNPSYYLKRPKRLALLFIVFVGVSFIVWDRQTLVREHQLDDLNNKQGGTSGKTDLRKATKTSKEVLDDPIDIERREKVKEAMLHAWGSYEKYAWGQDELQPQSKNGVNSFGGLGATLIDSLDTLYIMGLNEQFQKAREWVANSLDFNKDYEASVFETTISAYDLSGDKVFLNKAIEIADRLLPAWNTPTGIPYNIINLSHGRAHNPSWTGGESILADSGTEQLEFIVLSQRTGDPKYQQKVENVIAQLNKTFPDDGLLPIYINPHSGAAGYSPITFGAMGDRDMWEKSMKGLSSLIRRSTPSSFAYICEKNGGSLTDKMDELACFAPGMIALGSFGYSADDDSQKFLSLAEELAWTCYNFYQSTPTKLAGENYFFHSGQDMSVGTSWNILRPETVESLFYLWRLTGNKTYQEWGWNIFQAFEKNSRIESGYVGLKDVNSGVKDNMMQSFFLAETLKYFYLLFSPSSVIPLDEWVFNTEAHPLRIVTRHEEGLVKNLNEKQKPFSRIGGRKEGRSACKMSAFPHCEGLSVPLRRIPQTRPPSTSYHSLTFTVPSSRLQCSSSQAKPATNIEFNDRHSQRAVKTALWCNFLVFSLKFGVWLASSSHVMLAEVVHSVADFANQALLAYGLSSSRRAPDAIHPYGYSKERFVWSLISAVGIFCLGSGATVVNGVQNLWIAQPPENMQYAALVICGSFIIEGASLIVAIQAVKKGAAAEGMKLRDYIWRGHDPTSVAVMTEDGAAVTGLVIAGASLVAVNVTGNAIYDPIGSIVVGNLLGMVAIFLIQRNRHALIGRAMDDHDMEKVLQFLKKDPFREAAKQKDDTALMKIMSNYGEEVVTALGSEVDRLEKEIQNLVPGIRHVDIEAHNPPTEATFITSSEGNTKLSYMPRVELTLDSS

SEQ ID NO: 186172 - protein, 578 aa, Glycine max
  Coding DNA Sequence Number=SeqID_69394
  Gene Ontology: Mol. function=RNA binding; Cellular component =cytoplasm; Biological process=anatomical structure morphogenesis
  Homolog annotation: Hit_ID=Q1SU11; Match level="QueryCoverage=98%, HitCoverage=97%, E-value=9e-62, Identity=28%"; Hit description=KH, type 1
  Pfam annotation: Domain name=KH_1; Domain location=195-257; Score =61.4; E_value=2.9e-15; Accession=PF00013.19; Description=KH domain
  Pfam annotation: Domain name=KH_1; Domain location=298-364; Score =52.6; E_value=1.3e-12; Accession=PF00013.19; Description=KH domain
  Pfam annotation: Domain name=KH_1; Domain location=505-567; Score =46.9; E_value=6.6e-11; Accession=PF00013.19; Description=KH domain
  Pfam annotation: Domain name=KH_1; Domain location=87-154; Score =65.9; E_value=1.3e-16; Accession=PF00013.19; Description=KH domain
  Pfam annotation: Domain name=KH_2; Domain location=195-254; Score =5.5; E_value=0.026; Accession=PF07650.7; Description=KH domain
  Pfam module annotation: Pfam domain module=KH_1::KH_1::KH_1::KH_1::KH_ 2; Domain location=195-257::298-364::505-567::87-154::195-254
MFNNNSKKRRHAPPAAPDAVFRIVCPAAKTEDVATIGGDGAKILVEDLVSAEERVVVIVGEESAAQVALVRVFERTVDEETKNSTVSCKLVAPSYQVGCVLGRGGKIVEKIRQDTGAHIRVLPKDQPPLPPPPGEEFIQITGNFGAVKKAVLSVSACFYDNNSGAFKPLDHHSRGCYSESAGHSSHRMFLEEDVVFKLLCHHEKVGSLIGKGGSVVRALQNETGASIQIVEAGPDSDERVVVISAREACNLCVIFVAGVHLQIVYSTSEQKHSPAQEAVIRVHCRLTEIGFEPSAAVVAKLLVRSPQVGCLLGKGGLVISEMRRVTGASIRIFSKEQIKYISQNEEVVQVIGSLQSVQDALFHITSRIRETIFPIRTPPNFSAPPHLPPFPEMPPPLFRPRNHLMSSGHPPPPQVGHPHDHSTVPPMPVDHQQHAFVHGMGRGPPNMDRVPYPRGYEGPNSPRSWNPLAVNRGNSGGTADTSSLASRNENLGENGNPLQNPNNLTIEITIPHMYLTHVYGENNSNLTQIRQTSGANVVVHDPKPGATEGLVIVSGAPDQTHAAQSLIQAFILCGQTIA

SEQ ID NO: 186173 - protein, 342 aa, Glycine max
  Coding DNA Sequence Number=SeqID_69395
  Gene Ontology: Mol. function=structural constituent of ribosome; Cellular component=large ribosomal subunit; Biological process =translation
  Homolog annotation: Hit_ID=Q2HVI3; Match level="QueryCoverage=70%, HitCoverage=98%, E-value=1e-105, Identity=79%"; Hit description =Peptidase, cysteine peptidase active site; Ribosomal protein L30
  Pfam annotation: Domain name=Ribosomal_L30; Domain location=182-234; Score=88.5; E_value=2.1e-23; Accession=PF00327.10; Description =Ribosomal protein L30pL7e
  Pfam annotation: Domain name=Ribosomal_L30_N; Domain location=111 -181; Score=107.5; E_value=3.8e-29; Accession=PF08079.2; Description =Ribosomal L30 N-terminal domain
  Pfam module annotation: Pfam domain module=Ribosomal_L30::Ribosomal _L30_N; Domain location=182-234::111-181
MGNHKPNGDGLMIYDPRVVSSSSTVRINLGSKRRIRTVECEKPQGTEQLQNPTYLTLQCCQACRENPSSLAVTQEANPIHSSLFRSENISSDLIVRMTEMGEEVKVVVPESVLKKRKREEEWALAKKQELDAAKKKRAESRKLIYNRAKQYAKEYDHQEKELIRLKREAKLKGGFYVDPEAKLLFIIRIRGINAMDPKSRKILQLLRLRQIFNGVFLKVNKATVNMLHRVEPYVTYGYPNLKSVRELIYKRGYGKLMKQRTALTDNSIIEQALGKYGIISTEDLIHEIITVGPHFKEANNFLWPFKLKAPLGGLKKKRNHYVEGGDAGNRENYINELIRRMN

SEQ ID NO: 186174 - protein, 198 aa, Glycine max
  Coding DNA Sequence Number=SeqID_69396
  Gene Ontology: Mol. function=sequence-specific DNA binding; Cellular component=intracellular; Biological process=base-excision repair
  Homolog annotation: Hit_ID=Q1S757; Match level="QueryCoverage=90%, HitCoverage=63%, E-value=6e-58, Identity=63%"; Hit description=HhH -GPD
MEKKRKRKQQVKRDGEPKPKSVRAGSTRTDNVKDPFPSHARPTPQECEAVRDTLLALHGIPPELAKYRKLPPSDEPVQLQPPEPVLDGLVRTVLSQNTTEANSQKAFASLKSSFPSWEQVLWAESKDVENAIRCGGLAPTKASCIKNVLRCLRERRGELCLEYLRDLSVDEVKAELSLFKGIGPKTLCQIFRYMATDE

SEQ ID NO: 186175 - protein, 462 aa, Glycine max
  Coding DNA Sequence Number=SeqID_69397
  Gene Ontology: Mol. function=signal transducer activity; Cellular component=nucleus; Biological process=regulation of transcription, DNA-dependent
  Homolog annotation: Hit_ID=Q8LAD5; Match level="QueryCoverage=94%, HitCoverage=92%, E-value=1e-147, Identity=56%"; Hit description=F -box protein ZEITLUPE/FKF/LKP/ADAGIO family
  Pfam annotation: Domain name=F-box; Domain location=19-66; Score =30.4; E_value=6.2e-06; Accession=PF00646.23; Description=F-box domain
  Pfam annotation: Domain name=Kelch_2; Domain location=170-219; Score =12.9; E_value=0.77; Accession=PF07646.5; Description=Kelch motif
  Pfam annotation: Domain name=Kelch_2; Domain location=228-279; Score =0.1; E_value=37; Accession=PF07646.5; Description=Kelch motif
  Pfam annotation: Domain name=Kelch_2; Domain location=283-330; Score =8.3; E_value=3.1; Accession=PF07646.5; Description=Kelch motif
  Pfam annotation: Domain name=Kelch_2; Domain location=342-389; Score =11.3; E_value=1.2; Accession=PF07646.5; Description=Kelch motif
  Pfam module annotation: Pfam domain module=F-box::Kelch_2::Kelch _2::Kelch_2::Kelch_2; Domain location=19-66::170-219::228-279::283 -330::342-389
MEESEGSTSGNHSYSSCGSPISNMAQDYLFTILLLLPIDAILSLSITCKRFRALTSSHTLWKSLCKRDLGSTCVDSLSSNNQHRHFPWMRLYKQVSQMDSVCCHKLLVSDLDFPAARASHSLNFVSDCLVLFGGGCEGGRHLDDTWVAYIGNDFRRMLKWQTVHSGIPSGRFGHTCVEMGDYLVLFGGINDRGNRKNDTWLGHVMFNENNGVTFSWKMLDVGNVAPPSRGAHAACCIDEKRMIIHGGIGLNGLRLGDTWVLEMSDSHCFGTWHEIVAHPSPPPRSGHTLTCIGRSRTILFGGRGLGYEVLDDVWLLDTYQGYQRWVQIVYDLQSIPAGVSLPRVGHTATLVLGGRLLIYGGEDSYRQRKDDFWVLDISAIPYPCITQQITVSSKKVLTRMWKRWKSSGHAANSRSFHRACADRSGRYVYVFGGMVDGFLQPAEPSGLRFDGELFLVELVLQL

SEQ ID NO: 186176 - protein, 484 aa, Glycine max
  Coding DNA Sequence Number=SeqID_69398
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=99%, HitCoverage=100%, E-value=1e-117, Identity=48%"; Hit description =Pentaxin
MGSRIPSHKLSNGLYVSGRPEQPKERTPTMTSTAVPYTGGDIKKSGELGKMFDIPVDGSKSRKSGPITGAPSRTGSFGGAGSHSGPMQPNAAARATYTSGPMTSGGMAGSTSMKKSNSGPLNKHGEPVKKSSGPQSGGVTPVGRQNSGPLAPVLPTTGLITSGPISSGPLNSSGAPRKVSGPLEATGSMKLQGSAAVHNQAVTVLSQGDDSFRRNFPKAVLWLLILLFVMGFIAGGFILGAVHNAILLIVVVILFGLVAASFTWNTYWGRRSIMGFVTHYPDSELRTAKNGQFVKVSGVVTCGNVPLESSFQKVPRCVYTSTSLYEYRGWDSKAANPAHRRLTWGLRLLERRVVDFYISDFQSGLRALVKTGHGARVTPYVDDSVLINVNPTKEELSPEFLRWLGERNLSSDDRIMRLEEGYIKEGSTVSVMGVVQRNENVLMIVPPPDPITTGCQWTKCIFPSSLEGIVLRCEDASKNDVIPV

SEQ ID NO: 186177 - protein, 423 aa, Glycine max
  Coding DNA Sequence Number=SeqID_69399
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q5BM96; Match level="QueryCoverage=98%, HitCoverage=97%, E-value=1e-125, Identity=54%"; Hit description =Secondary cell wall-related glycosyltransferase family 14
  Pfam annotation: Domain name=Branch; Domain location=65-290; Score =260.3; E_value=4e-75; Accession=PF02485.11; Description=Core-2I -Branching enzyme
MRTSKFPCRGLDYRLFLLIFAVCLVLYGTVSRLNAPNVSYATISKLRHFNPKHVISKGKGYPPVLAYWILGSKGESKKMLRLLKALYHPRNQYLLQLDDRSSESERMDLAISVKSIKVFEEYGNVNVIGKSYAINRMGSSALSAPLHAAALLLKLNPDWDWFITLSASDYPLMTQDDILHAFTFLPRYVNFIHYTNKTVRNEQRDINQIVVDQSLHYEKNSPLFFAVESRDTPDAFKLFRGSPWMILTRSFMEYCVRGWDNLPRKLLMFFSNVAYPLESYFHTVLCNSHEFQNTTVDNNLMYSLWDTDPSESQLLDMSHYDTMLETGAAFAHPFGEDDVVLEKIDDLILNRSSSGLVQGEWCSNSEINKTTKVSEAEEEFCSQSGNIDAVKPGPFGIKLKTLLADIENTRKFRTSQCKSFESW

SEQ ID NO: 186178 - protein, 286 aa, Glycine max
  Coding DNA Sequence Number=SeqID_69400
  Gene Ontology: Mol. function=mannosyl-oligosaccharide 1,2-alpha -mannosidase activity; Cellular component=membrane; Biological process=ER-associated protein catabolic process
  Homolog annotation: Hit_ID=Q1S755; Match level="QueryCoverage=100%, HitCoverage=52%, E-value=1e-144, Identity=83%"; Hit description =Glycoside hydrolase, family 47
  Pfam annotation: Domain name=Glyco_hydro_47; Domain location=1-265; Score=82.9; E_value=1e-21; Accession=PF01532.11; Description =Glycosyl hydrolase family 47
MENETTETSTSGCGSLILEMGALSKMTGDPIYESVALRALRKLWSMQSTLKLFGTTLDVTTGQWIEYSSGIGAGVDSFYEYLLKAHILFGKEDFWKMFHSAYVAVQKYFRHGPWYHEADMRTGRATYWQLTSLQAFWPGLQASSWTLNFYLLKIRYLLDHQMLHPTEKYYPLRPELAESTFYLYQATKDPWYIEVGESIVNSLNLYTKVEGGFASIKDVTTMQLEDHQHSFFLAETCKYLYLLFDDSFVHENNYVFTTEGHPLPVLSTWHEELPEAYIPTNWTFVK

SEQ ID NO: 186179 - protein, 134 aa, Glycine max
  Coding DNA Sequence Number=SeqID_69401
  Homolog annotation: Hit_ID=Q014K3; Match level="QueryCoverage=88%, HitCoverage=44%, E-value=2e-30, Identity=57%"; Hit description =Homology to unknown gene
MGTGQDLLVRRGESVPPNFEGPIFVCTRNDDLESVLQSTPSSRWRADLVFFQNGMMEPWLESKGLEDANQVLAYFAVSKIGESPIDGRTDTNPEGLTAAYGKWASVVAARLNAGGLSCKVSSFYCHTTPCPGFT

SEQ ID NO: 186180 - protein, 329 aa, Glycine max
  Coding DNA Sequence Number=SeqID_69402
  Gene Ontology: Mol. function=allantoinase activity; Cellular component=cytoplasm; Biological process=pyrimidine nucleotide biosynthetic process
  Homolog annotation: Hit_ID=Q1XKT4; Match level="QueryCoverage=96%, HitCoverage=72%, E-value=1e-133, Identity=72%"; Hit description =Dihydroorotase multifunctional complex type
  Pfam annotation: Domain name=Amidohydro_1; Domain location=49-281; Score=-45.6; E_value=0.097; Accession=PF01979.10; Description =Amidohydrolase family
MRTLIKNATIVNEGKIFESDILIEDDLISKIQPHISDEADQIIDGSGKYLLPGVIDDQVHFREPGLTHKGDIESESRAAIAGGITSFIDQPNTVPNAVTQELLADKYEIGSQKAYANYGFMMGGTNDNLEEVLKTNPRNVPGIKLFLGSSTGNMLVDNPETLENIFSNTKMLIAVHCEDEATIRANTQKYIEQYGEDIPVKFHHLIRSGEACYKSSSKAIELAEKTGARLHVFHLSTAIETALFRNDIPLKDKKITAEVCVHHLTFTNDDYETRGGLIKWNPAVKTQKDKDGLWEALLDGRIDVIATDHAPHTWEEKQNEWENFSGKNR

SEQ ID NO: 186181 - protein, 136 aa, Glycine max
  Coding DNA Sequence Number=SeqID_69403
  Gene Ontology: Mol. function=nucleotide binding; Cellular component =cytosol; Biological process=protein folding
  Homolog annotation: Hit_ID=P11143; Match level="QueryCoverage=43%, HitCoverage=9%, E-value=2e-23, Identity=88%"; Hit description=Heat shock 70 kDa protein
MASKTEGKGIDIAIAYGLDKKASRSGEKNVVIFDLGGGTFDVSLLTIQEAIFQVKATAGDTHLGGQDFDNRQGLLPIYIYDFLYTLLQSQKEIEEKYIHQGKMQLKEKKPYKTFTRLAEKYGPIYPSELVLSLSLL

SEQ ID NO: 186182 - protein, 102 aa, Glycine max
  Coding DNA Sequence Number=SeqID_69404
  Gene Ontology: Mol. function=oxidoreductase activity; Cellular component=endoplasmic reticulum; Biological process=electron transport
  Homolog annotation: Hit_ID=Q2LAK0; Match level="QueryCoverage=96%, HitCoverage=25%, E-value=3e-18, Identity=51%"; Hit description =Cytochrome P450 monooxygenase CYP701A16
  Subcellular localization annotation: CTP_CleavageSite=30; ConfidenceScore=5.31e-01
MVKKHIIISNVLGSNAQSSSTSAVNFRKIFASELFGLALKQSVGSNVESIYVEKLGGSLSKDDIHKILVEGAIEVSGGLERFLSKQELRDENTDLICTSAGM

SEQ ID NO: 186183 - protein, 443 aa, Glycine max
  Coding DNA Sequence Number=SeqID_69405
  Gene Ontology: Mol. function=transferase activity; Cellular component= nucleus; Biological process=flavonoid biosynthetic process
  Homolog annotation: Hit_ID=Q8GSM7; Match level="QueryCoverage=98%, HitCoverage=99%, E-value=0.0, Identity=75%"; Hit description =Hydroxycinnamoyl transferase
  Pfam annotation: Domain name=Transferase; Domain location=28-443; Score=291.2; E_value=2e-84; Accession=PF02458.6; Description =Transferase family
VEQRDDHQREGIDGGAAGGGGGAAGGVELQRGPGGPQFPHAQSNGTSNFFDGKVLKEALSKVLVPFYPMAGRLRRDEDGRVEIDCDGQGVLFVEADTGAVIDDFGDFAPTLELRQLIPAVDYSQGIETYPLLVLQSIASLPPPSRTAANGAQHVGMQHHVADGASGLHFINTWSDVARGLDVSIPPFIDRTILRARDPPRPVFDHIEYKPPPAMKTQQPTKPGSDSDNAAAAAAVSIFRLTREQLNTLKAKSKEDGNTISYSSYEMLAGHVWRSVCKARALPDDQETKLYIATDGRSRLQPPPPPGYFGNVIFTTTPIAVAGDLMSKPTWYAASRIHNALLRMDNDYLRSALDYLELQPDLKALVRGAHTFKCPNLGITSWTRLPIHDADFGWGRPIFMGPGGIAYEGLSFIIPSSTNDGSLSVAIALQPDHMKVFKDFLYDI

SEQ ID NO: 186184 - protein, 339 aa, Glycine max
  Coding DNA Sequence Number=SeqID_69406
  Gene Ontology: Mol. function=protein serine/threonine kinase activity; Cellular component=cytoplasm; Biological process=protein amino acid phosphorylation
  Homolog annotation: Hit_ID=P93321; Match level="QueryCoverage=99%, HitCoverage=100%, E-value=1e-142, Identity=74%"; Hit description =Cdc2MsD protein
  Pfam annotation: Domain name=Pkinase; Domain location=4-331; Score =290.8; E_value=2.7e-84; Accession=PF00069.15; Description=Protein kinase domain
  Pfam annotation: Domain name=Pkinase_Tyr; Domain location=4-331; Score=5.1; E_value=8.8e-13; Accession=PF07714.7; Description=Protein tyrosine kinase
  Pfam module annotation: Pfam domain module=Pkinase::Pkinase_Tyr; Domain location=4-331::4-331
MEKYEKLEKVGEGTYGKVYKAREKASGSLVALKKTRLEMDEEGVPPTALREVSLLQLLSQSIYIVRLLSVEHVDKVPKSQKSSSNPLTKPILYLVFEYLDTDLKKFIDSHRKGPNPRPLPPPLIQSFLFQLCKGVAHCHSHGVLHRDLKPQNLLLDQHKGILKIADLGLGRAFTVPLKSYTHEIVTLWYRAPEVLLGSTHYSTGVDIWSVGCIFAEMVRRQALFPGDSEFQQLIHIFNSHISYLPSHTLLIQLRCFLIFLSFKDVGTPTEENWPGVTSLRDWHVYPRWEPQSLAKNVPSLGPDGVDLLSKMLKYNPSERISAKAALDHPYFDSLDKSQF

SEQ ID NO: 186185 - protein, 481 aa, Glycine max
  Coding DNA Sequence Number=SeqID_69407
  Gene Ontology: Mol. function=pepsin A activity; Cellular component =cellulose and pectin-containing cell wall; Biological process =proteolysis
  Homolog annotation: Hit_ID=Q69P39; Match level="QueryCoverage=91%, HitCoverage=93%, E-value=1e-115, Identity=49%"; Hit description =Putative nucleoid DNA-binding protein cnd41, chloroplast
  Pfam annotation: Domain name=Asp; Domain location=133-476; Score= -77.1; E_value=4.7e-09; Accession=PF00026.14; Description=Eukaryotic aspartyl protease
MAMAPAMLPFFLFLSLLSLCLLINANGVSSFEEKKIFNVQTLQKKHQLGNQQACLLPESRKEKGAIILEMKDRGHCSEKKIDWNRRLQKQLISDDLRVRSMQNRIRRVVSSHNVEASQTQIPLSSGINLQTLNYIVTMGLGSTNMTVIIDTGSDLTWVQCEPCMSCYNQQGPIFKPSTSSSYQSVSCNSSTCQSLQFATGNTGACGSNPSTCNYVVNYGDGSYTNGELGVEQLSFGGVSVSDFVFGCGRNNKGLFGGVSGLMGLGRSYLSLVSQTNATFGGVFSYCLPTTESGASGSLVMGNESSVFKNVTPITYTRMLPNPQLSNFYILNLTGIDVDGVALQVPSFGNGGVLIDSGTVITRLPSSVYKALKALFLKQFTGFPSAPGFSILDTCFNLTGYDEVSIPTISMHFEGNAELKVDATGTFYVVKEDASQVCLALASLSDAYDTAIIGNYQQRNQRVIYDTKQSKVGFAEESCSFA

SEQ ID NO: 186186 - protein, 449 aa, Glycine max
  Coding DNA Sequence Number=SeqID_69408
  Gene Ontology: Mol. function=nucleotide binding; Cellular component =chloroplast; Biological process=response to heat
  Homolog annotation: Hit_ID=P26413; Match level="QueryCoverage=83%, HitCoverage=71%, E-value=1e-121, Identity=53%"; Hit description=Heat shock 70 kDa protein
  Pfam annotation: Domain name=HSP70; Domain location=1-420; Score =372.7; E_value=5.7e-109; Accession=PF00012.10; Description=Hsp70 protein
MGKGDVKAVILSREGPKNSAGESPRAQYMTVSTVIRISPYFDIGNQRFHQTTRSEQVRALALTSAPPTAAAIAYGLDKKASRSGEKNVVIFDLGGGTFDVSLLTIQEAIFQVKATAGDTHLGGQDFDNRQGLLPIYIYDFLEIEDCMRERAKRTLSSTTQTTIEIDSLYEAQHGHVHDVVLVGGSTRIPKVQQLLQDFFNGKELCKSINPDEAVAYGAAVQAAILSGEGNEKVQDLLLLDVTPLSLGIETAGGVMTVLIPRNTTIPTKKEQIFSTYADNQPGVLIQVYEGERASTKDNNLLGKFELTGIPSAPRGVPQINEEIEKMVQEAERYKAEDEEVKKKVDAKNSLENLAYNMRNTVKDDKFAGKMNPSDKEKIEKAVDETIEWLDRNLLTEVEEFQDKLKELEGLCNPIISNMYQGSGADDIPNGAGYGKSSTGGAGPKIEEVD

SEQ ID NO: 186187 - protein, 170 aa, Glycine max
  Coding DNA Sequence Number=SeqID_69409
MLELETFSLSLKQHGQNRSLILILSPENSYPHASQFSIPFTSIQAISTSEFNMNFTSKGKGLIQSNGPVQELLGKLYGSIEDSIRLNDKVEETKDGNKEERLNTTRKAQGGGSSRGTGSRGKTGSGGTADVNRRPRQSSAPSEPLFWVSIFNPCVSLALVILFSLPLGLM

SEQ ID NO: 186188 - protein, 718 aa, Glycine max
  Coding DNA Sequence Number=SeqID_69410
  Gene Ontology: Mol. function=nucleic acid binding; Cellular component= intracellular
  Subcellular localization annotation: CTP_CleavageSite=6; ConfidenceScore=5.24e-01
MVGPTSRAYVFNPPTRSLHHATTTKKVHEPGPTFYPFTSPDATCLPDGTQLRRFAPRVTFLNMPTIGDKRSTICGGHICHSGLNFTRLSCFKYGVVSYVARDSLSLKKEKKHCIMVQLMRSDTDNHCLKKVKLEVQDEIPPLHTHKRPKLESPPKQCGASDESISIPPASYNPLDEPSPLGLRLRKSPSLLDLIQMRLSQQEESKKKDQKASSSSSVAAAAAAAADSKLKASNFPGTILKIGNWEYKSRYEGDLVAKCYFAKHKLVWEVLDGCLKNKIEIPWSDIMAIKANYPDDGPGTLEVVLARRPLFFREINPQPRKHTLWQATSDFTGGQAGINRRHFLQCPQGLLGKHFEKLIQCDPRLNYLSQQADLVLDSPYFEPGTTSIHDHIESSDGFDRKSEERSGIFGLQDVESGSAVQSSSSKSEHNLGKAVENVSQEITSPSSVMNIHAMKDFRSRGAETLKFLSNLDQIKLPGLHPSMSMDDLVSHIGHCISEQMGSDNPNFAGDNQYSRSILEEFTQYLFNDSQHATTSDEQRKDPSTAEDMTKNGNSLGDANALSRVNSLYSLLQNAEDAMARNGNGLRDADVMSRVNSLYCLLQKDPYTAEDTNTMTRNGNGLDADEGGKVGVSNSNITELSQPCKTKVSDLEVQADDASGCKQGGTGMSRKESAGDLLLNLPRVASLPQFLFNMSEDSVNKFYLRGIQKFTLMMNPDRQT

SEQ ID NO: 186189 - protein, 130 aa, Glycine max
  Coding DNA Sequence Number=SeqID_69411
MYQTTSYIKYLEGRSYYANATQNLRDGYPLTGSASKGMCYVMWAPFYQVVERAYAWTPLSLPKPQIMFFLNFTHSHFVPCRGFPCPSTPSDGGAVAVGENPNPKVVVDDEKSPRRRSIPDANKLGQWLET

SEQ ID NO: 186190 - protein, 70 aa, Glycine max
  Coding DNA Sequence Number=SeqID_69412
  Subcellular localization annotation: CTP_CleavageSite=40; ConfidenceScore=5.14e-01
MRRRVVIGWMQLAGLESTHSKAFALTPNPYPDNSQLLSVLSSGSGNVPPPPLSSNSSRSMFIMHMKPSFL

SEQ ID NO: 186191 - protein, 209 aa, Glycine max
  Coding DNA Sequence Number=SeqID_69413
  Gene Ontology: Mol. function=electron carrier activity; Cellular component=membrane; Biological process=electron transport
  Homolog annotation: Hit_ID=Q2HW94; Match level="QueryCoverage=48%, HitCoverage=58%, E-value=5e-23, Identity=47%"; Hit description=Blue (Type 1) copper domain
  Pfam annotation: Domain name=Cu_bind_like; Domain location=73-153; Score=99.4; E_value=1.1e-26; Accession=PF02298.8; Description =Plastocyanin-like domain
  Subcellular localization annotation: CTP_CleavageSite=22; ConfidenceScore=5.17e-01
MELQNRQATQVFIRSKTASSLRSKQSKGHNTTEKEKSKSMGGSWSWQLTCALLLLFSAVVTATDHIVGANRGWNPGFNYTLWANNHTFYVGDLISFRYQKNQYNVFEVNQTGYDNCTTEGAVGNWSSGKDFIPLNKAKRYYFICGNGQCFSGMKVSVVVHPLPPPPTSAVAAQHSSPKSASPVLLKRGFRSLLVSTVSACFGIVWIYHL

SEQ ID NO: 186192 - protein, 392 aa, Glycine max
  Coding DNA Sequence Number=SeqID_69414
  Gene Ontology: Mol. function=sequence-specific DNA binding; Cellular component=nucleus; Biological process=regulation of transcription
  Homolog annotation: Hit_ID=Q06B53; Match level="QueryCoverage=94%, HitCoverage=78%, E-value=5e-71, Identity=44%"; Hit description=WRKY -like transcription factor
  Pfam annotation: Domain name=WRKY; Domain location=223-281; Score =139.0; E_value=1.3e-38; Accession=PF03106.6; Description=WRKY DNA -binding domain
VNLHTQSEAASSKDMGDLSMSFSFTDLLFTNNNNMNRDDDPFGLEFANNFKSASLPLSPSSIYPSYAEFPPGFAPTTQSLNSHHFFSSQNVPASYTTEPSSSMSFNMRNSSTMGQHGNKEEERNYSDHSFQTKANHVPLFQSSTSIFQVEPQKKQDTMIFNEAAKQTDFSSERTETKSEYPSTQGFSTALASIKHEIQSNSAPGSVQFNSTFAPKSIREQRRSEDGYNWRKYGEKQVKGSENPRSYYKCTHPSCPTKKKVERSLEGHITEIVYKGSHNHPKPHGRKNGSQSIHQTSSPCTNSGISDQSVGDEDLEQTSQTSYSGGGDDDLGNEAKRWKGENENDGYSYSSAGSRTVKEPKVVVQTTSEIDILDDGYRWRKYGQKVVKGNPNP

SEQ ID NO: 186193 - protein, 360 aa, Glycine max
  Coding DNA Sequence Number=SeqID_69415
  Homolog annotation: Hit_ID=Q6V5E9; Match level="QueryCoverage=73%, HitCoverage=64%, E-value=5e-09, Identity=21%"; Hit description=F-box protein
MGEIFIRLPFRSTVKCKCVCKRWLGLISSPSFPTEFVSSQYSLFKAYFTFLSPHQLMFGFFPSDLNFNAQIHKVPLSPAILIKGDVCGYSNGLFLCCSNRFTRGWGYFVYDPFTKECNHIPPFPDAHKETCLYAVGFLSQINDFEEEGNSNRCFWVVVVRSSMRMKYEFEVEVFYSGTRTWRQILMSCVDGFAFAPHWFLSFAFEGYLHFMGSRSILVLDPIFMICTTIDYPENADAMNIMSFGYLGCSGGTMRIADIGNNDLRVWELLIPGKWHLVHRTNLNLMEHLPTRFCSNYCKRVGGFHPYDGDIVYLHSYVDGIYAINLGTNKVVPISGYDKFDISPFQLELSSIPLADNDDRR

SEQ ID NO: 186194 - protein, 654 aa, Glycine max
  Coding DNA Sequence Number=SeqID_69416
  Gene Ontology: Mol. function=transferase activity, transferring glycosyl groups; Cellular component=integral to membrane; Biological process=cell wall biogenesis
  Homolog annotation: Hit_ID=Q9SWH5; Match level="QueryCoverage=69%, HitCoverage=81%, E-value=1e-112, Identity=45%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=111-579; Score= 647.4; E_value=1.1e-191; Accession=PF03254.4; Description=Xyloglucan fucosyltransferase
GLTESSAQNVTNNGFPLGGRVHNTTSDDEIETHLRTRHNDTVSVVLPGNIQNGSTVEERARTMNSTASGIEGKVERGTDRNVTAELLNGGVKDLQERSQNNFATEGRSENITAAYAGSKNASLASSTNVSTTEPVNLDDNDKLLGGLLTSGFDEASCKSRMQSHLYRKASPHKPSPYLISKLRKYEEIHRRCGPNTRDYDKSMKKIVSSKNNGAATKCKYIIWNTANGLGNQMISIAATFLYAILTDRVLLVKFNKDKHGLFCEPFLNSTWILPQKSPFSSWNEHNTETYQTMLDKDRASNSKKGLPSVLFINLQFSFENPEKYFHCDHSQDLLRKIPMLILRSDQYYVPSMFMNPFFNLEIANMFPERDIIFHHLGRYLFHPSNDAWELISSYYQAHLASASERIGLQIRVFNAATTPKQAIMNLVLSCTLQQKILPEVDLKTSVSSAGKNMTTVKAVLVASLHKEYGDNLRSMYLKKPTVSGEVIEVYQPSHEGKQKFNDNGHNLKAWTDMYLLSLSDVLVTTSLSTFGYVAQGLGNLKPWLLYRLVGNHSGDFPRCERDFSTEPCFHMPPKHYCNGEPMNDIVSSFPNLRECKDLRFGVKLAAVNGTAFGVYLAQNYQIPNIRKLADTALLQAKQIEEKYRKSKKKGGDDD

SEQ ID NO: 186195 - protein, 273 aa, Glycine max
  Coding DNA Sequence Number=SeqID_69417
  Homolog annotation: Hit_ID=Q01G24; Match level="QueryCoverage=40%, HitCoverage=33%, E-value=7e-09, Identity=54%"; Hit description =Homology to unknown gene
  Subcellular localization annotation: CTP_CleavageSite=33; ConfidenceScore=5.00e-01
MVMGISSPSYKLKFLRPRQLEPLSLTPPSSSFRALELKEKVQPLIPWPVSPFTNLNPTNSLSYALQDGKIRLEIDFPPLPSNISSYKGSSDEFIDANVQLALAVVQKLKKETRTQSLQKEIHTYFHIDGITIGSLDDVSLLDLFRPSGLPSQRFAVPLSFSIHSIRIREYSKVMLKQADGSYACIAESANCFSLGELHTNPLTDIGQRGIVEGLGTSRRRGKFSRISSKRLQGVLLQARGGKKILIQKYLMDGGVELCTVRRDCFTASACSGH

SEQ ID NO: 186196 - protein, 71 aa, Glycine max
  Coding DNA Sequence Number=SeqID_69418
MKLVQSHVLLQHTCTYLKGKGADSARQQNAKKEKAMPAAAESVNILVVTSLISSVAGIAEDVDDIKRYATT

SEQ ID NO: 186197 - protein, 232 aa, Glycine max
  Coding DNA Sequence Number=SeqID_69419
  Gene Ontology: Mol. function=amino acid binding; Cellular component =chloroplast thylakoid membrane; Biological process=metabolic process
  Homolog annotation: Hit_ID=Q2QXL3; Match level="QueryCoverage=84%, HitCoverage=64%, E-value=2e-28, Identity=42%"; Hit description=ACT domain-containing protein, putative, expressed
  Pfam annotation: Domain name=ACT; Domain location=98-162; Score=14.0; E_value=0.061; Accession=PF01842.15; Description=ACT domain
  Subcellular localization annotation: CTP_CleavageSite=64; ConfidenceScore=5.40e-01
MTLAMAVWSAGLHFSAARSSLRPLEKTICTAPFLKASSGFAATKPFCILNTTRLSYSGTTIIPRAAPVTDVKDGNQGETDTIPTPVVIIDQDSDPDATVVEITFGDRLGALLDTMNALKNLGLNVVKANVFLDSSGKHNKFSITKADTGRKVEEPELLEAIRLTIINNLIQYHPKPRGSSQLIRFFKLGGQGIKFPVSIGSSFWTSASKRADKFCQVKRYPIPSWYLEVSSI

SEQ ID NO: 186198 - protein, 482 aa, Glycine max
  Coding DNA Sequence Number=SeqID_69420
  Gene Ontology: Mol. function=transferase activity, transferring glycosyl groups; Cellular component=membrane; Biological process =cell wall biogenesis
  Homolog annotation: Hit_ID=Q6Z7Q2; Match level="QueryCoverage=73%, HitCoverage=61%, E-value=3e-91, Identity=45%"; Hit description =Putative galactoside 2-alpha-L-fucosyltransferase
  Pfam annotation: Domain name=XG_FTase; Domain location=71-482; Score =450.1; E_value=2.9e-132; Accession=PF03254.4; Description=Xyloglucan fucosyltransferase
  Subcellular localization annotation: CTP_CleavageSite=35; ConfidenceScore=5.12e-01
MEIFQATADKMRMSSKRFATLFVVFFISFSVFLIVSSIYRNSSYYAIFEGLSKGREAGESAQNVTINRFPLEGTVHNTSEENLVSEHGPKNVSLTSSTTESTPDLEDKDKLLGGLLTTGFDEASCISRMQSQLYRKASPHKPSPYLISKLRNYEDIHRRCGPNSRAYDRSMRKIVRSKNKGAAATLCKYLIWTPANGLGNQMISMAATFLYAMLTDRVMLVKFDKDKQGLFCEPFLNSTWVLPEKSPFWNEKHIETYQTMLEKDRNRTSNSKDDLPSVLFINLQHTLSEPEKFFHCDHSQYLLREVPLLILQSDQYFVPSLFMNPFFNQEVTKMFPEKDTVFHRLGRYLFHPSNEAWKLISDYYQEHLAKADKRIGLQIRVFSPVSTPQQTVMDLVLSCTLKHKILPQVDLQTSAGKNHSVKAVLVASLHREYGDNLRSMYLKKATVSGEVIEVYQPSHEEHQKFNDNKHNLKAWIDMDWGI

SEQ ID NO: 186199 - protein, 403 aa, Glycine max
  Coding DNA Sequence Number=SeqID_69421
  Gene Ontology: Mol. function=N-acetyltransferase activity; Biological process=metabolic process
  Homolog annotation: Hit_ID=Q42381; Match level="QueryCoverage=94%, HitCoverage=100%, E-value=1e-100, Identity=48%"; Hit description =Putative N-acetyltransferase hookless1
  Pfam annotation: Domain name=Acetyltransf_1; Domain location=77-165; Score=68.6; E_value=2e-17; Accession=PF00583.14; Description =Acetyltransferase (GNAT) family
MSLKIAAEIYPKSPSETVKEPLVVVKEYDEDRHKVAVERLERLCEVGQSGKPSLVTDLMGDPICRIRHFQLHVMLVAEYGEEGEVVGVIRVCVKTVTRGNSVYIKLAYILGLRVSPRHRRFGIGTKLVEHLEEWCKKKGAKYAYMATDCTNEPSVNLFTKKCGYSKFRTLTILVQPVHAHYKPISSNVAVLHLPPRLAGSIYNHMFANSEFYPKDIELILSNKLNLGTFMAIPKKYLSRCDPKRGILPPSYAILSVWNTKDVFKLQVKGVSPLAHACCVGTRLLDEWMPWLRLPSFPDVFRPFGVYFLYGLHMEGKRGAQLMKSLCGFVHNMARDDGGCGAIVAELGQRDPVRDAVPHWSKFSWAEDMWCIKNLEDTKKDIQESDWFTSRSSSPVIFVDPRDF

SEQ ID NO: 186200 - protein, 89 aa, Glycine max
  Coding DNA Sequence Number=SeqID_69422
  Gene Ontology: Mol. function=amino acid binding; Cellular component =chloroplast thylakoid membrane; Biological process=metabolic process
  Homolog annotation: Hit_ID=Q2QXL3; Match level="QueryCoverage=86%, HitCoverage=27%, E-value=3e-24, Identity=66%"; Hit description=ACT domain-containing protein, putative, expressed
MAQIEGDAFICMLYVETADRPGLLVDLVKIITDINIAVESGEFDTEGLLAKAKFHVSYNGKAISKPLQQVLANSLRYFLRRPTTEESSF

SEQ ID NO: 186201 - protein, 94 aa, Glycine max
  Coding DNA Sequence Number=SeqID_69423
MLANFKRASPGAAGKVAYNIPPPYLRIAKSLWAMGYEKMLANFTLELAIPTRLAPQTLKIPQPLTKKFIAKDEENTEDHGGHEPNPWEGNQENL

SEQ ID NO: 186202 - protein, 73 aa, Glycine max
  Coding DNA Sequence Number=SeqID_69424
MMFIAAGLEAIRFGLLCVSKVSGKATVIAAIGVGYTKKYADGGYTISGMQGCKILCPNMFLQWGTFIRPFMSF

SEQ ID NO: 186203 - protein, 331 aa, Glycine max
  Coding DNA Sequence Number=SeqID_69425
  Gene Ontology: Mol. function=sequence-specific DNA binding; Cellular component=nucleus; Biological process=regulation of transcription
  Homolog annotation: Hit_ID=Q2PJR9; Match level="QueryCoverage=99%, HitCoverage=99%, E-value=3e-86, Identity=56%"; Hit description=WRKY78
  Pfam annotation: Domain name=WRKY; Domain location=178-238; Score =132.3; E_value=1.4e-36; Accession=PF03106.6; Description=WRKY DNA -binding domain
MDCSSWINTSLDLNINPRRVHEEVPKEVESELFSLGMTKFNVEEESTSDLEEELKRVTAENKKLAEMLSVVCENYNTLRNHLMECMRKNGEKEVSPTSKKRKSESSNNNSNLMGTNNGNSESSSTDEESCKKPREEIIKAKISRVYVRTEASDTSLVSLFTSTQSLVLGHGIDYIGIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 186204 - protein, 368 aa, Glycine max
  Coding DNA Sequence Number=SeqID_69426
  Gene Ontology: Mol. function=DNA-3-methyladenine glycosylase I activity; Biological process=base-excision repair
  Homolog annotation: Hit_ID=Q1SSR7; Match level="QueryCoverage=99%, HitCoverage=99%, E-value=7e-65, Identity=39%"; Hit description =Protein prenyltransferase, alpha subunit
  Pfam annotation: Domain name=Adenine_glyco; Domain location=179-325; Score=248.3; E_value=1.6e-71; Accession=PF03352.4; Description =Methyladenine glycosylase
MSGPPRVRSMNVAVADADARPVLVPAGNKVRPVVEGRKPVKKSSTETEKKPVAHSPQCVSVPAVAISRQQEHHQAVLKSMSSMNASFSSDTSSTDSSTHSSGASSSGKVTRRVSVALRKKQVGPKTEKASCDNVAGSDDADLSDSLEGKKRCAWVTPNTEFEVGVDMLDKGCSTSPSCITQPCYIAFHDEEWGVPVHDDRKLFELLSFSGALAELTWPTILSKRQLFREVFLDFDPSAVSRMNEKKIAAPGSPANSLLSELRLRSIIENARQMCKVPVKSPKAEFISKDLVRRGFRSVGPTVIYTFMQVAGLTNDHIISCFRFKECTSNAEAMGKESSLNSKVKEKANEEPTSVGLLLSVNKLSFTSK

SEQ ID NO: 186205 - protein, 87 aa, Glycine max
  Coding DNA Sequence Number=SeqID_69427
MSKSLRVEIPSNTNNNNRLLYLTKVANFSSHKQNPTKEGFDKPWWAEIALKVAAWIGQNQKTRPMVMMGHKLLVVGEEWVKSGKGCW

SEQ ID NO: 186206 - protein, 126 aa, Glycine max
  Coding DNA Sequence Number=SeqID_69428
  Gene Ontology: Mol. function=transition metal ion binding; Cellular component=cytoplasm; Biological process=fucose metabolic process
MGDRLEDMIRDLGQKSFQQAHTPMHDTLQTDSKKPLYSEYQKILASTNDCILYRHQFQEMSKCPRCGVSWYKLKDDEECSSDENLNKGPPVKVLWYLPIIPKFKRLFANGDDAKDLTWHANGRNCD

SEQ ID NO: 186207 - protein, 219 aa, Glycine max
  Coding DNA Sequence Number=SeqID_69429
  Gene Ontology: Mol. function=protein phosphatase type 2C activity; Cellular component=nucleus
  Homolog annotation: Hit_ID=Q9FG61; Match level="QueryCoverage=91%, HitCoverage=48%, E-value=5e-38, Identity=39%"; Hit description =Protein phosphatase-2C PP2C-like
MGGCCSCHVSFVGKVHDVECECNHNNDDGACEHGGARVMLKGSSTFVSMYSQKGSKGVNQDALTVWQDFTGKKDMIFCGVFDGHGPLGHKLSQCIRDNLPAKLSASIKQSQEKAMKHYDANATNGGSHSDDYVEDNQNMSFPSWEGTFMRCFSEIDEKLAKNIDTDGFRGGSTSVSVIKQGEQVIIGNVGDSRAVLCRRAPDNHLIPVQLTVDLTPDIP

SEQ ID NO: 186208 - protein, 133 aa, Glycine max
  Coding DNA Sequence Number=SeqID_69430
  Gene Ontology: Mol. function=microtubule motor activity; Cellular component=microtubule associated complex; Biological process =microtubule-based movement
  Homolog annotation: Hit_ID=Q2HU33; Match level="QueryCoverage=99%, HitCoverage=12%, E-value=1e-46, Identity=77%"; Hit description =Kinesin, motor region
  Pfam annotation: Domain name=Kinesin; Domain location=1-132; Score= -160.2; E_value=0.00029; Accession=PF00225.13; Description=Kinesin motor domain
  Pfam annotation: Domain name=PABP; Domain location=34-100; Score= -13.0; E_value=0.098; Accession=PF00658.8; Description=Poly-adenylate binding protein, unique domain
  Pfam module annotation: Pfam domain module=Kinesin::PABP; Domain location=1-132::34-100
MSLIVYERLEGYNCTIFAYGQTGTGKTYTMEGVARKKAIHNAKFSSNASVIPRAVKQIFDILEAQNANYNMKVTFLELYDEEITNLLAPEETLKFKVDTYRKPIALMEDEKGVFLPGAWKKRLFALQMKFTRY

SEQ ID NO: 186209 - protein, 116 aa, Glycine max
  Coding DNA Sequence Number=SeqID_69431
MNSFFFLDEKVEEGWALRASGFFFHACYAVLLIETKDQEGQSQVLSAALEIAEDENVEVDPKFRALVAVGSLMLEGLVRKTALDFDVVNIAKAAKGSKEAKIAEVGSDIELLTKQS

SEQ ID NO: 186210 - protein, 159 aa, Glycine max
  Coding DNA Sequence Number=SeqID_69432
MKRGEKELKESERNLSLLRPVCVVTLPTNSSLSHHPGIPLCLSISNKNDTCHDSEDNVDVISSELMLAVSISLEPTILSSTSTAPRALASSLSNQIQEAKKWRVSMPPLGLVIELSDPNTNEDDDHDLDSAVANAVNSASSSIESSSKKRRTSEARVAN

SEQ ID NO: 186211 - protein, 421 aa, Glycine max
  Coding DNA Sequence Number=SeqID_69433
  Gene Ontology: Mol. function=transporter activity; Cellular component= integral to membrane; Biological process=cell division
  Homolog annotation: Hit_ID=Q9SCU1; Match level="QueryCoverage=99%, HitCoverage=99%, E-value=1e-170, Identity=72%"; Hit description =Patellin-6
  Pfam annotation: Domain name=CRAL_TRIO; Domain location=145-323; Score=66.2; E_value=1.1e-16; Accession=PF00650.10; Description =CRALTRIO domain
  Pfam annotation: Domain name=CRAL_TRIO_N; Domain location=48-130; Score=44.5; E_value=3.6e-10; Accession=PF03765.5; Description =CRALTRIO, N-terminus
  Pfam annotation: Domain name=EMP24_GP25L; Domain location=334-415; Score=16.6; E_value=0.02; Accession=PF01105.14; Description =emp24gp25Lp24 family
  Pfam module annotation: Pfam domain module=CRAL_TRIO::CRAL_TRIO _N::EMP24_GP25L; Domain location=145-323::48-130::334-415
MDTTSSPMSLQTQKTNFQDLPEASPKPYKKGIVATLMGGAGSFKEDNYFVSLLRSSEKKALQELKEKLKSSFEDSPSDASMWGIPLLGGDDKADVILLKFLRARDFRIGDAHHMLLKCLSWRKEFGADTILEEDLGFNKELEGVVAYMQGYDKEGHPVCYNAYGVFKDKEMYERVFGDEEKLKKFLRWRVQVLERGIKVLHFKPGGVNSLIQVTDLKDMPKRELRVASNQILSLFQDNYPEMVARKIFINVPWYFSMLYSMFSPFLTQRTKSKFVISKEGNAAETLYKFMRPEDIPVQYGGLNRPSDLQNGPPKPVSEFRIKGGEKVNIQIEGIEAGATITWDIVVGGWDLEYSAEFVPNAEGSYTIAVEKPRKMGASEEAIHNSFTSKESGKMVLSVDNTASRRKKVAAYRYVVRKSSTI

SEQ ID NO: 186212 - protein, 694 aa, Glycine max
  Coding DNA Sequence Number=SeqID_69434
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=40%, HitCoverage=98%, E-value=9e-51, Identity=46%"; Hit description =Integrase, catalytic region
  Pfam annotation: Domain name=Chromo; Domain location=607-658; Score =16.3; E_value=0.012; Accession=PF00385.14; Description='chromo' (CHRromatin Organisation MOdifier
  Pfam annotation: Domain name=zf-H2C2; Domain location=353-394; Score =4.3; E_value=0.097; Accession=PF09337.1; Description=His(2)-Cys(2) zinc finger
  Pfam module annotation: Pfam domain module=Chromo::zf-H2C2; Domain location=607-658::353-394
MADSTRSKSNLDCLEDAIAKLTASQFNLSMRLDDICQKVATLETRPLSLSSSSANLSTAPSFIISDRMKLEITQFFEYHETLEPDCLTIAYFYMEGLALAWFQWMSRNGQLASWPIPRQQNCWSSNTIFAQLFHLGIKSRDSPRNIGSIAPHAALSAPPPLRPLLLVHTLALLPTPQPSPSIPFKKLSSKELALHREKSLCFNCNEKFSGGHRCSSKMFLFITDEDDNPIDELIPPDELGDTGEPDAISSAPALQLPNFEIPFTVETDASGVGIMAQVIQTSEQQFYLSRLMGYDYTIKYRTGKTNTIADALSRVPDDSQSSLFIVSVPHFNFLEQFKTDLTTHPEFVALQFHSTPTGGHMGIKKTLARLGEIFIWFDMRTDVRQFFLACLDCQATKYEAKKPVGLLCPLPIPSRPWEDLSLDFIVGLPSYHGVVSLEWNKVMDEFRLSSLNEWSNREWCYNTSIHSAIGISPFEVSFGRKPPSIPQYLTGDYQVITVDNILNEREAVFTKLHKKLSKAQERMKLTADMHRRDVMFEPGEWVMLAKRFYGPFQILSRIGKVAYKLKLPEESRIHLVFHCSNLKLFHNSTTATPLALPSQDIDNNPVIIPLAILGTHWDLVQDEPRLQVLVQWQVLHPYDTTWEDWANLKEAHHLEDKVLPDGVENGRPKIGNAKITQGRPKRRIIVPSHLKDYV

SEQ ID NO: 186213 - protein, 92 aa, Glycine max
  Coding DNA Sequence Number=SeqID_69435
  Subcellular localization annotation: CTP_CleavageSite=76; ConfidenceScore=5.64e-01
MGDMLGAPRFFAGAPSNLLKCQFCPSFKNIKSFFPLSEAFCLLFREKASFLSSLFRESKLPWWSSSPRDFSAFIFSARLLSSICIRGRWPSS

SEQ ID NO: 186214 - protein, 108 aa, Glycine max
  Coding DNA Sequence Number=SeqID_69436
NGNLPEEASSGNIPDDVLLEVVPEHFRKSQILLPEEVSPLHCLLGAPAIMLGARNNSPHIGPTKTLIELENYTPRLYSPYAICSGNGRKDSEKYAELEGAASFTGETC

SEQ ID NO: 186215 - protein, 173 aa, Glycine max
  Coding DNA Sequence Number=SeqID_69437
MNVGLLVVYWISRTLGVGLGRQNPMHYSSGEGHDGQPVSGRSLGSWSKHKLTNFLDHACDVNFEAEQDQYSVGLILGSQNFAEKLEPIEIVAKQEAAHGVEELTAGLGRWKQTITMIRKVYLSSCLWVFDLDHTWMKKTQQMQVVILAESFQANVVFLLGSMDHNKWWESVPS

SEQ ID NO: 186216 - protein, 47 aa, Glycine max
  Coding DNA Sequence Number=SeqID_69438
MARRLLLDPTIHEEFTQLKFGLLALKEVGIMCHTSVVLDKCQSRVVS

SEQ ID NO: 186217 - protein, 79 aa, Glycine max
  Coding DNA Sequence Number=SeqID_69439
MGNTQMGKIDAFQEDGIGWTYHVPKKAFRGVENLHHACMMKKMQSKKEYPVGLKDVEKRFKKVKKERCGYCSVAEYFVN

SEQ ID NO: 186218 - protein, 251 aa, Glycine max
  Coding DNA Sequence Number=SeqID_69440
  Gene Ontology: Mol. function=transporter activity; Cellular component= membrane; Biological process=transport
  Homolog annotation: Hit_ID=Q2Z1Q0; Match level="QueryCoverage=99%, HitCoverage=51%, E-value=3e-88, Identity=64%"; Hit description=NRAMP family metal transporter
  Pfam annotation: Domain name=Nramp; Domain location=1-137; Score= -91.6; E_value=3.7e-10; Accession=PF01566.9; Description=Natural resistance-associated macrophage protein
MEACRFYMIESAFALTVAFLINISVISNVLGKWSSKLFAIALLASGQSSTITGTYAGQYVMQGFLDLRLKSWIRNLLTRCLAIVPSLIVALIGGSAGAGELIIIASMILSFELPFALIPLLKFTSSKIKMGEHVNSISISAVTWIIGSLIMGINIYYLLTSFVKLLLHVHLKIVTKVFLGILGFSGVALYMGGIAYLVFRKNKKTTHILAFRTLEEQQVANEQGDISIYSLPREDIVSMQLPQKRSPAEID

SEQ ID NO: 186219 - protein, 74 aa, Glycine max
  Coding DNA Sequence Number=SeqID_69441
  Gene Ontology: Mol. function=protein serine/threonine kinase activity; Biological process=protein amino acid phosphorylation
  Homolog annotation: Hit_ID=Q53VE1; Match level="QueryCoverage=80%, HitCoverage=14%, E-value=4e-16, Identity=70%"; Hit description =Ser/Thr protein kinase
MQGTEEGRKGKLAMTVEVFEVAPEVAVAEFTKSAGDTLEYVKFCEEQVRPSLKDIVWSWQVLVLSMIHHGRGLI

SEQ ID NO: 186220 - protein, 87 aa, Glycine max
  Coding DNA Sequence Number=SeqID_69442
  Gene Ontology: Mol. function=transporter activity; Cellular component= integral to membrane; Biological process=iron ion transport
  Homolog annotation: Hit_ID=Q9SAH8; Match level="QueryCoverage=92%, HitCoverage=14%, E-value=3e-28, Identity=72%"; Hit description=Metal transporter Nramp1
MTVTGSSSGQPQFIASTGGNRNFSNAPLIENSDTDQIVVPDTTGWKNLFAYVGPGFLVSIAYIDPGNFETDLQSGAQYKYETRGVLN

SEQ ID NO: 186221 - protein, 89 aa, Glycine max
  Coding DNA Sequence Number=SeqID_69443
MASYGGDSNNNYLRRLQEKPIPYIISILAQIAVKLLTCIYVAFAALGKCFVVRSVDNQPRSHEKTKSAQSNSEEQLMTPAIKEPLWQRI

SEQ ID NO: 186222 - protein, 91 aa, Glycine max
  Coding DNA Sequence Number=SeqID_69444
MESSNVKNKSGGKRKMSSEDTRSYFAWNLEMERVLADVLRDQRNLGNKGDGNWKAVAYSTAAQILSKRFGVHLMADNVKNRFKLWRTWYGI

SEQ ID NO: 186223 - protein, 162 aa, Glycine max
  Coding DNA Sequence Number=SeqID_69445
MDEFDAQEPEPEQPTVEATKGEDELTPPEPFYFDASVHMAQEEETSTDQIPEPSPAPIPDDAIPSSPTCELEKPTSQDLPVAQPLEENEHVIGIMTENVSQFVRLIVKECIDRILAMFDCDSHLAKKLTMCLNDLSLATREHHHRKRGSKQICPKFGGVIIK

SEQ ID NO: 186224 - protein, 582 aa, Glycine max
  Coding DNA Sequence Number=SeqID_69446
  Gene Ontology: Mol. function=structural constituent of ribosome; Cellular component=intracellular; Biological process=cell wall modification
  Homolog annotation: Hit_ID=Q1SG66; Match level="QueryCoverage=99%, HitCoverage=92%, E-value=0.0, Identity=70%"; Hit description =Pectinesterase; Pectinesterase inhibitor; TonB box, N-terminal
  Pfam annotation: Domain name=PMEI; Domain location=53-206; Score =125.5; E_value=1.5e-34; Accession=PF04043.6; Description=Plant invertasepectin methylesterase inhibitor
  Pfam annotation: Domain name=Pectinesterase; Domain location=255-555; Score=636.1; E_value=3e-188; Accession=PF01095.10; Description =Pectinesterase
  Pfam module annotation: Pfam domain module=PMEI::Pectinesterase; Domain location=53-206::255-555
MSEGNAGKGKRIAIIGVSTLLLVAMVVAVTIGVNLNENGSNNDIEDNKKNHVASSIKAVQTLCHPTNYEKECEESLIAGAGNTTDPKELVKIFFNITITKIGDKLKETNILHEIEEEPRAKMALDTCKQLMDLSIGELTRSLDGINEFNLINVDKILMNLKVWLSGAITYQDTCLDGFENTTSDAGKKMKDLLTIGMHMSSNALAIVTDLADTVNDWNITKSFGRRLLQDSELPSWVDQHRLLNENASPFKRKPNVTVAIDGSGDFKSINEALKQVPEKNRKPFVIYIKEGVYQEYVEVTKKMTHVVFIGEGGKKTRISGNKNFIDGTNTYRTATVAIQGDHFVAINMGFENSAGPHKHQAVALRVQADKSIFYNCSMDGYQDTLYAHTMRQFYRDCTISGTIDFVFGNALAVFQNCTFVVRKPLENQQCIVTAQGRKEIQQPSGIVIQGGSIVSDPEFYSVRFENKAYLARPWKNYSRTIIMDTYIDDLIDADGYLPWQGLEGPSGMDTCFYAEYHNIGPGSDKSKRVKWAGIWNLNSKAARWFSPSKFFHGTDWIEVTGIPCFPGVPKHHRHKKTILNWQ

SEQ ID NO: 186225 - protein, 629 aa, Glycine max
  Coding DNA Sequence Number=SeqID_69447
  Homolog annotation: Hit_ID=Q6KAC4; Match level="QueryCoverage=96%, HitCoverage=97%, E-value=1e-137, Identity=43%"; Hit description =Putative X1
  Pfam annotation: Domain name=XH; Domain location=494-628; Score =243.3; E_value=5e-70; Accession=PF03469.5; Description=XH domain
  Pfam annotation: Domain name=XS; Domain location=114-222; Score =128.6; E_value=1.8e-35; Accession=PF03468.5; Description=XS domain
  Pfam annotation: Domain name=zf-XS; Domain location=43-85; Score =96.9; E_value=6.1e-26; Accession=PF03470.5; Description=XS zinc finger domain
  Pfam module annotation: Pfam domain module=XH::XS::zf-XS; Domain location=494-628::114-222::43-85
MDYSSEEDSDISESEIEEYAEKPYEQLRAGKYKVKNLNGTLRCPYCAGKKKQEFKYKDLLQHASGVGKGSANRSAQQKANHLALAKYLETDLACEAEPIQRPALPQAVNQPLHQEDLYVWPWTGIIVNIKGKSIDSGYWLKEFAKFRPIDFRIFLKDDDLIAGAVVDFNNDWNGFMNASDFEKSFEAARHGKKDWNSRKLEAGSNIYGWVAREDDYNCGGPIGEYLRNKGRLRTVTDIVQEASESRNSIVTNLTNEIEITNENLDKMQYKFNEKTMSLSRMLEEKDKLHNAFEEESRNMQRRARNEVRRILDEQEKLSSELEEKKRKLDSWSRDLNKREALTDQEKKKLEEDNKKKDLRNESLQLASKEQKIADENVLRLVEEQKREKEEAYNKILQLEKQLDAKQKLEMEIEELKGKLQVMKHLGDEDDAAVQNKIKEMNDELQEKVDNLENMEAMNQTLIVKERQSNDELQEARKELIKGLDDMLNAPRTKIGLKRMGELDQKVFVNNCKKRFPLEEAGTKGVELCSLWQENVKNSAWHPFKVVTVDDKAENIINEEDEKLRSLKHEWGDEIYSAVVTALKEINEYNASGGYTVVELWNFKDNRKATLKEVINYIMEHIKPLKRKRA

SEQ ID NO: 186226 - protein, 97 aa, Glycine max
  Coding DNA Sequence Number=SeqID_69448
  Gene Ontology: Mol. function=sequence-specific DNA binding; Cellular component=nucleus; Biological process=regulation of transcription, DNA-dependent
  Homolog annotation: Hit_ID=Q1EMR8; Match level="QueryCoverage=66%, HitCoverage=29%, E-value=3e-27, Identity=96%"; Hit description=MADS -box transcription factor
  Pfam annotation: Domain name=SRF-TF; Domain location=9-59; Score =114.3; E_value=3.5e-31; Accession=PF00319.9; Description=SRF-type transcription factor (DNA-binding and dimerisation domain)
MVRGKTQMRRIENATSRQVTFSKRRNGLLKKAFELSVLCDAEVALIIFSPRGKLYEFASSSLNSTQDLHHNLKSVMKYSGVWITPEEPNLKSFLLGL

SEQ ID NO: 186227 - protein, 238 aa, Glycine max
  Coding DNA Sequence Number=SeqID_69449
  Gene Ontology: Mol. function=fructokinase activity; Biological process=D-ribose metabolic process
  Homolog annotation: Hit_ID=O04897; Match level="QueryCoverage=98%, HitCoverage=51%, E-value=1e-38, Identity=45%"; Hit description =Fructokinase
EPCRSAHLAAMNAAKVSGCILSYAANLALPLWPSKEAARQGIMSIWNYADIIKVSVDEIRLLTEGDDPYDDVVIMKKLHHYNLKLLLVTEGARGCRDYTKVLIHNKILHDLYSAYVHKHNAIINATDRNLVLRGRILQVLGCLSIGSRAGFLCRGRCIPSIGVFKCLVLLQIVEVIDTTGAADSFVGGLYIHLSKRDEKRLREALDFANACAAFTVTGRGAIPSLPTKDAVLRILFSY

SEQ ID NO: 186228 - protein, 605 aa, Glycine max
  Coding DNA Sequence Number=SeqID_69450
  Gene Ontology: Mol. function=structural constituent of ribosome; Cellular component=intracellular; Biological process=cell wall modification
  Homolog annotation: Hit_ID=Q1SG66; Match level="QueryCoverage=95%, HitCoverage=92%, E-value=0.0, Identity=69%"; Hit description =Pectinesterase; Pectinesterase inhibitor; TonB box, N-terminal
  Pfam annotation: Domain name=PMEI; Domain location=76-229; Score =125.6; E_value=1.4e-34; Accession=PF04043.6; Description=Plant invertasepectin methylesterase inhibitor
  Pfam annotation: Domain name=Pectinesterase; Domain location=278-578; Score=629.7; E_value=2.4e-186; Accession=PF01095.10; Description =Pectinesterase
  Pfam module annotation: Pfam domain module=PMEI::Pectinesterase; Domain location=76-229::278-578
MAILLVTLTNFTVILINDREVVEMSEGNAGKGKKIAIIGVSTLLLVAMVVAVTIGVNLNENGSNNDIEDNKKDHVASSIKAVQTLCHPTNYEKECEESLIAGAGNTTDPKELIKIFFNITITKIGDKLKETNILHEIEEEPRAKMALDTCKQLMDLSIGELTRSLDGINEFNLINVDKILMNLKVWLSGAVTYQDTCLDGFENTTSDAGKKMKDLLTIGMHMSSNALAIVTGLADTVNDWNITKSFGRRLLQDSELPSWVDQHRLLNENASPFKRKPNVTVAIDDSGDFKSINEALKQVPEKNRKPFVIYIKEGVYQEYVEVTKKMTHVVFIGEGGKKTRISGNKNFIDGTNTYRTATVAIQGDHFVAINMGFENSAGPHKHQAVALRVQADKSIFYNCSMDGYQDTLYAHTMRQFYRDCTISGTIDFVFGNALAVFQNCTFVVRKPMENQQCIVTAQGRKEIQQPSGIVIQGGSIVSDPEFYSVRFENKAYLARPWKNYSRTIIMDTYIDDLIDADGYLPWQGLEGPSGMDTCFYAEYHNIGPGSDKSKRVKWAGIWNLNSKAARWFSPSKFFHGTDWIEVTGIPYFPGVPKHHRHKKTILNWQ

SEQ ID NO: 186229 - protein, 51 aa, Glycine max
  Coding DNA Sequence Number=SeqID_69451
MVCDSLVKHIDYGVSLIINDGGEWRQQANCGTNEGLLKRKKKTQQDEEEEM

SEQ ID NO: 186230 - protein, 74 aa, Glycine max
  Coding DNA Sequence Number=SeqID_69452
MTPEQVTYNIIIIHPMLVNILISIKQHHQLLHFGVTPSYGRTVSIVETMSSKIILMMPKNQESNKFQESRSRFK

SEQ ID NO: 186231 - protein, 283 aa, Glycine max
  Coding DNA Sequence Number=SeqID_69453
MAPRKLSSKRSRKDAAAAGTSAAPEFDSHRFRSTEHQQRFEAIKGCWTSLVTPMAKFDLDIVLEFYANAWPTEEGVRDLRSWECEYGQRRNRADGFDEEVIAQLLCIPDMDDVAAQQHPAQRSQLRPPSAEVSAGVCHPDMDERPCMPPTRHPLDPDKSNRALGFPALITGLYQSFGVPVTPSKAPNAPPPPHQADPAGSFDTERYLRHLVRQQAANHKGHVQTHECLYQLSLSLQSQGFAPFTCPTREQFRAEVAWLGDWPEAQAGEAPAEAPDDGEEAPHG

SEQ ID NO: 186232 - protein, 124 aa, Glycine max
  Coding DNA Sequence Number=SeqID_69454
  Subcellular localization annotation: CTP_CleavageSite=38; ConfidenceScore=5.58e-01
MATPPYSPPPLESSSPLSSISKKTRKATRFRSLATKPVGGERSVVHVNPTTGKVDGPHKKKLRTYLGIVARDKVVAEFDIPGASDLRTNKKILQIIGEWMFERRIPWKSRPHREALTPMDVKIY

SEQ ID NO: 186233 - protein, 97 aa, Glycine max
  Coding DNA Sequence Number=SeqID_69455
MTNATARKEEEHTEIETHQESICQVTLIHHQLTNEEETPEVSSTPEYPYLATVGYVGGKDKGRLELSIEDQKISFDLFEAMKHPDIGDAYFEEEEVE

SEQ ID NO: 186234 - protein, 112 aa, Glycine max
  Coding DNA Sequence Number=SeqID_69456
  Subcellular localization annotation: CTP_CleavageSite=46; ConfidenceScore=5.76e-01
MSPSTGPSPYPPHPSINYPSPISPSPGPSPSPSRPINCWRATWPTSFSPKGPYWASRWWDPLPRRCEPHPTRPFLALVMNDDDLTQNPLGERGREGHVERSYSLSLVLSRGV

SEQ ID NO: 186235 - protein, 579 aa, Glycine max
  Coding DNA Sequence Number=SeqID_69457
  Gene Ontology: Mol. function=binding; Cellular component=membrane; Biological process=photosynthesis
  Homolog annotation: Hit_ID=Q337L2; Match level="QueryCoverage=96%, HitCoverage=76%, E-value=1e-159, Identity=54%"; Hit description=TPR Domain containing protein, expressed
  Pfam annotation: Domain name=TPR_2; Domain location=135-168; Score =6.4; E_value=6; Accession=PF07719.7; Description=Tetratricopeptide repeat
  Pfam annotation: Domain name=TPR_2; Domain location=320-353; Score =9.7; E_value=2.5; Accession=PF07719.7; Description=Tetratricopeptide repeat
  Pfam annotation: Domain name=TPR_2; Domain location=439-472; Score =7.8; E_value=4.1; Accession=PF07719.7; Description=Tetratricopeptide repeat
  Pfam annotation: Domain name=TPR_2; Domain location=474-507; Score =10.3; E_value=2.1; Accession=PF07719.7; Description=Tetratricopeptide repeat
  Pfam annotation: Domain name=TPR_2; Domain location=510-543; Score =7.2; E_value=4.8; Accession=PF07719.7; Description=Tetratricopeptide repeat
  Pfam module annotation: Pfam domain module=TPR_2::TPR_2::TPR_2::TPR _2::TPR_2; Domain location=135-168::320-353::439-472::474-507::510-543
MKCLRSVESLGGADEVFPSSSGSLASAIKDFSASENSCLAEQLDKKPDTGNIEEAESSLRESGVLNYEEARALLGRYEYQKGNIVAALHVFEGIDIGVVTPKIKIALSRSRERRKRHSQNHAEPQMSIHSVGLLLEAVFLKAKSLQVLERFKEAAQSCKVILDIVESSLPEGMPDNFGAECKLQETLNKAVELLPELWKLADCPREAILSYRRALLHHWNLDAETIAKIQKEFAVFLLYSGGEATPPNLRSQMDGSFVPRNNIEEAILLLMILLRKVSLNRIEWDPSILDHLSFALSVSGDLTALANQLEELLPGTIHRSERYYALALCYYGTSKDLVALDLLRKLLRSREDQHHVPGLLMASKICCENSTLAEEGVSFAWQVLQNLDGRCNQLENHANFFLGVSLSAHSKLAVSDSDRFKRQSEALQALETAGRTGNPFVLYHLSLEYAEQRKLDAALYYAKCFLKLEGGSNVKGWLLLARILSALKQFLDAESIINTALDQTGKWDQGDLLRTKAKLQIAQGQLRNAIETYTQLLAVLQIQSKGFGSGKKLYKAFREKVESRMHRVPQNFACVDEAF

SEQ ID NO: 186236 - protein, 407 aa, Glycine max
  Coding DNA Sequence Number=SeqID_69458
  Homolog annotation: Hit_ID=Q10S15; Match level="QueryCoverage=88%, HitCoverage=96%, E-value=3e-30, Identity=29%"; Hit description =Expressed protein
  Subcellular localization annotation: CTP_CleavageSite=25; ConfidenceScore=5.29e-01
MGCFFGCFGSSKHRNHKHKVQQPNRANGSSNSKQEQHSVSLVQDCSTNAINPIPQLQDKSEEQLSVSSRKKVTFDSNVKTYEPLLADEVVERKNEEGGKEEALAQSKSSSSEASSVTSTGSYPPNHRYQNCRNSDDEEEEIDYGDSDLSDGDDDEECNEVSEDFGEDDIVASTAADDHVFVEEVDVKSIGSNPNVRDRSAYVHPVLNPVENLTQWKVLKAKRTPIRPQKENDFGVGVKGSPFSLNSKSDLPKKLNREIRVDASLSNWLVSPETTPVCKAGSVASFAGSTPDRITSQGSYSVISHEDRPILGALTLEEIKQFSATSSSRKSPSRSPDEMPIIGTVGTYWNVAGSAEDPGSVSSFKGIPNSTSKYREDKSVNWRSTPFETRLEKALNRGAASAYVPRVF

SEQ ID NO: 186237 - protein, 315 aa, Glycine max
  Coding DNA Sequence Number=SeqID_69459
  Gene Ontology: Mol. function=Rho GDP-dissociation inhibitor activity; Cellular component=cytoplasm; Biological process=actin cytoskeleton organization and biogenesis
  Homolog annotation: Hit_ID=Q705X4; Match level="QueryCoverage=75%, HitCoverage=99%, E-value=4e-81, Identity=64%"; Hit description=Rho GDP dissociation inhibitor 1
  Pfam annotation: Domain name=Rho_GDI; Domain location=31-242; Score =36.0; E_value=2.3e-11; Accession=PF02115.7; Description=RHO protein GDP dissociation inhibitor
MEGANWKITEEEAGPSSSSGIASNKQQNPPETFHHQHHRKEAAAEEEETEEEEEDDVDHHNNSTFVPGPLLSLKDQIEKDKEDESLRRWKEKLLGCMESDLDGQIHPEVKFHSIGIISEDFGEVITPLSVDESQNGHILFTLKEGSHYQLKLKFSVLHNIVSGLAYCNNVWKGGLQVDQSKGMLGTFAPQKEPYVHTLKEDITPSGVLARGVYSAKIKFEDDDGRCHMELKYSLEIKKRVSPGAAVKLCLGDLLVMGSNPETASLSMQGTDIDTDMDIGHNTCGHLSNTSNSTQTRMPVSRRTPDTARDWGVRAS

SEQ ID NO: 186238 - protein, 892 aa, Glycine max
  Coding DNA Sequence Number=SeqID_69460
  Gene Ontology: Mol. function=transferase activity, transferring glycosyl groups; Cellular component=membrane; Biological process =cellulose biosynthetic process
  Homolog annotation: Hit_ID=Q5DI94; Match level="QueryCoverage=91%, HitCoverage=79%, E-value=0.0, Identity=69%"; Hit description =Cellulose synthase catalytic subunit
  Pfam annotation: Domain name=Cellulose_synt; Domain location=88-887; Score=1862.0; E_value=0; Accession=PF03552.5; Description=Cellulose synthase
MAMSAALNTGSHSRNGFRYSDEENGDFNQQQWQHNDDQALSAAGSVANEDFEGPKAYYSNPRKRKDERSLTSNDQGEDDYLLAESRQPLWRKVPISSSLINPYRIVIIMRLIILVFFFHLRITTPVHDALALWIISVVCEIWLALSWLVDQIPKWFPITRETYLERLSIRFEREGEPNLLSPVDIFVTTADPLKEPPIITANTVLSVLSVDYPVVKVSCYVSDDSASMLLFDTLLETAEFARIWVPFCNKYNIEPRAPEFYFSQKLDYLKDKVHPTFVKDRRAMKREYEEFKVKINVLVAKAQKKPEEGWVMQDGNPWPGNNIDDHPGMIQVCLGSAGALDIEGKELPRLVYVSREKRPGYQHHSKAGASNALVRVSAVLSNAPFALNLDCDQYINNSKVLREAMCFLMDPQIGKKFCYVQFPRRFDGIDCNDRYANHNTVFFDINMKCLDGIQGPMYVGTGCVFNRQALYGREPPSDKRPKMKSCSWPSCCSCCSGDSQSSSDDDETDQELEDFDEDEEEELPFMSLKSLEKRFGQSPVFISSALIEDGGLPKGTDAQLLIKEAIHVISCDYEEKTEWGREQIGWLYGSVTEDLLTGFNMHCRGWKSVYCMPKKAAFKGSAPINLSDRLHQVLKWASGSTEIFFSGYCPLWYGYGGKLKWLQRLAYTNSVVYPFTSIPLLIYCAIPAVCLLTGKFIIPTLSNLASIWLMALFISIILTCVLELRWSGVSIQDWWRNEQFWVIGGVSAHFFAVFQGLLKVGGVHTNFNVRAKSANDTAFGQLYLFKWTTLLIPPTSLVILNMVGIVAGISDAINNGYDSWGPFFGKLFFSLWVIVHLYPFLKGLMGRQNRTPTIVVLWSILLAIIFSMIWVRIDIFLPKQTGPALKQCGIRC

SEQ ID NO: 186239 - protein, 68 aa, Glycine max
  Coding DNA Sequence Number=SeqID_69461
  Homolog annotation: Hit_ID=Q00M75; Match level="QueryCoverage=44%, HitCoverage=5%, E-value=2e-08, Identity=93%"; Hit description=PPR -repeat containing protein
MGEGYCTQSYPCIDKEAVSGFEPMTNKSPRHNFTAAPGLTLVDASTFQLYVISGVQITNAEFCISLEL

SEQ ID NO: 186240 - protein, 966 aa, Glycine max
  Coding DNA Sequence Number=SeqID_69462
  Homolog annotation: Hit_ID=Q75HJ9; Match level="QueryCoverage=72%, HitCoverage=92%, E-value=3e-60, Identity=26%"; Hit description =Expressed protein
MESSSTPPPKFRFRDHSEPESQNSLEPSSDVVSAASPSIGDPDADLEIESMTGRGIMHLCDELRELKEAANEDLQKNIFSKYSTFLRILEEVIGVENELVQLENHFVSHKRQVKDLIDRIYPKILSIDIAFDDHVNIVPSHPTELKAHINECLENLDILLSENKMDEALNHLESADEHYQSLQFQDCSHREIMLYESAISEKKSMLIQQLSQIAENKRTPGPELQRALARLCRLGDTQLAINLLLKHYHLRVANGTDNLQWAKSSSIEIYIRELARFVFSMVSQAARSFVMLCGETSPYASELMLFAYEETKSFIICFDKYVKGTSAISGGLSSAIKAVKFAVMYCSLLENQKLVLRPYLVKHLFPCMEEVLNTHINHFKKVIVIFSASDPWILEKYLVSGVFVGAGSSTLAVGEQHDYCLLTTSGRKVVTLLQAIVEDISSLVSLHMGSLVISGITILFTEYIVILEKALTYEASSTEQGSPRIKLAESLPQQVSILANLSTLVQFLSIMVKDIFSSSDHIEFQVLENYSIVHQQQGLDDFLLFIEEGSNKLRNVFCQQLILRVLSTYHRHEIFSASHCNDQFDANTVHDPMPSGIFQVLFLELKKIEQLEEENVFEVNWLMGLLRELMESMFIWVSNNKEILATTEKNVSSQTDEAKQFILDVQFLVEIGMYGGYFSSDPLLLLTLMKSTFNSAGLDPFKDVDDDYWAIDAATKTIQKLLEIEKTSLHPKEPVVTIKEESHEHENQINQSAYECNFSKENDISSSENNVVKHELDEVAKHELEVAIDAKMASLDTVFSPGEGSLVKRDYVDTDSSNLRPPSIMTLQLEDADFVEATDTKNDELTPTSSVGEALQALVREGMRCKLNNDNSINIWKDPWLRNSDKCYVTSPPPIGLEHMTVNSLIDGERKCRRLDNGQQILNNEDLQDIQISAYCETKTGRFLKLSYGGCSFNSMILSEVDCKSF

SEQ ID NO: 186241 - protein, 243 aa, Glycine max
  Coding DNA Sequence Number=SeqID_69463
MDSNTTNNRDNGGTILRINSIKTRGNHPQGHNNKGPSLYDHTTKLEDTLAQFMPVSKSNQKSTESAIKNLEEECKVVMTRSRMATHVDEGKAEKKMEEHKQQLAAKPTLEPVDDFVELEEVNKEAEEEDVDIPLILGHPFMSTASYIVDMGKKMLYLAPFVAQYVKFRNMPKIKRKHCYTVREIPMFLQKAVASRGTNLARLGELGGKLPPYFPINRGRSEGERGSALLKDFQPFFVVLRSST

SEQ ID NO: 186242 - protein, 105 aa, Glycine max
  Coding DNA Sequence Number=SeqID_69464
MLLETETREIEARVVFNEREKYDLNSPINPNLNEKVPMWLFVRFVIGPSEDKLCIEWLNSVFQWKMILTGQPVKSHPQLSIVDLLLCLRQCATVSSDDEMIVVVR

SEQ ID NO: 186243 - protein, 70 aa, Glycine max
  Coding DNA Sequence Number=SeqID_69465
MALGFKEVTLDTPLPDINYSNLDQFLGQIRRQYFSFLRKQRFLDTKADSWRERERGKERSGKDPRPRDLD

SEQ ID NO: 186244 - protein, 152 aa, Glycine max
  Coding DNA Sequence Number=SeqID_69466
MASRKKKSPASVSQSRYDRSKFTSQDAWDRYADNILGQKILLKRNVKLFYAKFHEFRREVGRRNWHKELTNFLEGSIEVAIVKEFYANLYDPEDKSPKACNSSMSLWEGISVECRQPASEDLEEESDYSGPDLECSILFKLSPDIPHFWHYS

SEQ ID NO: 186245 - protein, 492 aa, Glycine max
  Coding DNA Sequence Number=SeqID_69467
  Gene Ontology: Mol. function=DNA binding; Biological process =regulation of transcription
  Homolog annotation: Hit_ID=Q94CL7; Match level="QueryCoverage=85%, HitCoverage=88%, E-value=1e-70, Identity=44%"; Hit description =Phosphate starvation response regulator 1
  Pfam annotation: Domain name=Myb_DNA-binding; Domain location=261 -312; Score=42.8; E_value=1.2e-09; Accession=PF00249.21; Description =Myb-like DNA-binding domain
MEAHPTFSIERSKQLNNMGMSGALSSSLSILPIPPEEMFPKLPQSQLDFVEQELMTRPFTHSSYLNSGGVVGHIFSSSPGYSTDLHHSSLSPDEKHSTNAHLISQSSTNITQFPLSYSSNTGPPTSATPSHYSKESSVSWHTDSLPSFLDFPENGSIDNNRVESSACPIMASEEYSKQNDWQEWAERLISDDDTLTTNWNDLLADNIQDLEPKVPFQVSKPLSQIPGHQSQGHQQLPASYGENCIGAALSSSANFAPAKSRMRWTPELHEAFVEAVNQLGGSEKATPKGVLKLMKVEGLTIYHVKSHLQHAFLLKQIWLEMKKYRTARYRPESSEGVMEKKTSSVEEMASLDLRTGIEITEALRLQMEVQKRLHEQLEIQRNLQLRIEEQGRYLQMMFEKQCKPGNETFKAPSSIIETPSGGSSNATKDSLAKNEMEASQVNHGRSGPDQVKGSTTFEEGSLEKCGKPDSPKTEHAIASEDSAQAPKRQRTE

SEQ ID NO: 186246 - protein, 333 aa, Glycine max
  Coding DNA Sequence Number=SeqID_69468
  Homolog annotation: Hit_ID=Q1S717; Match level="QueryCoverage=43%, HitCoverage=16%, E-value=1e-27, Identity=38%"; Hit description =Ovarian tumour, otubain
MVNQLTKNMVKSGQMLLTIKDQNQTNLNTIKIIYNEHQRYCLQEKGLRMEIQHLIKLIERDQYVYWFRWLDNEDVVRDIMWPHPNSIKLLNSFSIVLIYDTTYKTNKYRLSLLEIVGITSTSMTFVVAFAYLSYERTDNFEWALSIDSSTYGCTLRITHRLPCAYELIEFISAYGYILLKNIHVHWKILSIRSSYDTSDSWGNLTLTREIDALFKRFSQLDVPGKIILKTKIKTKDAPKSMKSTKHKPSMWEQVDEINMMVSNSGTPSVTRKGERDNKKKKMDNYVDEFSDELQKYILNIVDIQADRNCCYMVIISVLGWVKSLGLSSCKNTF

SEQ ID NO: 186247 - protein, 140 aa, Glycine max
  Coding DNA Sequence Number=SeqID_69469
  Homolog annotation: Hit_ID=Q9SIN1; Match level="QueryCoverage=44%, HitCoverage=9%, E-value=3e-11, Identity=52%"; Hit description =Expressed protein
MGVKFLEAVKRRLHAINNGPRTKLGLMVDEGRNLGGGFMRLTSINEFFSRKSFLSGLIRYLTVVGHLGGTQNKKIENSRQNLCLFGVQEDQSEEQKLVLLEKNLNRCTNARKHGDWKRVVRESEAAIAVGAYFSPQVVLN

SEQ ID NO: 186248 - protein, 56 aa, Glycine max
  Coding DNA Sequence Number=SeqID_69470
MAFQVTTFHLAFVDDTREFLITGRYLLPNDHLNELQWCIFSFLTWHMLCLSVMIHF

SEQ ID NO: 186249 - protein, 67 aa, Glycine max
  Coding DNA Sequence Number=SeqID_69471
MEVYDETKILVCILKLLKQESVDGSLDKGMHFKARRESPVAYTKKYKNSQKLHVRLLVSSHAAKGRK

SEQ ID NO: 186250 - protein, 823 aa, Glycine max
  Coding DNA Sequence Number=SeqID_69472
  Gene Ontology: Mol. function=histone-lysine N-methyltransferase activity; Cellular component=nucleus; Biological process=chromatin modification
  Homolog annotation: Hit_ID=Q1S200; Match level="QueryCoverage=98%, HitCoverage=98%, E-value=0.0, Identity=50%"; Hit description=SET -related region; Pre-SET; Histone H3-K9 methyltransferase
  Pfam annotation: Domain name=Pre-SET; Domain location=496-642; Score =13.8; E_value=2.6e-05; Accession=PF05033.6; Description=Pre-SET motif
  Pfam annotation: Domain name=SET; Domain location=644-789; Score =131.6; E_value=2.2e-36; Accession=PF00856.18; Description=SET domain
  Pfam module annotation: Pfam domain module=Pre-SET::SET; Domain location=496-642::644-789
MAPTPSQKERALAACRAMSSLGIDDSKVKSVLKKLLKVYDKNWELIEAENYRVLADAIFEDDDNMVPELKKKSQTADVHNTGHSMSSSFQNNQEAETGCEEAQMHVETPQPLKRLRLQGQESQPLHPPPNGSPSPSSKKLKLDDNASGKKPQNKPVSSDGNPGIATRPLPPRDGIVDKGKQPASLPLNHRGRRLPSERVPQSIPSREPTVEPGRFLLPNNQMPRTQTLVIPKDEPIDELTDYEMPIAVIPPESSVRNSSIKNGVAGKHSGHVTVTSSQNRDGVGDEDVIPTSKKEATCNVEIASSTLGEVKLSLSYGSALQGSDFHIPSRDQLIKVMEDKCLRSYKITDPNFSVKNLLRDICDCMLEFRNDSNDDSQEGSVISSSVDVSKEPRAPGTLSVVGNKDLDTSSHFSNGSINVKSSDDLVSPGSILPLAHPNGLSDAVPVSKMDRTNDFLQSNVKKDLEDPMSPNSHSLVVVPQHQLTADDIRSFHDANDLTKGEENVEIPWVNETTNDFAPSFNYIPQNLVFQEAYVNISLSRVGSEDCCSTCMGNCVLSSSCACANKTGGEFAYNAQGLLKEEFLEECIAISRNPQQHLFYCKNCPLERSKSDGCLEPCKGHLKRKFIKECWSKCGCGKQCGNRVIQRGITCHLQVFFTSEGKGWGLRTLEDLPKGAFVCEFVGEILSMKELHERNLKCTENGKYTCPVLLDANWDSGYVKDEEALCLDAASFGNTARFINHRCSDANLIEIPVEVEDPGHYYYHFAFFTSRKISAQEELTWDYGIDFDDHDHPVKLFQCRCGSKFCRNMKRYSTPQAHNDSHEI

SEQ ID NO: 186251 - protein, 328 aa, Glycine max
  Coding DNA Sequence Number=SeqID_69473
  Gene Ontology: Mol. function=transferase activity; Cellular component= cytoplasm; Biological process=protein modification process
  Homolog annotation: Hit_ID=Q6K8N9; Match level="QueryCoverage=90%, HitCoverage=82%, E-value=2e-74, Identity=47%"; Hit description =Glutathione S-transferase C-terminal domain-containing protein-like
  Pfam annotation: Domain name=GST_C; Domain location=127-270; Score =29.0; E_value=1.6e-05; Accession=PF00043.15; Description=Glutathione S-transferase, C-terminal domain
  Subcellular localization annotation: CTP_CleavageSite=53; ConfidenceScore=5.20e-01
MSLNDGNDSKLNPSSLLNSFTKLLWGQSLPPPGAPRRHRPHRLEFHVAPTPPAATPLRGPGVPVGPPHPHNAHAEGVRRRRARLGCFAGPRRVVEVQTGRWARHGTLKQIYRLRRGGYDGRSTVPMLWDKASKDVVCNESYDIIHLFNSELNSVAQNPGLDLSPPQLKKRIGEWNQIIYPNSKRQQRGLYSQEGYDKELNDLFSTLDKLEVHLANSGYLCGDTLTLVDICLFTTLVRFDLAYNVLLNCTKKKLCEYTNLHAYLRDIYQIPKVAATCNFTDIMDGYYKILFPLNPGSIRPVMPSTCEHESLCRPHARESLSSATLAFVK

SEQ ID NO: 186252 - protein, 266 aa, Glycine max
  Coding DNA Sequence Number=SeqID_69474
  Gene Ontology: Mol. function=receptor activity; Cellular component =anchored to membrane; Biological process=protein amino acid phosphorylation
  Homolog annotation: Hit_ID=O22784; Match level="QueryCoverage=80%, HitCoverage=70%, E-value=5e-65, Identity=56%"; Hit description =Expressed protein
  Pfam annotation: Domain name=DUF26; Domain location=164-215; Score =50.8; E_value=4.7e-12; Accession=PF01657.8; Description=Domain of unknown function DUF26
  Pfam annotation: Domain name=DUF26; Domain location=58-112; Score =51.2; E_value=3.5e-12; Accession=PF01657.8; Description=Domain of unknown function DUF26
  Pfam module annotation: Pfam domain module=DUF26::DUF26; Domain location=164-215::58-112
MTDADNIYLVYKGCADQKLHDPSGIYSQNLKTLLDSLVSQSEKKAFFTTTYGEGQNVIMGLYQCRGDLSNTDCYNCVSKIPDMLENLCGKVVAARVQLIGCYLRYEIVGFKQVPETQLLYKVCGAKEESYNDGFEERRDSVFGMVESGVKNSGNLFYSGSYQSFYVLGQCEGDLAKDDCGDCVKSAEDQAKAECGDSISSQVYLHKCFVSYSFYSKGGTNISSSPGRSLDTQRTVALAVGAFAALGFLIVCLLFLKSVLKKKSDKY

SEQ ID NO: 186253 - protein, 68 aa, Glycine max
  Coding DNA Sequence Number=SeqID_69475
MEGSKKYLSGRRKKEAAGRVFAEVWRNTPLTCVLAPSATPAPHPVSMLTKFMSLVSFRLNCVPVFSAI

SEQ ID NO: 186254 - protein, 182 aa, Glycine max
  Coding DNA Sequence Number=SeqID_69476
  Homolog annotation: Hit_ID=Q9FNC9; Match level="QueryCoverage=32%, HitCoverage=61%, E-value=5e-18, Identity=75%"; Hit description =Mitochondrial import receptor subunit TOM22 homolog 2
MSLADNRLGLQGLFKFDPSGIYSQNLQTVLVSLWLQSEQMPFFTTTLGDGQNVINSNNAKGTSQTPLAATVSKILDMLENLCGKVVAAIATARVQLIGCYLRYEILEFKQEAGLLELEVVELLLAVHLDDERNNEDEEGGAGDPRGLAGAAEELLGDECGVAGGFLAAGDDGGARDLREDGA

SEQ ID NO: 186255 - protein, 63 aa, Glycine max
  Coding DNA Sequence Number=SeqID_69477
MAAQCTRLLSLWGLVSEVHSLASVNEETASIINPEYFTFKLAPSRTAPSRFALNCHADEGDIN

SEQ ID NO: 186256 - protein, 75 aa, Glycine max
  Coding DNA Sequence Number=SeqID_69478
  Gene Ontology: Mol. function=protein dimerization activity; Cellular component=nucleus; Biological process=regulation of transcription, DNA-dependent
  Homolog annotation: Hit_ID=Q38829; Match level="QueryCoverage=54%, HitCoverage=29%, E-value=9e-09, Identity=76%"; Hit description=Auxin- responsive protein IAA11
MPRIYKVEKRGSIKELWALKSTFLPIGIPSIFTLTNRELLSYSLYMFEVEAIQLLDCLERDSNTIDYLFGWQTTC

SEQ ID NO: 186257 - protein, 755 aa, Glycine max
  Coding DNA Sequence Number=SeqID_69479
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=98%, HitCoverage=86%, E-value=0.0, Identity=52%"; Hit description=Protein kinase; Actin-binding, actinin-type
  Pfam annotation: Domain name=LRR_1; Domain location=118-140; Score =12.8; E_value=1.2; Accession=PF00560.23; Description=Leucine Rich Repeat
  Pfam annotation: Domain name=LRR_1; Domain location=142-164; Score =14.1; E_value=0.49; Accession=PF00560.23; Description=Leucine Rich Repeat
  Pfam annotation: Domain name=LRR_1; Domain location=166-185; Score =9.6; E_value=4.5; Accession=PF00560.23; Description=Leucine Rich Repeat
  Pfam annotation: Domain name=LRR_1; Domain location=190-212; Score =10.7; E_value=2.9; Accession=PF00560.23; Description=Leucine Rich Repeat
  Pfam annotation: Domain name=LRR_1; Domain location=214-236; Score =10.5; E_value=3.1; Accession=PF00560.23; Description=Leucine Rich Repeat
  Pfam annotation: Domain name=LRR_1; Domain location=22-44; Score =10.0; E_value=3.8; Accession=PF00560.23; Description=Leucine Rich Repeat
  Pfam annotation: Domain name=LRR_1; Domain location=238-260; Score =14.2; E_value=0.48; Accession=PF00560.23; Description=Leucine Rich Repeat
  Pfam annotation: Domain name=LRR_1; Domain location=262-284; Score =3.7; E_value=58; Accession=PF00560.23; Description=Leucine Rich Repeat
  Pfam annotation: Domain name=LRR_1; Domain location=286-308; Score =15.2; E_value=0.24; Accession=PF00560.23; Description=Leucine Rich Repeat
  Pfam annotation: Domain name=LRR_1; Domain location=310-332; Score =11.8; E_value=1.8; Accession=PF00560.23; Description=Leucine Rich Repeat
  Pfam annotation: Domain name=LRR_1; Domain location=334-356; Score =16.0; E_value=0.13; Accession=PF00560.23; Description=Leucine Rich Repeat
  Pfam annotation: Domain name=LRR_1; Domain location=382-402; Score =7.4; E_value=12; Accession=PF00560.23; Description=Leucine Rich Repeat
  Pfam annotation: Domain name=LRR_1; Domain location=46-68; Score=8.0; E_value=9; Accession=PF00560.23; Description=Leucine Rich Repeat
  Pfam annotation: Domain name=LRR_1; Domain location=70-92; Score=7.0; E_value=14; Accession=PF00560.23; Description=Leucine Rich Repeat
  Pfam annotation: Domain name=LRR_1; Domain location=94-116; Score =16.3; E_value=0.11; Accession=PF00560.23; Description=Leucine Rich Repeat
  Pfam annotation: Domain name=Pkinase; Domain location=510-753; Score =122.7; E_value=1e-33; Accession=PF00069.15; Description=Protein kinase domain
  Pfam annotation: Domain name=Pkinase_Tyr; Domain location=510-743; Score=40.5; E_value=5.9e-15; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::Pkinase::Pkinase_Tyr; Domain location=118-140::142 -164::166-185::...
  Pfam module annotation: Domain location=190-212::214-236::22-44::238 -260::262-284::286-308::310-332::334-356::382-402::46-68::70-92::94 -116::510-753::510-743
MGYEVFFNLTGETPGELGKLSSLECMIIGYNKFEGGIPADFGNLTKLKYLDIAEGNLGGEIPAELGKLKMLNTVFLYKNKFEGKIPSEIGNLTSLVQLDLSDNMLSGNIPAEISRLKNLQLLNFMRNRLSGPVPSGLGDLPQLEVLELWNNSLSGPLPRNLGKNSPLQWLDVSSNLLSGEIPETLCTKGNLTKLILFNNAFLGPIPASLSTCPSLVRFRIQNNFLNGTIPVGLGKLGKLQRLELANNSLTGGIPDDIGSSTSLSFIDFSRNNLHSSLPSTIISIPNLQTLIVSNNNLRGEIPDQFQDCPSLGVLDLSSNRFSGIIPSSIASCQKLVNLNLQNNQLTGGIPKELASMPTWAILDLANNTLSGHMPESFGMSPALETFNVSHNKLEGPVPENGMLRTINPNDLVGNAGLCGGVLPPCGQTSAYPLRHGSSPAKHILVGWIIGVSSILAIGVATLVARSLYMMRYTDGLCFPERFYKGRKVLPWRLMAFQRLDFTSSDILSCIKDTNMIGMGATGVVYKAEIPQSSTIVAVKKLRRSGSDIEVGSSDDLVGEVNLLRRLRHRNIVRLLGFLYNDADVMIVYEFMHNGNLGDALHGKQAGRLLVDWVSRYNIALGIAQGLAYLHHDCHPPVIHQDIKSNNILLDANLEARIADFGLAKMMLWKNETVSMIAGSYGYIAPEYGYSLKVDEKIDIYSYGVVLLELLTGKRSLDPEFGESIDIVGWIRRKIDNKSPEEALDPSVGNRKHVQE

SEQ ID NO: 186258 - protein, 50 aa, Glycine max
  Coding DNA Sequence Number=SeqID_69480
MGPGGCRETRGTGTREAARKPRQDFSIQKVWVDFFSREIRGYWVFGSYDG

SEQ ID NO: 186259 - protein, 174 aa, Glycine max
  Coding DNA Sequence Number=SeqID_69481
MVKGYINRSGLKPLYDERYMTVNKGMGYIRVEIRGLLSESNVLANKAYFLYLLDNTIFVEKSSMHAWVFEHLSTIPASENVLENDCKKPFAAKWLALRDTNKVVGTNVLMDQLDLKPFEDQTLYSGYIVVGTFMWSYLPKRVLRQFEYVQRIPLDPPKRPIAYEKYCDTWAKWD

SEQ ID NO: 186260 - protein, 592 aa, Glycine max
  Coding DNA Sequence Number=SeqID_69482
  Gene Ontology: Mol. function=transferase activity, transferring glycosyl groups; Cellular component=membrane
  Homolog annotation: Hit_ID=Q1S232; Match level="QueryCoverage=99%, HitCoverage=100%, E-value=0.0, Identity=75%"; Hit description =Exostosin-like
  Pfam annotation: Domain name=Exostosin; Domain location=137-485; Score=570.3; E_value=1.9e-168; Accession=PF03016.6; Description =Exostosin family
MRKRPDQMEKGAAAKNQNSRLCCLASLSAFFWFLLLYFHFVVLSGDDTNANSSRKNSYNNHVDLDHSTLSTTPVSVGYEPPPIHQVQASPRKIGLPDPDVRRSDADTDTPRAEKIFPFMRAMRASENKSDPCGGRYIYVHDLPSRFNEDMLKECKSLSLWTNMCKFTTNAGLGPPLENAEGVFSNTGWYATNQFAVDVIFGNRMKQYECLTNDSSIAAAVFVPFYAGFDIARYLWGYNISMRDAASLDLVHWLMKRPEWSTMNGRDHFLVAGRITWDFRRLSEEESDWGNKLLFLPAAKNMSMLVVESSPWNANDFGIPYPTYFHPAKDADVFMWQDRMRQLDRKWLFSFAGAPRPGNPKSIRGQLIDQCRRSNVCKLLECDFGESKCHSPSSIMQMFQSSLFCLQPQGDSYTRRSAFDSMLAGCIPVFFHPGSAYTQYTWHLPKNYTKYSVFIPEDDIRKRNISIEERLSQIPPEQVKIMREEVISLIPRLVYADPRSKLETLKDAFDVAVQAVIDKVTNLRKDIIEGRTDDNFIEENSWKYALLPEGEHEVGPHEWDPFFSKPKDGSGDSNDSSAEVAKNSWKNERRNQS

SEQ ID NO: 186261 - protein, 84 aa, Glycine max
  Coding DNA Sequence Number=SeqID_69483
  Subcellular localization annotation: CTP_CleavageSite=63; ConfidenceScore=5.12e-01
MRMQPPNYIARTQRKCIAQRAYCQNTGEVVTTSQQNVGSTFASDDVRLRVRTVMRERIVARVRVRALVKGLGGTVQTECKKRTQ

SEQ ID NO: 186262 - protein, 44 aa, Glycine max
  Coding DNA Sequence Number=SeqID_69484
MACTKKSKAAREIANGIDSLKEKSKQGSLWLPTSAPDRTSSIKR

SEQ ID NO: 186263 - protein, 101 aa, Glycine max
  Coding DNA Sequence Number=SeqID_69485
MNSYSIRPWTSTTRLTATKDACGVRRRCSRDDEGGAKVPHTTICGDLTRRRLAVTSRDQREGNGHEGGGGAVVQRRWCSGVGEEEVGKDSYRLTIRMILMD

SEQ ID NO: 186264 - protein, 1529 aa, Glycine max
  Coding DNA Sequence Number=SeqID_69486
  Gene Ontology: Mol. function=ATPase activity, coupled to transmembrane movement of substances; Cellular component=integral to membrane; Biological process=transport
  Homolog annotation: Hit_ID=Q7GB25; Match level="QueryCoverage=99%, HitCoverage=99%, E-value=0.0, Identity=76%"; Hit description =Multidrug resistance-associated protein 5
  Pfam annotation: Domain name=ABC_membrane; Domain location=314-583; Score=111.5; E_value=2.5e-30; Accession=PF00664.13; Description=ABC transporter transmembrane region
  Pfam annotation: Domain name=ABC_membrane; Domain location=954-1238; Score=82.4; E_value=1.4e-21; Accession=PF00664.13; Description=ABC transporter transmembrane region
  Pfam annotation: Domain name=ABC_tran; Domain location=1310-1493; Score=158.1; E_value=2.3e-44; Accession=PF00005.17; Description=ABC transporter
  Pfam annotation: Domain name=ABC_tran; Domain location=657-827; Score= 121.9; E_value=1.8e-33; Accession=PF00005.17; Description=ABC transporter
  Pfam annotation: Domain name=MMR_HSR1; Domain location=1311-1410; Score=-8.7; E_value=0.0063; Accession=PF01926.13; Description=GTPase of unknown function
  Pfam module annotation: Pfam domain module=ABC_membrane::ABC _membrane::ABC_tran::ABC_tran::MMR_HSR1; Domain location=314-583::954- 1238::1310-1493::657-827::1311-1410
MGVARFFHDVLGLPVLELATICMNLTFVLLFLFVVSVRRVLVYGGGFRFGKDGNSGNASPICSVIDEETRGVRIGVGFKLSVLSCFYVLFVNVLALGFEGGALIWGEANGDADVDLSLLAVPAAQGLAWFVLSFSALYCKFKVSERFPFLLRAWWFLSFVICLCTLYVDGRGFWEEGSEHLCSRAVANVAVTPALAFLCVVAIRGGTGIRVCGNSDLQEPLLVDEEPGCLKVTPYRDAGLFSLATLSWLNPLLSIGAKRPLELKDIPLVAPRDRAKTSYKVLNSNWERLKAENENPSKQPSLAWAILKSFWKDAALNAIFAGMNTLVSYVGPYMISYFVDYLGGKETFPHEGYILAGIFFVAKLVETVTTRQWYLGVDILGMHVRSALTAMVYRKGLRLSSSAKQSHTSGEIVNYMAVDVQRVGDYSWYLHDMWMLPMQIVLALLILYKNVGIASVATLIATIISIVVTVPVARVQEDYQDKLMAAKDERMRKTSECLRNMRILKLQAWEDRYRLKLEEMRGVEFKWLRKALYSQACITFMFWSSPIFVSAVTFATSILLGGQLTAGGVLSALATFRILQEPLRNFPDLVSTMAQTKVSLDRISAFLQDEELQEDATIVLPPGISNTAIEIMDGVFCWDSSLPRPTLSGIHVKVERGMTVAVCGMVGSGKSSFLSCILGEIPKLSGEVKMCGSVAYVSQSAWIQSGNIEENILFGTPMDKAKYKNVLHACSLKKDLELFSHGDQTIIGDRGINLSGGQKQRVQLARALYQDADIYLLDDPFSAVDAHTGSELFREYVLTALADKTVIFVTHQVEFLPAADMIMFGKKPRASPGTAVLKEGHIIQAGKYDDLLQAGTDFKTLVSAHHEAIEAMDIPNHSEDSDENVPLDDTIMTSKTSISSANDIESLAKEVQEGSSDQKVIKEKKKAKRSRKKQLVQEEERVRGRVSMKVYLSYMAAAYKGVLIPLIIIAQTLFQFLQIASNWWMAWANPQTKGDQPKVTPTVLLLVYMALAFGSSWFIFVRAVLVATFGLAAAQKLFFNMLRSIFHSPMSFFDSTPAGRILNRVSIDQSVVDLDIPFRLGGFASSTIQLIGIVAVMTDVTWQVLLLVVPLAIICLWMQKYYMASSRELVRIVSIQKSPIIHLFGESIAGAATIRGFGQEKRFMKRNLYLLDCFARPFFCSLAAIEWLCLRMELLSTFVFAFCLVLLVSLPHGSIDPSMAGLAVTYGLNLNARLSRWILSFCKLENKIISIERIYQYSQIPSEAPAIVEDSRPPSSWPENGTIQLIDLKVRYKENLPVVLHGVSCTFPGGKKIGIVGRTGSGKSTLIQALFRLVEPEAGSILIDNINISSIGLHDLRSHLSIIPQDPTLFEGTIRGNLDPLDEHSDKEIWEALDKSQLGDIIRETERKLDMPVLENGDNWSVGQCQLVSLGRALLKQSKILVLDEATASVDTATDNLIQKIIRREFRDCTVCTIAHRIPTVIDSDLVLVLSDGRVAEFDSPSRLLEDKSSMFLKLVTEYSSRSSGIPDF

SEQ ID NO: 186265 - protein, 92 aa, Glycine max
  Coding DNA Sequence Number=SeqID_69487
MENHRFISKSDSAKARSNRKRIRQQKVHLNVQDSVHASVNPASSHTEDDYNQPKSPPHSVHAIFNRASHDAEDHFGYPNCESSHHDSSMDTE

SEQ ID NO: 186266 - protein, 142 aa, Glycine max
  Coding DNA Sequence Number=SeqID_69488
METVMVAHFRCSSTIKVPYHPETSKSDVPFAIRRQSSMMEHGHKHSRLLPLAKDSMKPPACRGELGSNLLPYFFYKWTLGAEEKRSNTFGNQISLKISEEKKKEGENQGQGASITLHDVSMINSANVLCLSSLFAIRSLIFN

SEQ ID NO: 186267 - protein, 533 aa, Glycine max
  Coding DNA Sequence Number=SeqID_69489
  Gene Ontology: Mol. function=binding; Cellular component=integral to membrane; Biological process=intein-mediated protein splicing
  Homolog annotation: Hit_ID=Q7N2L2; Match level="QueryCoverage=98%, HitCoverage=30%, E-value=1e-171, Identity=59%"; Hit description =Complete genome; segment 11/17
  Pfam annotation: Domain name=Fil_haemagg; Domain location=114-190; Score=22.0; E_value=0.0021; Accession=PF05594.4; Description =Haemagluttinin repeat
  Pfam annotation: Domain name=Fil_haemagg; Domain location=372-419; Score=0.0; E_value=28; Accession=PF05594.4; Description =Haemagluttinin repeat
  Pfam annotation: Domain name=Haemagg_act; Domain location=3-66; Score= 23.5; E_value=1.6e-06; Accession=PF05860.3; Description =haemagglutination activity domain
  Pfam module annotation: Pfam domain module=Fil_haemagg::Fil _haemagg::Haemagg_act; Domain location=114-190::372-419::3-66
LEDPPELIINEVTGGSRSELQGKLEVFGNKANVMIANPNGITCNGCGFINAPGVTLTTGKPQFDKQGALEALEVKKGGVTIGGKGLDGSSADYVDIISRATELNGKINAQNLSLTQGANRISFKDGTIKPIAGEGAKPVLAVDTKALGGMYANKIRLVANEDGVGVNLKDLTSKQRDITLSVSGRIELGNTQAATDLNASAREIHISSGVKVRGERDVTMAADTLNNNGNVTAHRDMRVFADTVRNVALRDGDNTALHSNNNLWIQKDAQGNKAKQIENRSARIQTNSGDLVIRTENLNNVRQEVQAVWKNTPANSKAFNKSLVGSYYDSRQGVDAIVLLEPELKDFGIGSWFGEINLSKGDKVNVGKDEYLLVKSQAPGVINSGNNAYINATTLWNDQSNISAAKDLILTGNDFTVKSIQLGQKDRYWRLGTNTFGVGAFARDEDAPPGDWDLLYVTEKAPYTKQQELVVWRAKGQQKSSITAGNNLTADFKNKIEISTPTPHENQLNEVVTSGRPESLKARNVLLHAKNIV

SEQ ID NO: 186268 - protein, 51 aa, Glycine max
  Coding DNA Sequence Number=SeqID_69490
MREKFHSYLGVVAREKVPIIHNNWKDVPETLKEIVWNDILIKVRDQNKSCV

SEQ ID NO: 186269 - protein, 69 aa, Glycine max
  Coding DNA Sequence Number=SeqID_69491
  Gene Ontology: Mol. function=oxidoreductase activity, acting on the CH-OH group of donors, NAD or NADP as acceptor
  Homolog annotation: Hit_ID=Q67XB8; Match level="QueryCoverage=90%, HitCoverage=17%, E-value=7e-22, Identity=80%"; Hit description =Sorbitol dehydrogenase-like protein
DVAEEVVQIQKVMGADIDVTFDCAGFDKTMSTALSATQPGGKVCLVGMGHSEMTVPLTPAAARLCMMHK

SEQ ID NO: 186270 - protein, 84 aa, Glycine max
  Coding DNA Sequence Number=SeqID_69492
  Subcellular localization annotation: CTP_CleavageSite=17; ConfidenceScore=5.12e-01
MFSPSGIKKSLEICEKNCFREKNPSRGASVTLLRRFCKQFRGDSSPFFIVLCRSSVFNRLSGPYLFCVLLFSLRLFSVPPFVVL

SEQ ID NO: 186271 - protein, 37 aa, Glycine max
  Coding DNA Sequence Number=SeqID_69493
MGTRAERNEEKATYMHLICAIARPSPSTTYDGCPIIQ

SEQ ID NO: 186272 - protein, 62 aa, Glycine max
  Coding DNA Sequence Number=SeqID_69494
MVFVSEGGVGFVTPQLNHTRIRGMGLCRWSSGKFLRKCLSKDKTCLKVLYWFVGSVIEPRSS

SEQ ID NO: 186273 - protein, 147 aa, Glycine max
  Coding DNA Sequence Number=SeqID_69495
MAIGKLSLIVIALRARWGIVFEMRCLECVINREGVELLGYKCEVKSHIGSPYMVTRGPQVYPSNLPNNWYQSRWFKLVTDSDELPLEGETTMWKRLTLEGEMCWVTSVRSPYVVTRGPKECDDSFLMCCLCLDPMKISNLVFMGEDD

SEQ ID NO: 186274 - protein, 121 aa, Glycine max
  Coding DNA Sequence Number=SeqID_69496
MPKLGTPRGRFTLNPEGAPWKILWKDIITLAQTWSVLSYFNLTPTSHTFDLNMDRALLIYVIVMKMDMDIGNKISLQITQIAQSRPRRIQARATQDASPPPPPPVSPPPVTLSSTNQSSSQ

SEQ ID NO: 186275 - protein, 60 aa, Glycine max
  Coding DNA Sequence Number=SeqID_69497
MAVSDHRVLGKGLEQGGYNEENVNKSSSLSMFLRERTSATRCPRVHVRVVSGVRIDVGAS

SEQ ID NO: 186276 - protein, 49 aa, Glycine max
  Coding DNA Sequence Number=SeqID_69498
MEEIPLDQLDERMWGYMIFMECLAKKRKCKEDVLYVTFHATMKAYGLSS

SEQ ID NO: 186277 - protein, 92 aa, Glycine max
  Coding DNA Sequence Number=SeqID_69499
  Gene Ontology: Mol. function=DNA binding; Biological process=DNA integration
  Homolog annotation: Hit_ID=Q1SKC8; Match level="QueryCoverage=75%, HitCoverage=16%, E-value=1e-17, Identity=60%"; Hit description =Integrase, catalytic region
MKVYHDKKLIKKTSQPGQQVLLFNSRLRLFLGKLKSKWFGPFIIQEMKPYGAVELMDLASSDPERSWIMASRKHRIGASQPQGGILLGIPPS

SEQ ID NO: 186278 - protein, 840 aa, Glycine max
  Coding DNA Sequence Number=SeqID_69500
  Gene Ontology: Mol. function=protein serine/threonine kinase activity; Cellular component=membrane; Biological process=protein amino acid phosphorylation
  Homolog annotation: Hit_ID=Q5ZAL3; Match level="QueryCoverage=90%, HitCoverage=93%, E-value=1e-155, Identity=42%"; Hit description =Putative serine/threonine kinase
  Pfam annotation: Domain name=B_lectin; Domain location=73-179; Score =107.7; E_value=3.3e-29; Accession=PF01453.15; Description=D-mannose binding lectin
  Pfam annotation: Domain name=PAN_1; Domain location=322-399; Score =21.2; E_value=0.0012; Accession=PF00024.16; Description=PAN domain
  Pfam annotation: Domain name=PAN_2; Domain location=309-381; Score =56.0; E_value=1.3e-13; Accession=PF08276.2; Description=PAN-like domain
  Pfam annotation: Domain name=Pkinase; Domain location=501-761; Score =103.0; E_value=8.7e-28; Accession=PF00069.15; Description=Protein kinase domain
  Pfam annotation: Domain name=Pkinase_Tyr; Domain location=501-761; Score=100.8; E_value=3.9e-27; Accession=PF07714.7; Description =Protein tyrosine kinase
  Pfam annotation: Domain name=S_locus_glycop; Domain location=192-292; Score=12.6; E_value=4.3e-06; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=73-179::322- 399::309-381::501-761::501-761::192-292
MAFTSALTSLTTLVCLCMFCVNATTHKEILQTGQSLGTSDTLLSYGGNFELGFFSKDNSTKYYVGIWYKRVPNDKIVWVANRDSPVQTSSAVLIIQPDGNFMIIDGQTTYRVNKASNNFNTYATLLDSGNLVLLNTSNRAILWQSFDDPTDTLIPGMNLGYNSGNFRSLRSWTSADDPAPGEFSLNYGSGAASLIIYNGTDVFWRDDNYNDTYNGMEDYFTWSVDNDSRLVLEVSGELIKESWSEEAKRWVSIRSSKCGTENSCGVFSICNPQAHDPCDCLHGFQPLHADSWRNGNTSAGCVRKIELSCSNRSSNNVKSNDGFFQFNKVQLPQTSNGYIKLKIDRARECESACSRNCSCVAYAYYLNSSICQLWHGQVLSLKNISTYLDNSDNTNPIFYLRLDASELVTADSNPTNATELATDFRKHENLLRNLLLIVILILLLAFLILGLLVYWTRRQRRKGEDLLRFHVSMSMKVEDSELAEAHRGAKVKKKEVKLPLFSFGILLNGDEVAVKRLSRRSGQGWEELRNEALLIAKLQHNNLVRLLGCCIDRDEKMLIYELMPNKSLDVFLFDATKRRMLDWGTRVRIIDGIAQGILYLHQYSRFRIIHRDLKASNILLDTNMNPKISDFGMARIFGDNELQANTNRIVGTYGYMSPEYAMEGLFSIKSDVFSFGVLLLEILSGKKNTGFYQTNSFNLLGYAWDLWTNNSGMDLMDPALDDSDTTSSSMHTVPRYVNIGLLCVQESPADRPTMSDVVSMIGNDTVALPSPKPPAFLNVREVIAIFGEIQIKVVKPDNFVTLLMGCAQLGVLEQGKWNHNYMDENRIVVDAVFGTALNVC

SEQ ID NO: 186279 - protein, 525 aa, Glycine max
  Coding DNA Sequence Number=SeqID_69501
MATCGNQQYTTVKNTNFFSLPKSLIHERNFPTLKIGEEMDSDISQWVTEFLLRSSVPDSLIQKTLAALPLSTASPRLKKTLLLRTLQTLLRTATLSETALDILELLEPSAPVSDAHRRAYCAVAVECTVKYLAACPEDIDGEYAGAVRRIWRGRVSALKARWSRLVSGELARWRDVVEDAFGDSRARQRLVGLNSRRDAMKEVRVFLKEAWGAMGPSFLETVAAKEKNKDEGARDNDDNDNICDDHDDGACMEDVAMHGENQEPLEESVDANQEVGGFDLSPRRDKAIPKRNSQLKHKHSAFRASHRGRGVEISSPKEVKATKSWSKHDPVPSAEVKKVRESLKSSSLELRALVKDPLPHALHISDVVRSKLATSDTKTEPLIENQHEDVEVQDPDVCQSIVPFQPNDVNLGKKSFVHCSNIHQPYLMEQNISARTFELFPSFFQWEDSVDNSPQARQPRRRKRKWSSLEEETLRAGVKMFGEGNWASIRSFYSNVFENRSGVCNLCPKMLCHVVIFLSGLVPVI

SEQ ID NO: 186280 - protein, 66 aa, Glycine max
  Coding DNA Sequence Number=SeqID_69502
MWYHVSETLGRLRVHNKTHHMMGISDLKEHSNQVTPKAYTPKSLSGPLPPDSGRTPKIILAHKHCS

SEQ ID NO: 186281 - protein, 1077 aa, Glycine max
  Coding DNA Sequence Number=SeqID_69503
  Gene Ontology: Mol. function=nucleic acid binding; Cellular component= proton-transporting two-sector ATPase complex; Biological process=DNA integration
  Subcellular localization annotation: CTP_CleavageSite=51; ConfidenceScore=5.11e-01
MGRKIGSSCNAAFSSGHKIADTVLKPSPWHWPFGSCNQLNGSWYQESGSFPMATESSFVQAAIPRFDGHYDHWSMLMENFLRSKEYWSVIESGIQESPVGAVLTDAQKTKFEARKLKDLKAKNYLFQAIDRAILETILCKETSKDIWESMKRKYEGSVKVKRAQLQALRRDFETLAMKDGESVTNYFARTMEISNKMRFHGEKMTDKMHRSCTTEEQALKASTATNTHSSDFRGRGRERGRGRGRGKGVCGNREDNKNPRANTTSKGRGQYFNRSKLECFDEAKNKEVETLLMAIQEGGKTESDIWYVDTGCSNHMSGLMGKGDVKIKTKNGFVETISNVLYAPDLKSNLLSTSQLQEKGYVIEIQKGACEIYDPVRGAIAIVQMSSNRLFPLKIESIQTCFKTDMEDPSWLWHFCYGHLNFSGLKTLQQKNMVTGLPQITIPSQVCEECVVGKQHRSQFPKGKSWKAKDVLELEKSEAFCTFKSFKASVENEAKKSIKTLCTDRGVNWSIHVLNRSPTFAVQNMTPEEAWKGRRPAVDRFRIFGCITYAYVPEVKRKKLDDKAEKCVFLGVSEPSQVIYDNDTEHEQISAPYMLENTTNSTPIAAVTSPTTTSINKEEAQSHSRVRRRPVWMKDYEVTGIQNPITHFALFADCNPTTFESVVKEEKWPKAMNDEIDAIERNDTWELFDLPRGQKTIGVKWVFKTKLNENGEVDKYKARLVAKGYKQQYGTDYTKCFPQLQDMTQLDWWSRWQHNNPGKFSSSMSNPHSCTDTWKNRDEGKILIVSLYVDDLIFTGNCDAMFKEFKKSMMDEFEMSDLGMMHYFLGIEVVQSNASIFISQKKYVEEILDRFHMQNCNSTTTPVAFGCKLHKDHEGIKVDNTFFKQIVGSLIYLTATRPDIMYYVSLVSRKGITSNLLGFTNSDFAGDQDDRRSTSGYAFMFGNGAITWSSKKQPIINLSSTEAEFVAATACACQAIWLRRILEELQFKQLEATQVFCDNNSSIKLSKNPVLYGRSKHIDVRYYFLRELTKEKIVELIHCKSEDQVADLFTKPLKLASFQKLRALLGVCTMEEAVQGT

SEQ ID NO: 186282 - protein, 89 aa, Glycine max
  Coding DNA Sequence Number=SeqID_69504
MEQSLGTSDTILSRSGNFEPGYTWSLRSWTSADDPALGAFSLRSGVEVYYSYVSCPVVNDSRLVLEVSGELNLEYWSEEEKHWISIKSS

SEQ ID NO: 186283 - protein, 188 aa, Glycine max
  Coding DNA Sequence Number=SeqID_69505
  Gene Ontology: Mol. function=oxidoreductase activity; Cellular component=cytosol; Biological process=chromatin silencing at silent mating-type cassette
  Homolog annotation: Hit_ID=Q9LSQ5; Match level="QueryCoverage=89%, HitCoverage=80%, E-value=2e-60, Identity=70%"; Hit description=1,4 -benzoquinone reductase-like; Trp repressor binding protein-like
MAPVLYSVPETLSTEELEALRAPPKSDVPIITRNELRDADGFVFGFPTRFGMMAAQFQAFLDSIGLLWDEEDQFLEGKPAGMFFSTGCQGGGQETTALTAIPQLVNHGLLFVPILYTLGAGISGMFEIEEVRGGSPFGSGTYAGTDGKRNPTEIELRQAFHQGKCIAAISKKLKRDPQNYLHNIARRW

SEQ ID NO: 186284 - protein, 111 aa, Glycine max
  Coding DNA Sequence Number=SeqID_69506
  Gene Ontology: Mol. function=transmembrane receptor activity; Cellular component=membrane; Biological process=defense response
  Homolog annotation: Hit_ID=Q1SGR7; Match level="QueryCoverage=97%, HitCoverage=12%, E-value=2e-18, Identity=37%"; Hit description=TIR; Disease resistance protein; AAA ATPase
  Pfam annotation: Domain name=TIR; Domain location=6-106; Score=24.9; E_value=2.4e-07; Accession=PF01582.10; Description=TIR domain
MRTYDVFVCFRVETRNDFNGFLFKALRRKGIDAFKDDKDIRKVAHLCNCIQTSPRRVVPIFYDVDTSHVRNQSGCYEIAFAKYAERLKEDKENTDEMQRWREALTRVASVS

SEQ ID NO: 186285 - protein, 73 aa, Glycine max
  Coding DNA Sequence Number=SeqID_69507
MGNETLSRRAMTLGFEEMKRPGDMLVLKEWRRGFVVREWMHNIDFNKTDEDCSQLFLAGSYIYQLFIAQVHHG

SEQ ID NO: 186286 - protein, 139 aa, Glycine max
  Coding DNA Sequence Number=SeqID_69508
MLMWDLHLCWLVILMMHWTLKNVTFFTLLTDSIVEELLSHFVEELLSAEHRVMKIGPHKELKFISKEKTVWHNSHLVEDKNRRKLISSDLLNYGLESEFHIGSVFSAHLIYGSQVNGSVIHAPSDAASVAFEIPLLTYG

SEQ ID NO: 186287 - protein, 115 aa, Glycine max
  Coding DNA Sequence Number=SeqID_69509
MELFYRISHPFMSLTQPRESPRHPPMVHDDTFIVPDLPQQPVNATTMPEPPAPTVADVDMPRHTMDACQRIAENLEHIINMRMITAGIEAYTLTKHYLRLARGVTKQQNVYVRSR

SEQ ID NO: 186288 - protein, 210 aa, Glycine max
  Coding DNA Sequence Number=SeqID_69510
  Homolog annotation: Hit_ID=Q1T1F7; Match level="QueryCoverage=54%, HitCoverage=24%, E-value=2e-14, Identity=38%"; Hit description=IMP dehydrogenase/GMP reductase
  Pfam annotation: Domain name=DUF1723; Domain location=97-146; Score =64.3; E_value=3.9e-16; Accession=PF08330.1; Description=Protein of unknown function (DUF1723)
MQKKPLSIEGRQHLHERVTNHAGADTKVFPAEPHDTSMLMSYVDHVVARVWTEEERIELKLASHGRKVEKFGRHAPEIEGIVTTIGLSSLITCSLNTGDRGLLSALVERWHKETNSFHLSVGEVTITLDDVASLLHQHITGAFLTFDALDVDQVVELLVELLDVSTKEAKDETFQCIGAHVHLCWIYEHFPTIASIVADEDYHERKPHAS

SEQ ID NO: 186289 - protein, 1240 aa, Glycine max
  Coding DNA Sequence Number=SeqID_69511
  Gene Ontology: Mol. function=nucleoside-triphosphatase activity; Cellular component=membrane; Biological process=defense response
  Homolog annotation: Hit_ID=Q1STU9; Match level="QueryCoverage=86%, HitCoverage=94%, E-value=1e-155, Identity=33%"; Hit description=H+ -transporting two-sector ATPase, alpha/beta subunit, central region; Disease resistance protein
  Pfam annotation: Domain name=AAA; Domain location=164-351; Score= -24.1; E_value=0.014; Accession=PF00004.19; Description=ATPase family associated with various cellular activities (AAA)
  Pfam annotation: Domain name=LRR_1; Domain location=1005-1029; Score =2.4; E_value=1e+02; Accession=PF00560.23; Description=Leucine Rich Repeat
  Pfam annotation: Domain name=LRR_1; Domain location=1031-1052; Score =2.7; E_value=91; Accession=PF00560.23; Description=Leucine Rich Repeat
  Pfam annotation: Domain name=LRR_1; Domain location=1121-1144; Score =3.9; E_value=52; Accession=PF00560.23; Description=Leucine Rich Repeat
  Pfam annotation: Domain name=LRR_1; Domain location=18-39; Score=0.8; E_value=2e+02; Accession=PF00560.23; Description=Leucine Rich Repeat
  Pfam annotation: Domain name=LRR_1; Domain location=541-563; Score =8.3; E_value=8.1; Accession=PF00560.23; Description=Leucine Rich Repeat
  Pfam annotation: Domain name=LRR_1; Domain location=565-585; Score =4.5; E_value=41; Accession=PF00560.23; Description=Leucine Rich Repeat
  Pfam annotation: Domain name=LRR_1; Domain location=587-608; Score =10.7; E_value=2.8; Accession=PF00560.23; Description=Leucine Rich Repeat
  Pfam annotation: Domain name=LRR_1; Domain location=610-633; Score =12.5; E_value=1.3; Accession=PF00560.23; Description=Leucine Rich Repeat
  Pfam annotation: Domain name=LRR_1; Domain location=635-668; Score =5.4; E_value=28; Accession=PF00560.23; Description=Leucine Rich Repeat
  Pfam annotation: Domain name=LRR_1; Domain location=799-827; Score =3.0; E_value=79; Accession=PF00560.23; Description=Leucine Rich Repeat
  Pfam annotation: Domain name=LRR_1; Domain location=883-903; Score =4.3; E_value=44; Accession=PF00560.23; Description=Leucine Rich Repeat
  Pfam annotation: Domain name=LRR_1; Domain location=936-958; Score =2.0; E_value=1.2e+02; Accession=PF00560.23; Description=Leucine Rich Repeat
  Pfam annotation: Domain name=LRR_1; Domain location=978-1001; Score =3.7; E_value=59; Accession=PF00560.23; Description=Leucine Rich Repeat
  Pfam annotation: Domain name=NACHT; Domain location=163-315; Score= -21.5; E_value=0.0027; Accession=PF05729.3; Description=NACHT domain
  Pfam annotation: Domain name=NB-ARC; Domain location=125-424; Score =110.5; E_value=4.7e-30; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::NACHT::NB-ARC; Domain location=164-351::1005-1029::1031 -1052::1121-1144::18-39::...
  Pfam module annotation: Domain location=541-563::565-585::587 -608::610-633::635-668::799-827::883-903::936-958::978-1001::163 -315::125-424
MDAIASVASNVAAPLLKHLTYVLMYSTYLNQLETEIQRLQHEEKEVRHTVEAAKRSGEEIEDTVLDWFGRVRATVEEGQSFLSGEDRERIGCLDVYSRYTKSQRAKDLVDLVREMRKETFDRVSYRCALRCNVSPSAREYVELESRKMMLNEIMKVLKDGDVDIVGLYGMAGVGKTALVKELAWQAEMDGLFDAVVMATVTNSPDVGMIRAEIADGLGLKFDELTELGRASRLRQRIRQEQRILVILDDVWGKLELTQVGVPFGENKRGCKCQLLVTSRDLNVLNTNFEVDKAYRLEVLSEDESWELFEKRGGDSVKETSVQPMAEKVAKSCDGLPLLIVTVVEAMKNQDLYAWKDALEQVTSFELEGCFYSPVRSAIELSYEHLESHELKTFFLLLGSMGNGCTTRDLLVYGWCLGLHKHVDTLADGRNRLYKLIDNMRAASLSLDEGKRDSVVALDVVRHIAASISSRDKPFFTVPRNKELKEWPRMDLLKTCHHIFLDWCFIRELPEMLECPKLKILQLNCQGNYLKIPDNFFVQMQELKVLNLGGLNCTPSLPASLSLLTNLQALNLCKCMLEDIAIVGEITSLEILNLEKSELRELPAEIEGLSNLRLLDLTDCSTLGVIPRNLISSLTSLEELYMGNCNVQEEVKGSKSQSIDSCISELRHLNKLTTLNVQIEDTSDFPRDYLGFGRLESYKILIGEGWEWSGVESGNYETSKLLKLNLGADTSILMDYGIKMLMAKAEDLYLAELKGVREVLYELNDEGFSRLKHLNILNCAEMESIIGSTEWAYGDHAFPKLESLILHNLINMERICSDPLPAQAFTKLQVIKVKGCDRMEFLFSHSMVKHLSELVEIEISECKFMTNIIAAQRQKDADAGQTDKIRLINLRSLTLECLPSLVTLSPESSIQATESGNDGCERLTHIFSYSVARKLVKLEHLLISSCKSVEQIFVADENSGHHHHFRISAPTELVPIFPNLETFVISHMDNLKSIWPDQLTENSFYKLKKMEITSCNNLLNVFPCHVLDKLQSLESLNLWNCMALKVVYEIDGINTGQEGSSQGGLNIPLRTMSLGNLPKLTHLWNKDPQGNIQFRNLFTVKAAKCQSLKHVFPLSVAKDLVHLQFLEISDCGVEEIIVNDQVGGILRASILRKIYLTQEGDQVYWEGDLNTTIRKLFDRGSCALKKHPIKKAMQKEEKLNMRTQVQVQELGSVFSLVEGFFSKADHVSNRSTEKSDVAVEK

SEQ ID NO: 186290 - protein, 68 aa, Glycine max
  Coding DNA Sequence Number=SeqID_69512
  Pfam annotation: Domain name=AP2; Domain location=9-61; Score=58.1; E_ value=3e-14; Accession=PF00847.10; Description=AP2 domain
MAPACIINITGGAFSWNPSKKSRVWLGTFDTAEEAARAYDAAAREFRDPKAKTNFPLPLENVKNLSPS

SEQ ID NO: 186291 - protein, 150 aa, Glycine max
  Coding DNA Sequence Number=SeqID_69513
MSHPIRALYPDVIQHKLTSFHHFVAQHHITTQHISFIFTIFTYSRIKTQYHQVNQSISINTQALSNKYTKTQSYMQCDTMSVKNHVGRLGVHDKTNHTLSGSRCFERMLQPCGIDTSLKEHSNRVTPKAYTLKSPSRSLPLDSYSTQKTF

SEQ ID NO: 186292 - protein, 73 aa, Glycine max
  Coding DNA Sequence Number=SeqID_69514
MGLMTTTITGGRDRWSDIKGGMNGGDWCAMQPEEKRRLKQQHMHPPNGTEGGAPPQRVAHLPNDDSATEALWL

SEQ ID NO: 186293 - protein, 34 aa, Glycine max
  Coding DNA Sequence Number=SeqID_69515
MDEGDEVLAEGVAFTLEAHFDQPVVVDEGEEGCR

SEQ ID NO: 186294 - protein, 170 aa, Glycine max
  Coding DNA Sequence Number=SeqID_69516
  Homolog annotation: Hit_ID=O22784; Match level="QueryCoverage=80%, HitCoverage=54%, E-value=2e-16, Identity=36%"; Hit description =Expressed protein
  Pfam annotation: Domain name=DUF26; Domain location=49-103; Score= -8.8; E_value=0.079; Accession=PF01657.8; Description=Domain of unknown function DUF26
  Subcellular localization annotation: CTP_CleavageSite=34; ConfidenceScore=5.02e-01
MSHFRVSDIIAMIWVVTQGQYCQNLKPLLDSLVLVSTQKGFVATTQNTFTGTFQCRGDLSNAECYNYVSKIPNMLGHLCGGGTGAAERVLPMVRGGQVQGGLGYIASVQGVRGSQSGRQWRVLGSYQSLYVLGQCEGILGNADCGGCIKSVMELASSCSPPLHESIPHSA

SEQ ID NO: 186295 - protein, 115 aa, Glycine max
  Coding DNA Sequence Number=SeqID_69517
MELENEGTGPQCRQRKQSMATPPKKNQQEHKGAGTRKRMKNTNAQRGRRKGSDDVRNVNNDTTETNMSRVDEVYDAPWNLIVGMLKPLEEVGPVTCNNQYISWPFHADMNFHVHI

SEQ ID NO: 186296 - protein, 204 aa, Glycine max
  Coding DNA Sequence Number=SeqID_69518
  Gene Ontology: Mol. function=steroid hormone receptor activity; Cellular component=nucleus; Biological process=regulation of transcription, DNA-dependent
  Homolog annotation: Hit_ID=Q2HU72; Match level="QueryCoverage=92%, HitCoverage=32%, E-value=2e-50, Identity=52%"; Hit description =Steroid nuclear receptor, ligand-binding
MAGIVRSVIGGAAYGFFAPIFATFEAVEGGKENKLFHCFINFIFYPWDGTWSTIRTTFNIVKDVKNECYDSYFSFMNDLLQPNRKYYEIRLRYLLGAIVVVILGIIIGMPVISFVAIFKGPYMLFKGWKRLFHDLIGCEGPFLETICVPFAALAIVLWPLAVVGRVLASALASFVFGGYGGFITYQVNPFTSFKSIDTIVTNLL

SEQ ID NO: 186297 - protein, 93 aa, Glycine max
  Coding DNA Sequence Number=SeqID_69519
MENKKCIYSTPFGIQTTGLTSVLSTVRRVSGNGKEVEREVQSEGDTIKYDGGGGGANDNGIGAEGLVEQLSDMSKVLCHGQSCYSVRKEKQKP

SEQ ID NO: 186298 - protein, 216 aa, Glycine max
  Coding DNA Sequence Number=SeqID_69520
MAPKFEPGSQIKMGEGMSEWRKEWSRSVPPTLAAIVTRENEQRSKGRMRQLGGMTAMVGGDDTGVGCCCLSAGSGGGVGVGGRVSMNGGSGVGGGVDMGVCARSAFAEEEDGMVVEEEGGGKSMVGVKGEAAIGGGDGGRRREVAGWCGLRASSSRSEVAVYLVDSAIEGRRRSNESSNQPPKEKKKTQKRRVPGAFAERSHHSSFLLGFASSYTP

SEQ ID NO: 186299 - protein, 98 aa, Glycine max
  Coding DNA Sequence Number=SeqID_69521
MVVAERNDEAENRGNVVICIHCGGKGRGGSMGSWRWGAMVVVGFRGGGEVMVRGFGFVEVMVWVHDGCEVVVSGGGGVLDKWWQLDQSIEKLGFANSA

SEQ ID NO: 186300 - protein, 328 aa, Glycine max
  Coding DNA Sequence Number=SeqID_69522
  Homolog annotation: Hit_ID=Q2R276; Match level="QueryCoverage=31%, HitCoverage=22%, E-value=1e-14, Identity=49%"; Hit description =Expressed protein
MSFGLTEDEAEGDQYELPTYEYPPLKCNVMHDGMDAGNDDTDIEKYAFGETPSDRLRNLENRISQMEKTPTYSRMDGDFTGKNILEKVIVGQSPRRIKHSRRFSSDSASLSGIGKEIGPESMMDSPKLNSNYRRDYFSESEDPSNFKKVHNASDGDDMSDRIYTIDSVHCGAPYNGFTDSKAGGFEDYATTPRESGNHATDFEDPYIKKLYMRLQALEADRESMRQAIISMRTDKAQVVLLKEIAQHLCKEMSPKRKMARKLYFSGNSNSSFVSIFKWISSIVFWRKRAHQSKYMFGLPPESVGLLMLLDKGMHARPWRCVSSTQVGD

SEQ ID NO: 186301 - protein, 78 aa, Glycine max
  Coding DNA Sequence Number=SeqID_69523
MALVRCIGGNSVPRRLSNMALSCFFFFYSEAQSLLLVHLICPCLQVAAVVHFLVVSFGNATMEDVQLFELQEQGGTQE

SEQ ID NO: 186302 - protein, 193 aa, Glycine max
  Coding DNA Sequence Number=SeqID_69524
  Gene Ontology: Mol. function=transcription regulator activity; Cellular component=nucleus; Biological process=regulation of transcription
  Homolog annotation: Hit_ID=Q1T110; Match level="QueryCoverage=68%, HitCoverage=37%, E-value=1e-24, Identity=52%"; Hit description=Helix- loop-helix DNA-binding
MDKASIIGDAVSYVHDLQAQARKLKADVAGFEASLLVSENYQGSINNPKNVQVMARNISHPNCKKIMQVDKFQVEERGYLAKIVCNKEKGLELIVTSRLINDSEEEEDDRVEKFAFIVAVASVEITARFTFSRIECKHVADAVAIGCGGIEMEELRRSGIGGMVAKMMDAFNPMNKSDAGGVVGGAIPSEKKK

SEQ ID NO: 186303 - protein, 72 aa, Glycine max; identical to SEQ ID NO: 132292
  Coding DNA Sequence Number=SeqID_69525

SEQ ID NO: 186304 - protein, 231 aa, Glycine max
  Coding DNA Sequence Number=SeqID_69526
  Gene Ontology: Mol. function=RNA-directed DNA polymerase activity; Cellular component=chromatin; Biological process=chromatin assembly or disassembly
  Pfam annotation: Domain name=RVP_2; Domain location=50-169; Score= -54.0; E_value=0.016; Accession=PF08284.2; Description=Retroviral aspartyl protease
  Subcellular localization annotation: CTP_CleavageSite=70; ConfidenceScore=5.05e-01
EDKDLDPNTVLNDPPDPPDKVDLPNPSPTQISFHSLAGHLALKTLWLSGSFSGRQVVVLVDGGGTYNFIQQELVTQLNMSCRDTPFPLWVMVGNIQHLLCTSLCEATLIDIQSMQFAVDLHVLPISGAYVVLGVQWLKSLGPLLTDYNILCMQFFYQGRMVELNGDQDDTPNFITLSQFWRISQTQALGLYYHITLLSKDSPNPQDLHPDIQSLLTKFAHLFHQPSTLSSK

SEQ ID NO: 186305 - protein, 95 aa, Glycine max
  Coding DNA Sequence Number=SeqID_69527
MGPKSILRLMRIFLESSIQCPWGLAQLWPNGYMDNHGIKHGICRVHLDFGRRREKSKLKREGKRTIFFLALPKWNMEKLMCLTKIKQLNPIKTPS

SEQ ID NO: 186306 - protein, 533 aa, Glycine max
  Coding DNA Sequence Number=SeqID_69528
  Homolog annotation: Hit_ID=Q1RTB4; Match level="QueryCoverage=63%, HitCoverage=82%, E-value=1e-23, Identity=27%"; Hit description=IMP dehydrogenase/GMP reductase
MGSNQTPLLKKMFYQVKIKSLEVTGLRELGQLMGQLQRKPSAKPMDFQLVQTVEEFQEILGCPLGGRKPYLFSGFYPSMARVAKVVKISAQELDRVKQNRNGVVGVPQKHLEEKAKALASQGEWASFIDILALLIFRIVLFPNMEGLVDLEAIDTFLAFHHSKEGPVVAILADMYDIIEGAFVNWFPRWKEGRTKILFSCKGFPNVPLMGTRGCINYNPVLAIRQLGYPMRGAPSEESPMPFIAWGFSDPNARLLRGVHNAWDALRKKDKELRGSSNGITGGYRKWLKVHAQGLDWLPKLRAMREGEAEAPKESEEVQVLKAELEKTQAVKEKFKSIAIKVRKEYDELKDINMATAEALERETKRARKEEHGRNKIRGALWGSNSELKLQKDERDQSRVEGMILKDELKACFRCKRSLSQQLSETEENMLAIIDKHKEELNLAVAHEHRLMDEYAKVSAKKEAKGRVIDSLHEEAMMWMDRFTFTLNGSQELPQLLAKAKAMVDVYTALEEIHGLLNYCQHMIDLMAHIIRSR

SEQ ID NO: 186307 - protein, 70 aa, Glycine max
  Coding DNA Sequence Number=SeqID_69529
MLSFRLSFSNYTKVPNHVIWCKGEQKSKGYFTKPHIVKNLLSQVKSGHRIEVASAAKGVFKTSSELSQKS

SEQ ID NO: 186308 - protein, 146 aa, Glycine max
  Coding DNA Sequence Number=SeqID_69530
  Subcellular localization annotation: CTP_CleavageSite=75; ConfidenceScore=5.13e-01
MVNYAHVTITSFLLPSTLPLATVHHHQRQFQATKPAPVKLQPLHNFALPLLNGVRTTSIIRNRLSLPLKPPPLHEAEHDNTDNSVHKPWNLRLRKPHSSPRPPSKSAPDLLHPHHSTSNNNDNNNPALKCQLRGHAVHGLRGGNSG

SEQ ID NO: 186309 - protein, 256 aa, Glycine max
  Coding DNA Sequence Number=SeqID_69531
MAPRKLLVKRSRKDTTGEGSSTAPHVDMDFDRHWFQSAPLVTPMAKFDPEIVMEFYANAWTTEEGCEYSQGRSQASGFDEEAITQLLCIPGQDFAQTAAGRRVSVHMAQLISNAIYQFAGIAPMRHPVDPEKSNRALGFPALITSLCQFYGMPVASSKRRTNSQLQICHRHLKRIELKMHRCMCNVTSQQAANHRGQRQLNETFYHYNLHQQSQDPSPFPWPTPKEFEAMVGWPRDETEFETQAGPAGTSRGGDEA

SEQ ID NO: 186310 - protein, 103 aa, Glycine max
  Coding DNA Sequence Number=SeqID_69532
  Gene Ontology: Mol. function=RNA-directed DNA polymerase activity; Biological process=RNA-dependent DNA replication
MDKIVDSIRPRREDKGPRDSLERSYNYLDESIWRGHRQPDCELQHDNGFGNHTPSIERAMTKKILPPLLDGGRNHKQLPDVCQSSEQFWRKLFTEEGYWMVSS

SEQ ID NO: 186311 - protein, 158 aa, Glycine max
  Coding DNA Sequence Number=SeqID_69533
  Subcellular localization annotation: CTP_CleavageSite=56; ConfidenceScore=5.02e-01
MVRQANPLTHRDKRGRLHPSSKSQRLVTETTLVSPSSSRDDKSDDMRRYLTVIRTSVNQRQASSLTCRDQHGHLHPLSKTQRLSTETTLVSPSSSRDDKSNDRWRHLTVVRTSVNQRQASLLTHRDQRGRLHPLSKTQRLSTKTTLVSLPSSRDKQVR

SEQ ID NO: 186312 - protein, 100 aa, Glycine max
  Coding DNA Sequence Number=SeqID_69534
MEYQSPPASEAPQQPGDDQQQAAGAPPPPPDSTSDHLPRLEWYIRHEVDQQAANHRGQFVAVVAWPGDWPEDQTGPVCGPGGEDEAEDDQDMVGLIDFLL

SEQ ID NO: 186313 - protein, 88 aa, Glycine max
  Coding DNA Sequence Number=SeqID_69535
MVIQFSTSRGSGLGLGLGLGLGLVLGLDQRTKWWELRESSRTKTVARREKVLTTLVFNLTCKHSLGKMDGEMEINRTLYNLHKMGHSP

SEQ ID NO: 186314 - protein, 123 aa, Glycine max
  Coding DNA Sequence Number=SeqID_69536
MVKNDEETSTESITEMSRKHYGSVSAWMFSFLLLLTNFNSPRRVGLLPPKAIPFFGIFQMGPGARLRSAEFRLDRPIAQSAKPVKRKSIKDIRCNNKSLGALKAIKMDNRDGLCMLSDLIVSG

SEQ ID NO: 186315 - protein, 113 aa, Glycine max
  Coding DNA Sequence Number=SeqID_69537
MSVLQTAKKNVYTDNHSGISARQRDSNVSMTDLVSAEDDVNLRVSTGLSAVIDEGRRRRPKKNVYTDNHSGISARQRDSNVSMTDLVSVEDDVNLRVSTGLSAAIDEGRRRRR

SEQ ID NO: 186316 - protein, 227 aa, Glycine max
  Coding DNA Sequence Number=SeqID_69538
MAQSNSSKLGFSALISALCIARGVISDSLTFESLNPAINLAYIKKNCWNLDDPTIEFSGICKARARGSEGPSSATPPAPASSAPAPSLTPAPFTSAPPFPPAHSPAPASSASSSSFECRCSKVAWPGVQPSPLGGGEASAAQEPQPKPEVAHEATLEATPRTSPVTSPIVEVSEGEEGPVDIDYVADLQAAQSTWDPWPTAAQETPQPAQDTPSSPHGEPAPTQDDC

SEQ ID NO: 186317 - protein, 296 aa, Glycine max
  Coding DNA Sequence Number=SeqID_69539
  Homolog annotation: Hit_ID=Q1ENZ3; Match level="QueryCoverage=77%, HitCoverage=72%, E-value=1e-46, Identity=49%"; Hit description =Remorin-related
  Pfam annotation: Domain name=Remorin_C; Domain location=183-294; Score=164.9; E_value=2e-46; Accession=PF03763.4; Description=Remorin, C-terminal region
MLNDQTPSTSHGTEQHHIDSAENEPQIREIYALTPPPRREPNFETHTHSHSHLSSSVSIEGGSSENFSMSREFSALVLAGSSIDHNITTPSQMSLDMMMHSDEGGVNSNNTNNNNNYNNLGRIEEDEVLMMEETNPLAIVADNNPLEAVSSSPPPPSRGGGTFSSSSATSGGGAVNEMTVQRVRKEEVEAKISAWQNAKVAKINNRFKREDAVINGWENEQVQKASSWMKKVERKLEEKRARALEKMQNDVAKAHRKAEERKASAEAKRGTKVARVLEIANLMRAVGRAPTKRSFF

SEQ ID NO: 186318 - protein, 74 aa, Glycine max
  Coding DNA Sequence Number=SeqID_69540
MEGVQGDILGVVRTEKLKKSLLLGRASFEKIKFPNENALIIWDRHRLKGALKPSVFTPKAYTSKSPSGPLPPDL

SEQ ID NO: 186319 - protein, 175 aa, Glycine max
  Coding DNA Sequence Number=SeqID_69541
  Gene Ontology: Mol. function=RNA-directed DNA polymerase activity; Cellular component=extracellular region; Biological process=RNA -dependent DNA replication
  Homolog annotation: Hit_ID=Q2HS45; Match level="QueryCoverage=96%, HitCoverage=32%, E-value=2e-40, Identity=42%"; Hit description=RNA -directed DNA polymerase
MEFHEKWLSWIHLCLKTVHYSITLNGDSVGYISPWRGLRQGDPLSPYLFILCIKGLSSLPKYHERRGVDEGETNTFKNILDSYGQASCQMINFQKSETFLSSNTPTKAKHEISSSLGRKKKTIFGYLTNRLWNHINHWSSNFLSKAGKEILINSVAQSIPTYCMSVFFLTLHFTR

SEQ ID NO: 186320 - protein, 118 aa, Glycine max
  Coding DNA Sequence Number=SeqID_69542
MDVYFEAQDTNKRVVVAFADNSGFVDNSWELIYNVRDKHLLINKREISLLKKLLYVTKNGNQTAQGYIKCNIDAAIFQDIHAFGIGICIRGGQVRCDFTNCTIDVMGLSQAQDSRYHI

SEQ ID NO: 186321 - protein, 83 aa, Glycine max
  Coding DNA Sequence Number=SeqID_69543
MVRRKTPCPKWVKEVQCREEEQNGRCSATRRNRMGGATSRERGSGMVGTLHRKELSHSEKARVRVARRRMGGAVPRGGGGATS

SEQ ID NO: 186322 - protein, 40 aa, Glycine max
  Coding DNA Sequence Number=SeqID_69544
MTLWHICILEGDAMNQIGGDIDSGFCAPGKTINMRDIDGD

SEQ ID NO: 186323 - protein, 337 aa, Glycine max
  Coding DNA Sequence Number=SeqID_69545
MAFLGLARPFSIGKYAHNGVVAHAVAVGVFVYLSLPLCVFFCLLHGSYAAPHGILQVLLLLGGVANGYLQVECFLQNCSVIGRQGLVLVWLVPLIRLVKVDLGDSFSLFTLLSGLSNFIPEYGHFFYLDVALGLARSMECNATSGLRFLIWTAVHPNLSMNFLRDSSSAYHRLAKKLSMDLGVSPPYQEGIQMLIWIYGSITLLEVEWFPPQGYVSLHNATSSMPCWTAKCERSALRPGGVRYEPPTNHGTFVKRKRGETCKTNDSDTQEWSVTVAPYGVAACGACRTWIFFINGFLCFLKVMAAEWRRKKDDWRRHFKEKISQEEAHYHRKPWTRA

SEQ ID NO: 186324 - protein, 340 aa, Glycine max
  Coding DNA Sequence Number=SeqID_69546
  Gene Ontology: Mol. function=DNA binding; Biological process=DNA integration
  Homolog annotation: Hit_ID=Q1SAI8; Match level="QueryCoverage=86%, HitCoverage=20%, E-value=3e-33, Identity=60%"; Hit description =Integrase, catalytic region
  Pfam annotation: Domain name=GRP; Domain location=93-179; Score= -20.5; E_value=0.0092; Accession=PF07172.2; Description=Glycine rich protein family
NKHFRAVTLEYEFSHTTMEAFSSVFAYCQHLKSLSDQLKNVDFPVDNSRLVLQLVFSLTEPYKRVATLIRQSDPLPQFYQARSILVLEEFCLKKAAQTSSSAMVARDLDESQEMSDHSSARLTNNGGKQYSNRGNSRKNRNNTGGCDNSGAGKGGFGGGGKSGGGNNRGGGQQQPQNNPWPAGQQWPWPWMQWVVPPCPYPATPWVRPNYQQTPRQQPGILGSRPQQAYTATTPTPTGIEAAMHTLDITPPDLNWYMDTGATSHMTSTSGNLTSYFNMSNHRGITIGNGQSIPIRAMPLMRCESRGALYPIIESTTPATSSSTFATLAHSLWHEQLGHPG

SEQ ID NO: 186325 - protein, 33 aa, Glycine max
  Coding DNA Sequence Number=SeqID_69547
SRSCGNRSTVDQGAIEDADFAMSLPHANGGTIK

SEQ ID NO: 186326 - protein, 51 aa, Glycine max
  Coding DNA Sequence Number=SeqID_69548
MVLPNEKSIKVEVAARNMLVAQGKSEAKDMRVIVEEFLSKAHYKQLHMFNP

SEQ ID NO: 186327 - protein, 85 aa, Glycine max
  Coding DNA Sequence Number=SeqID_69549
MQPKVAWGSKNRESRVARPGELSLPKRANLPFFFWRHHEHGPLRAGVRLLEPTPGCLATAFSACPEPGRDDDLSVMTLAFICIRP

SEQ ID NO: 186328 - protein, 106 aa, Glycine max
  Coding DNA Sequence Number=SeqID_69550
MHLLRGTLVDDWKFDYSSHDARRMVCIDQAYMTDRLLVGSLTFDCRIMHYIIVRILMPRSSNLAQAFEEDSILMWAFLIGRLIGWAHLIRYRMHKALQSSAPLPYP

SEQ ID NO: 186329 - protein, 92 aa, Glycine max
  Coding DNA Sequence Number=SeqID_69551
MDGQWLKKDAQPPQDECTPSPPPQRDDSSALMHEVLSKLRGLRTYVGERFDSLDGRIDAIDAHFEGMDTRITQLEEDVSYLRRCFDLPPPSS

SEQ ID NO: 186330 - protein, 153 aa, Glycine max
  Coding DNA Sequence Number=SeqID_69552
  Gene Ontology: Mol. function=oxidoreductase activity; Cellular component=vacuole; Biological process=response to oxidative stress
  Homolog annotation: Hit_ID=Q18PR1; Match level="QueryCoverage=83%, HitCoverage=40%, E-value=1e-51, Identity=79%"; Hit description =Peroxidase
  Pfam annotation: Domain name=peroxidase; Domain location=43-153; Score=50.8; E_value=3.3e-12; Accession=PF00141.13; Description =Peroxidase
  Subcellular localization annotation: CTP_CleavageSite=44; ConfidenceScore=5.48e-01
MANSLNSHFFVVVFILSLLAFSSNAQLSPTFYAKTCPNVQTIVSSAMRQAVAKEARIGASILRLFFHDCFVNGCDGSILLDDTATFTGEKNAGPNRNSARGFEVIDTIKTNVEASCNATVSCADILALATRDGVVLVSQLSIISLANSSSITN

SEQ ID NO: 186331 - protein, 139 aa, Glycine max
  Coding DNA Sequence Number=SeqID_69553
  Gene Ontology: Mol. function=hydrolase activity, hydrolyzing O -glycosyl compounds; Biological process=carbohydrate metabolic process
  Homolog annotation: Hit_ID=Q9LTN0; Match level="QueryCoverage=65%, HitCoverage=16%, E-value=2e-24, Identity=54%"; Hit description =Arabidopsis thaliana genomic DNA, chromosome 3, P1 clone: MTC11
THLLLEVASPLSLPFSIPLPFIFQEAKESIDEEDPRPTSSNGACITNQVCGKVTADIKQRSTFLVDQGWPLFVSEFGGDLRGTNVNDNRYLNCFLALVAELDLDWAYWTLVDSYYFREGVIGMEEFYGLLTWDWIQITR

SEQ ID NO: 186332 - protein, 60 aa, Glycine max
  Coding DNA Sequence Number=SeqID_69554
MVEACVESTSKDKKESSSDATRNPWGALCTDLSGSLALAFGHVHTLDVVYDRGGHCALTF

SEQ ID NO: 186333 - protein, 145 aa, Glycine max
  Coding DNA Sequence Number=SeqID_69555
  Gene Ontology: Mol. function=monooxygenase activity; Cellular component=membrane; Biological process=electron transport
  Homolog annotation: Hit_ID=Q1S220; Match level="QueryCoverage=78%, HitCoverage=22%, E-value=4e-44, Identity=75%"; Hit description=E -class P450, group I
MLMRQASKDVMLGSINVPAKTQLFLALAVVHHDREILGDDHNFNPMRFSEPRKHLAAFFPIGLDPRICVGQNLAMLEAKIALALIIQSYNFVVSLNYMHAPILFVTLQPQYGAQIIFKDFILKIVVVFFLFCLRVTLNSICGDAL

SEQ ID NO: 186334 - protein, 92 aa, Glycine max
  Coding DNA Sequence Number=SeqID_69556
MKALQKLEEQGSIFSFKSMRLFGYNKEKQFEMVKRAWDENASSTSSDSNNEEKENLYLMADGDVESIPSTFDSEIDLDENYDKLLDAFNEMH

SEQ ID NO: 186335 - protein, 82 aa, Glycine max
  Coding DNA Sequence Number=SeqID_69557
MSEEDDVIEVNIDIEDVGAIEEVLAGAFEGRIIIGVKVVKAEDDGEAGREGATCGLGNTLLLVGATPRITEGATTKGDKGRR

SEQ ID NO: 186336 - protein, 830 aa, Glycine max
  Coding DNA Sequence Number=SeqID_69558
  Gene Ontology: Biological process=vesicle docking during exocytosis
  Homolog annotation: Hit_ID=Q2RA23; Match level="QueryCoverage=91%, HitCoverage=92%, E-value=0.0, Identity=48%"; Hit description =Expressed protein
MAKQSSRAHFISWEVCYKPQIEGWIESRLGNLICRSMALAVQWLWPPSDYLVLSKFPYILFEHTKVVVDWNSNSNPARKLVVITSSLLSDAHRIQTAHSAFPDSPLGPDAYHEYESLLVQDYEELVKKSGIKPGQAKHNFEDGGRSEFSSSGENVLNLEASSSGRDFYEHNPLDYIEDAVLKLVVSVHHFPMILCPISPRVFVLPAEGLVAEAYLSAEHEDSISPGLPPLSTGMLSDADDVPPGATLTAHFLYHLAAKMDLKMEIFSLGDISKTVGKILTDMSSLYDVGRRKQSAGLLLIDRTLDLLTPCCHGDSLVDRMFSSLPRRNRTFSHGSGSQLKLGSSYLQRAPLDVQIPLAKILNEEDWQIDNFRLLETVEAFLCGWNSGDSDSQVEGLINLSQKIHDKPSQSDVEILTGSFISSENFRGMPLLEAILDRKTKDGALLIKKWLQESLRRENLTVNVKSRPGLVTKPELQAMIKALSRSQSSLLRNKGIIQLASATLFSLDESNYAKWDAFSSAEKILGVSSGETSQSLAIQIGDLINKSALLGSHVNEGKREISKGLLSLQDALLLMIIGYILAGENFPTSGSDGPFSWQEEHLLKEAVVDALLENPSVANLKFLDGLREELETNVSKYKSEETAEEPSKLDIDDFDDQWGKWGDEDVDDDNKNEKVYGDVQLKLELRDRVDKFFKFLHKLSGLKRKNIPLRDGSLTTEANFDEDRKGLLYKLLTRVLGKYDVPGLEYHSSTVGRLFKSGFGRFGLGQAKPSLADQNVILVFVIGGINGLEVREAHEALAESGRPDIELLVGGTTLLTSNDMLNLLLGDSSYI

SEQ ID NO: 186337 - protein, 56 aa, Glycine max
  Coding DNA Sequence Number=SeqID_69559
MEDTPELKEEDFKCFGGKLMQKLEEKALKKRVEEGTARLVHKPGPMRLLAQRPAQA

SEQ ID NO: 186338 - protein, 113 aa, Glycine max
  Coding DNA Sequence Number=SeqID_69560
  Homolog annotation: Hit_ID=Q2RA23; Match level="QueryCoverage=43%, HitCoverage=5%, E-value=2e-12, Identity=68%"; Hit description =Expressed protein
MATVDVIKSCIGSIRQQNSTMGEIGCILVYIGVPGHLDKTVPSISENLHLKRQEVFTELILRLEEISEHIQDAIVYLDAGSTESFQFIGAYPVLLELGARAICSLENMCALDV

SEQ ID NO: 186339 - protein, 58 aa, Glycine max
  Coding DNA Sequence Number=SeqID_69561
  Homolog annotation: Hit_ID=Q8RZ40; Match level="QueryCoverage=89%, HitCoverage=21%, E-value=6e-07, Identity=30%"; Hit description =Lipase-like
MGMEVVIDTRKSPSLKDSKNPSDWENLQDEYGMPRSWWMEKNKGMAKRGDGEWFGSAG

SEQ ID NO: 186340 - protein, 103 aa, Glycine max
  Coding DNA Sequence Number=SeqID_69562
MCIFEHHFSPKGYRNGITNFNPLDRGRVHVYVGESGSGTGGKYSSPSCPVAMSRSNIDDNIAHNERSEDNAKVTTLESTVVEGEKDFIFNHVDANNNVIVILE

SEQ ID NO: 186341 - protein, 61 aa, Glycine max
  Coding DNA Sequence Number=SeqID_69563
MTLAPRCCPPNPRTMSPVCAYSLGDTYGFHLLDTSDFFCKMKSLSTLLLRILRCDEKFKPT

SEQ ID NO: 186342 - protein, 321 aa, Glycine max
  Coding DNA Sequence Number=SeqID_69564
  Homolog annotation: Hit_ID=Q5JJM4; Match level="QueryCoverage=44%, HitCoverage=21%, E-value=3e-11, Identity=38%"; Hit description =Peptidylprolyl cis-trans isomerase-like protein
VESTTIEKEELAKIVADLQAQLKESESKLEESELRASKGREVSKELEEELDLDLGIFYPTKDMKDGELLREEEIVAAKEYVDEEQDVLANVLSIILVVLPFTLWSFSPNACEEVDLGFDEPLEMRDSPRADLGFDEPLECETHQGWTLGLTSLWRSKTPQGADLGFDKPLVMQDSPRADLGFHKPLEKRDSPREDLGLDEPLEKRDSPRANLEFDEPLEMRDSPRADLGFDEALEMRDSPRVDLGAELGFDKPLVMQDSPRENLGFIEPLEKQDSPRTYLRFDEPLEKSIKAHQADLGFDEPLKKRDSPRVNLGFNEPLYG

SEQ ID NO: 186343 - protein, 163 aa, Glycine max
  Coding DNA Sequence Number=SeqID_69565
  Gene Ontology: Mol. function=RNA-directed DNA polymerase activity; Biological process=RNA-dependent DNA replication
MASMLYVSQKGVSLIVVWGFKDDPIGCLHLTIGLGDGIRKTISVYEELDCSWGLWQGSQYVHPPHGKRPRVAQATKVVRRGTHHFGCKGVSLDMEVVDSFMNLSRDIVCLLAIEAFQQGWGHPIWFLLLSCHDLTGFYGLSLECLLDDHFEMLDLFSVGQFGE

SEQ ID NO: 186344 - protein, 49 aa, Glycine max
  Coding DNA Sequence Number=SeqID_69566
MKFGLLRGVIWARIELDMAGRKIGGMRHNRLHKYGNRLPESNFSRNNCL

SEQ ID NO: 186345 - protein, 254 aa, Glycine max
  Coding DNA Sequence Number=SeqID_69567
  Subcellular localization annotation: CTP_CleavageSite=51; ConfidenceScore=5.28e-01
MAEPSKKRKGTSSRSQRHSGSQEAPIPPSIPSGSLFSSEEQRTRYTNLFSSCSIVDPKFIDMEFFSNENFECFQAFENSNLIPFMSLKLPVYSELVKAFYSNLEIHEGALIDEWKFDFSVHDARRLVCTNQADMTGRLLAGSLAFESRILHYLIVRILLPRSSNLAQVSEEDLTVMWAFHKGLQIDWAHLVRYRMHKALRLNAPLPYPHLVTLFLQHFNIPLDFEPYVPIKRSFLIGASVIASFGYIKEHDGSW

SEQ ID NO: 186346 - protein, 86 aa, Glycine max
  Coding DNA Sequence Number=SeqID_69568
MPISPCESIGWSVPSRHKDRAHKTPSGPGEVQQGPGVSSFGYGPLSVLQGARSPQQGIAPARHPVDPEKSNRVLGFPALITSLCQF

SEQ ID NO: 186347 - protein, 133 aa, Glycine max
  Coding DNA Sequence Number=SeqID_69569
  Gene Ontology: Mol. function=chitin binding; Cellular component =extracellular region; Biological process=chitin metabolic process
  Homolog annotation: Hit_ID=UPI000044ABC7; Match level="QueryCoverage =91%, HitCoverage=45%, E-value=9e-14, Identity=31%"; Hit description =PREDICTED: similar to retinitis pigmentosa 1-like protein 1, partial
RIPPFRGLHILTIRGLHVLTFRVLHALAIRGLHVLTIRGLHVLTFKGLHVLTIRGLHILTYRGLYILTFRGLHVLAIRGLYALTFRGSRTLTFKGLHVLTFRGLHVLTFRGLHVLTIRGLDVLTFQKATRSRL

SEQ ID NO: 186348 - protein, 862 aa, Glycine max
  Coding DNA Sequence Number=SeqID_69570
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q8S3L6; Match level="QueryCoverage=98%, HitCoverage=98%, E-value=0.0, Identity=76%"; Hit description =Putative trehalose synthase
  Pfam annotation: Domain name=Glyco_transf_20; Domain location=63-548; Score=834.2; E_value=6.9e-248; Accession=PF00982.11; Description =Glycosyltransferase family 20
  Pfam annotation: Domain name=Hydrolase_3; Domain location=596-841; Score=-81.5; E_value=0.021; Accession=PF08282.2; Description =haloacid dehalogenase-like hydrolase
  Pfam annotation: Domain name=Trehalose_PPase; Domain location=597 -832; Score=331.4; E_value=1.5e-96; Accession=PF02358.7; Description =Trehalose-phosphatase
  Pfam module annotation: Pfam domain module=Glyco_transf_20::Hydrolase_ 3::Trehalose_PPase; Domain location=63-548::596-841::597-832
MMSRSYTNLLDLASGNFPAMGGRETRERRRLPRVMSVPGFITEVDDDQAVSVSSDNPSTVTTDRMIIVANQLPLKAKRKEDNKGWSFSWNEDSLLLQLKDGLPDDMEVLYVGSLRVDIDPAEQDDVSQYLLDKFKCVPTFLPADVLAKFYDGFCKRQLWPLFHYMLPFSTDKSHRFDRSLWEAYVLANKLFFQKVVEIINPEDDYIWIHDYHLMVLPTFIRRRFNRVKMGFFLHSPFPSSEIYRTLPVREEILKALLNSDIIGFHTFDYARHFLSCCSRMLGLEYQSKRGYLGLEYYGRTISIKIMPVGIHMGRIESVMRMADEECKVKELKQQFEGKTILLGIDDMDIFKGINLKILAMEQMLRQHPKWQGRAILVQIVNPARGKGIHLEEIHAEIQESCNRINRVFGRPGYEPIVFIDRAVPIAEKVAYHSMAECVIVTAVRDGMNLTPYEYIACRQGISGSESCSNVSDPKKSMLVISEFIGCSPSLSGAIRVNPWNVEATSEAMNEAISMSDGEKQLRHEKHYRYVSTHDVAYWSRSFLQDMERACTDLLRKRCWGIGLSFGFRVVALDPNFKKLSIDAMVSAYKRAKNRAILLDYDGTVMPQNSINKSPSKEVLSILESLSADPKNVVFIVSGRGRNSLSDWFDSCEKLGIAAEHGYFLRWSHGGEWENCGKSSDFGWMQIAEPVMKQYTEATDGSSIERKESALVWQYRDADLGFGSAQAKEMLDHLESVLANEPVAVKSGQFIVEVKPQDVSKGLVAEKIFSSMHRKGKQADFVLCVGDDRSDEDMFEIVSSAISRNILASNASVFACTVGQKPSKAKYYLDDTTEVTSMLESLAEESDASPCIEETGDSSWRPV

SEQ ID NO: 186349 - protein, 76 aa, Glycine max
  Coding DNA Sequence Number=SeqID_69571
MTHNLLVTHAVLSHISRWSPKSAQSVTTYDMESGELNFNFQAGTTLLVVGQLEAKAIFLEVEQEAPWNDLHTPHPT

SEQ ID NO: 186350 - protein, 51 aa, Glycine max
  Coding DNA Sequence Number=SeqID_69572
MTTENLWFWNVLEKQRGGLPEVNSYKALENITCMSLIRLKLVQISKVKSRF

SEQ ID NO: 186351 - protein, 212 aa, Glycine max
  Coding DNA Sequence Number=SeqID_69573
  Gene Ontology: Mol. function=transferase activity, transferring nitrogenous groups; Cellular component=mitochondrion; Biological process=amino acid metabolic process
  Homolog annotation: Hit_ID=Q42803; Match level="QueryCoverage=91%, HitCoverage=44%, E-value=1e-105, Identity=96%"; Hit description =Mitochondrial aspartate aminotransferase precursor
  Pfam annotation: Domain name=Aminotran_1_2; Domain location=1-212; Score=-7.5; E_value=5.4e-07; Accession=PF00155.11; Description =Aminotransferase class I and II
MGGSIKMIEESLKLAFGDNSEFIKDKRIAAVQALSGTGACRLFAAFQQRFHPNTQIYIPVPTWAKNYSHHNIWRDAGVPMKTFRYYHPESRGLDFSGLMDDIKNAPDGSFFLLHACAHNPTGVDPSEEQWREISSQIKAKGHFPFFDMAYQGFASGDPERDAKAIKIFLEDGHLIGLAQSYAKNMGLYGQRAGSLRLFSGISCGWGVAYVGP

SEQ ID NO: 186352 - protein, 124 aa, Glycine max
  Coding DNA Sequence Number=SeqID_69574
  Gene Ontology: Mol. function=transferase activity, transferring nitrogenous groups; Cellular component=mitochondrion; Biological process=amino acid metabolic process
  Homolog annotation: Hit_ID=Q42803; Match level="QueryCoverage=84%, HitCoverage=22%, E-value=1e-42, Identity=81%"; Hit description =Mitochondrial aspartate aminotransferase precursor
MKKLWQQIEIGLTLIVSLQVMADRIIGMRTTLRENLEKKGSTLPWQHITNQIGMFCYSGLTPEQVDRMTNEFHIYMTRNGRISMAGLNTGNVGYVADAIHEQHLAFHHQYVRRTGQSSGGPILK

SEQ ID NO: 186353 - protein, 60 aa, Glycine max
  Coding DNA Sequence Number=SeqID_69575
SLSSIPQIFQADKDLHLARQGALRATSQLDNTGLASRLAKPNSKNLKNKEILALSMTGHA

SEQ ID NO: 186354 - protein, 115 aa, Glycine max
  Coding DNA Sequence Number=SeqID_69576
MYEKGMDKSEDVATNERVNVEASHNDKLNLLLRGNDFSLFHLRCCRNDACMKPNWVFLAKEKPQPSGERPSTRNTFEVVLQQVSMRNNDFLNDYLTESEKHNLSILEKLPRRLSA

SEQ ID NO: 186355 - protein, 181 aa, Glycine max
  Coding DNA Sequence Number=SeqID_69577
MTLAWHGDKMASVWHMMLGWIPGMSNSCHMNWQIHIEYIILVTQTCFVNGQGSYWRPFIHANDLTATTRLKYVYGAALINEDLGHHAIGDHDEEDYGVVLVDRVDALEVSVDECYGRETSWEWFVNTIDVDILDNMEMTLLGLARLSSIGKFACNGVDYTSNLLGELIFLFLQRSLLVSCW

SEQ ID NO: 186356 - protein, 94 aa, Glycine max
  Coding DNA Sequence Number=SeqID_69578
MLDKGVKVVDGPWRESSIPCQCCSFEECWENPTKDCVIIGVEICHYRLSGFQPKGRSASMTLLVYIHALCRESACHPGGVSPEPPSGRGQPLAL

SEQ ID NO: 186357 - protein, 143 aa, Glycine max
  Coding DNA Sequence Number=SeqID_69579
MPLRASSWWCTPAKHFGGPSVSPTTTTLAFYELCLVPDIVIPPKFKVSDFNKYKGTTCPKNHLKYQYNSDMAPDRMQLQNISSSTPNDREGDDNNDSGHITSVPDAILPPRALDRRLQEDCARDAREGPRVLMSLRIDFWPMG

SEQ ID NO: 186358 - protein, 282 aa, Glycine max
  Coding DNA Sequence Number=SeqID_69580
  Gene Ontology: Mol. function=RNA-directed DNA polymerase activity; Biological process=RNA-dependent DNA replication
  Homolog annotation: Hit_ID=Q47522; Match level="QueryCoverage=16%, HitCoverage=58%, E-value=3e-21, Identity=100%"; Hit description=LacZ protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLSHPRAHSHRREKERKPQEANINLSYFHGKNNIEAYLDWEMKVPLATLCFQGALRKSYIPSYYERELMDKLQRLRQGSMSVEEKEERTSIARFLSGLNMEVRDKVELLPYRDLDDLVQLCIRVEQQLKRRPTSKYYGSHSYPKKDQGRGILGAAPSKPKNDKEKTIERQPPKA

SEQ ID NO: 186359 - protein, 78 aa, Glycine max
  Coding DNA Sequence Number=SeqID_69581
MVATPDIFPPLESAPVNLALAHPRKRARCDTYGCSIHMTRDASKFTHISPKNSGHVTYGDNNKAKIMIHGYGIRELPI

SEQ ID NO: 186360 - protein, 188 aa, Glycine max
  Coding DNA Sequence Number=SeqID_69582
MTRRLLAGSLALESRILLYLIVHILLPRSSNLAQRQIDWAHLVWYRMHKALRLNAPLPYPHLVTLFLQHFNIHLDSEPYVPIKRSFLIGAVVVASFAYHKERDSSWVKKGAQPNDDEGHLPVEGDSSLHQSILDRFDGLQTYIGERFDSLERQVDTRFEEMNSRIAKVEEDVTIIRNCFDLPPPPPSV

SEQ ID NO: 186361 - protein, 87 aa, Glycine max
  Coding DNA Sequence Number=SeqID_69583
METETSSFTLSDKNLNIIQQDDQPSSMDDERQIKTLTREQDLWLVSTVPIKESSNLLCLMSLRHIKIAASIPISIKGLMATCTHPMM

SEQ ID NO: 186362 - protein, 511 aa, Glycine max
  Coding DNA Sequence Number=SeqID_69584
  Gene Ontology: Mol. function=DNA binding; Cellular component=integral to membrane; Biological process=regulation of transcription, DNA -dependent
  Homolog annotation: Hit_ID=Q66C67; Match level="QueryCoverage=94%, HitCoverage=92%, E-value=1e-170, Identity=64%"; Hit description =Possible CorC/HlyC family of Mg+2/Co+2/heavy metal efflux pumps
  Pfam annotation: Domain name=CBS; Domain location=307-421; Score =87.4; E_value=4.3e-23; Accession=PF00571.18; Description=CBS domain
  Pfam annotation: Domain name=CorC_HlyC; Domain location=438-505; Score=20.2; E_value=0.0018; Accession=PF03471.7; Description =Transporter associated domain
  Pfam annotation: Domain name=TerC; Domain location=13-119; Score =126.6; E_value=6.9e-35; Accession=PF03741.6; Description=Integral membrane protein TerC family
  Pfam module annotation: Pfam domain module=CBS::CorC_HlyC::TerC; Domain location=307-421::438-505::13-119
MWEWIIDPSLWAGLVTLIVLELVLGIDNLVFIAILVEKLPPTLRDRARVFGLLLALVSRLVLLASLSWLVTLTQPLFTLFQHSFSARDLMLLGGGIFLLFKATTELNARLEGSDEESGQNNSGAKFWPVVAQIVVLDAIFSLDAVITAVGMVNDLPVMMIAVTIAILLMLLASKPLTRFVNGHPTIVILCLSFLLMIGFSLVAEGFGFVIPKGYLYAAIGFSIVIEIFNQLALFNRRRFLTAGRPLRQRTAEAVLRILRGEAQRADLDADTASLLSDNQGAALFNRQERRMIMRVLGLGQRQINSIMTSRHDVEHIDLSEDPQSIMDKLDRNQHTRLLITEQGREPLGVVHVIDLLHQSLHSKSLDLRALIRQPLVFPERVTLLQALEQFRHARTHFAFVVDEFGSVEGVVTLSDVMETIAGNLPNEGEEIDARYDIQPAEHGGWIANGHMPLEDLALYVALPLDERRNYHTLAGLLMDSLQHVPAEGWAFMRTGIGFIAAVHTSGYPATD

SEQ ID NO: 186363 - protein, 120 aa, Glycine max
  Coding DNA Sequence Number=SeqID_69585
  Gene Ontology: Mol. function=receptor activity; Biological process =xylan catabolic process
  Homolog annotation: Hit_ID=Q6JN46; Match level="QueryCoverage=87%, HitCoverage=10%, E-value=3e-22, Identity=46%"; Hit description=EIX receptor 2
LSHNYLTGKIPTSTQLQSFNASSYEDNLDLCGPPLEKLCIDKGLAQEPNVEVPEDEYSLFSREFYMSMTFGFVISFWVVFGSILFKRSWRHAYFKFLKNLSDNIYVKVAVFANKISKVHD

SEQ ID NO: 186364 - protein, 251 aa, Glycine max
  Coding DNA Sequence Number=SeqID_69586
  Gene Ontology: Mol. function=nucleic acid binding; Cellular component= chromatin; Biological process=DNA integration
  Homolog annotation: Hit_ID=Q1RWP6; Match level="QueryCoverage=97%, HitCoverage=18%, E-value=3e-45, Identity=43%"; Hit description=Zinc finger, CCHC-type; Polynucleotidyl transferase, Ribonuclease H fold
MSLRERLSSITKGTSSISTYLLLICNIVDELALIGHPIDDLEMVIHTLNGLGPIFREFTASIRTRDSPISFNELYDKLVDFEMYLQREERLSTNIPVTANVVQHHQHDQGRGYFSHGRQHNHHVSSSNKKSTNLITYQYCEKPGHSTKHCYKIHGYPKKPRQPTANVVQTTSSHSPPPSSHSPPSSWLFDSGASHHITNDLTNLTLKDDYHGYDNLQVANGNQLLITHIGSTTIPTNGSPLKLSDILYVPN

SEQ ID NO: 186365 - protein, 56 aa, Glycine max
  Coding DNA Sequence Number=SeqID_69587
MAISGYTLIPVKAITRSITCWAVKAQINRLWKTVEHANGNAIRRFNVKSKLILLFV

SEQ ID NO: 186366 - protein, 98 aa, Glycine max
  Coding DNA Sequence Number=SeqID_69588
MMTTDITKLNSMFHLFPERENAEGRCLRDVVNNPIAYTVNQICHDKQVLRMFHSKEFLIVAQELAAKTIAQRSSIENTKMITGVKVLAEAEIMHPKLH

SEQ ID NO: 186367 - protein, 78 aa, Glycine max
  Coding DNA Sequence Number=SeqID_69589
MNQAIEIFTKKVQEAKLVLLKHGSIFKAETLIHEFPLHFKTSCAFSINSGKTMDNVSKIKTEFGFEDENRPPHAARQS

SEQ ID NO: 186368 - protein, 176 aa, Glycine max
  Coding DNA Sequence Number=SeqID_69590
  Subcellular localization annotation: CTP_CleavageSite=57; ConfidenceScore=5.01e-01
MSRYARSSWLLKQNDADTKHACALSVNSILRYSEKFRKRKAPSTPTQDRFDRSRFTSQEALERYTDIVVPRKLLPERNVVVYYTEFDEFKEELEIHHWDEELTNFLDDNIDVAIVKEFYANLYDPEDKSPKQVRVRVHLIKFDEDTLNSFLKTPVVVEEGEKICASSRFALLRLDP

SEQ ID NO: 186369 - protein, 119 aa, Glycine max
  Coding DNA Sequence Number=SeqID_69591
MEHISIHVAQLISDVIHQFVGTKPLRHPVDPEKSNKALEQDQQPQSAADAPPPRQPPSLESISAHMQRMELQMHTYMRHLADQQAANHRGQMQLNDNFCPYTLHQHRQDPSLYPWPTPE

SEQ ID NO: 186370 - protein, 192 aa, Glycine max
  Coding DNA Sequence Number=SeqID_69592
MNLKDKRFGSCLREGKLWFHLVTFKIIKRGLAKKLRVEIAQQLAQASCLLPPEVTLLAQASSARPGELVTSALSFLVGPGAKKCPKSDPFAILLGSKDKDTNFIPAISPSDRPIVEAPAAKPVKRRIIKGIRAEDIDSLRKTIDFDSLVRVKKADDHDCLRMMTDFDSLENVKKADDHDCLHKPTDLVVLKI

SEQ ID NO: 186371 - protein, 213 aa, Glycine max
  Coding DNA Sequence Number=SeqID_69593
  Gene Ontology: Mol. function=pyruvate kinase activity; Biological process=glycolysis
  Homolog annotation: Hit_ID=Q1RYJ8; Match level="QueryCoverage=87%, HitCoverage=35%, E-value=4e-71, Identity=66%"; Hit description =Pyruvate kinase
  Pfam annotation: Domain name=PK; Domain location=105-213; Score= -209.5; E_value=7.6e-05; Accession=PF00224.11; Description=Pyruvate kinase, barrel domain
  Subcellular localization annotation: CTP_CleavageSite=56; ConfidenceScore=5.80e-01
MSQVVATRSIHSSLTRPTSGSAHHRAQTLLKPPTFASKLFGAQRNNPSKVCSRSCLVNARKSAPAKVVPVSPEDDSKIEEELQHLRGMQQLGDTSVGMWSKPTFRRKTKVVCTIGPSTNTREMIWKLAEAGMNVARLNMSHGDHASHQKIIDLGPEVRSGDLPQPINLTTGQEFTFTIRRGVGTADCVSVNYDDFVNDVDVGDMLLVDGMATN

SEQ ID NO: 186372 - protein, 187 aa, Glycine max
  Coding DNA Sequence Number=SeqID_69594
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=93%, HitCoverage=19%, E-value=1e-58, Identity=66%"; Hit description =Kinesin-like protein
  Pfam annotation: Domain name=Kinesin; Domain location=1-184; Score= -72.5; E_value=1.1e-09; Accession=PF00225.13; Description=Kinesin motor domain
MPSDIVHSVLDGYNGIVMAYGQTRIGKTFTLGQLGEEDTSDRGIMVCSMEDILADISLGIDFVTVSYLQLYMEALQDFLNPANDNIPIVEDPKTGDVSLSGDTSVEIKDQPSFLELLRVGETHRIAANTKLNTESSHSHAILTVHVKRFVVDCEDVVSTKNNDASHLTKPSKPIFRKSKLERASWLW

SEQ ID NO: 186373 - protein, 621 aa, Glycine max
  Coding DNA Sequence Number=SeqID_69595
  Homolog annotation: Hit_ID=Q1RYJ7; Match level="QueryCoverage=99%, HitCoverage=49%, E-value=0.0, Identity=66%"; Hit description =Timeless protein; Timeless C-terminal
  Pfam annotation: Domain name=TIMELESS_C; Domain location=422-621; Score=-170.0; E_value=0.0034; Accession=PF05029.4; Description =Timeless protein C terminal region
MDGSKAVIKGNPNSSHNVLLKAQNVTRGPTKRTVWDHPRLPSTEDKILELLHGFVNQFLSGGYNVLMRSIREDIEKEHPSIQKSDVVVFFQVAEFVTSFQCYKYSASKTTEGGDTFETFSHKDADTSDFSGQICGPIAASLNESMFQLVISKWRHAYDGLKETNDYQFLSAAGSLLKNMIRMLDLILKLLPEDSKEPQTARILLYKLFYDQTEEGMTQFLLNLIKTFDTHKQPKRYPIVVIYLVEIIHKVVKLMDNLQSRGALRVSRKSRKVKKKIIPEGTESGDKLAGDHSFIQNETGISTVNQSAENQPLQEGLPNANSTGEDVIPDDNEHENHVEEVGNSQVGLEPMGATNSEHVNEDMLDGTKDFSEDEQLHAYNEVDFKVSTLVSAFANHNIIQKLCWLLKFYKSNSLATNHYIISMLRRISDDLELHPMLYQLSLLTTFYDILVEQKSCPCKDYAGIVDFLTCLVRKMLKKMKKQPLLFVELLFWKTRRECHYINAEYLLSELGHLKKESANWNNTQGDEEIGSSPAKVWTRRSIADALGEDEADVVITHDSGYQKDKLDDVIKGFAPTSGSNSDKDDHNGEQLMEDESQIAPRRRKKLVLDGDLERQIKDLHEK

SEQ ID NO: 186374 - protein, 100 aa, Glycine max
  Coding DNA Sequence Number=SeqID_69596
  Subcellular localization annotation: CTP_CleavageSite=32; ConfidenceScore=5.03e-01
MTTLVSVCYHALGLMDSKRMLIPITTQRLMVRGRRRKSLRVNGLGPRLTKGAEDDVRITIRYPRMSSDSLSLDDKGVDDDIDCAEKLLVYFRTSPDLRVK

SEQ ID NO: 186375 - protein, 271 aa, Glycine max
  Coding DNA Sequence Number=SeqID_69597
  Gene Ontology: Mol. function=peptidase activity; Cellular component =integral to membrane
  Homolog annotation: Hit_ID=Q1RYI7; Match level="QueryCoverage=90%, HitCoverage=71%, E-value=1e-112, Identity=87%"; Hit description =Abortive infection protein
  Pfam annotation: Domain name=Abi; Domain location=179-269; Score =93.4; E_value=7e-25; Accession=PF02517.7; Description=CAAX amino terminal protease family
MAETDGAGVDSGGKEASSIFKLEWGGHNCHSWCGTLDSSLDSKDHCSVSSHLEEQTKLGSAGSWIVPFLAYTAGFRKESLTYRGQALCSLLTDVAEGVVGIAILRHCLAKFQPLSSDWFKFEVKGKWQFDVGLGCLMFPLINQLSQMNLNLLPVLQYTPVTISSVEQSIVARDPVAMALYAVVVSVCAPIWEEIVFRGFLLPSLTKYMPVWSAILVSSIAFALAHFNIQRMLPLVFLGMVMGTVFVRSRNLFPSMLLHSLWNAFVFLDLMK

SEQ ID NO: 186376 - protein, 278 aa, Glycine max
  Coding DNA Sequence Number=SeqID_69598
  Homolog annotation: Hit_ID=Q9FLX1; Match level="QueryCoverage=77%, HitCoverage=95%, E-value=3e-31, Identity=43%"; Hit description =Arabidopsis thaliana genomic DNA, chromosome 5, P1 clone:MXC20
METSQPLSIESFSYSWLVNLRPSSLESLESSLRTSLDASDEASFIEMDPRMPPSKRFFKNSQDSKFDFPISQSPLTLVHADELFSNGYLMPLFVESLQMEEYESSDSNTSLVSSSSHAPTSEAPTGPSRCLSLKRCRTLSRRVFQKYLNFLRPLCRKLRVHKSSTEAVAKRGEAVKNRRYYSDTTSPRTSVAFSADDWRYSCDSESSIYEAVLHCKRSIDFWSSNISTLCLWQENELRNLQKGKEKMKINEKGLKSIHCHCKTFYTMREKSMELCCYS

SEQ ID NO: 186377 - protein, 153 aa, Glycine max
  Coding DNA Sequence Number=SeqID_69599
  Gene Ontology: Mol. function=protein serine/threonine kinase activity; Cellular component=integral to membrane; Biological process=protein amino acid phosphorylation
  Homolog annotation: Hit_ID=Q19VG4; Match level="QueryCoverage=97%, HitCoverage=44%, E-value=5e-50, Identity=66%"; Hit description =Serine/threonine kinase protein
MYCQPSNILIDANFQAKLSDFGLSRVMDLGQSYVSSEVRGTFGYIDPEYRTNHHVKASGDVYSFGIVLLQLLSGQRVLNIDFQRPMSLGKMARDVVRGGDMSEFADPKLKREYSVEAFDIVLKLALSCIGLKQQRPSIEQVLYSLEKALDISL

SEQ ID NO: 186378 - protein, 180 aa, Glycine max
  Coding DNA Sequence Number=SeqID_69600
DKDNVDDTVCKKYDTSKEKWTQFCQSRRDPSWEGVLKKAQTIQKLNIFLHVLSCGGYEFLENKLMEEKKSKQLEEATKSGSIDTIIDPPSPIRRHVKWKMACTKKTCQMMSEAAKKIADKIVNSFVAHGRQDVLTAAIGQPEHPGRVCAAGAGVTIKQYFGQLQGPLAHLCPWFPKTWST

SEQ ID NO: 186379 - protein, 92 aa, Glycine max
  Coding DNA Sequence Number=SeqID_69601
MEDARTALGINSWGSGLDGGGCMNSARQSIHWAPDSMMEDARTALAINSWGSRLDGGGCTNSARKSIRGAPDSMVDDAQTELGNQFMGLQTQ

SEQ ID NO: 186380 - protein, 148 aa, Glycine max
  Coding DNA Sequence Number=SeqID_69602
  Gene Ontology: Mol. function=unspecific monooxygenase activity
  Homolog annotation: Hit_ID=O04892; Match level="QueryCoverage=63%, HitCoverage=17%, E-value=3e-28, Identity=79%"; Hit description =Cytochrome P450 like_TBP
MESRAPSGPFLPAPLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 186381 - protein, 41 aa, Glycine max
  Coding DNA Sequence Number=SeqID_69603
MAASTYLDLDEKGIRLIVRKSTSGTCHLLESSLVSWNCKKQ

SEQ ID NO: 186382 - protein, 115 aa, Glycine max
  Coding DNA Sequence Number=SeqID_69604
MIVEKFLQKVAWPRVEPSPLGGGKASAAQEPQQEQKEDILEASEPSPPEPFIFEIDLVAATPQVTPEPSTAMLDLSSSQTEPSAPVPDLPLPQDSSAGTPALDLNEHAMDSTQDH

SEQ ID NO: 186383 - protein, 96 aa, Glycine max
  Coding DNA Sequence Number=SeqID_69605
MKLLLEAENEIAENEFYCYVNSAHEKSSAPKLTNLLFAQLTIWAQRASIAKYSFGVLNATEESGRASISRLQLSIMVVFSQAQHRTGAKLKSTNSR

SEQ ID NO: 186384 - protein, 133 aa, Glycine max
  Coding DNA Sequence Number=SeqID_69606
  Gene Ontology: Mol. function=sugar porter activity; Cellular component=membrane
  Homolog annotation: Hit_ID=Q8GZZ6; Match level="QueryCoverage=91%, HitCoverage=37%, E-value=1e-34, Identity=66%"; Hit description =Putative phosphate/phosphoenolpyruvate translocator protein
  Pfam annotation: Domain name=TPT; Domain location=1-127; Score=100.8; E_value=4e-27; Accession=PF03151.7; Description=Triose-phosphate Transporter family
MLHPLQLHREKLNSMNLLLYMSPIAVLVLLPAALIMEPNVVDVILTLAKDHKSVWLLLFLNSVTAYAANLTNFLVTKHTSALTLQVLGNAKGAVAVVISILLFRNPVTVLGMGGYTITVMGVAAYGETKRRFR

SEQ ID NO: 186385 - protein, 1026 aa, Glycine max
  Coding DNA Sequence Number=SeqID_69607
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8W0V0; Match level="QueryCoverage=94%, HitCoverage=92%, E-value=0.0, Identity=81%"; Hit description=Type IIB calcium ATPase
  Pfam annotation: Domain name=Cation_ATPase_C; Domain location=862 -1006; Score=70.9; E_value=4.2e-18; Accession=PF00689.11; Description= Cation transporting ATPase, C-terminus
  Pfam annotation: Domain name=Cation_ATPase_N; Domain location=88-166; Score=57.6; E_value=4e-14; Accession=PF00690.16; Description=Cation transporterATPase, N-terminus
  Pfam annotation: Domain name=E1-E2_ATPase; Domain location=180-421; Score=232.3; E_value=1e-66; Accession=PF00122.10; Description=E1-E2 ATPase
  Pfam annotation: Domain name=Hydrolase; Domain location=425-756; Score=67.6; E_value=4.1e-17; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=862-1006::88 -166::180-421::425-756
MAVDQGVFKRKRLDSNVTPSPIYLTKLNLRKKFELLSTFKRQHYNLLMLIWFSYAAGNRVEYKLSSEARDSGFGIHPDEIASIVRGHDNKTLNDIGGVESIARKLLVSVDGGVSEESINSRQQIYGFNRYTEKPSRSFLMFVWDALQDLTLIILMVCAVVSIVIGIATEGWPKGTYDGVGIILSIFLVVVVTAVSDYKQSLQFRDLDKEKKKIFVQVNRDGKRQKISIYDIVVGDVVHLSTGDQVPADGIFLSGYSLLIDESSLSGESEPVNITEEKPFLLSGTKVQDGQGKMLVTTVGMRTEWGKLMETLNEGGEDETPLQVKLNGVATIIGKIGLTFAILTFVVLTVRFVVEKALHGDFASWSSDDAKKLLDFFAIAVTIIVVAVPEGLPLAVTLSLAFAMKKLMNDKALVRHLSACETMGSASCICTDKTGTLTTNKMVVTKAWICEKAMQIKGTESANELKTCTSEGVINILLQAIFQNTSAEVVKDDKNGKDTILGTPTESALLEFGCLLSADFDAYAQRREYKILKVEPFNSVRKKMSVLVGLPNGGVRAFCKGASEIILKMCDKTIDCNGEVVDLPEDGANNVSDVINAFASEALRTICLAFKEINETHEPNSIPDSGYTLIALVGIKDPVRPGVKEAVQTCMAAGITIRMVTGDNINTAKAIAKECGLLTEGGLAIEGPDFRDLSPEQMKDVIPRIQVMARSLPLDKHKLVTNLRKMFGEVVAVTGDGTNDAPALREADIGLAMGIAGTEVAKENADVIIMDDNFTTIVNVVKWGRAVYINIQKFVQFQLTVNVVALVINFISACITATWVIVFLLSGSAPLTAVQLLWVNLIMDTLGALALATEPPNDGLLKRPPVARGANFITKPMWRNIIGQSIYQLIILGILNFDGKRLLGLGGSDSTKILNTLIFNSFVFCQVFNEINSRDIDKINIFRGMFDSWIFMAIIFATAAFQVVIVEFLGTFASTVPLNWQFWLLSVVIGAFSMPIAAILKCIPVERDASKQHRDGYEALPSGPELA

SEQ ID NO: 186386 - protein, 118 aa, Glycine max
  Coding DNA Sequence Number=SeqID_69608
MVWLQVFTYLKSFGLRVIQIKLIHKKHTDQLDRMLLTSSYKSTNEAETETTPMGRRGLPRRSTVGQPNARPQCRQNTDEKKLQSTMNTATHNEGKKKKNSGVGAELQSRMREKWRLGA

SEQ ID NO: 186387 - protein, 117 aa, Glycine max
  Coding DNA Sequence Number=SeqID_69609
MSLSLSSKDQNFLFLPWQEVVSPPRNVRVASGDVEGPQSQPTLLQASEAKLTGASSKGEKCAESPPTFICGKCRKNRRKPVMKNIPDSRVVFMFEEGRQKRGSCSYIPSIEEEIKPT

SEQ ID NO: 186388 - protein, 152 aa, Glycine max
  Coding DNA Sequence Number=SeqID_69610
  Gene Ontology: Mol. function=oxidoreductase activity; Cellular component=integral to membrane; Biological process=electron transport
  Homolog annotation: Hit_ID=Q1RSM3; Match level="QueryCoverage=53%, HitCoverage=12%, E-value=6e-35, Identity=84%"; Hit description =Calcium-binding EF-hand; Ferric reductase-like transmembrane component
MKRFPSSLQWSLILGCREIDSLESAGWGNVDMRCWPPTPLLYNLEMLLLQAPAQSTHITTDSGILSQMLSQKLVPTKEYNPIKRGFRALAYFVQDNWKRLWVIALWLSICAGLLIWKFIQYKHGRKHNCRGRGRNSKPGVREKAKPKRKEEW

SEQ ID NO: 186389 - protein, 46 aa, Glycine max
  Coding DNA Sequence Number=SeqID_69611
  Homolog annotation: Hit_ID=Q9LTU4; Match level="QueryCoverage=97%, HitCoverage=3%, E-value=1e-10, Identity=75%"; Hit description =Helicase-like protein
MVGLYLPKPVFTHGQLYVALSRVNSAKGLKILIHDDEQKSMNSTTN

SEQ ID NO: 186390 - protein, 862 aa, Glycine max
  Coding DNA Sequence Number=SeqID_69612
  Gene Ontology: Mol. function=protein binding; Cellular component =integral to membrane; Biological process=defense response to fungus
  Homolog annotation: Hit_ID=Q1S5Q9; Match level="QueryCoverage=98%, HitCoverage=98%, E-value=0.0, Identity=47%"; Hit description=Leucine- rich repeat
  Pfam annotation: Domain name=LRRNT_2; Domain location=2-36; Score =37.4; E_value=5.1e-08; Accession=PF08263.3; Description=Leucine rich repeat N-terminal domain
  Pfam annotation: Domain name=LRR_1; Domain location=123-146; Score =5.1; E_value=31; Accession=PF00560.23; Description=Leucine Rich Repeat
  Pfam annotation: Domain name=LRR_1; Domain location=148-169; Score =2.8; E_value=86; Accession=PF00560.23; Description=Leucine Rich Repeat
  Pfam annotation: Domain name=LRR_1; Domain location=174-192; Score =5.6; E_value=25; Accession=PF00560.23; Description=Leucine Rich Repeat
  Pfam annotation: Domain name=LRR_1; Domain location=199-221; Score =13.9; E_value=0.59; Accession=PF00560.23; Description=Leucine Rich Repeat
  Pfam annotation: Domain name=LRR_1; Domain location=224-246; Score =10.3; E_value=3.4; Accession=PF00560.23; Description=Leucine Rich Repeat
  Pfam annotation: Domain name=LRR_1; Domain location=248-270; Score =13.7; E_value=0.68; Accession=PF00560.23; Description=Leucine Rich Repeat
  Pfam annotation: Domain name=LRR_1; Domain location=272-294; Score =21.9; E_value=0.0023; Accession=PF00560.23; Description=Leucine Rich Repeat
  Pfam annotation: Domain name=LRR_1; Domain location=296-318; Score =9.8; E_value=4.1; Accession=PF00560.23; Description=Leucine Rich Repeat
  Pfam annotation: Domain name=LRR_1; Domain location=320-343; Score =9.2; E_value=5.5; Accession=PF00560.23; Description=Leucine Rich Repeat
  Pfam annotation: Domain name=LRR_1; Domain location=416-435; Score =2.6; E_value=93; Accession=PF00560.23; Description=Leucine Rich Repeat
  Pfam annotation: Domain name=LRR_1; Domain location=458-481; Score =10.9; E_value=2.6; Accession=PF00560.23; Description=Leucine Rich Repeat
  Pfam annotation: Domain name=LRR_1; Domain location=486-505; Score =8.4; E_value=7.8; Accession=PF00560.23; Description=Leucine Rich Repeat
  Pfam annotation: Domain name=LRR_1; Domain location=510-532; Score =15.3; E_value=0.22; Accession=PF00560.23; Description=Leucine Rich Repeat
  Pfam annotation: Domain name=LRR_1; Domain location=534-556; Score =13.4; E_value=0.86; Accession=PF00560.23; Description=Leucine Rich Repeat
  Pfam annotation: Domain name=LRR_1; Domain location=558-579; Score =10.5; E_value=3.1; Accession=PF00560.23; Description=Leucine Rich Repeat
  Pfam annotation: Domain name=LRR_1; Domain location=580-602; Score =9.0; E_value=6; Accession=PF00560.23; Description=Leucine Rich Repeat
  Pfam annotation: Domain name=LRR_1; Domain location=604-626; Score =6.2; E_value=20; Accession=PF00560.23; Description=Leucine Rich Repeat
  Pfam annotation: Domain name=LRR_1; Domain location=670-692; Score =5.9; E_value=22; Accession=PF00560.23; Description=Leucine Rich Repeat
  Pfam annotation: Domain name=LRR_1; Domain location=694-716; Score =17.1; E_value=0.063; Accession=PF00560.23; Description=Leucine Rich Repeat
  Pfam annotation: Domain name=LRR_1; Domain location=718-740; Score =16.8; E_value=0.08; Accession=PF00560.23; Description=Leucine Rich Repeat
  Pfam annotation: Domain name=LRR_1; Domain location=742-763; Score =8.9; E_value=6.2; Accession=PF00560.23; Description=Leucine Rich Repeat
  Pfam annotation: Domain name=LRR_1; Domain location=82-104; Score =7.5; E_value=11; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=2-36::123 -146::148-169::174-192::199-221::224-246::248-270::272-294::296 -318::320-343::416-435::458-481::486-505::510-532::534-556::558 -579::580-602::604-626::670-692::...
  Pfam module annotation: =694-716::718-740::742-763::82-104
MNTLLRFKKGVRDPSGMLSSWLPKLDCCRWTGVKCDNITGRVTQLNLPCHTTQPEVVAYQEKDDKSHCLTGEFSLTLLELEFLSYLDFSNNDFKSIQYSSMGNHKCDDLSRGNLPHLCGNSTNLHYLDLSHNYDLLVYNLHWVSRLSSLKYLNLGGVRLPKEIDWLQSVTMLPSLLELTLENCQLENIYPFLQYANFTSLQVLNLAGNDFVSELPSWLFNLSCDISHIDLSQNRINSQLPERFPNFRSIQTLFLSDNYLKGPIPNWLGQLEELKELDLSHNSFSGPIPEGLGNLSSLINLILESNELKGNLPDNLGHLFNLETLAVSKNSLTGIVSERNLRSLTNLKSFSMGSPSLVYDFDPEWVPPFQLVSISLGYVRDKLPAWLFTQSSLTDLKILDSTASFEPLDKFWNFATQLEYFVLVNSTINGDISNVLLSSKLVWLDSNNLRGGMPRISPEVRVLRIYNNSLSGSISPLLCDSMKNKSNLVHLDMGYNHLTGELTDCWNDWKSLVHIDLGYNNLTGKIPHSMGSLSNLRFLYLESNKFFGEVPFSLNNCKNLWILDLGHNNLSGVIPNWLGQSVRGLKLRSNQFSGNIPTQLCQLGSLMVMDFASNRLSGPIPNCLHNFTAMLFSNASTYKVGFTVQSPDFSVSIACGIRMFIKGKELNRVYLMNDIDLSNNNLSGSVPLEIYMLTGLQSLNLSHNQLMGTIPQEIGNLKQLEAIDLSRNQFSGEIPVSLSALHYLSVLNLSFNNLMGKIPSGTQLGSTDLSYIGNSDLCGPPLTKICPQDEKSHNITKPVREEDDDDDKSEVYSWFYMGMGIGFAVGFWGVFGTILLNRRCRLVYFRFLHRVCDFVIRKMISIY

SEQ ID NO: 186391 - protein, 170 aa, Glycine max
  Coding DNA Sequence Number=SeqID_69613
  Gene Ontology: Mol. function=protein binding; Cellular component =integral to membrane; Biological process=xylan catabolic process
  Homolog annotation: Hit_ID=Q1S5Q1; Match level="QueryCoverage=86%, HitCoverage=17%, E-value=3e-30, Identity=46%"; Hit description =Leucine-rich repeat; Leucine-rich repeat, cysteine-containing type
  Pfam annotation: Domain name=LRR_1; Domain location=28-50; Score =14.3; E_value=0.45; Accession=PF00560.23; Description=Leucine Rich Repeat
  Pfam annotation: Domain name=LRR_1; Domain location=4-26; Score=16.8; E_value=0.079; Accession=PF00560.23; Description=Leucine Rich Repeat
  Pfam annotation: Domain name=LRR_1; Domain location=52-73; Score=7.3; E_value=12; Accession=PF00560.23; Description=Leucine Rich Repeat
  Pfam module annotation: Pfam domain module=LRR_1::LRR_1::LRR_1; Domain location=28-50::4-26::52-73
MLTGLQSLNLSHNQLLGTIPQEIGNLKQLEAIDLSRNQFSGEIPESMAVLHYLSVLNLSLNNFVGEIPTGTQLGSTNLSYIGNPHLCGAPLTKICPQDEKSNNTKHAGEEDDDDKSELYSWFYMGLGIGFAVGFLGVLGAIFFNRRCRHAYFRFLHRMYDFVIQKMNSIY

SEQ ID NO: 186392 - protein, 279 aa, Glycine max
  Coding DNA Sequence Number=SeqID_69614
  Gene Ontology: Cellular component=endoplasmic reticulum
  Homolog annotation: Hit_ID=O82352; Match level="QueryCoverage=98%, HitCoverage=98%, E-value=2e-52, Identity=42%"; Hit description =Expressed protein
  Pfam annotation: Domain name=Reticulon; Domain location=94-277; Score= 355.9; E_value=6.4e-104; Accession=PF02453.8; Description=Reticulon
MAEEPESTVTNGAADESLLDKITEKLHGHDSSSSSSSDSDSDSEKTVTSSVKDKIQCGNVVDGCIGENWDVKSRIEELFDEVSLNGELYAIVSAADVLLWRNKKISAGMLGGATAVWVLFELLEYHLLTLVCHILILLLAVLFLWSNAHTFIHKSPPRIPEFHLPEEPFLQVASALRIEVNRGFAVLHSIGSGRDLKKFLVVIASVWILSIVGNWCNFLTLFYITFILLHTVPVLYEKYDDKIDPLAEKAVIEIKKQYAVFDAKVLSKIPLGPLKAKLS

SEQ ID NO: 186393 - protein, 535 aa, Glycine max
  Coding DNA Sequence Number=SeqID_69615
  Gene Ontology: Mol. function=transition metal ion binding; Cellular component=Golgi apparatus; Biological process=metabolic process
  Homolog annotation: Hit_ID=Q00WZ0; Match level="QueryCoverage=58%, HitCoverage=87%, E-value=5e-20, Identity=26%"; Hit description =Homology to unknown gene
MPSSIRAMTTNEVSKLHNELNEKISEIKRLQLELTRREDEEAGDSVDSFKRLIETLEKENTTLKLEKDELEVALKSSRMASKMSPDDSQIQIKVPSSNSDVSQNLKAIFTLQEQLPDPSKSFPGNEDLERSLHKLSKELKETQNERNKAVQELTRLKQHLLEKESEESEKMDEDIKIIEELRDSNNYLRAQIAHLERTLKQATASQEKLKMANDNEILKSREIIDDLNKKLTNCMSTIDAKNTELVNLQTALGQYYAEIEAKEHLEGDLARAKEETSKLSQLLKDADCRANVLISEKEEILAKLSQSEKVQSEWRSRVSKLEEDNSRLRRALEQSMTRLNRMSVDSDFLVDRRIVIKLLITYFQRNHSKEVLDLMVRMLGFSTEDKQRIGVAQQGPGKGVVRGVLGFPGRLVGGILGGSGSTESAANVGVDNQSFADLWVDFLLKETEEREKKESEGRDKSIDESHDKSFDINSSPPHSNQRFSTGASINSPTNQNISSHPRGYFQHSEQIGSEFSTVPLTSSDSKTTSSRLPRY

SEQ ID NO: 186394 - protein, 230 aa, Glycine max
  Coding DNA Sequence Number=SeqID_69616
  Gene Ontology: Mol. function=transition metal ion binding
MWDTIANFKENLNKIALDVHYADEDDVVFPPDVHTAAVSDRRNSHSSAHSKSLPMSPAASNGTSDHPYSPEIEQYKAEIKRLQASEAEIKALSVNYAALLKEKENFEATSPASANGAYTVKGSNDQSPNPLHRFTTQMKNRYATNNGTTSTLESDASQSKMVSKHSNLRVKDKEQADMVEGKSSPTATAAVQHTHEIRKMKLELEQERKKLANIQLKFQGNYSAFRISRL

SEQ ID NO: 186395 - protein, 380 aa, Glycine max
  Coding DNA Sequence Number=SeqID_69617
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=95%, HitCoverage=98%, E-value=2e-86, Identity=47%"; Hit description=SAM dependent carboxyl methyltransferase
  Pfam annotation: Domain name=Methyltransf_7; Domain location=43-375; Score=460.2; E_value=2.7e-135; Accession=PF03492.6; Description=SAM dependent carboxyl methyltransferase
MGSLGASSGRELLLHMNGGTGKRSYANNSSFQKKLMLKAKPMLEETITRLYRDSSPNCMKVADLGCSVGPNTLLVTSNIIDIVDTTCTRLNREPPIFQFFLNDLFGNDFNTIFKSLPDFYTRLQGDKGNEFGSCFINATPGSFHGRLFPSNSINFFHSANSLHWLSQDPLSGLTKETKSLNKGNCHIVSTSPSEVYKAYFKQFQEGFKSFLKSRSEELVPGGAMVLVLPCTCKNETLSKSLWEVISLTLNDMLSEGLIEEAKLDSFNIPTYEPTIEEIRHLIKEEESLFLQRLEVFTVPRDEGVSECGDDFFLDGNIRAEFIATYTRAAMEPLLSAKFEAQVINELFIRFRKKLVQIMKVEKFETANLMISMTKIARRSV

SEQ ID NO: 186396 - protein, 395 aa, Glycine max
  Coding DNA Sequence Number=SeqID_69618
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=85%, HitCoverage=92%, E-value=1e-81, Identity=47%"; Hit description=SAM dependent carboxyl methyltransferase
  Pfam annotation: Domain name=Methyltransf_7; Domain location=43-374; Score=417.3; E_value=2.1e-122; Accession=PF03492.6; Description=SAM dependent carboxyl methyltransferase
MDSFSATTERQLLLHMNGGKGERSYANNSLLQKKLMLKAKPILEETIMKLYHDSSPSCMKVADLGCSVGPNSLLVISNIINIVDTTCTILNCEPPTFQFYLNDLFGNDFNTIFKSLPDFHTRLVEDKGHKFGSCFINATPGSFYGRLFPSNSIDLFHSSNSLHWLSQDPLLGLTKEAESLYKGHCHIVSTSPPEVYKAYLKQFQQDFKLFLKSRSEELVPGGAMLLVVLGNHETPRRTGWELISLILNDMFLEGLIEEEKLNSFNIPVYEPTVEEIRHVIQEEGSFFVQRLEILILPWVEGINEAGDDSFLDGNIKAGLMAKHVRAAMEPLLSTKFGEEVINEVFIRNIRVLPRSHNNIKVCFSFMFWLCAFFDKTRTDLFMRHKVFMQCTSDVK

SEQ ID NO: 186397 - protein, 376 aa, Glycine max
  Coding DNA Sequence Number=SeqID_69619
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=96%, HitCoverage=98%, E-value=1e-87, Identity=47%"; Hit description=SAM dependent carboxyl methyltransferase
  Pfam annotation: Domain name=Methyltransf_7; Domain location=43-375; Score=453.3; E_value=3.1e-133; Accession=PF03492.6; Description=SAM dependent carboxyl methyltransferase
MGSLGTSNGRELLLHMNGGKGERSYANNSSFQKKLMLKAKSILEETITTLYRDSSPNCMKVADLGCSVGPNTFLVTSNIIDIVDTTTTLLNCEQPTFQFYLNDLYGNDFNTIFKSLPDFYTRLEEDKGHKFGSCFINATPGSFHGRLFPSNSINLFHSANSLHWLSQDPLSGLTEEEKSLNKGNCHLVSTSPSEVYKAYFKQFQEGFKSFLKSRSEELVPGGAMVLVLPCTCKNETLSKSLWEVISLTLNDMLSEGLIEEAKLDSFNIPTYEPTIEEIRHLIKEEESLFLQRLEVFTVPRDEGVSECGDDVFLDGNIRAEFIATYTRAAMEPLLSAKFDAQVIDELFIRFQKKLVQIMKVEKFETANLMISLTKIA

SEQ ID NO: 186398 - protein, 62 aa, Glycine max
  Coding DNA Sequence Number=SeqID_69620
MVTESGMRTLLRVVPEDMSRGSGDLGDVRWGAIAQNQAWPIPTQPGHSQPVRTCAVPQQASS

SEQ ID NO: 186399 - protein, 85 aa, Glycine max
  Coding DNA Sequence Number=SeqID_69621
DAPAQAAEDHSPSPPPQRDDSSSLMHNILDRLDGLHTFFGERFDSLDNCIDAIDARFAGMDTRITQLEEDMSYVRQCFDLPPPSS

SEQ ID NO: 186400 - protein, 218 aa, Glycine max
  Coding DNA Sequence Number=SeqID_69622
MAWDLWSSSYAQVASGSNYWSQHPECDFYFGCGRDFIEEDALNVESCVRVLRILITKADTEIEELERDLLLLQNELACTEHEKWPDICCAALTERISRLDVAVSTLKNDYADDAEMQPLLDKEPAETLNEILAQSLDMNMLSPIVNVTGHALDKDSSTFDSNIIIKEEEKELHGTSESSELLLELHEKRSDNPEKIEVEKALLYVFNLNALIFYSCMS

SEQ ID NO: 186401 - protein, 97 aa, Glycine max
  Coding DNA Sequence Number=SeqID_69623
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O82531; Match level="QueryCoverage=83%, HitCoverage=36%, E-value=2e-36, Identity=86%"; Hit description =Proteasome subunit beta type 1
MTKQEANWSPYDNNGGSCVAIAGADYCVIAADTRMSTGYNILTRDYSKISQLAEKCVMASSGFQADVKALQKVLSARHLVSQKLETAVVIVNSFGVA

SEQ ID NO: 186402 - protein, 632 aa, Glycine max
  Coding DNA Sequence Number=SeqID_69624
  Pfam annotation: Domain name=Rho_N; Domain location=592-630; Score =20.7; E_value=0.0021; Accession=PF07498.2; Description=Rho termination factor, N-terminal doma
MPIVERLILYLPRLHYSFNVDLPEKSLVRSPDLGAIISDETKLSETFDNEVTGNEEVRKSQLINTDIGQMLDLFSTKDDGNIPSEVKKENEFVKENDVSLDDFRPAIGVKGRKEYPHSRLATSQQRKRGPDHSHWMKLSETSDNKVAGNEEVGRNQLINTDIGQILDLFSAKDNENIPSEVKKESEFVKEKDVSSDDFRPAIGVKGRKEYPHSRLATSQQQKSGPESPDHSDWMKLSETSDKVSGNEVERSQLIDTDIGQILDLFSAKDNENIPNEAKKENEFVKEDVSSDDFRPATDIKGRKKYPNSRLATSQRKSRNSNLDKKVCDFAPETAQRAYKKQSKVAPDEDLNSVDLPLQVVYPQTFCSADTEFCSFKGSNGNNSGLVFNIENTTPLLMLKILHWFLLGIQTKSTLNTDLQMIDEDEEEQEAQDLKSQITSEFRKLNMSFPSKLKAREKQKLELEAFSSREPYDSCTEVIPSTPIIVSTKRQRRSKPCTDVAILNEPMNRKIITRRAVQPDKHETEGRALVPYDSNFSELQKRRKALKLPITVDMETNSDRVSMDSRSQLVLHSSNLHSLVDSHDGASSLLPGDLNSLSLIDLRAMAKDHKVKQYYKLRKGALVEQLAKQLSSC

SEQ ID NO: 186403 - protein, 272 aa, Glycine max
  Coding DNA Sequence Number=SeqID_69625
  Gene Ontology: Mol. function=carbonate dehydratase activity; Cellular component=extracellular region; Biological process=one-carbon compound metabolic process
  Homolog annotation: Hit_ID=UPI0000162AE2; Match level="QueryCoverage =96%, HitCoverage=98%, E-value=3e-70, Identity=47%"; Hit description =carbonate dehydratase/ zinc ion binding
  Pfam annotation: Domain name=Carb_anhydrase; Domain location=42-266; Score=87.6; E_value=3.9e-23; Accession=PF00194.11; Description =Eukaryotic-type carbonic anhydrase
MALPTNLKFFCVFLLVLILYSSSFLASAVDPKAEDEEFTFAEGSIKGPKNWGQINPKWKVCGDGKLQSPIDLSDQMAQELPQLGKLDKVYKPAPVVLINRGHDIMLQWNGDAGQLNINGTFYNLMQCHWHTPSEHTLNGTKFDLELHAVHKTSKGEIAVIGIWYKIGHSDPLLSKLLNDIKSIKDKKIDVGVINPGDIMFETKEYYRYVGSLTTPPCTEGVVWTIVKEVRTVSTEQLNALKGAVHHGEENARPTQELGGRQVLLYKDVNWEL

SEQ ID NO: 186404 - protein, 1097 aa, Glycine max
  Coding DNA Sequence Number=SeqID_69626
  Gene Ontology: Mol. function=nucleic acid binding; Cellular component= nucleus; Biological process=regulation of transcription, DNA-dependent
  Homolog annotation: Hit_ID=Q9M2L7; Match level="QueryCoverage=100%, HitCoverage=73%, E-value=0.0, Identity=59%"; Hit description =Helicase-like protein
  Pfam annotation: Domain name=DEAD; Domain location=597-747; Score= -32.1; E_value=0.0029; Accession=PF00270.19; Description=DEADDEAH box helicase
  Pfam annotation: Domain name=ResIII; Domain location=563-741; Score= -17.2; E_value=0.0013; Accession=PF04851.6; Description=Type III restriction enzyme, res subunit
  Pfam annotation: Domain name=SNF2_N; Domain location=569-876; Score =346.8; E_value=3.6e-101; Accession=PF00176.13; Description=SNF2 family N-terminal domain
  Pfam module annotation: Pfam domain module=DEAD::ResIII::SNF2_N; Domain location=597-747::563-741::569-876
MDHRPKSKESLSYSTLFNLESLMNFQLPEQDNDFDYYGNSSQDESRDSQGVGIANHSNGNVHEKEVNLFKKRRWSLNSDNEEKSSFYGTHMTEERYRSMLGEHIQKYKRRFKGTLNSPAQNQAAVPLVKSNTGLKAHKSGNERRGGGLHVAESTSEWMNDSGSQKPGNYRNADFSPQYGTDRIMYEPASLDIGDGIIYKIPPVYDKLAGALNLPSCSDIHVEDLYLKGTLDLGSLAEMMAADKRFGNRNRAGMGEAIPQFESLQARLKVMSASNSARKFSLKMSDVDLNSSIPEGAAGSIRRSILSEGGVLQVYYVKVLEKGDTYELCHIGLLQIIERSLPKKQKVKKDPALIEKEEMERCGKVWANIVRMKVSRSLKWTRTASMRTRKLARDMLLFWKRIDKEMTEVRKREEKEAAEALRREQELREAKRQQQRLNFLIQQTELYSHFMQNKSNLLSSETLPKEDEDADDQDALIDSSDAVPDEEEDPEEAELKKEALKAAQEAVSKQKMLTSAFDTECLRLRQAGETDSLPPDVAGASNIDLQTPSTMPVASTVRTPELFKGVLKEYQLKGLQWLVNCYEQGLNGILADEMGLGKTIQAMAFLAHLAEVAIHPHVLEKNIWGPFLVVAPASVLNNWNEELERFCPELKRLPYWGGLSERTVLRKSINPKDLYRREAKFHILITSYQLLVSDEKYFRRVKWQYMVLDEAQAIKSATSIRWKTLLSFNCRNRLLLTGTPIQNNMAELWALLHFIMPTLFDSHEQFNEWFSKGIENHAEHGGTLNEHQLNRLHSILKPFMLRRVKKDVISELTTKTEVTVHCKLSSRQQAFYQAIKNKISLAELFDSNRGQLNEKRILNLMNIVIQLRKVCNHPELFERSEGSTYLYFGEIPNSLPPPPFGEMEDVYYSGGHNPISYEFLWSENGSIVNGRYKEDFSMIPKLVYQEIIQSSETLSSAVGRGVSRESFHKHFNIFRPENVYRSVFSEDMCSKSGNFGFTHMMNLSPHEVTFLATGSFMERLLFSMMRWEQKFIDEAVDFLMETIDDDPECSYLEKEKVRAVTRMLLVPSRSETQFLQKKWQTGPSHAPFEALVVPHQDR

SEQ ID NO: 186405 - protein, 55 aa, Glycine max
  Coding DNA Sequence Number=SeqID_69627
MKKKKRNRKRKKRNRVVRRIRPGKVTFTLTCATLYVSILTVEFAVYRRREETEGE

SEQ ID NO: 186406 - protein, 80 aa, Glycine max
  Coding DNA Sequence Number=SeqID_69628
MYPLLFSVTTTQVDVPSTCTTKDVHSNVLKQSSQAISPLKLCEGETKDISSGRRDTQKEFRRLVLGEFFLAKGEENEKEE

SEQ ID NO: 186407 - protein, 67 aa, Glycine max
  Coding DNA Sequence Number=SeqID_69629
  Gene Ontology: Mol. function=protein binding
  Homolog annotation: Hit_ID=Q9FKT0; Match level="QueryCoverage=76%, HitCoverage=11%, E-value=1e-15, Identity=75%"; Hit description =Similarity to actin
MSSHRSCLVFFSFAWQQNLCYVALDYEAELLKDTKASFEAAGEGWFTLSKGRFQTAEILFQPHLAGV

SEQ ID NO: 186408 - protein, 97 aa, Glycine max
  Coding DNA Sequence Number=SeqID_69630
MKIKKRTKERKEGFSIKDRKEVKRGKEATLDQRKEENRKSPKPDCHSESFLTGNIPPHMNKEEKTETPSFLSKNADLEKILLISPMFPLRVCLKARS

SEQ ID NO: 186409 - protein, 104 aa, Glycine max
  Coding DNA Sequence Number=SeqID_69631
MKQAKYSLKAQVEKDEGPSGEGQSPRVEKDEGPSNPCGVYPDLSSLTGSGVYPDLSSFTGSGVYPDLSSFTGSGVIQNLRSLYQTIHSYCSHQSIRKCSIDVTR

SEQ ID NO: 186410 - protein, 104 aa, Glycine max
  Coding DNA Sequence Number=SeqID_69632
  Homolog annotation: Hit_ID=Q49N12; Match level="QueryCoverage=43%, HitCoverage=4%, E-value=9e-09, Identity=65%"; Hit description =Putative receptor-like protein kinase 2
AHKNPRAFSWISGPIFLESSIQCPWGVGLHRDFNIKEAMVMINVALLCTKVSPALRPTMSSVVSMREGRTIIQEVVSDTREAYALLTDTGSSGGEIRKLENLER

SEQ ID NO: 186411 - protein, 71 aa, Glycine max
  Coding DNA Sequence Number=SeqID_69633
MDEKSWSKGWTVVGNMESSRLVLGKGYGTKLGGVVNLSIDRSNTSSNDNDGLRSTMPVERRWSEVDGAVGV

SEQ ID NO: 186412 - protein, 99 aa, Glycine max
  Coding DNA Sequence Number=SeqID_69634
  Pfam annotation: Domain name=zf-CCHC; Domain location=37-54; Score =20.5; E_value=0.00041; Accession=PF00098.13; Description=Zinc knuckle
MSLEELIGTLKNKSGSRWKISFKKVFKEKKDKEKRLIICHECKKLGHFKSECLKLEKSKEKYKDMKSLIGTWDLDDTTFDEEAKEEANLCSMANTTFKE

SEQ ID NO: 186413 - protein, 47 aa, Glycine max
  Coding DNA Sequence Number=SeqID_69635
  Gene Ontology: Mol. function=CTP synthase activity; Cellular component=cellular_component; Biological process=pyrimidine nucleotide biosynthetic process
  Homolog annotation: Hit_ID=UPI0000162F30; Match level="QueryCoverage =95%, HitCoverage=10%, E-value=3e-13, Identity=63%"; Hit description =CTP synthase/ catalytic
  Pfam annotation: Domain name=CTP_synth_N; Domain location=2-47; Score= -223.0; E_value=0.074; Accession=PF06418.4; Description=CTP synthase N-terminus
MVDLDIGNYEHFLDLKLTRDNNITTGKIYQVVPHVIDAIQEWIECVA

SEQ ID NO: 186414 - protein, 43 aa, Glycine max
  Coding DNA Sequence Number=SeqID_69636
IEETKDADRNGPKGIISAVRISIVVGWGYILGITFAVTDIVYQ

SEQ ID NO: 186415 - protein, 56 aa, Glycine max
  Coding DNA Sequence Number=SeqID_69637
MFWSSVREAEATTKEAEAEVGSNERIIAVTWDGVSSYLGTIFELEVGFEVPSKEEE

SEQ ID NO: 186416 - protein, 1568 aa, Glycine max
  Coding DNA Sequence Number=SeqID_69638
  Gene Ontology: Mol. function=RNA-directed DNA polymerase activity; Cellular component=chromatin; Biological process=chromatin assembly or disassembly
  Pfam annotation: Domain name=Chromo; Domain location=1458-1506; Score= 23.3; E_value=0.00087; Accession=PF00385.14; Description='chromo' (CHRromatin Organisation MOdifier
  Pfam annotation: Domain name=RVP_2; Domain location=383-516; Score= -37.4; E_value=0.00083; Accession=PF08284.2; Description=Retroviral aspartyl protease
  Pfam annotation: Domain name=RnaseH; Domain location=901-1020; Score=- 33.8; E_value=0.081; Accession=PF00075.14; Description=RNase H
  Pfam annotation: Domain name=rve; Domain location=1155-1311; Score =119.5; E_value=9.7e-33; Accession=PF00665.16; Description=Integrase core domain
  Pfam annotation: Domain name=zf-H2C2; Domain location=1096-1137; Score=20.6; E_value=0.00066; Accession=PF09337.1; Description=His(2)- Cys(2) zinc finger
  Pfam module annotation: Pfam domain module=Chromo::RVP_2::RVT _1::Retrotrans_gag::RnaseH::rve::zf-H2C2; Domain location=1458 -1506::383-516::641-810::151-241::901-1020::1155-1311::1096-1137
MKYTEKFIPILISGGTLSSKQGVEHPLLLSTGPTCRAMADHGTRKTTTDRLEDAISRLSIHHSSLLDKHTDLADKYMDLSGKVDAILAQLHQLNSNHSPNPSPSSASTQPSHRSPVKLDIPRFDGRDPLGWIFKISQLFDYQNTPEEERITVASFYLDGAALSWYQWMFRNGFITSWSGFLQALESRFAPTHYDDPKGALFKLSQRGTVNEYLTEFERLANRVIGLPPPFLLSCFISGLSPEIRREVLALQPISLPQATSLAKLQEDKLRDRRFPSRPYPSPSHISSAPHAPTPPLRPKPPFIQRTPDEIALRREKGLCYNCDEKWNSSHRCKGRVLLFIADPSHPEPEPTHTPSFEPTTFDPSLPDLPTYDPTTLTPAPSLDPSSSHISLHALSGLPSHDTFRLFGTIHHHRLTILIDSGSTHNFLQPRLAHFLHLPTQTTTPLHVLVGNGSVLDCTQLCPDVPLTLQDHPFTVTFHLLPISGADAVLGIEWLKQLGPVTTDYTSFIMHFTHLGLPTTLHADAAIGPETISAPQFKRLLQTGSTSALYHLCLLPVNPPDPPSTPSSPIPAIEALLSKFQPLFDPPSLLPPPRQVTHRINLFPSTAPVNVRPYRYPHFQKAEIERQVSELLTAGLIRPSTSPYSSPVLLVKKKDASWRMCVDYRALNSVTIRDRFPIPTIDELLDELGHASWFSKLDLRQGFHQILMHEPDIEKTAFRTHHGHYEYRVMPFGLCNAPSTFQAAMNTLLAPFLRRFATVFFDDILVYSDSLSSHLHHLELVFQALLQQQFFLKRTKCLIAQRQLEYLGHLVSAKGVEPEPSKLQAIVNWPSPTSAKDLRAFLGLTGFYRKFIKNYAAIAAPLTALLCKDAFAWSPTSQAAFDHLKTVMTQAPVLALPDFTVPFVVETDASGTAMGAVLMQSGHPIAFFSKQFGPRLLHASTYVRELHAIVTAVRKWRQYLLGHSFTILTDHKSLRELMSQVIQTPEQHYYLSKLLGFDYSIQYKPGPSNLVADALSRTNCDNSGQLLLLSVPNFVFIDDLRRTLHDSPTFMAQFDKVKAQPTAFPDFHLHNGLLFFKGRIWLDPTNPFIPNLLLEFHATPLGGHLGVAKTLHRLQSSFHWDTIRKDVTRFVRECHTCQQTKPSTRRPAGLLQPLPIPSGVWEDVSMDFITHLPPSHGFTVVLVVVDRYSKGVHFGALPTHYSAFKVASLFLDMVCKLHGFPRSIVSDRDPVFISSFWRELFRLSGTRLRMSTAYHPQSDGQTEVMNRILEQYLRAFVHSQPSQWFRFLPLAEWSYNTSLHSGSGYTPFEVIYGKPPPSLPQYLAGTSNNEAVDSLLTSRQELHDTLQRRLLKAQASMKVHADSKRQDITFEPGQWVYVRLRPFRQRSMHITMNPKLSKRYFGPFQIIARVGQVAYHLRLPAAARIHPVFHCSLLRPHHGPLPPSPDNWPLQVIDHKPVPQPLSFLATKTDHSTSPPTRYVLTQWLGQPPEDTSWEPWQELRNTYHLEDKVVFEEGGIVSNTPDFIIDPTAEPNPAEPNPAEPNPTAEPNISERPKRATKQPNYLQDYEV

SEQ ID NO: 186417 - protein, 507 aa, Glycine max
  Coding DNA Sequence Number=SeqID_69639
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=99%, HitCoverage=91%, E-value=0.0, Identity=69%"; Hit description=Indole -3-acetic acid-amido synthetase GH3.5
  Pfam annotation: Domain name=GH3; Domain location=20-507; Score =872.3; E_value=2.3e-259; Accession=PF03321.4; Description=GH3 auxin -responsive promoter
MPEAPRDSTKDYVLEEKNKKILDFIEDVTNNADEVQNKVLSEILSRNANVEYLRRHGVNGQTVDRDTFKRLLPVITYEDIQPDINRIANGDKSPILTTKPITEFLTSSGTSGGERKLMPTIEEELGRRCILYSLLMPIMSQFVPDLEKGKGMYLMFIKCESKTPGGIVARPVLTSYYKSPYFRDRPYDPYTKGSRVGAIFASGFIRAIRFLEKHWTLLCNDIKTGTINNSITDSSVREAVMRILKADPKLADFIHNECSKGSWQGIITRLWPNTKYVDVIVTGTMAQYIPTLDYYSNDLPLVCTMYASSECYFGVNLNPLCKPSQVSYTLIPTMCYYEFLPVNRSNNELAVSRPSPTSLNQAQHEELVELVDVKLGQEYELVVTTHAGFKNKAPQFSFVCRKNVALSIDSDKTDEVELQNAMKNAVTHLEPFDAHVSEYTSYADTTTIPGHYVLYWELNLKGSTPIPPCVYEESLNSVYRQGRVSDKSIGALEIKIVEQGTFDKLMD

SEQ ID NO: 186418 - protein, 76 aa, Glycine max
  Coding DNA Sequence Number=SeqID_69640
HFFSVLHILRARASTLVFLDKRHTEVGGFLHRQFQKALYVWMLHVTSLVVNFSTAHTLQHLHIDTSLNVLVGQNLS

SEQ ID NO: 186419 - protein, 50 aa, Glycine max
  Coding DNA Sequence Number=SeqID_69641
  Gene Ontology: Mol. function=voltage-gated ion-selective channel activity; Cellular component=mitochondrial outer membrane; Biological process=anion transport
  Homolog annotation: Hit_ID=Q1S7K4; Match level="QueryCoverage=80%, HitCoverage=14%, E-value=5e-12, Identity=80%"; Hit description=Porin, eukaryotic type
MSKGPGLFTDIGKKSKDLLTKDYSSDQKLTVSSYSVSGVRIPHYIVSMLS

SEQ ID NO: 186420 - protein, 389 aa, Glycine max
  Coding DNA Sequence Number=SeqID_69642
  Gene Ontology: Mol. function=RNA-directed DNA polymerase activity; Cellular component=chromatin; Biological process=chromatin assembly or disassembly
  Pfam annotation: Domain name=RVP_2; Domain location=93-196; Score= -53.1; E_value=0.014; Accession=PF08284.2; Description=Retroviral aspartyl protease
  Pfam module annotation: Pfam domain module=RVP_2::RVT_1; Domain location=93-196::76-372
MAANQSEPTSSGSQNRGVRNLPYQEYLCRREAKLLPLWRTICCWSQGEISRLEGELENTFDNTVETKVECQWMDLSICSAGGFTQPQTMKLEGLIQGKKVLIFIDSGASHNFISQDLVQQLGLKVTPTQTYGVRLGDGNKKNAQGCCEQMEVQLGQMTITEKFFLFDLGGIDIIFGVAWLEKLGDVKVQDTVDTQEAVQYGGSIVEQKQVQGVLDEFSSVFSERKGLPPPRAVDHAIPIRTGTNPINVKPYRYPYLQANETEKKVSEMLHAEIIRPNNSPYSTPMISVKKKDRSWRLCTDYRALNKVTTLQPFLRKFVLVFFDDVLIYSSSWEDHLQHLRTVLGTLVQHEFTANLKKCSFGQQEIEYLGHIISAKGVAMDTRKIEAVLQ

SEQ ID NO: 186421 - protein, 167 aa, Glycine max
  Coding DNA Sequence Number=SeqID_69643
  Gene Ontology: Mol. function=DNA binding; Cellular component =chromosome; Biological process=chromosome organization and biogenesis (sensu Eukaryota)
  Homolog annotation: Hit_ID=UPI00000E8E77; Match level="QueryCoverage =75%, HitCoverage=70%, E-value=3e-49, Identity=80%"; Hit description =H3 histone, family 2 isoform 2
METRKKRHFYETTEEFEFLKTCSYSHRAVLISLLPKSSNLCVRNGSYDANRKEVHQRKSFEKATCHESSTQVRSGDRRREEAAPFQAKYGGAKGDPKVPEEHRASHKEASFPKTRKGNRSGLQDQSLLPQQRRLHSPRSRRGLPRCALRGHQPLHHSPKRVTIMPKD

SEQ ID NO: 186422 - protein, 232 aa, Glycine max
  Coding DNA Sequence Number=SeqID_69644
MDGNEARFTVLESSVTALKTTTSKLKAMTTELQKSSKKQTEVIAKNSGLEDAESVTEPKPSSALEDEASESEEDLILHSSRHYWAKGVKMPVFEGEDPLGWITCGEVCFRATRPTERESEIGLYQYGGKRLALVPVLEAKGKAEELEFEVLVAQVLGTKEVQLGGYFLAGLRNDICAKFCPHKPKDLSSAMELAADFEEFEKEGNLEIDLHSREFHFQPKGGTWIAVLEDPL

SEQ ID NO: 186423 - protein, 322 aa, Glycine max
  Coding DNA Sequence Number=SeqID_69645
  Gene Ontology: Mol. function=transcription factor activity; Cellular component=nucleus; Biological process=regulation of transcription
  Homolog annotation: Hit_ID=Q1S6U1; Match level="QueryCoverage=98%, HitCoverage=69%, E-value=1e-109, Identity=62%"; Hit description=GRAS transcription factor
  Pfam annotation: Domain name=GRAS; Domain location=75-322; Score =187.3; E_value=3.7e-53; Accession=PF03514.5; Description=GRAS family transcription factor
  Subcellular localization annotation: CTP_CleavageSite=30; ConfidenceScore=5.35e-01
MDTTLFRVVSSFQHQHQPDHDQSLNNSTTSSSSRSSRQQQNYPYPQEDEECFNFFMDEEDLSSSSSKHYCPYQPHPPSTTTIHHSFSPTPCDFEFSGKWAQDILLETARAVADKNTTRLQQLMWMLNELSSPYGDTDQKLASYFLQAFFSRISQAGDRTYRTLASASEKTCSFESTRKTVLKFQEVSPWTTFGHVASNGAILEALEGEPKLHIIDISNTYCTQWPTLFEALATRNDDTPHLRLTSVVTADATAQKLMKEIGARMEKFARLMGVPFKFNVVHHVGQLSDLDFSMLDIKEDEALAINCVNTLHSIAAVGNHRDA

SEQ ID NO: 186424 - protein, 659 aa, Glycine max
  Coding DNA Sequence Number=SeqID_69646
  Gene Ontology: Mol. function=ubiquitin-protein ligase activity; Cellular component=ubiquitin ligase complex; Biological process =protein ubiquitination
  Homolog annotation: Hit_ID=Q10QD1; Match level="QueryCoverage=90%, HitCoverage=100%, E-value=0.0, Identity=68%"; Hit description =Peptidylprolyl isomerase, putative, expressed
  Pfam annotation: Domain name=DUF602; Domain location=23-282; Score= -137.1; E_value=0.074; Accession=PF04641.3; Description=Protein of unknown function, DUF602
  Pfam annotation: Domain name=Pro_isomerase; Domain location=350-502; Score=192.3; E_value=1.1e-54; Accession=PF00160.11; Description =Cyclophilin type peptidyl-prolyl cis-
  Pfam annotation: Domain name=U-box; Domain location=38-97; Score=3.0; E_value=0.00024; Accession=PF04564.6; Description=U-box domain
  Pfam module annotation: Pfam domain module=DUF602::Pro_isomerase::U -box; Domain location=23-282::350-502::38-97
MGKKQHSKDRMFITKTEWATEWGGAKSKENRTPFKRLPFYCCSLTFTPFEEPVCTPDGSVFDNMNITPYIVKYGKHPVNGAPLKHQDLIPLTFHKNSEGEYHCPVLNKVFTEFTHIVAVKTTGNVFCYEAVKELNIKTKNWKELLTDEPFTKDDLITIQNPNALDSKVLLDFDHVKNSLKVDDEELQKMSSDPTYNINMSGDIKQMLKELGTEKGKETALHGGGGGKAQKERAAALAAILAARSRVEEDSKSNPNKEAKAPQAFSVVDAASASVHGRSAAAAKASAGDKTAARIAMHVAGDRAPVNAKMVKSRFTTGAASRSFTSTSFDPVTKNEFEYVKVEKNPKKKGYVQLHTTHGDLNIELHCDITPRACENFITLCERGYYNGVAFHRNIRNFMIQGGDPTGTGRGGESIWGKPFKDELNSKLIHSGRGVVSMANSGPHTNGSQFFILYKSANHLNFKHTVFGGVVGGLTTLAAMEKVPVDDDDRPLEEIKITSVTIFVNPYTEPDEGEEQDNAKEKNAEDEDNDKVGSWYSNPGAATSVSGGTGAGGGVGKYLKARSTQAKSATVDNTGTDVVVKKRKVGVASSEFKDFSAWEFLLFLFSNQLSGVNANFSLGCHSQGHFKSVSLASFFTDFSDGFLVTLWHRIQGMYNSEYRK

SEQ ID NO: 186425 - protein, 463 aa, Glycine max
  Coding DNA Sequence Number=SeqID_69647
  Gene Ontology: Mol. function=protein binding; Biological process =response to light stimulus
  Pfam annotation: Domain name=BTB; Domain location=48-150; Score=5.4; E_value=0.0013; Accession=PF00651.21; Description=BTBPOZ domain
MRGWNQFETIYEEEQELSSTSSPFLSPSSSSSPPPPPSLHSIVNAWSLDSGSEPDVLICVQGTSFRLHKYKNPSKKVRLISRSSYLKRHLTGVSDLTLSPPLNLTAETFAAVAEFCYSRRVHLTPSNVAAVRVAAELLGMTGEENLREVTESYFERVVGIGASMVLRSCVALLPEAETTASLASRCIEALVWEDDVSCMSDVVGMHPQDFQTVSYSLNRRLPNHDVLYKMVDLYLKENKCRKLTEEQKTEICNSIDCSKLSPHTLVNCVQNPQMPLRFIVQAILMEHLNTRRSVTAAATTGAQQQLERTTLREILQRDTADRQTTQIKETMDSTYSRIQSLEKELRGMKKILHEHHQAEGEKIRNNNVLNSERSASFHFDPADAESSKIQRGGRGSVSSSGFGLDNVRRKNKEVAGGMCNLSVGSSCRHDSKTPKMTKFFRHSKFITGLKNAFRISNSTSNPY

SEQ ID NO: 186426 - protein, 158 aa, Glycine max
  Coding DNA Sequence Number=SeqID_69648
  Gene Ontology: Mol. function=structural constituent of ribosome; Cellular component=large ribosomal subunit; Biological process =translation
  Homolog annotation: Hit_ID=Q1S7K3; Match level="QueryCoverage=91%, HitCoverage=100%, E-value=8e-54, Identity=73%"; Hit description =Ribosomal protein L24/L26
  Pfam annotation: Domain name=KOW; Domain location=49-82; Score=42.6; E_value=1.4e-09; Accession=PF00467.19; Description=KOW motif
  Subcellular localization annotation: CTP_CleavageSite=45; ConfidenceScore=5.42e-01
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDIMQTFEGLVVWILRVPLL

SEQ ID NO: 186427 - protein, 48 aa, Glycine max
  Coding DNA Sequence Number=SeqID_69649
IVEIYGRDAAGKTTIALRIIKEAQKLGVCLWRFLFEILMSTDDVNKGL

SEQ ID NO: 186428 - protein, 600 aa, Glycine max
  Coding DNA Sequence Number=SeqID_69650
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=86%, HitCoverage=79%, E-value=0.0, Identity=70%"; Hit description =Putative amino acid acetyltransferase
  Pfam annotation: Domain name=AA_kinase; Domain location=54-306; Score= -24.1; E_value=0.00069; Accession=PF00696.18; Description=Amino acid kinase family
  Pfam annotation: Domain name=Acetyltransf_1; Domain location=480-556; Score=59.2; E_value=1.3e-14; Accession=PF00583.14; Description =Acetyltransferase (GNAT) family
  Pfam module annotation: Pfam domain module=AA_kinase::Acetyltransf_1; Domain location=54-306::480-556
  Subcellular localization annotation: CTP_CleavageSite=46; ConfidenceScore=5.18e-01
MAPSLCLSLPNTSTFSDFNKLHCFCFHPKKPNRQFMSGWVPEARPVAAHLGYRKKLNALSQDGESYHGTMEDKQFDIAFLNHLGIRFVLVPGTHVQIDKLLNERGCQPKYVGRYRITDDESLEAAMEAAGGIRLMIEAKLSPGPSICNIRRHGDNSRWHEVGVSVASGNFLAAKRRGVVNGIDFGSTGEVKKVDVSRMRERLDGGCVVILTNLGYSSSGEVLNCNTYEVATACALAIGADKLICLIDGPILDESGRLIRFLPLQEADMLIRKRAEQSEAAANYVKAVDEEGFNSLEYNNFNGAVKSPPIGRFTEWHNATFHNGVGFESGNGLGSGEQGFAIGGQERLSRMNGYLSELAAAAFVCRGGVQRVHLLDGTISGVLLLELFKRDGMGTMVAREIGGKVWGYDTVQLFKYRLVGILVDFLLVAPYRSHIDLYEGTRTAGVKDISGIKQLIQPLEASGILVKRTDEELLKTLDSFIVVEREGHIIACAALFPHFEEKCGEVACIAVSPDCRGQGQGDKLLDYMEKKASSLGLNMLFLLTTRTADWFVRRGFSECSIDYLPEKKRRMINLSRNSKYYMKKLLPNISGITVGVKSASS

SEQ ID NO: 186429 - protein, 215 aa, Glycine max
  Coding DNA Sequence Number=SeqID_69651
  Gene Ontology: Mol. function=DNA binding; Cellular component =nucleosome; Biological process=chromosome organization and biogenesis (sensu Eukaryota)
  Homolog annotation: Hit_ID=Q0PJK3; Match level="QueryCoverage=56%, HitCoverage=41%, E-value=2e-42, Identity=75%"; Hit description=MYB transcription factor MYB85
  Pfam annotation: Domain name=Myb_DNA-binding; Domain location=5-57; Score=31.6; E_value=2.7e-06; Accession=PF00249.21; Description=Myb -like DNA-binding domain
MGAPKQKWTAEEEAALKAGVVKHGAGKWRTILTDPEFSSILRMRSNVDLKDKWRNINVTAIWGSRQKAKLALKKNLLPSTKIDNNHLALSTVVQRDKEVANPKPLAVSSGTSPNSKEKISKLQNFQPKDSPKAEKTGVNILSKSEIDAELSKMKGVTPQEAAAAAAKAVAEAEAAIAEAEAAAREADAAEAEAEAARVFAKAAMKALKCKTLRIW

SEQ ID NO: 186430 - protein, 511 aa, Glycine max
  Coding DNA Sequence Number=SeqID_69652
  Gene Ontology: Mol. function=nucleic acid binding; Cellular component= nuclear pore; Biological process=DNA integration
  Pfam module annotation: Pfam domain module=RVT_2::Retrotrans_gag; Domain location=215-372::1-115
MVVSGLVHSVATSICQSILWMDSAVDIWKDLKARYSQGDLLRISDLQHKLASIKQGDMDITDYFTKLRTIWDELESYRADPVCTCASKCGCDALVEVKKRKDQDRIMEFMRGLNDQYNHVRSNILMTDPLPSINKAFSYMAQQERQFASSDALGNLSLVNAAANTRLSNSCSYCSRDNHTVETCYKKNGFPPNFFSKTEPKSFKEASQSDKWIKAMNVEIEALEANHTWILTDLPPNKSAIGCKWVYKVKHKADGSVERYKARLVAKEYTQIEGQDYLDTFSPVTKITTVRLLLALVVVNNWHLKQLDVNNAFLYGDLNEEVYMTLPPDDIVLSGNDLLEIKSITQLLDEVFKIKDLGMLGSKPVFTPIDYAVRLHQQSGTPLDDTTASSYRRLIGRLIYLTNTRPDITFAMQHLSQFVAHPSSAHQQAAYRILRYLKAAPGSGIFFSASSILQLKAFSDSDWAGCIDTRRSITDYSVYLGNSLISWKSKKQATVSRSSSEAEYRAIASAT

SEQ ID NO: 186431 - protein, 111 aa, Glycine max
  Coding DNA Sequence Number=SeqID_69653
  Homolog annotation: Hit_ID=Q1S6U1; Match level="QueryCoverage=96%, HitCoverage=21%, E-value=4e-36, Identity=66%"; Hit description=GRAS transcription factor
VYFEALDESFPRTSNERLLLERAAGRAVVDLVACSAAESVERRETAARWARRMHGGGLNTVAFSEEVCDDVRALLRRYREGWAMTQCSDAGIFLTWKEQPVVWASAWRALT

SEQ ID NO: 186432 - protein, 323 aa, Glycine max
  Coding DNA Sequence Number=SeqID_69654
MEILMFETSIMWLLRHLQESTATHLHASGCCWLCFITLFGQLLSPHFLPTSLLHLSRHTKLELRQLGWYDRIASSFVLVTSQKTLRRTEKLKECVEGIGEDALRTIGRVMKTTNQMQILLLPYNPQICVCSAFVVLTVNLVTLVAALVLMLLHWRPGFIIFAEDACFAFEDFLENRQNSCLGSMLPCIDESFSGKLIAQIGYTIHSFIVELNSNMSVIYRLLGASEENEELMGVIKICDPFSGSPNLSYVPHSCPQDAIWIGDLSKILAKFTCHEEGTREECRKEGRFLPEASYNMAHAYSRSIQDLLGICIQTYKDCPNAPL

SEQ ID NO: 186433 - protein, 132 aa, Glycine max
  Coding DNA Sequence Number=SeqID_69655
  Gene Ontology: Mol. function=nucleoside-triphosphatase activity; Cellular component=mitochondrion; Biological process=response to DNA damage stimulus
  Homolog annotation: Hit_ID=Q8RY99; Match level="QueryCoverage=68%, HitCoverage=23%, E-value=2e-17, Identity=48%"; Hit description=DNA repair protein recA homolog 2, mitochondrial precursor
MTRVVLCVRKTLILNHVTFNMLLLYVIVSHILNLILKIHLVEGVMICAQVVKNKLAPAATKRAEQGIKFGRGFCHESDVLDLACEHGIIVKHEGSYFIEGSSLDSREAAELFLAQNDAVCDKLVRDMTRLYF

SEQ ID NO: 186434 - protein, 255 aa, Glycine max
  Coding DNA Sequence Number=SeqID_69656
  Homolog annotation: Hit_ID=Q84ST1; Match level="QueryCoverage=74%, HitCoverage=37%, E-value=7e-21, Identity=29%"; Hit description =Expressed protein
MAMAGTHTRQSAWFLRLLCLWASAVLVFADERSLCLTQNSTLQLSRGLPVGNSPASKPGATVVVERVHIHGLSRFRNLGKFAHSFKVKVLPLPTNSNVRLPNIEVCFHRNVSLVAGMCPHGQWEKVTKGSWARSMSPFDHKILDIRTTGSTLENFEVSVEEVNHTFNFNSSSQENHSYALFVDLMQIYVSVRSSWMVSVGMKLLPTGRKSSLAIFLYSTAVGFGTFLLRYIPGLVRSVLTELGIDEDMYNPVSIR

SEQ ID NO: 186435 - protein, 153 aa, Glycine max
  Coding DNA Sequence Number=SeqID_69657
  Gene Ontology: Mol. function=metalloexopeptidase activity; Biological process=proteolysis
  Homolog annotation: Hit_ID=Q6Z8B5; Match level="QueryCoverage=87%, HitCoverage=40%, E-value=6e-16, Identity=55%"; Hit description =Putative Xaa-Pro dipeptidase
MYVCRVTTYDFSHLGHTCAIVSFDNLFGAVLHYGHAAAPNGNTWEDKDMALFDMGADYHFYGCCFYATWSGAFLGIDTHDPRGYLKGLEIRKEPGLKSLRTIIDLREGMVIIVKPGYYFIDALLLAATINNPIISSLAILDTRWEDLRHGPRF

SEQ ID NO: 186436 - protein, 86 aa, Glycine max
  Coding DNA Sequence Number=SeqID_69658
MCSRSLSLVTKMRASRSLSESRYLKVRRGVIEGDDLGEEGGELNGAVDGEDLGIIADVGKLIVVFWFSCSSRSERFSKLISREREE

SEQ ID NO: 186437 - protein, 188 aa, Glycine max
  Coding DNA Sequence Number=SeqID_69659
  Gene Ontology: Mol. function=phosphatidylcholine-sterol O -acyltransferase activity; Cellular component=integral to membrane; Biological process=lipid metabolic process
  Homolog annotation: Hit_ID=Q10PI5; Match level="QueryCoverage=85%, HitCoverage=39%, E-value=2e-75, Identity=80%"; Hit description =Haemolysin-III related family protein, expressed
  Pfam annotation: Domain name=HlyIII; Domain location=1-152; Score =52.3; E_value=1.6e-12; Accession=PF03006.10; Description=Haemolysin -III related
MAYIMLRLDYAGIAALISTSFYPPVYYSFMCDPFFCNLYLGFITVLGIATILFSLLPVFQNPEFRTIRASLFFGMGLSGAAPILHKLYLFWGQPEVFHTTAYEILMGVLYGIGALVYATRIPERWMPGKFDIAGHSHQLFHILVVAGAYAHYRAGIHSSNWCEFVIPAGDVSAAIGIMYTLRTLSTNH

SEQ ID NO: 186438 - protein, 181 aa, Glycine max
  Coding DNA Sequence Number=SeqID_69660
MAENEGSTKPSLICYIPLPILLLNHKYYLSAFPSSTLFFFNSMELEPVEAAFIDDGSGSDIISDNLDDCDNNASTSGNEEHDDSETTEKLTRVQRKKIRKKKLNEEAIHRGKLIGPLLPPPMLQLLCHAQLCLGDDVAACAKSVKVKQRRMAKRLAKEKQNATTSENANQSSTVDIKETHL

SEQ ID NO: 186439 - protein, 238 aa, Glycine max
  Coding DNA Sequence Number=SeqID_69661
  Gene Ontology: Biological process=steroid metabolic process
  Homolog annotation: Hit_ID=Q8LN57; Match level="QueryCoverage=54%, HitCoverage=24%, E-value=1e-30, Identity=40%"; Hit description =Putative oxysterol binding protein
MRALLLIPISKWKDLKDDKEAIQVLEEVYDDDVEELEVLVGLMAEKKIKGFAISETTYVIFQLMATRDSTCACVTVMRKIINLSFVSSSDLINAKLEEHQFYGSKQCLGCKHKFQGKLIHGVVEDKKGTTVATLFEKWDESLHYVIGGNFGKRSLTPEYQTRYNVTQFSITLYEITPRLKAQKMKEKGWKPRWFAKEKGNNSYHYVGGYWETREKENWESCLDIFDQASTDTDFKQTS

SEQ ID NO: 186440 - protein, 449 aa, Glycine max
  Coding DNA Sequence Number=SeqID_69662
  Gene Ontology: Mol. function=transferase activity, transferring glycosyl groups; Cellular component=integral to membrane; Biological process=electron transport
  Homolog annotation: Hit_ID=Q564G6; Match level="QueryCoverage=95%, HitCoverage=99%, E-value=0.0, Identity=71%"; Hit description =Galactomannan galactosyltransferase
  Pfam annotation: Domain name=Glyco_transf_34; Domain location=128 -405; Score=424.7; E_value=1.3e-124; Accession=PF05637.3; Description= galactosyl transferase GMA12MNN10 family
  Subcellular localization annotation: CTP_CleavageSite=18; ConfidenceScore=5.30e-01
MVKSELSNHYHNNNKSPMMMAKPHRNKSSSLFLSDGCLFLGGAFSALILVWGFSSFTTTIPNDTPNFESLSKNDAASHHIAPDFNFDPPDRTFYDDPQMGYTMDKKVRNWDEKREEWLKLHPSFAAGARERVFMVTGSQPKPCRNPTGDHLLLRFFKNKVDYCRLHGCDIFYNNALLEPKMFAYWAKYPAVRAAMVAHPEAEWIWWVDSDALFTDMEFKLPLERYREHNLVVHGWAHLIHEKRSWTGLNAGVFLIRNCQWSLDFMEAWASMGPQSPNYEKWGQTLRSTFKDKFFPESDDQTGLAYLIAMEKDKWAERIYLESEYYFEGYWEEIQGTFKNITEKYKEMEKGVQRLRRRHAEKVSETYGEMREEYLKDAGNAKGSWRRPFITHFTGCQPCSGKYNAMYSAHDCWNAMHNALNFADNQVMRKFGYSLLDNAVSPLPFDYPRH

SEQ ID NO: 186441 - protein, 120 aa, Glycine max
  Coding DNA Sequence Number=SeqID_69663
MRNRDSLYTCSYSHLSLHTRHLFAEIAYQITQVPREFDTRFLPFYITYDIRCTCQKPNSIGRGRGYPIPYGYGDGIINFNPSSIGYGYRDMLGSQGQRLGRQYPYPPHLTAMSMHDDHIN

SEQ ID NO: 186442 - protein, 367 aa, Glycine max
  Coding DNA Sequence Number=SeqID_69664
MANCRKQQGEGHHQVGHWRSSYNRKPPLGNKWHSTVPAWERKFCTSIGSVPWRKLVESKKYMHLFEHVVNWDDSAGKEAFDNAKTRYWAEINGVPCNISPPDPNIFIDEVDWNATVDPQLILDVETELAKVPNEELRKNDHEIVMIGGALFLNEQKLPCTGWDDDYAAEGPKPFDPNSAVQGWGENLQEHNGVESGKLNHAPAEHAGEHVAPAEPAKEDFSLAEPAKEDFSLAEHAKGHEWQDWRNDSWGWNQRENYGGGGGGDLHKMGRGRNGGGGYGNWGTWDGYNRRRENNMSWSKTPSAYNGNNEYHVNNNRGRRNYRGGGRRGNFVYVPKEVPPTPTHAGWFMVYSSTCRGDRFMYIQRKYA

SEQ ID NO: 186443 - protein, 357 aa, Glycine max
  Coding DNA Sequence Number=SeqID_69665
  Gene Ontology: Mol. function=hydrolase activity, hydrolyzing O -glycosyl compounds; Cellular component=vacuole; Biological process =carbohydrate metabolic process
  Homolog annotation: Hit_ID=Q03773; Match level="QueryCoverage=88%, HitCoverage=91%, E-value=0.0, Identity=100%"; Hit description=Glucan endo-1,3-beta-glucosidase precursor (EC 3.2.1.39) ((1->3)-beta- glucan ...
  Homolog annotation: Hit description=endohydrolase) ((1->3)-beta -glucanase)
  Pfam annotation: Domain name=Glyco_hydro_17; Domain location=44-356; Score=611.8; E_value=5.9e-181; Accession=PF00332.9; Description =Glycosyl hydrolases family 17
MLYAALPLHMQRGCFRIRTHDQQVTKAQLYRCTRARPQIFDAQSGVCYGRLGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIVVSESGWPSSGGTATSLDNARTYNTNLVRNVKQGTPKRPGAPLETYVFAMFDENQKQPEFEKFWGLFSPITKQPKYSINFN

SEQ ID NO: 186444 - protein, 449 aa, Glycine max
  Coding DNA Sequence Number=SeqID_69666
  Gene Ontology: Mol. function=ubiquitin-protein ligase activity; Cellular component=ubiquitin ligase complex; Biological process =protein ubiquitination
  Homolog annotation: Hit_ID=Q84QD5; Match level="QueryCoverage=83%, HitCoverage=90%, E-value=8e-42, Identity=30%"; Hit description =Avr9/Cf-9 rapidly elicited protein 74
  Pfam annotation: Domain name=Arm; Domain location=179-220; Score=0.9; E_value=9.4; Accession=PF00514.13; Description=Armadillobeta-catenin -like repeat
  Pfam annotation: Domain name=Arm; Domain location=305-345; Score =16.7; E_value=0.084; Accession=PF00514.13; Description=Armadillobeta- catenin-like repeat
  Pfam annotation: Domain name=Arm; Domain location=346-387; Score=3.1; E_value=5; Accession=PF00514.13; Description=Armadillobeta-catenin -like repeat
  Pfam annotation: Domain name=U-box; Domain location=64-138; Score =43.8; E_value=6e-10; Accession=PF04564.6; Description=U-box domain
  Pfam module annotation: Pfam domain module=Arm::Arm::Arm::U-box; Domain location=179-220::305-345::346-387::64-138
MPMFQPCRKDMVTGYEGGADGQILDLDTAVKDGVLGGVEGGVVGGGVGEKVDLGKMIEELELCEVPSVFICPISLEPMQDPITLCTGQTYERSNILKWFNLGHFTCPTTMQELWDDSVTPNTTLYRLIHTWFSQKYLLMKKRSEDVQGRASELLETLKKVKGQARVQALKEIHQLVASHATARKAVIDEGGVSVVSSLLGPFTSHAVGSEVIGILVTLTLDSESRKNLLQPAKVSLMVDILNEGSIETKINCTRLIESLIEEKDFRSEVISSHSLLVGLMRLVKDKRHSNGVCPGLSLLRTICLHKEVRNLLVSIGAVSQLVELLSGMEPDCTELALCVLDALASVPEGRVALKDCSNTIPIMVKLLMRISENCTQYALSILWSVCKLSPDECSSIAVDAGLAAKLLLVIQSGCNPILKQQSAELLKLCSLNYSDTIFISKCKLTRTIQ

SEQ ID NO: 186445 - protein, 72 aa, Glycine max
  Coding DNA Sequence Number=SeqID_69667
MPGRDREREGNQENKPPKDQCNEKEKKEIIEKGDQRIMMENSKKAWKLKEVKMVNQKDRTTMGYTTEWEEKK

SEQ ID NO: 186446 - protein, 98 aa, Glycine max
  Coding DNA Sequence Number=SeqID_69668
MAEWCRGISKKHHQIAEALRVAYGGAMAAAIAWQSWQNRVNGGIAGFFFKTCATGVGLTRPNPTRVSPAKGNSERENKATNRTVPQSLAARSAAVSSA

SEQ ID NO: 186447 - protein, 406 aa, Glycine max
  Coding DNA Sequence Number=SeqID_69669
  Gene Ontology: Mol. function=ATP binding; Cellular component=integral to membrane; Biological process=photosynthesis
  Homolog annotation: Hit_ID=Q9SLU2; Match level="QueryCoverage=95%, HitCoverage=92%, E-value=2e-82, Identity=42%"; Hit description=CF9 protein
MEVQLVDNFRRKKKWILILCAVGLGGFSAFKLYHAPSVARKRKRLSNLLSALVSVAEAVSESADTIGIVSRDVKDFLESNSDQIPNSLKQISKIARSEQLSESLVSVTRAVTVGVLRGYESMNRTGGDQTGSTVVDRVLDKILTSAGSGFASVVLGSFARNLVLAFYSDQHNHSGREFNSSNSNSETVLAWVDVVCGDRCGELIGNCVQLFVSTAVAVYLDKTMHINTYDDFFAGLTNPKHETNVRDMLLSVCNGAVETLVKTSHQVITSSNADVGSGSDSYLSIGETVRNEDLGVGMSSVESKVDVCDDENKSGWLSKVSSTLAVPSNRSLVLDVTGRVTFETVRSFMEFVLQIFCASVRRCAHIVHEAVLEIVRYVAAKSSVIVTICLSLCLHIMGGGWALVTA

SEQ ID NO: 186448 - protein, 448 aa, Glycine max
  Coding DNA Sequence Number=SeqID_69670
  Gene Ontology: Mol. function=transferase activity; Biological process= metabolic process
  Homolog annotation: Hit_ID=Q9FHP1; Match level="QueryCoverage=96%, HitCoverage=90%, E-value=1e-104, Identity=49%"; Hit description =Uridylyl transferases-like
  Pfam annotation: Domain name=ACT; Domain location=103-175; Score =30.7; E_value=5e-06; Accession=PF01842.15; Description=ACT domain
  Pfam annotation: Domain name=ACT; Domain location=2-67; Score=7.0; E _value=0.53; Accession=PF01842.15; Description=ACT domain
  Pfam annotation: Domain name=ACT; Domain location=246-318; Score =12.6; E_value=0.094; Accession=PF01842.15; Description=ACT domain
  Pfam annotation: Domain name=ACT; Domain location=325-391; Score =33.8; E_value=6.1e-07; Accession=PF01842.15; Description=ACT domain
  Pfam module annotation: Pfam domain module=ACT::ACT::ACT::ACT; Domain location=103-175::2-67::246-318::325-391
MCVVEKQVDSANRKGILLEMVQVLTDLDLIISKSYISSDGGWCMDVFHVTDEAGKKLTDETLMLHIQQELCATRSKREISRDTEMVSQKAPQAQQQNVPKENTALEMSVTDRPGLLSELSAVLVELGCSVTSAMAWTHNDRVACIIFLEDASSPGPISDPERLGLVEEQLENVVAAHGETGQKKSVRVTTLGTGRTHTERRLHQLMYADRDYESCRACDGDSSGEHKKGCDGTHVSVGRCEDKGYLVVNVRSRDRPKLLFDTVCVLTDMQYVVFHAAISSKRSMAHQEYFIRNCKGSLALPSEREKEELTLCLIAAIERRVSHGLMVDIRTDNRMGLLSNVTRVFRENGLSISRFEIGTEGEKAVGSFFVTDSSGEEVNPDIVELVRQASGGSVVTDHKSPHRVHQSSSSSDINETMGSMEPKPKFSLGSLLWSRLERLSGGFGPLRS

SEQ ID NO: 186449 - protein, 466 aa, Glycine max
  Coding DNA Sequence Number=SeqID_69671
  Gene Ontology: Mol. function=ubiquitin-protein ligase activity; Cellular component=ubiquitin ligase complex; Biological process =protein ubiquitination
  Homolog annotation: Hit_ID=Q9FHP0; Match level="QueryCoverage=99%, HitCoverage=100%, E-value=2e-86, Identity=44%"; Hit description =Arabidopsis thaliana genomic DNA, chromosome 5, TAC clone:K14B20
  Pfam annotation: Domain name=BSD; Domain location=171-237; Score =76.4; E_value=9.1e-20; Accession=PF03909.7; Description=BSD domain
MSWFARTIANSLRLDDDDDDHNGSDLKSPPKKPDSVSTPSPTARGVKEDFSELTKSFSRQLWGVASFLAPPPDPLSENPVADPNPIPTDEEEEDVIAGIRNDFAEISGKFKNGIFKISGNKTVSEFTKIASSFLQLGSEEEHDLDGVLGVTEDVVAFARSVALHPETWLDFPLPDDEDSDDFDLSDAQQEHALAVEHLAPSLAALRMELCPGYMSDGNFWKIYFVLVHPRLSKTDAAILSTPQIMEARAMLTQALDKRSKEKKESDLSAGGNIPSKEEEQHLFVPSNAQLEPVPLQTSAAEAAPSVVVSDVEMEKHVVPEIIDKSVVKEAPVISSAEQSSSGSTNRFLDETYDDDADDWLKEEDTSEMVGPSGTSVHTGNDEDVSFSDLEEDDGDVHESYKKTRSGSDSSTKDSRDWVQLGRSSPNSDKDINSVEGKHVGSQHSSARNSVTKDSNDWLNVDDIDVI

SEQ ID NO: 186450 - protein, 172 aa, Glycine max
  Coding DNA Sequence Number=SeqID_69672
  Gene Ontology: Mol. function=protein dimerization activity; Cellular component=nucleus; Biological process=regulation of transcription, DNA-dependent
  Homolog annotation: Hit_ID=Q9T062; Match level="QueryCoverage=68%, HitCoverage=36%, E-value=2e-17, Identity=40%"; Hit description=BZIP transcription factor-like protein
  Pfam annotation: Domain name=bZIP_1; Domain location=70-133; Score =34.0; E_value=5e-07; Accession=PF00170.11; Description=bZIP transcription factor
  Pfam annotation: Domain name=bZIP_2; Domain location=69-123; Score =26.3; E_value=0.00011; Accession=PF07716.5; Description=Basic region leucine zipper
  Pfam module annotation: Pfam domain module=bZIP_1::bZIP_2; Domain location=70-133::69-123
MLSAISFQGNPFPALEYGFTPWDGLHSLGFKPTSPDPNHVTSSSGSDDPNRTHAEEKLASDESNRVASIMEERKRRRMISNRESARRSRVRKQRHLENLRNQVNLFRVENRELNNGLQFLLHHGNRLRTENEWLRSERALLRQKLANINQLLLFQQLQAFSSAWPCNIVMAE

SEQ ID NO: 186451 - protein, 592 aa, Glycine max
  Coding DNA Sequence Number=SeqID_69673
  Gene Ontology: Mol. function=transcription factor activity; Cellular component=nucleus; Biological process=regulation of transcription, DNA-dependent
  Homolog annotation: Hit_ID=Q6SA75; Match level="QueryCoverage=98%, HitCoverage=96%, E-value=1e-100, Identity=41%"; Hit description=ANT -like protein
  Pfam annotation: Domain name=AP2; Domain location=273-343; Score =120.4; E_value=5.1e-33; Accession=PF00847.10; Description=AP2 domain
  Pfam annotation: Domain name=AP2; Domain location=354-420; Score =97.1; E_value=5.2e-26; Accession=PF00847.10; Description=AP2 domain
  Pfam module annotation: Pfam domain module=AP2::AP2; Domain location =273-343::354-420
MKPIENGNTVSINYQNSWLGFSLSPQMNIGVPSHLHQTQPSSAAVEAVPPNFYHHTPLHNYGLYYELEGEHVGMSSSLPIMPLKSNASLSGIEALSRSQAQATTTISAMHSSLNSMLINELLCHGLNNPNNLNHVQEDISQQQFSYYSTLRNQDVILEGSKHQLPCIAEDENPGLKSWFSRDFHARHAEESRMIVPLECNGGESGSIGSITYGDLHSSNLSVSPTSGSSSVTSSPALTNTVATNTKKRWLEMVDQNQKQIVHRKSIDTFGQRTSQYRGVTRHRWTGRYEAHLWDNSCKKEGQGRKGRQGGYDMEEKAARAYDMAALKYWGPSSHINFPLENYQNELEEMKNMTRQEYVAHLRRHHQHGRWQARIGRVAGNKDLYLGTFSTQEEAAEAYDIAAIKFRGVNAVTNFDITRYDVEKIMESNNLLSSEQAKRKREMDDGTRSEATVNQKPSTYDHTQETILMQKRCKNQSEWKMVQFPCPQQLDQNQRIESCRTQPFSTDLDNMFRHQVEERSNMGTHLSNPSSLVTSLSSSREESPDKTSMPMLFGMPSTVSKLLANVDSWDLSSNLRTALSMPQMPIFAAWTDA

SEQ ID NO: 186452 - protein, 256 aa, Glycine max
  Coding DNA Sequence Number=SeqID_69674
  Gene Ontology: Mol. function=transcription factor activity; Cellular component=nucleus; Biological process=regulation of transcription, DNA-dependent
  Homolog annotation: Hit_ID=Q84QC2; Match level="QueryCoverage=36%, HitCoverage=45%, E-value=1e-27, Identity=68%"; Hit description =Putative AP2 domain transcription factor
  Pfam annotation: Domain name=AP2; Domain location=28-92; Score=102.2; E_value=1.5e-27; Accession=PF00847.10; Description=AP2 domain
  Subcellular localization annotation: CTP_CleavageSite=27; ConfidenceScore=5.32e-01
MVKSAMASVDSSSCNNDSFSSNNNIDSCKMFKGVRKRKWGKWVSEIRLPNSRERIWLGSYDTQVKAARAFDAALYCLRGQSATFNFPDTPRHLETNMVLSRDKQPQPLSHQEIQEVAVKFANNDDHPLEEEECAFQKQEQERSLEESQSDESKSGNTIMEMSNFPSIYDGETHNNNVQVDQLKGDWDTMDWTFLNMLDDLNGSDFGLYVGLDKMHPSEFLCPMTQAPLLYHGDDEIEGDDDHDAFSNHSLLWSWNF

SEQ ID NO: 186453 - protein, 75 aa, Glycine max
  Coding DNA Sequence Number=SeqID_69675
  Homolog annotation: Hit_ID=Q2A9T4; Match level="QueryCoverage=99%, HitCoverage=27%, E-value=2e-15, Identity=86%"; Hit description=MO25 protein-related
MPLRLLQIYRGSRFSPSSSPLITWILIWILWMSWYLGHFGHGFISICSGLTTKKFFDYIQLPNFDIAADAAATFK

SEQ ID NO: 186454 - protein, 299 aa, Glycine max
  Coding DNA Sequence Number=SeqID_69676
MLSLRCELAMVPFSEPRVTDTAMATGEDGYGYKHDDSPNRMRFHETNKMARRLEVGGWNYLTSHGMEERLERVLWGEDIGEGAVGVDGEGAAAREGSEASRLGFNAKGECGRTPFECLCGGDDNNNDDDRDTSSGRGGDSNDGSSGNAYGGDSDNTMVVAINNGDIGGDGGDKCSISGGDDEGGISDVGGGCNSSNKGDIGCSDGGDNEIDSDSNTDNDDDVSDNDGCNDNSVSDDSDNNKDGGDVGGSCDIVDSNDGDDNDNNDDNDINSVGDNNNVKSDDVICDDDDHSDIGGGIKW

SEQ ID NO: 186455 - protein, 129 aa, Glycine max
  Coding DNA Sequence Number=SeqID_69677
MSLTYCRCLRPHICRSSLPTNSNSKGPTQTLSASASLYLHFHFHSIKPNPDPARGKHMRKPENTKKIVGLNTGIHLDSGTALGLDAVESVDKSDVGSCALLPPWIVQPTELDPIIWCTSTKLSTSSHNR

SEQ ID NO: 186456 - protein, 56 aa, Glycine max
  Coding DNA Sequence Number=SeqID_69678
MYAMQVFPGTASTLKTYELVPNGSVKDRGLIQRKRIKPKKLANGKGINQREARFLL

SEQ ID NO: 186457 - protein, 86 aa, Glycine max
  Coding DNA Sequence Number=SeqID_69679
  Gene Ontology: Mol. function=nucleotide binding; Cellular component =endoplasmic reticulum; Biological process=protein folding
  Homolog annotation: Hit_ID=Q9LKR3; Match level="QueryCoverage=54%, HitCoverage=7%, E-value=9e-15, Identity=78%"; Hit description =Luminal-binding protein 1 precursor
MTGVCLQLDQFIRGLESSKGPPYFSLGMEDVGLHKNQMDEIDLVGGSTRIPKVRHLLKDYFEGKKPNKGVNPDEELHMVMQCKEAF

SEQ ID NO: 186458 - protein, 139 aa, Glycine max
  Coding DNA Sequence Number=SeqID_69680
  Gene Ontology: Mol. function=RNA-directed DNA polymerase activity; Biological process=RNA-dependent DNA replication
  Pfam annotation: Domain name=AT_hook; Domain location=66-78; Score =15.5; E_value=0.049; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIKKDLEINGLDRSMLDNEHLNSLFVPYTLFSQTHRRSVFQVGQGDPKRIHRLSVSWMQKRCYRT

SEQ ID NO: 186459 - protein, 285 aa, Glycine max
  Coding DNA Sequence Number=SeqID_69681
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=45%, E-value=5e-61, Identity=63%"; Hit description =Integrase, catalytic region
  Pfam annotation: Domain name=rve; Domain location=78-233; Score=55.0; E_value=2.5e-13; Accession=PF00665.16; Description=Integrase core domain
  Subcellular localization annotation: CTP_CleavageSite=35; ConfidenceScore=5.11e-01
MNLKMDSLLEHLANLTPIPTSPKFTPTPTPASCSRSHMKLEIPRFDGSNPIGWIFKATQFFEYQNLPDQEKITIARFYMEGPALSWFQWMHRNGFLTTWPSMHTDVHRFTKGVHFGALPSQYPAFKAATLFIDTFCKLHGFPRSIVSDRDPLFISALWRELFRLSGTKLRMSTTYHPQTDGQMEVLNRVLKQYLRSFVHDRPSQWFKYLALAEWSYNTSVHSGTGILPFKATYGKSLPSIPHYIHGTSHLEPVDDLLATRFAIHDTLRRHLQKAQASMKAVADAH

SEQ ID NO: 186460 - protein, 104 aa, Glycine max
  Coding DNA Sequence Number=SeqID_69682
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=28%, E-value=3e-22, Identity=56%"; Hit description =Integrase, catalytic region
MDLVLKVIGNSNLLPVFSGGIFGGQARPLDQNQLCWRCCRAVPLPVHKGKWLVVMHLEEKAVDRDVVLTMIHEKRDGSWMKQGVLGDKLQVLHVLGCETGQRIA

SEQ ID NO: 186461 - protein, 85 aa, Glycine max
  Coding DNA Sequence Number=SeqID_69683
MEEFDAQVAWPGDQPSSSRGGGASTGQEPVTEEPIAPAPSPAIAEEETTPAQTPQPSLPYAPTPKETQPSKLDLNEDQPKEEEDV

SEQ ID NO: 186462 - protein, 156 aa, Glycine max
  Coding DNA Sequence Number=SeqID_69684
MTTLAQTWSVLSFSNLIPTFHTSDVTLDRARLIYGIIMKMDMNVGYLISHQISLTAQHDTSRLGFLALITALCKARGIQSDSRSLESLSPTINLTYIKKNYWNLDDPTVTFIGPKKARGKRSEAPSTLASEAPTPSSSTLPPSSSIDIPVIPPTPS

SEQ ID NO: 186463 - protein, 246 aa, Glycine max
  Coding DNA Sequence Number=SeqID_69685
  Gene Ontology: Mol. function=RNA-directed DNA polymerase activity; Cellular component=intracellular; Biological process=RNA-dependent DNA replication
  Pfam annotation: Domain name=G-patch; Domain location=74-118; Score =29.9; E_value=8.7e-06; Accession=PF01585.13; Description=G-patch domain
MGVVPSTLHQKLMFMVDGRLVIVSGEEDLLLSCSSSTPYIEATNESLETAFQSFEVVSNTFVESLPMQPRMFDAAMMVVCVMLGQGFEPGMGLGKNNDGMASLVDVKENRGKFGLGYKPTRADLRRSVVERRNRVVGLKSFVSAGLRLEEQVAVIYDEVPQERSDLEDREMRPHQEEIEIVNLGVGDEKKEVKVGTGMTAPVHDELVVLLRDYQDVFAWTYQDMPGLNPDIVQHRLPLNPDCSLVK

SEQ ID NO: 186464 - protein, 69 aa, Glycine max
  Coding DNA Sequence Number=SeqID_69686
RKEAVPNIPQPPWLCILAILGVKNYFREENSSRGAFVKLLRRFREQIREGFPSFFTVLHPFFVRSSFFN

SEQ ID NO: 186465 - protein, 167 aa, Glycine max
  Coding DNA Sequence Number=SeqID_69687
  Homolog annotation: Hit_ID=Q84VH5; Match level="QueryCoverage=56%, HitCoverage=13%, E-value=1e-45, Identity=96%"; Hit description =Envelope-like protein
HSESFAVKLPIAFPTVLCGIMLSQHPNMLNYTDSVIKRESPLSLHYKLFEGTHVPDIVSTSGKFAASGAVSKDALIAELKDTCKVLEATIKATTEKKIQLSKKRQLRKKEKQLKKKKKLLRKRKMQQKRQNQMMILKIVGYDVCMIHDLEGELYEYDFEGETAADDD

SEQ ID NO: 186466 - protein, 84 aa, Glycine max
  Coding DNA Sequence Number=SeqID_69688
MENGSTTRARRAGMVLRGGFPVRWDSEGGADPCGGRRRTGTTVRGRGGRAGQIDRHLRPAMLEATLGRSSPFAKGGHALTPGKP

SEQ ID NO: 186467 - protein, 56 aa, Glycine max
  Coding DNA Sequence Number=SeqID_69689
MSLHVLYLYVFSGYPPGISRLLYLSLQSFKEVNVGAGSSRATFWGRDKVKAAKNQS

SEQ ID NO: 186468 - protein, 104 aa, Glycine max
  Coding DNA Sequence Number=SeqID_69690
FIKHDIQWLSARNNPEEDELSSLLSAPLQVIKRTASAHLLNPRGEGDILTTCVFAVFHLVLLFVVKEVFGLWKAKSSVGSSLGNWSDSKVLGSTRLSRCAITRD

SEQ ID NO: 186469 - protein, 280 aa, Glycine max
  Coding DNA Sequence Number=SeqID_69691
  Homolog annotation: Hit_ID=Q1SDG1; Match level="QueryCoverage=29%, HitCoverage=9%, E-value=2e-08, Identity=33%"; Hit description =Integrase, catalytic region; Zinc finger, CCHC-type
MISHFESIHIDLWVMVENGKCIPYDDQLNEIPRSWWMEKQKLRFLLDSKAQNVMLCALSEEEYTKVKRSKFNLLTRKYELFSMEEGKDIKQDEGPKREKSLVFVVKRTKRPHHLENKSQEAHRKPLKLIIPLMTNLRKTLMKMNSPSSHRRSTRYGKTKRRFKTRRNTTIPKKKEDLMSNWEDLDDTLSNKDEEEANLCLMVNTTFEESELDQEDEKTLQDQVDVSPDESTQTCKACGTLKEKESKLCLENEIIAKEKSTKELSRLVKQTERSSKGSDRA

SEQ ID NO: 186470 - protein, 188 aa, Glycine max
  Coding DNA Sequence Number=SeqID_69692
MVKDECKEVSVPSKRLAKKESHFEIKTNIKETSPLGQPPHLLLCKKTLVSTVTPLRLDIIPQVKELLDKGLIHKSLNPYALLVPKIGISRHQIPKIGYMMNVLSGTILFYKITHAPNIFKIRVDRDSLGRIVLIFSFNTNLGSHMAHLSDQGVPTNTKRIKVIPEWPTPPSIRKIWDFHDLTNFYKRC

SEQ ID NO: 186471 - protein, 93 aa, Glycine max
  Coding DNA Sequence Number=SeqID_69693
  Gene Ontology: Mol. function=unspecific monooxygenase activity
  Homolog annotation: Hit_ID=O04892; Match level="QueryCoverage=97%, HitCoverage=22%, E-value=8e-20, Identity=54%"; Hit description =Cytochrome P450 like_TBP
  Subcellular localization annotation: CTP_CleavageSite=26; ConfidenceScore=5.35e-01
SGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 186472 - protein, 142 aa, Glycine max
  Coding DNA Sequence Number=SeqID_69694
  Homolog annotation: Hit_ID=Q7CR66; Match level="QueryCoverage=45%, HitCoverage=49%, E-value=6e-27, Identity=89%"; Hit description =Putative HesB-like domain
MAIPAMMKKILLACCGALLSGAPHADAVSGRIGVTLTIEPQWAVRLEAAAPRAECSHSAAQPNITRQPALENGAEANSDAERPTATASGFGIRVGHHQARPFQPFGVVHRTADQILQAHRIDHQRHALLLDGHIAIVDLVVK

SEQ ID NO: 186473 - protein, 309 aa, Glycine max
  Coding DNA Sequence Number=SeqID_69695
  Gene Ontology: Mol. function=transporter activity; Cellular component= integral to membrane; Biological process=transport
  Homolog annotation: Hit_ID=UPI00005F7683; Match level="QueryCoverage =95%, HitCoverage=64%, E-value=1e-134, Identity=79%"; Hit description= COG0477: Permeases of the major facilitator superfamily
  Pfam annotation: Domain name=MFS_1; Domain location=39-297; Score= -28.5; E_value=0.0064; Accession=PF07690.6; Description=Major Facilitator Superfamily
  Pfam annotation: Domain name=Sugar_tr; Domain location=42-309; Score=- 134.6; E_value=0.012; Accession=PF00083.14; Description=Sugar (and other) transporter
  Pfam module annotation: Pfam domain module=MFS_1::Sugar_tr; Domain location=39-297::42-309
MVMTVHHSVTQQGSHASAADARLETTSGRKDFWRATFSCWLGTAMEYADFALYGLAAGIIFGDVFFPEATPAMALLSSFATWSVGFIARPIGALLFGWIGDRKGRKVVMISTIILMGASTTLIGLIPSYATIGLWAPACLVLLRFTQGLGAGAELSGGTVMLGEYAPVERRGLVSSVIALGSNSGTLIASLVWLAVIQMDKATLLDWGWRIPFLSSVLIAAVALWIRRHLRETPVFERQQAELQAQRHETLAQSATQPDSRSFWQRSRAFWTLVGLRIGENGPSYLAQGFIVGYVAKVLMLDKSVPTTA

SEQ ID NO: 186474 - protein, 143 aa, Glycine max
  Coding DNA Sequence Number=SeqID_69696
MELLLLRAGLREEERTSIARFLSGLNMEVRDKVELLPYRDLDELVQLCIRVEQQLKRKPSSKSYGSHSYPRKDQAHGILGAAPSKPKEDKGPNSPRPAFGSLGPPNNFKAKALACLGELTASGLSFSSPGRAATAPGWPFAYK

SEQ ID NO: 186475 - protein, 56 aa, Glycine max
  Coding DNA Sequence Number=SeqID_69697
  Homolog annotation: Hit_ID=Q1T098; Match level="QueryCoverage=81%, HitCoverage=8%, E-value=3e-08, Identity=67%"; Hit description =Forkhead-associated
EADLCSMITVVSGNNQREGSGSVVAVLESMGSKGSVVVNETLVKKSTSCMFNSGDE

SEQ ID NO: 186476 - protein, 375 aa, Glycine max
  Coding DNA Sequence Number=SeqID_69698
  Gene Ontology: Mol. function=tricarboxylate carrier activity; Cellular component=integral to membrane; Biological process=transport
  Homolog annotation: Hit_ID=P16482; Match level="QueryCoverage=94%, HitCoverage=79%, E-value=1e-164, Identity=84%"; Hit description =Citrate-proton symporter
  Pfam annotation: Domain name=DUF368; Domain location=61-338; Score= -130.3; E_value=0.06; Accession=PF04018.4; Description=Domain of unknown function (DUF368)
  Pfam annotation: Domain name=MASE1; Domain location=54-339; Score= -60.7; E_value=0.085; Accession=PF05231.5; Description=MASE1 domain
  Pfam annotation: Domain name=MFS_1; Domain location=1-337; Score =57.9; E_value=3.2e-14; Accession=PF07690.6; Description=Major Facilitator Superfamily
  Pfam annotation: Domain name=Sugar_tr; Domain location=1-375; Score =114.0; E_value=4.3e-31; Accession=PF00083.14; Description=Sugar (and other) transporter
  Pfam module annotation: Pfam domain module=DUF368::MASE1::MFS _1::Sugar_tr; Domain location=61-338::54-339::1-337::1-375
MTFAVFGAGFLMRPIGAIVLGAYIDKVGRRKGLIVTLSIMAAGTFLIVLIPSYQSIGLWAPLLVLIGRLLQGFSAGAELGGVSVYLAEIATPGRKGFYTSWQSGSQQVAIMVAAAMGFALNAALEQSAISAWGWRIPFLFGCLIVPFIFILRRRLEETQEFSARRHHLDMRQVFSTLLQNWPVVIAGMLMVAMTTTAFYLITVYAPTFGKKVLMLSASDSLLVTLLVAISNFIWLPIGGALSDRFGRKPVLLAMTLLALATAYPALTLLAQTPTFSMMLSVLLWLSFIYGLYNGAMIPALTEVMPAEVRVAGFSLAYSLATALFGGFTPVVSTALIEYTGDKASPGYWMSFAAICALLATLYLYRRRALTLQTAR

SEQ ID NO: 186477 - protein, 172 aa, Glycine max
  Coding DNA Sequence Number=SeqID_69699
NGHCLRPGDGQQEEEAHYFQNQARPQQNIQGSYQGYRGGSGSNQPYGWRLQNSGPTNTSFVGPSNNSSGGFSNRGPQQHQAQLDRMSKMEDTLTQFMQDNNEKKNKEGIEKENEINDEVVTSEKVVIEEEKNKSNEQTTDKVKAIVNIHQLSIFLIRILRQRKIRKGSTSVL

SEQ ID NO: 186478 - protein, 117 aa, Glycine max
  Coding DNA Sequence Number=SeqID_69700
VVAPPGSIPSIEQFLERVAWPGAQPSLHREDEGPTTQEVAATSERSREVTSDPPIPVVDLSSPQHAIDPSTPILEIPEDLTTPVLTLNTSPPATPVLHLTDEEDVQTQDTQDQSQEF

SEQ ID NO: 186479 - protein, 298 aa, Glycine max
  Coding DNA Sequence Number=SeqID_69701
  Gene Ontology: Mol. function=hydrolase activity, hydrolyzing O -glycosyl compounds; Cellular component=vacuole; Biological process =carbohydrate metabolic process
  Homolog annotation: Hit_ID=Q8LST3; Match level="QueryCoverage=92%, HitCoverage=92%, E-value=1e-97, Identity=62%"; Hit description =Chitinase
  Pfam annotation: Domain name=Glyco_hydro_18; Domain location=26-285; Score=157.0; E_value=4.8e-44; Accession=PF00704.18; Description =Glycosyl hydrolases family 18
MRNKLSHPLCLFLLISLSLFAKSDAGSLVVYWGQNAAEGHLTKTCKTGLFHIVNIAFLSTFGNGTQPQINLAGHCSPVSNGCKRLGIGIKNCQRRGIKVMLSIGGGTKTYSLSSPDDARQVADYIWDNFLGGKSKSRPFGDAILDGVDFDIESGELHYAALAYKLHDHYAGSSKKFYLTAAPQCPFQNNLLHGALTTGLFDHVWIKFYTNPQCEFTPKDPTGFKSAWNQWTTSINAAGKFFVGLPASHAAARTGFVSSHALINHLLPIVRSPKYGGVMLWDRFHDLQSGYSGKIRRSV

SEQ ID NO: 186480 - protein, 69 aa, Glycine max
  Coding DNA Sequence Number=SeqID_69702
MNLGESFRNLRVPATQLSMPWIFFINGFLYFLKINDNKMEKEKDNWRHHFKEKISQEEAHHHRKLWIRA

SEQ ID NO: 186481 - protein, 80 aa, Glycine max
  Coding DNA Sequence Number=SeqID_69703
MVLCYMKKVVGEESAMGALNLGDAKTMRLGKEHNQSQFPNQTLIKKERIPDNLGEGTEKEKGTSQIKPKSKPRENPNQTL

SEQ ID NO: 186482 - protein, 81 aa, Glycine max
  Coding DNA Sequence Number=SeqID_69704
MAPYEALYARRCRTPLCWFKTRETFDAILPRKGPVTRAMSKRLQKDWARATEEGPRVLMNLRVGYPRNVRFFSPCILGHLD

SEQ ID NO: 186483 - protein, 93 aa, Glycine max
  Coding DNA Sequence Number=SeqID_69705
MKLIVPLQGLVLGRRGLLLGTLVPCTLFYFLQQHSRLHDEEGIGRRRDCVFEKESVTRGHQEEHKELAATICHPSLEQFFGMRPHVIDSNSLF

SEQ ID NO: 186484 - protein, 119 aa, Glycine max
  Coding DNA Sequence Number=SeqID_69706
  Gene Ontology: Mol. function=oxidoreductase activity, acting on CH-OH group of donors; Biological process=alcohol metabolic process
  Homolog annotation: Hit_ID=Q1SGN8; Match level="QueryCoverage=66%, HitCoverage=14%, E-value=1e-17, Identity=60%"; Hit description=GMC oxidoreductase
  Subcellular localization annotation: CTP_CleavageSite=57; ConfidenceScore=5.11e-01
MRSLRARMQPKVWVVKKQKDIAFVLRFLHYLNVVTLISKISRPLSSGFLRLALTNVNANPVVRFNYFNNPVEMERCMNGMRKIAKILGSRALRVSSSTIVSGSQTSGSFTTTKNIFYDG

SEQ ID NO: 186485 - protein, 286 aa, Glycine max
  Coding DNA Sequence Number=SeqID_69707
  Pfam annotation: Domain name=RRM_1; Domain location=54-124; Score =19.7; E_value=0.0021; Accession=PF00076.12; Description=RNA recognition motif. (a.k.a. RRM, R
MRGERGERNRGWESVRHRERFQAGPQQISTRMRDGQHNHRNQTNWRDQRGITSYYFTRFADDINEKVLWQHFKRWGDVREVYISKQTNENGRRYGFVRYKDVKDEYRLERQLDSIVVGGLKLYVNLPRFGRRNGGNRSQGAKRQEQQQVKITEAWSQKQRGEGANKSTYVEVVAGKRNTAKSREGGSSSVYLEPSDEMLKWLKDAWVGRLSNPAKFDKVEDELRWDYGVDISAKYMGDDMVLLLGLNEASAENLLHEDSHGTPPLFIYSIHAQYLANHTLNRKPNE

SEQ ID NO: 186486 - protein, 152 aa, Glycine max
  Coding DNA Sequence Number=SeqID_69708
  Gene Ontology: Mol. function=transcription corepressor activity; Cellular component=signalosome complex; Biological process=red or far red light signaling pathway
  Homolog annotation: Hit_ID=Q8W207; Match level="QueryCoverage=98%, HitCoverage=35%, E-value=3e-63, Identity=78%"; Hit description=COP9 signalosome complex subunit 2
  Pfam annotation: Domain name=PCI; Domain location=25-129; Score =108.9; E_value=1.5e-29; Accession=PF01399.17; Description=PCI domain
MLMESEVNPFDGQEAKPYKNDPEILVMTNLIAAYQRNEISEFEKILKSNRRTIMDDPFIRNYIEDLLKNIRTQVLLKLIKPYTRIRIPFISKELNVPEHDVEQLLVSLILDNRIQGHIDQVNRSKGMKKYTAVDKWNTQLKSLYQTINNRVS

SEQ ID NO: 186487 - protein, 137 aa, Glycine max
  Coding DNA Sequence Number=SeqID_69709
MGNKWKQELGNIQIHQAWPKIISSNETYPPHLFPAYSQNNSKAPKFLKGKGLHREILNPQVGIGPDTAAARGGPTASYRFATVASRGGTISERQLNETFYHYNLHQQSQDPSPFPWPTPEQFEATVAWPGDKTEFEM

SEQ ID NO: 186488 - protein, 209 aa, Glycine max
  Coding DNA Sequence Number=SeqID_69710
MSFDRDYFSLPLVIQWQASPLTRRDQHGCLHPSSKDQCLSTETTLVSPSSSRDNQSPPRHPEASQPVDTQRPTWSFAPFIEDSMSFDHHYFSLPFVIQRKSSPMTHRDQRGRLHPSSKTQCLSTETTEVSPRHPEASEPIDTQRPTWSSAPFVEDSMSIDRDYFSLSILSSIDNQHWAHLGPSGSFNMKQPARLGEHVASRGSFQLTWA

SEQ ID NO: 186489 - protein, 82 aa, Glycine max
  Coding DNA Sequence Number=SeqID_69711
MTTLASACQLDLGSLNDEVWITRFVSKRPFRGNIGSNKIEENHSKCINLTQVYGGLRFWLKRLVEQLNMIYVRALVWPAIQG

SEQ ID NO: 186490 - protein, 51 aa, Glycine max
  Coding DNA Sequence Number=SeqID_69712
  Homolog annotation: Hit_ID=Q9LTU4; Match level="QueryCoverage=94%, HitCoverage=3%, E-value=2e-11, Identity=63%"; Hit description =Helicase-like protein
MADVIRPYKESLTRQSRCIHVHSGIPTTRTSSCPFIVIFTRQQQISISKRY

SEQ ID NO: 186491 - protein, 71 aa, Glycine max
  Coding DNA Sequence Number=SeqID_69713
MPLRTLFLLPHQALIPEVSGVGSNGQIGSKNAISRSHRRPAYKTQVFINKETEAAAEPHRIGEGRREKDDQ

SEQ ID NO: 186492 - protein, 272 aa, Glycine max
  Coding DNA Sequence Number=SeqID_69714
  Gene Ontology: Mol. function=nucleic acid binding; Biological process= transport
  Homolog annotation: Hit_ID=Q8H6Q8; Match level="QueryCoverage=46%, HitCoverage=4%, E-value=1e-24, Identity=45%"; Hit description=CTV.20
  Pfam annotation: Domain name=MP; Domain location=75-250; Score=41.5; E_value=2.9e-09; Accession=PF01107.9; Description=Viral movement protein (MP)
  Subcellular localization annotation: CTP_CleavageSite=25; ConfidenceScore=5.38e-01
MKAKILENVLIMSRLLRSFSRISFRSNSSSSSSSRNTNLLNDQDNQTQEVAPKHNLFDEEVRFEDINQNMDDWNIPEIPQDQLYVPETIKDKHNFDYIIKTVENNIPLGQDIGEEFHLLSKNSIYEHSRKYKYLHIGCVQVAIKPLIDMGIDAAVLMCLRDIRHNQFEDSLIGTVETSLGQGPIYFNCYPNKTVSLMDRNILDSLFLNIHFHGLDMNEGSIPVALIYRIQYKVMNTCASRVLLKPQKGETTLFITDMTKANVSLPRKIKCDE

SEQ ID NO: 186493 - protein, 121 aa, Glycine max
  Coding DNA Sequence Number=SeqID_69715
MKNTQIYQSILIRTSIEFPSITEKEKGLKPQFHGPTCNASFSLHRDYFENPNGNVAIKRVFLSTPTLFQNSQRCECSEARFGGMRENERVLRGGEGKMKVRGREGVEGIVSLKTDLRCPYL

SEQ ID NO: 186494 - protein, 44 aa, Glycine max
  Coding DNA Sequence Number=SeqID_69716
  Homolog annotation: Hit_ID=Q1RSG6; Match level="QueryCoverage=80%, HitCoverage=5%, E-value=5e-07, Identity=77%"; Hit description=B3/4
MNLQLNVDWLHDVAIAYGFNAIRYQAAVDNKGSKRLVPSLTLLK

SEQ ID NO: 186495 - protein, 40 aa, Glycine max
  Coding DNA Sequence Number=SeqID_69717
MAKQLKSLELEKKGHLQQGQKDHAEPNSAVRCLIIVIKHI

SEQ ID NO: 186496 - protein, 209 aa, Glycine max
  Coding DNA Sequence Number=SeqID_69718
  Homolog annotation: Hit_ID=O80383; Match level="QueryCoverage=32%, HitCoverage=13%, E-value=8e-21, Identity=72%"; Hit description=98b
  Subcellular localization annotation: CTP_CleavageSite=15; ConfidenceScore=5.41e-01
MAPNSIAFPVVVTVTLMYRNSSFRLFKGYSEGNLQRGTSQNVTTTAERLPNVTKTHGFQLGRAIQNTTHDSSGGKDQGNNNSIVSSGVKERQRRSQNHTSIEGRINNNITTVDDVIMELLSAEDCYCRRLKIFLATLLQKTVTAEEKKPYEGIYHAGKEAYLQVIAKEKRETDSMRFLEDEQKQRTAMELLEQYMQFKQEAEKDGKKNK

SEQ ID NO: 186497 - protein, 57 aa, Glycine max
  Coding DNA Sequence Number=SeqID_69719
MVTYPCGLKIIVLEDTKEYISYVSKEEAKTQHRRPTDLLVCLDVEMRSTSYCIPVIT

SEQ ID NO: 186498 - protein, 358 aa, Glycine max
  Coding DNA Sequence Number=SeqID_69720
  Gene Ontology: Mol. function=nucleic acid binding; Cellular component= chromatin; Biological process=DNA integration
  Homolog annotation: Hit_ID=Q2HUL7; Match level="QueryCoverage=99%, HitCoverage=26%, E-value=2e-65, Identity=38%"; Hit description =Integrase, catalytic region; Zinc finger, CCHC-type
  Pfam annotation: Domain name=zf-CCHC; Domain location=250-264; Score =6.7; E_value=0.079; Accession=PF00098.13; Description=Zinc knuckle
MAPTTSTTTNELKELMEFNNNFQFPIKLTATNYPAWYKQVHALLIVRDLEGYVTSKIVCPLATVGSGDAAAPNPAYSLWIRQDKLIYLALLGSCDSEARSVMAAVDTSCDAWVALARAFSNQSQSRIMSLRERLSSITKGTSSVSTYLPSIRNIADELALIGHPIDDLEMVIHTLNGLGPTFREFIASIRTRDSPIAFNELYDKLVDFEMYLQREERLSTNIPITANVVQHHQHGQSRGHFFHGHQHNHHYCEKPGHFVKQCYKIHGYPNKPRQPFANVAQTTSSHSPPPSWLFDLGASHHITNDLTNLTLKDDYHGNDNLQVANGNQLPITHIGSTTIPTNGSSLRLLDILYVPNVT

SEQ ID NO: 186499 - protein, 175 aa, Glycine max
  Coding DNA Sequence Number=SeqID_69721
  Gene Ontology: Mol. function=enzyme inhibitor activity
  Homolog annotation: Hit_ID=O49908; Match level="QueryCoverage=84%, HitCoverage=92%, E-value=2e-19, Identity=39%"; Hit description =Invertase inhibitor precursor
  Pfam annotation: Domain name=PMEI; Domain location=31-170; Score =101.0; E_value=3.6e-27; Accession=PF04043.6; Description=Plant invertasepectin methylesterase inhibitor
MLNLKHLSIICSILVVAIISMSACHCRVLQPNDLKLIEETCKRTPNPNLCLQLLKADPRAPSADIAGLALILVDVIKAKATEAEKTIKQLLKQGGNKKALSECADDYDGILKLDVPTATRAVRGNPKFAENAVSDCAVEADSCENGFHGKSPLTHVNNGMHDVANVARAIIRNLL

SEQ ID NO: 186500 - protein, 101 aa, Glycine max
  Coding DNA Sequence Number=SeqID_69722
MESSSVIISSHRNRFNAIVDHQQHHGVKHHRHPGVWESHLKNGRPNQYITAPKFIRILILPSTYMPAVKVIFTPACSSHQPLNGGECFYITLGLSRIFMID

SEQ ID NO: 186501 - protein, 140 aa, Glycine max
  Coding DNA Sequence Number=SeqID_69723
  Homolog annotation: Hit_ID=Q2R3Y3; Match level="QueryCoverage=45%, HitCoverage=84%, E-value=2e-11, Identity=46%"; Hit description =Expressed protein
MIPQIPGIGSAGVDMDFNGEDEDIVEREQDERVDENSFVIGLHATELKLLPVPRKGEKQPWLEQHEQNHPVQHRRKRVVEGSECLAWLCYSVVGTRVLGFCVNVWRGYALLDLIKGLSEPLLSRDAKEDNNHAWSVARGP

SEQ ID NO: 186502 - protein, 894 aa, Glycine max
  Coding DNA Sequence Number=SeqID_69724
  Gene Ontology: Mol. function=nucleic acid binding; Cellular component= chromatin; Biological process=DNA integration
  Pfam annotation: Domain name=rve; Domain location=360-523; Score =162.3; E_value=1.2e-45; Accession=PF00665.16; Description=Integrase core domain
  Pfam annotation: Domain name=zf-CCHC; Domain location=121-138; Score =10.6; E_value=0.018; Accession=PF00098.13; Description=Zinc knuckle
  Pfam module annotation: Pfam domain module=RVT_2::rve::zf-CCHC; Domain location=725-894::360-523::121-138
MKGGEKVEEYFARTLTIVNKMKIYGENITQVMIVEKILRSMTSRFDYVVCSVEESNNLDSLTVDELQSSLLVHEQRMNSHGGDTRDEQALKVSHEEQNGGRGFGRGRGRGRGRQSPNKATVECFKCHKLGYFQYECPRWKESANYAEIYEEEEMLLMSLVEADNLQQEETWFLDSGCSNHMCGNREWFSTIDEAFRHSVKLGNDSKMEVLGKGNIRLQINGAIHVVTDVYYVPDLKNNLLSVGQLQERGLALLIQDGKCKLYHPRRGLIMQTEMTANRMFVLLASVVLEETSTFLQLATEDSSQLWHRRFGHLSYKGLRTLQHKQMVKGLPFFKDSSKSCPGCFVGKQHRDVIPKKSQWRASHKLQLVHADICGPITPNSNSNKRYFITFIDDFSIKVWIYFLVEKSEAFTTFKYYKSLVEKESGAFICCLRTDRGGEFTSNEFNEFCKIHGISRQLTTSYTPQQNGVAECKNRTIMNMVRCMLCDKQVPKVFWPEAAKWTVHVLNRSPTLTVKDKTPEEMWSGIKPKVDYFKVFGCLTHVHVPDQKRTKLDDKSLQCVLLGVSDESKAYRLFDPVARKIIVSRDVSFEEDKGWNWGRIAEEVKHDVLIWEGSNDSEDASSENEEEAVVEGTETAGVTDQDAEATTSTSSDSSNEDASVHATAEGRSRRAPNYLQDYETGEGLSEDEDYFAMFISDDEDYFAMFTSHEDPSSFEEAERDEKWRKAMDLEIEAIKKNETWQLTALPKGAKKIGVKWVFRTKLNENGEVDRLKARLVAKGYAQQQGIDYNEVFAPVARWDTIRMVLALAAQKGWNVYQLDVKSAFLHGELTEDVYVEQPLGYVRKGEEEKVYKLKKALYGLKQAPRAWYSKIAAYFVKERFERCDHEHTLFVKTGG

SEQ ID NO: 186503 - protein, 108 aa, Glycine max
  Coding DNA Sequence Number=SeqID_69725
MDMNNEALNMSKDGGLSNSAILTSMQNIRWQTLYRNSPHHLKEEGVDKDADGKITEEEIKEIDNPGDALVAWTRGNYKRKKIDTQPWDEVLVAWGGQGREFLLHDSIL

SEQ ID NO: 186504 - protein, 86 aa, Glycine max
  Coding DNA Sequence Number=SeqID_69726
MTSSNKQIHTYFINISCKIATSTKHQHWLEKNRQVMQAPLELVGLGSSSSMDSFASWKMNGSGMEKEEREETPLQGEDESRRCSPP

SEQ ID NO: 186505 - protein, 127 aa, Glycine max
  Coding DNA Sequence Number=SeqID_69727
  Homolog annotation: Hit_ID=Q5ENY3; Match level="QueryCoverage=33%, HitCoverage=4%, E-value=3e-14, Identity=81%"; Hit description =Respiratory burst oxidase 2
  Pfam annotation: Domain name=FAD_binding_8; Domain location=23-118; Score=8.6; E_value=0.0001; Accession=PF08022.2; Description=FAD -binding domain
MISHNHLDSLKAKYLPMHAVDFRNIFKMTLVAVYPGNVLALHMSKPQGFKYSSGQYIFLSCPDVSPFQWCLCGSLSTLDLPVIGYDLLMQSYPARALDRKLQVDWAKDAREGPRVLMSLRVDFEPMD

SEQ ID NO: 186506 - protein, 118 aa, Glycine max
  Coding DNA Sequence Number=SeqID_69728
MLAFPFEMLRNFTDYATMLILRVSKGTNKRRVLHVVGLECLWMTKATIYCLRASSDLSSLDDEGADNHEVSPHAIGPSSHDSRIETFSRSRPKDADISGKGADDHIGLCVSTGSLAFG

SEQ ID NO: 186507 - protein, 101 aa, Glycine max
  Coding DNA Sequence Number=SeqID_69729
MASSGPVFSFSGTPTITTAKLNWKNYPSWSASVELWFLGQGHHDHLEKTSDSVSVDKRPEWEKLDYQLCVEIFANDIQSLFDATMKVIALKQTSHDMIAHV

SEQ ID NO: 186508 - protein, 221 aa, Glycine max
  Coding DNA Sequence Number=SeqID_69730
  Gene Ontology: Mol. function=isomerase activity; Cellular component =cellulose and pectin-containing cell wall; Biological process=cell redox homeostasis
  Homolog annotation: Hit_ID=Q5EUD5; Match level="QueryCoverage=84%, HitCoverage=41%, E-value=2e-75, Identity=72%"; Hit description =Protein disulfide isomerase
MLTVMLKRFKVQGFPTILVFGADKDSPIPYEGARTALAIESFALEQLETNVAPPEVTELHSPDVLEEKCGSAAICFVAFLPDILDSKAEGRNIYLQQLLSVAEKFKRSPYRQVKNYVWVAAGNQPDLEKNVGVGGYGYPALVALNLKKAVYAPLKSAFELDQIIEFVKEAGRGGKGNLPLQGTPTIVKTEPWDGKDGEIIEEDEFSLEELMGEDASSKDEL

SEQ ID NO: 186509 - protein, 58 aa, Glycine max
  Coding DNA Sequence Number=SeqID_69731
MMVQELGTPGHGGLKVLQPVIPPLSGAGGARCSVKPASRCALHHEVKNKNEYIYSDNW

SEQ ID NO: 186510 - protein, 108 aa, Glycine max
  Coding DNA Sequence Number=SeqID_69732
MAKINIGCSFANREEIWEWYALGWRGGIWYATKKFRKEQMKMLGQITPKRWQLLGKIKPRGFQFQFLRRKLTRFKVSDTATKNLKRLLALHKFFIPHGRSALETYVLF

SEQ ID NO: 186511 - protein, 106 aa, Glycine max
  Coding DNA Sequence Number=SeqID_69733
MAEECTAMDVHGSMVMVAVQCGGDGIGILLRDIAWFSPLELPLLPLPLLGSMKNNSNLQHSQIKDIVAGSASGAFSIPACVATAGTSLIIGFAPTLTCKQHARSAP

SEQ ID NO: 186512 - protein, 894 aa, Glycine max
  Coding DNA Sequence Number=SeqID_69734
  Gene Ontology: Mol. function=metal ion binding; Cellular component =integral to membrane; Biological process=chromatin modification
  Homolog annotation: Hit_ID=Q336R3; Match level="QueryCoverage=96%, HitCoverage=97%, E-value=0.0, Identity=43%"; Hit description=Zinc finger, C3HC4 type family protein, expressed
  Pfam annotation: Domain name=M; Domain location=334-354; Score=6.0; E_ value=20; Accession=PF02370.7; Description=M protein repeat
  Pfam annotation: Domain name=M; Domain location=522-542; Score=2.1; E_ value=67; Accession=PF02370.7; Description=M protein repeat
  Pfam annotation: Domain name=M; Domain location=599-619; Score=1.0; E_ value=93; Accession=PF02370.7; Description=M protein repeat
  Pfam annotation: Domain name=M; Domain location=700-720; Score=3.0; E_ value=51; Accession=PF02370.7; Description=M protein repeat
  Pfam annotation: Domain name=M; Domain location=798-818; Score=4.6; E_ value=31; Accession=PF02370.7; Description=M protein repeat
  Pfam annotation: Domain name=zf-C3HC4; Domain location=842-880; Score= 34.0; E_value=5.4e-07; Accession=PF00097.15; Description=Zinc finger, C3HC4 type (RING finger)
  Pfam module annotation: Pfam domain module=M::M::M::M::M::zf-C3HC4; Domain location=334-354::522-542::599-619::700-720::798-818::842-880
MICSLQADAGVLQFQNQQLVQQIDIQKHALHDLEEKIRELKGKQSSYDDLLIALNQLWTQLVDDMILLGIRAGRGKGKDTLQHLTDIDNPQGSVPLCPAEDMFLCRLIQKDSIKGISDDEIISYVEEALALRQSYTRELLKLLKDTIDDQMERAGSIAQVLHGDLSSEDAIIQMSKIDDMTKEEVDNFREVVDTLHAKHKEYTVAIQNSINEYSQDQSEIKRLADVVLTLLADRLFPGFEPVTGHKAATLLLCQGELDEIVAELEESRRKLVNLEMQKDAAIGMNSPKADAVNGNLSPENIADRTMGLRELKDSIEEAKIVDADRLSELQDAQEDNQTLTKQFQDLQNELKDDKYVRTSRIYSLANDQLQHWMTELARYKTSVESLQAGSVHVAKWENELNLKLESADSARQILGNSDHRIDDLELQLQKCIIEKNDLEIKMEEAKQDTGQHITCSVFRLVVHVIGSQFLTSLNVSGRKDIKSEFHVMASALSKEMGMMEGQLKRWKDAAHEAVSLREKAHSLREALSTKTEKLQKENQELEFVLDMHGLENYDKRYSEVRESESKAHSQAEMLKNALDEHSLELRVKAANEAEAACEQRLSAAEAEIEDLRSKLDASERKVSGDEEWGRDILELTEAVKVKDAEAEAYISEIETIGQAYEDMQTQNQNLLNQVIERDDYNIKLVSDSVKTKQAHNTLMSQKQALAKQLQQINTSIENSKTRITHSEEQMKAILSDAIKCNQEEKHLAVTLEFAKWELADAEKELKLLKSAVSSSEKEYDQIQKDTEAIEMELESERSLRKKLEEELRELNCKIDELTSETGETTIQKLEKEIRICKNMIKCTVCTDRPKEVVIVKCYHLFCNPCIQRNLELRHRKCPACGTAFGQSDVRFVKI

SEQ ID NO: 186513 - protein, 109 aa, Glycine max
  Coding DNA Sequence Number=SeqID_69735
  Gene Ontology: Mol. function=inositol or phosphatidylinositol phosphatase activity
  Homolog annotation: Hit_ID=P54928; Match level="QueryCoverage=50%, HitCoverage=30%, E-value=3e-11, Identity=46%"; Hit description =Inositol monophosphatase 3 (EC 3.1.3.25) (IMPase 3) (IMP 3) (Inositol- 1(or 4)-monophosphatase 3)
MYFDLKDLGNTTSQWDLYGSDAPSPYNTLQIIQKGFHRTKNVHRKGLFIGKETTTVGGNAELTDETTLIVDPLDGTTNFVHGIPTSKHMPDIFGTIVFMSLCKLRRYKI

SEQ ID NO: 186514 - protein, 99 aa, Glycine max
  Coding DNA Sequence Number=SeqID_69736
  Homolog annotation: Hit_ID=Q945P0; Match level="QueryCoverage=79%, HitCoverage=36%, E-value=1e-15, Identity=54%"; Hit description =Transcriptional activator FHA1
MVIIIVRTSQPESSVVREKIELLVLNLEEILGIELDRGVTGEVKDALDEAAILVEDLEGEVAATTKSPAIIMEKSSRMVVAAGFRGRSRVKRMTMRAQE

SEQ ID NO: 186515 - protein, 55 aa, Glycine max
  Coding DNA Sequence Number=SeqID_69737
MKKALQREYHEEEFDDEDDVSGKKMRGDRYDGYGYTGGKSLMSTPMDCRCRQGLW

SEQ ID NO: 186516 - protein, 48 aa, Glycine max
  Coding DNA Sequence Number=SeqID_69738
  Gene Ontology: Mol. function=oxidoreductase activity, acting on the CH-OH group of donors, NAD or NADP as acceptor; Biological process =malate metabolic process
  Homolog annotation: Hit_ID=P37225; Match level="QueryCoverage=77%, HitCoverage=6%, E-value=6e-11, Identity=86%"; Hit description=NAD -dependent malic enzyme 59 kDa isoform, mitochondrial precursor
MKNVLVDMIVLTNGSHILGLGDLGVQGIGIPIGKLDLYVAIVGTKRIK

SEQ ID NO: 186517 - protein, 179 aa, Glycine max
  Coding DNA Sequence Number=SeqID_69739
  Gene Ontology: Mol. function=actin binding; Biological process =cytoskeleton organization and biogenesis
  Pfam annotation: Domain name=Transposase_21; Domain location=22-172; Score=53.9; E_value=3.3e-19; Accession=PF02992.5; Description =Transposase family tnp2
MHKCPRCGVSQYKVKDDDDCSNDESTKKGLLAMKKINRLYLDFGKETRNLRLGLATYGMNPFGSLTTKHSLWPGLLVIYNLSPWSCIKCKYMTLSMMISGARKPRNDIDVYPSPLIEDLRKLWDERVNVIDGNQNETFKLHTMGHCACPICEEDTSGLKTSDDYKEAAESTLIEFYTII

SEQ ID NO: 186518 - protein, 85 aa, Glycine max
  Coding DNA Sequence Number=SeqID_69740
MEREMITMIVDTLPVFYYENMVGYMPSSFANLVFTVERIEVGLRRGKFDYPVLMNRKPGANGENKKEGETHVVVVVPTWSNFPLA

SEQ ID NO: 186519 - protein, 182 aa, Glycine max
  Coding DNA Sequence Number=SeqID_69741
  Homolog annotation: Hit_ID=Q1SJY5; Match level="QueryCoverage=44%, HitCoverage=7%, E-value=5e-09, Identity=57%"; Hit description =Integrase, catalytic region
MTVERSMFLDLKPHEGGAVAFGGIGKGKISGIDILGYTSLLISKGISRSLKYSIKEFNMKKDFANAEKGSRFSQSDHGTKFENAEFRSFYEKEWYFPQLLFTKETSTKWEIRLFVPPKEREIKLFEEILPQLEESSNHKPQVKDWNALVSKIEPKTIEETLTDDEWIIAIEEELHQFTRNNV

SEQ ID NO: 186520 - protein, 138 aa, Glycine max
  Coding DNA Sequence Number=SeqID_69742
MSSNLEMVAYDIGLASRASTTTSLSIVIGRECAKLRVEVLQQSPLSFWSLAVACLSSSSLIKHFVRECCLVLVIAPTLPLLGVGEPGLGIGWEGGLRTVGKVQGSKQVGMMMIKIYVLLKIGKAWLPPLASIEKTLQT

SEQ ID NO: 186521 - protein, 114 aa, Glycine max
  Coding DNA Sequence Number=SeqID_69743
MKKILGLEAPMELTSGSFQVLLNNLEALGQIYFKAQINLKVLDSFLKDKKKKSMMGTCNDSNSEKNSISDDEQANICLMADTNDNVEIRTCPESYTSSCASSDDENDMPYDLLL

SEQ ID NO: 186522 - protein, 99 aa, Glycine max
  Coding DNA Sequence Number=SeqID_69744
MEDAKPMKTLMHASNPLSKDESGKLVDQALYRDAIQVFPEDWFIIEKWINFQNLKEEGFDMKGLFGRQDGVSIKGNDVEKRVVISPTTIIVASGCALDG

SEQ ID NO: 186523 - protein, 99 aa, Glycine max
  Coding DNA Sequence Number=SeqID_69745
  Subcellular localization annotation: CTP_CleavageSite=33; ConfidenceScore=5.04e-01
MPNFTMTVRDTNCLKGKQTAKHSTPSKRKVYPLGAIVWRSREVAFHEMPFSIPLYLQQLLSLMATFNVVLPWNHAKSMESVYIEDIYLEDLELSPTFSK

SEQ ID NO: 186524 - protein, 148 aa, Glycine max
  Coding DNA Sequence Number=SeqID_69746
MKLCFYIMHSDLLVAYYELKRSTRVLKLSMDFEGFHHIRLRAVGEYQYLSWLLEEDSSLRKGTSEKERSWGMFYYGPTVGIKCTYQNSELSHVKVDVAKVDFKNSHVILRVAFVKRTRGETYKTKNFDPQIIRYLPRDKDIAIYSSNK

SEQ ID NO: 186525 - protein, 117 aa, Glycine max
  Coding DNA Sequence Number=SeqID_69747
  Subcellular localization annotation: CTP_CleavageSite=30; ConfidenceScore=5.12e-01
MAGRWVRKQDLPPPIPNERTPSPPPQRDTSSSLLTKVLTEFCDLQAFVVVFSGRFWLFDVAKGGENLRVEFIINLGRNSNLKGDEHLLSTRKNLEEDELYRFAKRTASVHPLSEKGR

SEQ ID NO: 186526 - protein, 257 aa, Glycine max
  Coding DNA Sequence Number=SeqID_69748
  Gene Ontology: Biological process=protein modification process
  Homolog annotation: Hit_ID=Q1RX70; Match level="QueryCoverage=94%, HitCoverage=34%, E-value=4e-47, Identity=50%"; Hit description =Ubiquitin
MELQRKIKEKSKNISFQRRETSLCFVKQMMLGGNINATLKEAFYQEISQKNVQFIAQQKWRHRKGPISLARISERLALPYLILQRASKKDKDLPTQAEMIIETPQSMNGKKPVDVETNDAIIKLQDLVENSGQSPFEAFMTMFGKEKSGRVCCLGRTKTPTLLKRNIEIKKRHANEVKELNDKIQEIKGKSRKEMAAAEEKRSQEMAAMDQKFQILLKTVLNQNDSKFNVAALISTPANANSGLHSSTSTHAPINED

SEQ ID NO: 186527 - protein, 412 aa, Glycine max
  Coding DNA Sequence Number=SeqID_69749
  Gene Ontology: Mol. function=nucleic acid binding; Cellular component= intracellular; Biological process=DNA integration
MLKVFGCPTYYQVSEGKLEPRAKKGFFIDYEDGVKGFQVKDVTKQVEFESSTIRNMSDQKKFEAPNETNQDLQMHPQHHNTTPVERTKWTRRCKWIFKKKYGSSTEEVVRYRACLVAKGYMAIMDMELEQLNVKTSFLHGRLEEDILMQRPEGFKEEGKEKIVYRLKRSLYKLEQLSRQWYKRFDDFIVFHGTWDLVKRFWAWRSRGIEFRRSSFSVRRNTFRNTAQSKLKKEYMFHVPYTSVIGGLMYVMVFTRPDLAQAFSVMSRDTSYALTGYSDYDYATYLDGRIFMIGYAFTIGNSLANCKATILLTFALSTTRAEYMALVEATKQGILLKGLISNQGFPKEKAIIFYVNLSVISILNVATYPSAGGRRETRGMRVPRKEYARSRHQRLFEENVGKTGKDAIYELLS

SEQ ID NO: 186528 - protein, 505 aa, Glycine max
  Coding DNA Sequence Number=SeqID_69750
GREFLEPPSMDKYCLMLRVVNMLLALRAGSDMSGNSDSGGSDAILSRKGPVTRVMSKRLQEDWARATKEGPRVLMNLRHPLQASYPRHILGGEVPSSMAYSLVDDVSPLLFSFAFCCISMQPLVDPKVISIDTSCLCGRANPSVASLVGKPISATMILTPSISKGARKSGCGDGGIGQSALLFYVQVSVQGLESGSFLDLFPSDPARFKSFDEDLLTLVQGTILLRPWMVKCLTLFSFMSEVRPAGGTMPPSAAIPHAEEGGKTVVEVGLTIEVVEVSPSVPSFVLVKRKQDGNPRDPPPTLLADQASAPTVVFIYAPPPPPATPVHAIVAHLPTVDAPLLSVGVATMSAPEMLPPPSSASPVPPSIVLASTSPSTSSHHCVSLDHIYTSNDVDSLWCIGYKPEKKTLRVEHPKVVSVTSVFAEALKSNQQLSSKDGSVLAREKNELADRVENTVAKKDEPSKVVANLEARLKESESRLEEFELRASKEMEARKELEEELLIYKK

SEQ ID NO: 186529 - protein, 142 aa, Glycine max
  Coding DNA Sequence Number=SeqID_69751
  Subcellular localization annotation: CTP_CleavageSite=68; ConfidenceScore=5.05e-01
MNCTGFLSAPLHLSKRTASIHPLSEKGALSQKSLTCAKHTNTNKATYLSLKSDFVKRVWTGIQSFSCLGFLERESGNWSDSKVLDSSGLSCCAFTRNRGAKVSWFSLTRGICGRGLIRTRLNDHEESGFSISGDTIRTHEHC

SEQ ID NO: 186530 - protein, 140 aa, Glycine max
  Coding DNA Sequence Number=SeqID_69752
  Homolog annotation: Hit_ID=Q1SRX2; Match level="QueryCoverage=98%, HitCoverage=19%, E-value=1e-07, Identity=31%"; Hit description=RNA -directed DNA polymerase
MAWDKMTVCKKLGGTSFKSIYGFNLAVLGKWRTRSDANIIVWSDPWLRKDDHSRLITPMNLDLPQLLVQSLLSPNEKKWNLDVLSILFNYDDVQAILSTLLFNYVQEDNYIWSPGRMVITVSSQLIDFLWRALLTRLTCS

SEQ ID NO: 186531 - protein, 85 aa, Glycine max
  Coding DNA Sequence Number=SeqID_69753
MATNLRTTSELRRTPEASSLEGSSSDWHRVRIGNAGGASLCRSRALSGGPLWLNGCPLLDGCRVGGVSGAGQKAWLMLGILGRHS

SEQ ID NO: 186532 - protein, 70 aa, Glycine max
  Coding DNA Sequence Number=SeqID_69754
MYKDNWTQPWPMGSEIYPMVHENPRAFFSSSSPIFLESLAHGSSDWSLPREDCITYPLLSAEVVRHPSTI

SEQ ID NO: 186533 - protein, 341 aa, Glycine max
  Coding DNA Sequence Number=SeqID_69755
GYIYLGIVILRTREGTSLVDQFKWRVHPLGFFKENKGGYIPCGSLVCKGFYKVERNLKNHRLLGDWMPPDPTGGTPGHSIEQRVALKHKVQINAIEEYGLQRPKQIKDVVTSRRFIFEALQEAGMISFDGHKGDSCLMHPGASHDMETCSTTEELLQGMMDQARFEIGDASKGEQHVCMQLADKSPSKPKPLMIHFTRDAASQKPRGSQPIPGKKFVPFPCRSNKAVPWRYAPQKPNEKKDKAVGDDLSFAKVTYISGMSGVTRSGRVFAAPDPLVWSKDAKGKAKVGTKENDKASPILDEEIPVGRFAKGEEDFSTKKISTKEANEFLRIIQQNEFKVIE

SEQ ID NO: 186534 - protein, 460 aa, Glycine max
  Coding DNA Sequence Number=SeqID_69756
  Homolog annotation: Hit_ID=O82271; Match level="QueryCoverage=96%, HitCoverage=100%, E-value=3e-22, Identity=29%"; Hit description =Expressed protein
MDLKIQHIKWVGNIYQKFEAVCQEVDDIVGQDAVKYLENQVQNVGDSVKKFYSGVVHELLPFPTSADSKYESHSVALTNNIGFPVESVVGHKDNNKKRDEENPTNNVIKSLQESSAIDIANNQQVGVPIKHKLIDETCSDSLEVEDSYITQEEVGDDSRETSGAKKEKLNTSIEEVSVESVPKSMNLMSLREKESLEFPIHSESYSDSSDSGCEDSIAKKDNIDVTVEQNSCLVVEKNAMNSSTSEVLSSQSLDGEESIKVSLFSESSDAVDEDTHDILAEVSPDASVSSERPIITMTEPLCSRNFITSDSLYSKSLGSYPLEIESCKNNSDKSLFSSVESSLEDIDLNDDPKLEENCVFVDDSELYAVSCRAQKLRSYKKRILDAFSSKKRLSKEYEQLAIWYGDTDIEPKQGFSQTSLPFISRTYMDSKNVQVQRASETEWELLWQTGRLKITLFRFP

SEQ ID NO: 186535 - protein, 112 aa, Glycine max
  Coding DNA Sequence Number=SeqID_69757
MEQKGERTYLDVANNGEQKNAQGEQHHHHLANNGEEPTTTPPKARTSSGRGSKNTQKEEEELSSRKRKGTAQLAEENKNRRKMYCWYEIKGHKFDSGISLLQMQVKAAYMDP

SEQ ID NO: 186536 - protein, 151 aa, Glycine max
  Coding DNA Sequence Number=SeqID_69758
MVKTRGLGHALGDCDDFDGAPQRRRSTASARRQQVLVTVADEVPVVPGDLPVVPAVEPAVAIDEPMVDADAQNTGVEADAQDTGAEAAADEAEGFPGGPRDLSVLREYVKNFASSIWSEEECSELKLSSHGRKVHKLGKPVPAIEDMVAGT

SEQ ID NO: 186537 - protein, 185 aa, Glycine max
  Coding DNA Sequence Number=SeqID_69759
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=5e-20, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGLQALSFRGLHVLGIGGLHALTFRGLHILTFRGLHAPTCRGLHVLTIKGLHALICRELHVLAIILLHALTFRRLHVIAIRGLHALAIRRLNALPFRGLHVLAIRGLDTLTFSGLHVLTIRGQNTLTFRGLHVLAIRGQHALTFRGLHDLNIKGLHALTCRGLHVLTTKGLRAFTCRGLHILAI

SEQ ID NO: 186538 - protein, 97 aa, Glycine max
  Coding DNA Sequence Number=SeqID_69760
MCHLAKGKRNEKVAQQLMQVDSSVYIGSRGPKTPTLQEPRLKNTYTQAFDLDNLIFVEPNDDAQSEEDLDDDNGDGDDEESDDIHGDDPIRGLDKLL

SEQ ID NO: 186539 - protein, 164 aa, Glycine max
  Coding DNA Sequence Number=SeqID_69761
  Gene Ontology: Mol. function=phosphoric monoester hydrolase activity; Cellular component=integral to membrane; Biological process=metabolic process
  Homolog annotation: Hit_ID=Q1SZL0; Match level="QueryCoverage=93%, HitCoverage=49%, E-value=2e-54, Identity=65%"; Hit description =Leucine-rich repeat
  Pfam annotation: Domain name=NAD_binding_4; Domain location=17-164; Score=27.0; E_value=2.1e-10; Accession=PF07993.2; Description=Male sterility protein
MELASVHDFLKGKTILVTGATGFLAKLFVEKILRVQPNIKKLYLLLRAENPHIATQRLHDEVLAKDLFKVVREMWGADFGSFISEKVLAVAGDVSLENLGLKDLNLREKMWEDIDIIVHAAAATKFDERFDIAMSINTMGALHALNFAKNCSKMQILLHLSTGM

SEQ ID NO: 186540 - protein, 120 aa, Glycine max
  Coding DNA Sequence Number=SeqID_69762
MTQQVVVTNCDGCITVGKGWRGIGNEEEQNPTVIEQVDLVVRRPCLPIVVCCNTRDNLNSLCSSLSSLPFLSSSALNSRNCANGIVINMVVGGKVVTLKSIEESSNIVMQEMPMQILEIL

SEQ ID NO: 186541 - protein, 163 aa, Glycine max
  Coding DNA Sequence Number=SeqID_69763
MVEEEEERLNPDNLTLIWRSSQKVETETETSDFSLACGEGFTCEEVNVDGLICWGLTLASLGNISNSFTVLAIGDSAICSVFSIFNCQTLISSGYDILSFTYDVLIITDRITVFGTSYSAKSGITLGFDQENKKIQGKGGKRVILWTFLDPSSPRLASDSPRS

SEQ ID NO: 186542 - protein, 321 aa, Glycine max
  Coding DNA Sequence Number=SeqID_69764
  Gene Ontology: Mol. function=nucleic acid binding; Cellular component= ribonucleoprotein complex; Biological process=RNA metabolic process
  Homolog annotation: Hit_ID=Q9LKA4; Match level="QueryCoverage=99%, HitCoverage=75%, E-value=6e-88, Identity=55%"; Hit description =Similarity to RNA-binding protein
  Pfam annotation: Domain name=RRM_1; Domain location=165-235; Score =48.6; E_value=2e-11; Accession=PF00076.12; Description=RNA recognition motif. (a.k.a. RRM, R
  Pfam annotation: Domain name=RRM_1; Domain location=73-143; Score =80.5; E_value=5.1e-21; Accession=PF00076.12; Description=RNA recognition motif. (a.k.a. RRM, R
  Pfam module annotation: Pfam domain module=RRM_1::RRM_1; Domain location=165-235::73-143
MDPTKKRKLDENGFNNNDSSDPLKLSPSEVRKLIERFTSDQLLDILQDAVARHLDVLAAVRAVADPDVSQRKLFIRGLGWDTTTDGLRSLFSTFGDLEEAVVILDKATGKSKGYGFVTFRHVDGALLALREPSKRIDGRVTVTQLAAAGNSASNVNPADVALRKIYVANVPPDLPADKLLAHFSVYGEIEEGPLGFDKQTGKSKGFALFVYKSPEGAQAALIDPVKTVEGRQLSCKLAITDGKQGKRVGPDSAQAHHGNVQHGHGDGVGAGMGMPPNAGSGPGQYGGPGQYGPPVGMGSYGGFGGQPPMGNHNHPLNSTNP

SEQ ID NO: 186543 - protein, 155 aa, Glycine max
  Coding DNA Sequence Number=SeqID_69765
MDNHEDECCNDLNSSVIIEKIVWLVNASKLDFDPYLELLIPRFCKASSCRVDEFAFNVSVLNELVLTSLCVREDLFALWTKELQRAQRATWWVSSDLDLEVRHCLDLRNNSESCKRLYNKVKDGDMVGCSGAGDGDVEGCNGVKDGDLGSTNLGI

SEQ ID NO: 186544 - protein, 150 aa, Glycine max
  Coding DNA Sequence Number=SeqID_69766
  Gene Ontology: Mol. function=nucleic acid binding; Biological process= metabolic process
  Homolog annotation: Hit_ID=Q9LXN3; Match level="QueryCoverage=99%, HitCoverage=31%, E-value=4e-34, Identity=45%"; Hit description=Acyl CoA reductase-protein
MGEMILFNMKGDVPLIIARPTTVLSTHSEPFPGWIEGVRTVDVFVVLYGKGKLRRSIPADMVINSMIIALLEAQYSKSLSKTLLYHIGSSLRNPFTISDLEDVAYQYFTKNPLINKNGKPVAISNKVTWISSMSSFERYMKIRYVLPLMV

SEQ ID NO: 186545 - protein, 76 aa, Glycine max
  Coding DNA Sequence Number=SeqID_69767
YVCGEAKGLVPEEPFHMGQTPNRSSTLDINVEKLLIEEKMEELRAQNAGEQTATSVMKNLGIIRCFVESVILFLPK

SEQ ID NO: 186546 - protein, 70 aa, Glycine max
  Coding DNA Sequence Number=SeqID_69768
  Gene Ontology: Mol. function=transposase activity; Biological process= transposition, DNA-mediated
  Homolog annotation: Hit_ID=Q1SC10; Match level="QueryCoverage=97%, HitCoverage=13%, E-value=2e-10, Identity=64%"; Hit description =Ubiquitin-activating enzyme, E1; Transposase, IS4
MCCLGGKGQQEILEYCETPCIVKTVSIFQMHLIKGLDIGNTPQNYKELFNLRHASARNVIERSFGVLKKR

SEQ ID NO: 186547 - protein, 80 aa, Glycine max
  Coding DNA Sequence Number=SeqID_69769
  Gene Ontology: Mol. function=nucleic acid binding; Biological process= DNA integration
MTFDSPKEIWDYLKEEYEGDEHVHDIQMLNLMREFDVQKMKESNTIKGYSDRLLGISNKITKDLSKISLTEVIHVLQAQD

SEQ ID NO: 186548 - protein, 396 aa, Glycine max
  Coding DNA Sequence Number=SeqID_69770
  Gene Ontology: Mol. function=protein serine/threonine kinase activity; Cellular component=membrane; Biological process=protein amino acid phosphorylation
  Homolog annotation: Hit_ID=Q6H6V1; Match level="QueryCoverage=90%, HitCoverage=89%, E-value=1e-117, Identity=61%"; Hit description =Putative receptor protein kinase PERK
  Pfam annotation: Domain name=Pkinase; Domain location=47-325; Score =130.0; E_value=6.5e-36; Accession=PF00069.15; Description=Protein kinase domain
  Pfam annotation: Domain name=Pkinase_Tyr; Domain location=47-325; Score=89.8; E_value=8.4e-24; Accession=PF07714.7; Description =Protein tyrosine kinase
  Pfam module annotation: Pfam domain module=Pkinase::Pkinase_Tyr; Domain location=47-325::47-325
MTSCFHLFRKKGSSSGTQLTGVDLDVSEIQNVNIYTYRELRIATEGFSNANKIGQGGFGVVYKITSSTVQGKLRNGSLAAIKVLSAESRQGVREFLTEIKVISSIEHENLVKLHGCCVEDNHRILVYGYLENNSLAQTLIGSGHSSIQLSWPVRRNICIGVARGLAFLHEEVRPHIIHRDIKASNVLLDKDLQPKISDFGLAKLIPPNLTHISTRVAGTVGYLAPEYAIRNQVTRKSDVYSFGVLLLEIVSRRPNTNRRLPVEEQYLLTRAWDLYESGEAEKLVDAFLEGDFNIEEAVRFCKIGLLCTQDSPQLRPSMSSVLEMLLGEKDVNEENVTKPGMIFEFVEAKSAGKQKCKAEVDSKSLLAEGKQDDSSSSGTMSSFATMTFTAIYDRSD

SEQ ID NO: 186549 - protein, 972 aa, Glycine max
  Coding DNA Sequence Number=SeqID_69771
  Gene Ontology: Mol. function=cellulose synthase (UDP-forming) activity; Cellular component=membrane; Biological process=cellulose biosynthetic process
  Homolog annotation: Hit_ID=Q1SRY4; Match level="QueryCoverage=99%, HitCoverage=88%, E-value=0.0, Identity=90%"; Hit description=Zinc finger, RING-type; Cellulose synthase; Zinc finger, FYVE/PHD- type
  Pfam annotation: Domain name=Cellulose_synt; Domain location=147-965; Score=2106.6; E_value=0; Accession=PF03552.5; Description=Cellulose synthase
MSESLYSGRPNTGRGANNGSGLATNLEHGSSALNSDIPLLTYGEEDPEISSDRHALIVPPYVNHGSRVHPMPYTDPSIPLQPRPMVPKKDIAVYGYGSVAWKDRMEDWKKRQSDKLQVVKHEGSNDGNFGDDFEDPDLPMMDEGRQPLSRKLPIPSSKINPYRMIIILRLVVLGLFFHYRILHPVNDAYGLWLTSVICEIWFAVSWIMDQFPKWYPIQRETYLDRLSLRYEKEGKPSELSSVDVFVSTVDPMKEPPLITANTVLSILAVDYPVDKVACYVSDDGAAMLTFEALSETSEFARRWVPFCKKYNIEPRAPEWYFGQKMDYLKNKVHPAFVRERRAMKRDYEEFKVRINSLVATAQKVPEDGWTMQDGTPWPGNNVRDHPGMIQVFLGQDGVRDVEGNELPRLVYVSREKRPGFDHHKKAGAMNALVRASAIITNAPYLLNVDCDHYINNSKALREAMCFMMDPQLGKKVCYVQFPQRFDGIDRHDRYSNRNVVFFDINMKGLDGIQGPIYVGTGCVFRRYALYGYDAPAKKKPPSKTCNCWPKWCCLCCGSRKKKNANSKKEKKRKVKHSEASKQIHALENIEAGNEGTNNEKTSNLTQTKLEKRFGQSPVFVASTLLDDGGVPHGVSPASLLKEAIQVISCGYEDKTEWGKEVGWIYGSVTEDILTGFKMHCHGWRSVYCIPKRPAFKGSAPINLSDRLHQVLRWALGSVEIFFSRHCPIWYGYGGGLKLLERFSYINSVVYPWTSLPLLVYCTLPAICLLTGKFIVPEISNYASLVFMALFISIAATGILEMQWGGVSIDDWWRNEQFWVIGGVSSHLFALFQGLLKVLAGVNTNFTVTSKAADDGEFSELYIFKWTSLLIPPMTLLIMNIVGVVVGISDAINNGYDSWGPLFGRLFFALWVILHLYPFLKGLLGKQDRMPTIILVWSILLASILTLMWVRINPFVSRDGPVLEICGLNCDES

SEQ ID NO: 186550 - protein, 88 aa, Glycine max
  Coding DNA Sequence Number=SeqID_69772
MQCAVIIASGFGCGHDQSEHHTAAGGGPVHQSRHKVLRGRTHGSDGGMHHEWSRDLATAVQVCCLLRVDGGFISRSDGIGGFISKDEK

SEQ ID NO: 186551 - protein, 482 aa, Glycine max
  Coding DNA Sequence Number=SeqID_69773
  Gene Ontology: Mol. function=carbohydrate binding
  Homolog annotation: Hit_ID=Q2QN32; Match level="QueryCoverage=92%, HitCoverage=92%, E-value=1e-154, Identity=61%"; Hit description =Lipase, putative, expressed
  Pfam annotation: Domain name=DUF620; Domain location=187-436; Score =664.5; E_value=8.4e-197; Accession=PF04788.3; Description=Protein of unknown function (DUF620)
  Subcellular localization annotation: CTP_CleavageSite=31; ConfidenceScore=5.25e-01
MERKQGFFSALKDEVVRGLSPARSRAKSPARSASPMSSLLRRRRKHHAPPPELFIARSGSLRPAEALSPLKEGPDGTDGGQDSSRGEGRWGQWMKGPLARAPSVSSSSSSCNNKKSDLRLLLGVLGAPLAPVHVCTTDPFPHLSIKDIPIVSPSLLVIEETSSAQYILQQYIAASGGQKLQNSINNAYAMGKVRMIASEFETANKVTRSRNSSKAAESGGFVLWQMNPDMWYVELALGGSKVHAGCNGRLVWRHTPWLGAHAAKGPVRPLRRTLQGLDPRTTASMFINTRCIGEKKINEEDCFILKLCADPSTLKARSEGPAEIIRHVLFGYFSQKTGLLVHLEDSHLTRIQNNGGEAVYWETTINSFLDDYRPVEGIMIAHSGRSVVTLFRFGETAMSHTKTRMEEAWTIEEVAFNVPGLSVDCFIPPSELRFASMSEACELPQGQRVKTAVAAAAYHAKVTQLQKSHDSHTNNINWTVDV

SEQ ID NO: 186552 - protein, 155 aa, Glycine max
  Coding DNA Sequence Number=SeqID_69774
  Gene Ontology: Mol. function=transferase activity, transferring glycosyl groups; Cellular component=membrane; Biological process =protein amino acid glycosylation
  Homolog annotation: Hit_ID=Q9LKA9; Match level="QueryCoverage=99%, HitCoverage=59%, E-value=4e-54, Identity=57%"; Hit description =Similarity to Avr9 elicitor response protein
  Pfam annotation: Domain name=Galactosyl_T; Domain location=1-105; Score=-68.2; E_value=0.057; Accession=PF01762.12; Description =Galactosyltransferase
MSALQKEVAEYDDFILLDIQEEYSKLPYKTLAFFKAAYALFDAEFYVKADDDIYLRPVVSLVQMDWELCSYCYPDNLRSFRMFSNEDVTIGAWMLAMNVNHENNHELCATDCTATSIAVWDIPKCSGLCNPEKKMLELHQKEACSKSPTLESDDE

SEQ ID NO: 186553 - protein, 109 aa, Glycine max
  Coding DNA Sequence Number=SeqID_69775
  Gene Ontology: Cellular component=spliceosome; Biological process =mRNA processing
  Homolog annotation: Hit_ID=Q6ESX9; Match level="QueryCoverage=56%, HitCoverage=20%, E-value=9e-20, Identity=72%"; Hit description =Putative WD repeat domain 5B
  Pfam annotation: Domain name=WD40; Domain location=30-68; Score=49.9; E_value=8.6e-12; Accession=PF00400.22; Description=WD domain, G-beta repeat
MGFHFPERSEEEEEEEEEEEEEMSVEDLPGKEVNVLKGHEGGVLAARFNGDGNYVLSCGKDRTIRLWNPHRGIHIKTYKSHAREVRDVHVTQYSLSLRIMHAYSECFNS

SEQ ID NO: 186554 - protein, 98 aa, Glycine max
  Coding DNA Sequence Number=SeqID_69776
MGFYFILTLFICPNFLIRPSRMTKFATFQTHIDPFTGEDQIRKALKVLPGMDSGRFQVSVPGNNYPRIAFVDNWAVGKEKVCYWLSNDIVGLVGYLAI

SEQ ID NO: 186555 - protein, 72 aa, Glycine max
  Coding DNA Sequence Number=SeqID_69777
EQQAEWEQQVEWVNAQRQILRPLSFRNDKLSGSSEAGDKRAKIDFAPFVIQKRAIVSGGMQRQVMVILYLPT

SEQ ID NO: 186556 - protein, 88 aa, Glycine max
  Coding DNA Sequence Number=SeqID_69778
MGTTTAEIHHQGDPGPYNSPLQPIYRKKGEEVAAQLAWLLPPEAIQLQKYSGRPIFKISKLLFAPPAFLISSPPSFVIYGKVTKAYWT

SEQ ID NO: 186557 - protein, 220 aa, Glycine max
  Coding DNA Sequence Number=SeqID_69779
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=3e-26, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDPWVLVPITFRGLHVLTFRGLHAPAFKGLHVLAFRELHALALPSKDYTSSPSEDYTGLHILAIRGLYILVFGGLHVLAFRGLHALAFRGLHILAFRGLQILAFKGLLIPSPLEDAFRGLHVLTIRVLHTGLHVLAFRGLHVLAFRGLPILPFRGKHALAFKGLHVLPFRGLHALTFVGLHVVAFRGLHVLAFRGQHVLPFRGLHALAFRGLHVLAFKGL

SEQ ID NO: 186558 - protein, 134 aa, Glycine max
  Coding DNA Sequence Number=SeqID_69780
MNKKKLQKDLVRAPVVQWAGPEVRREYLGLAGVCPELLWTKGPKNAKVDVSLSELNALSECHPLSETSTRLVDKSNLEGNLSRRHVLNALSARSVSRFSPSRLSASLALSKNSLTRAKRNVEVRESFLSLICAE

SEQ ID NO: 186559 - protein, 192 aa, Glycine max
  Coding DNA Sequence Number=SeqID_69781
  Gene Ontology: Mol. function=receptor activity; Biological process =protein amino acid phosphorylation
  Homolog annotation: Hit_ID=Q84KS6; Match level="QueryCoverage=83%, HitCoverage=46%, E-value=2e-12, Identity=31%"; Hit description =Membrane located receptor-like protein
AINYNNFTIRVVDPGVDQQTNCSSLPRYFLSRSNFTDTYSDIYNMDPYQAGQYSGRSNWDRLAFQHIVYMNCSNPVTQNGKYVDTASYVNWDSKDKYIYAIAGDLKAEDFQVGCHVKLVALTSWWGLDTNNYSYSAMHTGLVYGFEISWMRLICDQHCPSKHGCYYYKVCFFDSVSQEVHYWNWETSWGWSE

SEQ ID NO: 186560 - protein, 57 aa, Glycine max
  Coding DNA Sequence Number=SeqID_69782
MAFDEPVELAALVEQVDIVGSANVDATDEYAWQGKVAATAEDDVELVAEVGDALVRP

SEQ ID NO: 186561 - protein, 219 aa, Glycine max
  Coding DNA Sequence Number=SeqID_69783
  Gene Ontology: Mol. function=protein kinase activity; Cellular component=cell surface; Biological process=protein amino acid phosphorylation
  Homolog annotation: Hit_ID=Q1S8T9; Match level="QueryCoverage=86%, HitCoverage=29%, E-value=1e-67, Identity=66%"; Hit description =Protein kinase
  Pfam annotation: Domain name=Pkinase; Domain location=3-195; Score =25.2; E_value=4.6e-10; Accession=PF00069.15; Description=Protein kinase domain
  Pfam annotation: Domain name=Pkinase_Tyr; Domain location=5-195; Score=-43.0; E_value=7.9e-10; Accession=PF07714.7; Description =Protein tyrosine kinase
  Pfam module annotation: Pfam domain module=Pkinase::Pkinase_Tyr; Domain location=3-195::5-195
MAGGFKDKLGEGGYGSVFKGKLGSGSCVAIKMLVARGIAYLHYGCEMQILHFDIKPHNILLDENFTPKVSDFGLAKLYPIDNSIVPRTAARGTIGYMAPELFYNNIGGISHKADVYSYGMLLMEMASKRKNLNPHAERSSQLFFPFWIYNHIGDEEDIEMEDVTEEEKKMIIVALWCIQLKPNDRPSMNKVVEMLEGDIENLEIPPKPTLYPSETITKD

SEQ ID NO: 186562 - protein, 134 aa, Glycine max
  Coding DNA Sequence Number=SeqID_69784
MDFLLWFLGVKLDCVFGEDLDLDEITFLLELYDDNDCDLKSPLKKPDSASTPSPTACGVKEDFSVLTNDEEEEDVIADCHLPLQSSTFPLFSPVIVGTQRASLMEQYEKVEKIGSRPRHQRDHRVEEDSPRAGG

SEQ ID NO: 186563 - protein, 176 aa, Glycine max
  Coding DNA Sequence Number=SeqID_69785
MRPNWVETVPTVKKVVEERWSSLGELRVSGSWGKQKCQQVVADGAGVLGKALCMILGKAILMKSKGSIACSKFMLSKSKEPPVFKSQNLGLKDLVVCRVGQTGSEKVGVSLSEAYAPSEQHPLSEASARFASQGNLEENLPRMHALSAPSAHPTSSLSLLALSAPGSLSQESLTRA

SEQ ID NO: 186564 - protein, 96 aa, Glycine max
  Coding DNA Sequence Number=SeqID_69786
  Gene Ontology: Mol. function=nucleic acid binding
  Subcellular localization annotation: CTP_CleavageSite=39; ConfidenceScore=5.22e-01
MAAFPSTVFDSGKYFFINFSITSSQFFKLLPLNECSHLLASPDSENENKLSLTAPSGTPAILTLLQISCRLLGVHMGLHYHEINCLVLAVLKNEDK

SEQ ID NO: 186565 - protein, 139 aa, Glycine max
  Coding DNA Sequence Number=SeqID_69787
  Gene Ontology: Mol. function=protein serine/threonine kinase activity; Biological process=protein amino acid phosphorylation
  Homolog annotation: Hit_ID=Q1S8T0; Match level="QueryCoverage=58%, HitCoverage=13%, E-value=5e-15, Identity=47%"; Hit description =Protein kinase
MFDIVTPVLAYGMQRNSLDLRWFEANSSKCKAKGKKCKWKNNKGSILLGFIVIAIFKIIYHFRQKEEDQARVKKFLEEYRAEKPARFTYADVKRITGGFKEKLGEGAHGVVLRGKISIEILVAVKILNNTEGKRERVHQ

SEQ ID NO: 186566 - protein, 54 aa, Glycine max
  Coding DNA Sequence Number=SeqID_69788
MVATRSLWGFRLIKEVATRVWVCGGDNKVVIGSLATWWRGGVVVAVMWLMLQLI

SEQ ID NO: 186567 - protein, 143 aa, Glycine max
  Coding DNA Sequence Number=SeqID_69789
  Gene Ontology: Mol. function=catalytic activity; Biological process =cellular metabolic process
  Homolog annotation: Hit_ID=Q3HLM7; Match level="QueryCoverage=99%, HitCoverage=44%, E-value=3e-53, Identity=60%"; Hit description =Progesterone 5-beta-reductase
MNLVGTLCVYAAICKHEGVPLWFPGTKAVWECYNTASDADLIAEQHIWGAVDPRAKNEAFNCSNGDVFKWKHVWKEEIVKKNGLQRTKLEDVGDWWFADLILRMEAVLDSMNKAREHGFFGFRDSKKSFMNWIDKTKACKIVP

SEQ ID NO: 186568 - protein, 65 aa, Glycine max
  Coding DNA Sequence Number=SeqID_69790
MVDKGLGFIDFSLTNGVNALGMLVRYKVNRKTQGPSLIVVEEPERCNHARQKHLVYIGPLSIGLV

SEQ ID NO: 186569 - protein, 607 aa, Glycine max
  Coding DNA Sequence Number=SeqID_69791
  Gene Ontology: Mol. function=RNA-directed DNA polymerase activity; Cellular component=nucleus; Biological process=RNA-dependent DNA replication
MVKDFRPISCCTVVYKIITRIMSTRLGKVLSSVLHQSQAAFIPGQRIHDHILLAYELIKGYNTKGGTPRCMLQMDLQKAYDSVEWSALEAILNELSIPHMFIKWIMITVTTVSYRYQVNGALSNIVQAKRGLRQGDPLSPLLFVIVMEYLYRVLQKLKQVPNFNFHPKCEKLAIINLSFTDDLLMFTRGDPMSVRLAMNAFNDFSAATGLKVNPSKCNIYFENVADEVKKEIQANVNYNEGTIPFRYLGIPLSNKRLSVAHCLLIADKITARITHWSARLLSFAGRAQLINSVLFAVSNFWLQCIPLPKEVIKRINAICRSFLWSGGDKLTRKSPIAWKRVCTPTKQGGLNIISIEEWNKANLIKLLWNLNGKTDSLWIKWVHCYFLKKWSIMNVPMKTNTSWILKAVLSQRQEVCINPIWQSVLQGQKYQTGRMYKSLIHQFQEVKWRYLFKGNMARPRARFILWMACHERMATKDRLMRFGMLNDDTCCYCKEKETIQHIFFQCNVLSQFWKHTLKWLEVPHSPGGWNEELDWIIKKCKSKGSKAKIIKCAFTKAVYETWMFKNNKCFGLDTTSSDVGTRITDTIVYRCWLNPKLRNHLGRLMIP

SEQ ID NO: 186570 - protein, 42 aa, Glycine max
  Coding DNA Sequence Number=SeqID_69792
MTSTFVMFHVALKNFALYPSIPGVMFHYAIIRGKAHDDINRD

SEQ ID NO: 186571 - protein, 123 aa, Glycine max
  Coding DNA Sequence Number=SeqID_69793
MEISSVPYPMASCVIFYLFYQLMIPLQQASTHYTILNLDNNTFIRKGRSYSSFFNFAYATILSRNIHQPITLARFLLNFHACGFHTNLPYSHFTIWVNIVVQRGLEHLHIEIPHALELPKALF

SEQ ID NO: 186572 - protein, 394 aa, Glycine max
  Coding DNA Sequence Number=SeqID_69794
  Gene Ontology: Mol. function=acyl-CoA binding
  Homolog annotation: Hit_ID=Q10P83; Match level="QueryCoverage=50%, HitCoverage=37%, E-value=9e-26, Identity=37%"; Hit description=Acyl CoA binding protein, expressed
  Pfam annotation: Domain name=ACBP; Domain location=245-337; Score =32.5; E_value=1.2e-09; Accession=PF00887.9; Description=Acyl CoA binding protein
MELLTVVDDFFVTASLALLLTFIVLKLVEVINDTHAIPKRHVVHREPDRPVSHAEQRFTVQPAPAKTKVGFVSPVQEEFATCAVGTEHKIEKKAAVKPVRPRGKRFTVHPAQSKSGVETECNREEIAVEPERKIEEAVVEPVPVQTEVTVGLISPVQDDTCVGTAEKIEEATTVESDKNVEEEIAEGNEGTQELDDSAEKRNVKSVEEISVEPSTEIEASVTDSGVKENFDDDDDDWEGIERSELEKEFMAATKFVSGEENRLGGAGSNLRMELYGLHKVATEGPCREPQPMALKLAARAKWNAWQKLGNMNPEVAMEQYVSLLSDKFPGWMKDTSAGIGEHETTRPEVSESAASDLSTTLSNQQQMITTERELEQESDSKDRSPLTVSDLENS

SEQ ID NO: 186573 - protein, 329 aa, Glycine max
  Coding DNA Sequence Number=SeqID_69795
  Gene Ontology: Mol. function=mannitol dehydrogenase activity; Cellular component=cytoplasm; Biological process=lignin biosynthetic process
  Homolog annotation: Hit_ID=O82515; Match level="QueryCoverage=88%, HitCoverage=79%, E-value=1e-110, Identity=68%"; Hit description =Probable mannitol dehydrogenase
  Pfam annotation: Domain name=ADH_N; Domain location=33-154; Score =107.8; E_value=3.3e-29; Accession=PF08240.2; Description=Alcohol dehydrogenase GroES-like domain
  Pfam annotation: Domain name=ADH_zinc_N; Domain location=185-326; Score=66.2; E_value=1.1e-16; Accession=PF00107.16; Description=Zinc -binding dehydrogenase
  Pfam module annotation: Pfam domain module=ADH_N::ADH_zinc_N; Domain location=33-154::185-326
MANELPVKAFGWAASDTSGTLAPFHFSRRENGVDDVTLKILFCGVCHSDLHTLKNDWGFTTYPVVPGCGRSKRHEIVGVVTEVGNNVKNFKVGDKVGVGVIVESCKECENCQQDLENYCPRPVFTYNSPYYDGTRTQGGYSNIVVVHQRYVLRFPENLPLDAGAPLLCAGITVYSPMKYYGMTEPGKHLGVAGLGGLGHVAIKLAKAFGLKVTVISSSPNKQAEAIDRLGADFFLVSSDPAKMKAALGTMDYIIDTISAVHSLIPLLGLLKLNGKLVTVGLPNKPLELPIFPLVAVYLVLNVIQCKCNHTSINASDPNKTLQLSVLGRK

SEQ ID NO: 186574 - protein, 107 aa, Glycine max
  Coding DNA Sequence Number=SeqID_69796
MVVGEGLEPSKGVLHLRLDRVLTMGEKERLQGMFYHNPTVDANRIYQNSELSKVRIDMDENMSEYEKSEMEPDTYRIEWELQVLICRNCYGDVTTLVDNYWLIDNNQ

SEQ ID NO: 186575 - protein, 184 aa, Glycine max
  Coding DNA Sequence Number=SeqID_69797
  Gene Ontology: Mol. function=DNA binding; Biological process=DNA integration
MSFELGVVVDDNGVREAIPAYEVFTSELLHLVGCDFSQWSCLHPLGEVVDSDYGPSMSIPYMARAKESSGYGDCQEECTGCVGLCSRLEATPPELGNSCKGVYDGSLECLLDDSLEVPGIFGAGQVGEHVCSSVALPWYVVHLKAFKVVDESFGKVVELVQHYFLGLVFVGTLPIDKLRVSVAS

SEQ ID NO: 186576 - protein, 225 aa, Glycine max
  Coding DNA Sequence Number=SeqID_69798
  Subcellular localization annotation: CTP_CleavageSite=65; ConfidenceScore=5.47e-01
MLSELDVLTKPKTSASLVAAPKACKTQSLPLVSLISPKARKTLGMSLVSLTSPKACQTQGSSLVSLASPKACQTQGSSLVSLVSPKARKTQGSQNLRFILVDSSLKPRQTQGSSLMSLISPKARQTQVSLAKTRDKCVPGPKLVKPKVRHWRVHLQKYKEYKSTGTLETQGPPLVQKCIPTKIQGPPLVRIPTKTQGMPLVSSLLRNYENHNLKSMIPQGEKKHH

SEQ ID NO: 186577 - protein, 121 aa, Glycine max
  Coding DNA Sequence Number=SeqID_69799
MDDYKSLQIEFGKFKKDYYEERMKWQTELSYRKDLFRKMNNGKSNLSHLLSVQKHTIDKTGLGYNKQTPFSKKTKFASSKKVCLKAKDSLWYLDSGCSSHMTGDKSRLTDMVSKEGGYVTF

SEQ ID NO: 186578 - protein, 332 aa, Glycine max
  Coding DNA Sequence Number=SeqID_69800
MPLVKQVGPAGGTVLPFVVIPPTKEGGQTAVEVGTATSVAEVSPNILSSILAKRKPNDGVGVSGSSTPFVAIVVVAAPTPPPPLTISIKEISISHATEVSAPVASVSAVEAPLSTIVAPLLSVGVATISTPVMSLPPSSASSVPPLTVLVSALSSTCLFTQVFLWITSSLLVMLIFYGVWVTSLTRRPCWGLECYGFCQSLPIVKFGDPGREWTKAPRGAKLDDDELFERCKCLQREKNELANKVVADLEAQLKELESRLQESELQASKEREASKELEEELLIYKKEDLDLGLFDPFKDVKDDILLEEEDIHVEEEVGEEQDAEEKGDNANI

SEQ ID NO: 186579 - protein, 918 aa, Glycine max
  Coding DNA Sequence Number=SeqID_69801
  Gene Ontology: Mol. function=nucleic acid binding; Cellular component= beta-galactosidase complex; Biological process=DNA integration
  Pfam annotation: Domain name=rve; Domain location=118-273; Score =23.8; E_value=6.1e-05; Accession=PF00665.16; Description=Integrase core domain
  Pfam module annotation: Pfam domain module=RVT_2::rve; Domain location=475-691::118-273
MCGNREWFSTIDEAFRHSVKLGNDSKMEVLGKGNIRLQINGAIHVVTDVYYVPDLKNNLLSVGQLQERGLALLIQDGKCKLYHPRRGLIMQTEMTANRMFVLLASVVLEETSTFLQLATEDSSQLWHRRFGHLSYKGLRTLQHKQMVKGLPFFKDSSKSCPGCFVGKQHRDVIPKKSQWRASHKLQLVHADICGPITPNSNSNKRQLTTSYTPQQNGVAERKNRTIMNMVRCMLCDKQVPKAFWPEAAKWTVHVLNRSPTLTVKDKTPKEMWSGIKPKVDYFKVFGCLTHVHVPDQKRTKLDDKSLQCVLLGVSDESKAYRLFDPVARKIIVSRDVSFEEDKGWNWGRTAEEVKHDVLIWEGSNDSEDASSENEEEAVVEGTETAGVIDQDAEATTSTSSDSSNEDASVHATAEGRSQRAPNYLQDYETGEGLSEDEDYFAMFISDDEDYFAMFTSHEDPSSFEEAERDEKWRKAMDLEIEAIKKNETWQLTTLPKGAKKIGVKWWDTIRMVLAQAAQKGWNVYQLDVKSAFLHGELTEDVYVEQPPGYVRKGEEEKVYKLKKALYGLKQAPRAWYSKIEAYFVKEGFERCDHEHTLFVKTGGGKRILIVSLYVDDLIFTGNDACMFESFKKSMKIEFDMTDLGKMKYFLGVEIQQNSEGIYLSQKKYACELLEKFGLQNCNSVKNPIVPGSKLSKKGEGARIDATAYKQLIGSLMYITVTRPDLIPNELHMHAAKRVLRYLKGTVELGVFYKRGDVKDLVAYTDSDYAGDIDDRRSTSGYVFLLSGGAVSWASKKQPVVTLSTTEAEYVAAAVCACQCVWMRKVLEKIGLSQSKCSVIMCDNSSTIKLSKNPVMHGRCKHIDVRFHFLRDLTKKEVVKLIHCGTSNQVADIMTKSLKLDVFLKLRVQLGVREVPNLN

SEQ ID NO: 186580 - protein, 35 aa, Glycine max
  Coding DNA Sequence Number=SeqID_69802
MKPGTYRVALTSRKVVSISSPQAWARVSGEIRHVK

SEQ ID NO: 186581 - protein, 114 aa, Glycine max
  Coding DNA Sequence Number=SeqID_69803
  Gene Ontology: Mol. function=sequence-specific DNA binding; Cellular component=nucleus; Biological process=regulation of transcription, DNA-dependent
  Homolog annotation: Hit_ID=Q6SS01; Match level="QueryCoverage=92%, HitCoverage=40%, E-value=3e-12, Identity=40%"; Hit description =PHABULOSA-like protein
MRGCVEYSPRWEWGTIELLYMQTYAPTTFGSSMGLLDTKIHKFGRWKYCAVAYRVWLKNAIIICERSLTSLTGGPTGPPSTTFVRAEMLPSGFLVRPCEGGGSIIHIIDHIDLD

SEQ ID NO: 186582 - protein, 175 aa, Glycine max
  Coding DNA Sequence Number=SeqID_69804
MTMPRLGFRDYVNKKDRFCMYKVMDFKERFNPKVKKNHVPFGMLFTQIIKDPPPSSSGPKPSNQPKKAPPPNPKPSDHRITQKRKVTYSKSKLEFELTPKDQLSKLNTLNPNLSLLLPKDGNEVYWQISQSLFQPNPPTIPASPFPSKKEVVALAKAKKKSPVASKKKAELDHTL

SEQ ID NO: 186583 - protein, 75 aa, Glycine max
  Coding DNA Sequence Number=SeqID_69805
  Gene Ontology: Mol. function=oxidoreductase activity; Cellular component=cytoplasm; Biological process=lignin biosynthetic process
  Homolog annotation: Hit_ID=Q9ATW1; Match level="QueryCoverage=86%, HitCoverage=18%, E-value=2e-27, Identity=83%"; Hit description =Cinnamyl alcohol dehydrogenase
MAVPPEMEHPRKAFGWTARDTSGVLSPFKFSRRETGEKDVAFKVLYCAICHSDLHMLKNEWGISTYPLVPGQHKL

SEQ ID NO: 186584 - protein, 105 aa, Glycine max
  Coding DNA Sequence Number=SeqID_69806
MEMQRKTKEKRNLSTLNLCGEISPAIGDLVNLQSIFSYPVGVSMYVSFFSYPVGVSHDTNADHMPEHEAEEGQANSLSSISSWPHHLENVFPIYAMGTSNPVLDS

SEQ ID NO: 186585 - protein, 548 aa, Glycine max
  Coding DNA Sequence Number=SeqID_69807
  Gene Ontology: Mol. function=carboxypeptidase activity; Biological process=DNA integration
  Homolog annotation: Hit_ID=Q1S9U8; Match level="QueryCoverage=90%, HitCoverage=98%, E-value=0.0, Identity=65%"; Hit description =Carboxypeptidase regulatory region
  Pfam annotation: Domain name=Rhamnogal_lyase; Domain location=1-99; Score=72.8; E_value=1.1e-18; Accession=PF06045.2; Description =Rhamnogalacturonate lyase family
MDSSSLPLNIDKRYILRRGSSGLYIYAIFEHPKDFPALEIDHIRIVFKLQRDRFHYMAIADDRQRVMPTAEDRSKGRRLDFDEAVLITNPSNPELQGEVDDKYQYSCENKDNKVHGWINLDSNSNESVGFWMITPSNEFRSGGPIKQGLTSHVGPTTLNILHTTHYSGKEVTMALKEGEPFKKVYGPVFAYLNSVSSGHDSQALWSDAVQQLSEEIKSWPYDFPNSEEFFPANKRGRVEGRLLVQDRKELMFLIFTSRHIQGGNFVYGDNAYVGLALPGDVGSWQRQSKGYQFWTEADKVGQFTIENILPGDYDLYAWVPGIFGDYKHNTTITITPGCVIQLGSLIYHPPRNGPTIWEIGIPDRSAAEFYVPDPYPNLINRLYIGKPAHKFRQYGLWQRYTELYPSQDLVYNVDVSNYSKDWFYAQIPRNIGNNTFSPTTWEIKFHLPFVIRGTYTLQLALASATRSNLVVRLNNPVARPPHFSTGLIGRDNSVARHGIHGLHRPYSIEVPSYLLVEGTNTIYLRQSKGLSPFLGVMYDYIRLERPET

SEQ ID NO: 186586 - protein, 294 aa, Glycine max
  Coding DNA Sequence Number=SeqID_69808
  Gene Ontology: Mol. function=helicase activity; Biological process =viral genome replication
  Homolog annotation: Hit_ID=Q1SRJ5; Match level="QueryCoverage=98%, HitCoverage=38%, E-value=4e-51, Identity=37%"; Hit description =Probable helicase [imported]-Arabidopsis thaliana-related
NDQTENGDTHNDEIKEYLDYRKPAVERLHFHLPGQHSDLYEDHDDIDDELSKPSISDSKFISWMNTNQNSVEGRNLTYAELVSKFVYNQKKICWHLRKKGYTIGRLLWVPPIIGELFYLRMMLTVCKGPTSFEDLRTVDNVQYSTYKEACFAMGFLQDDKEFIEAIKEAKDWGLTHYIRKLFVLLLLTATMSKPKQVWDQTWHWMADDIVYNYKKLSTSPALQLDDRTLQNLVLLEIEELLQVNQRSFRDYPSMPYPEDANCPAYLDNSLILAELNYNNEELRSKFEHLFSHMT

SEQ ID NO: 186587 - protein, 83 aa, Glycine max
  Coding DNA Sequence Number=SeqID_69809
MEKAEATVPLIPNLSFTMLGGDSGCPAEILPVYRVVAATATVTTTLACKNARSVGDGSGAVAGGRGGWNPATGINYFVPRWLT

SEQ ID NO: 186588 - protein, 65 aa, Glycine max
  Coding DNA Sequence Number=SeqID_69810
MCVQEEERLVIEMGKSALLTIACGKNKTTKSQANQKENGRIPPQDDIKKVAMCFWYSKPKETSGK

SEQ ID NO: 186589 - protein, 67 aa, Glycine max
  Coding DNA Sequence Number=SeqID_69811
MCQLGYVQCIPAHPVHSWVSYDDVDDTWTHYSDHLEAAGDLCVVPRGLPCDRGGIGATSKCARHIHT

SEQ ID NO: 186590 - protein, 102 aa, Glycine max
  Coding DNA Sequence Number=SeqID_69812
MKKKKRRLMRRKRRARVRFQERKSERLLQLKARKYHIHWYLPRRIKRETKVVSVHGRRIFYKECRRPCWLLRVIKLYCLWMTKMETKVVSVDRHRVFDKGSR

SEQ ID NO: 186591 - protein, 98 aa, Glycine max
  Coding DNA Sequence Number=SeqID_69813
  Subcellular localization annotation: CTP_CleavageSite=50; ConfidenceScore=5.14e-01
MWTLKHQVWWPYNVKSRGNNTIKGNEDNHKFGDPGRRTLLPPRKSNRSAMSSSPWASSPPLESVSVEVCVGLRDRTGTLFSGALPGLLRGELLQNYFR

SEQ ID NO: 186592 - protein, 239 aa, Glycine max
  Coding DNA Sequence Number=SeqID_69814
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=7e-30, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GCTPLAFRGLLALTFRGLHVLPFRGLEVLAFRGLHVLTFRGLNVLAFRGLQVLTFRGRHALAFNEDYTYSPSADYNTSPFEGCMPFAFRGLLALTFRGLRVLPFRALQVLAFRGLHVLTFRGLHVLAFRGLHALTLRGLHSLAFRGMHVLAIRGLHVLAIRGLHVLTFRGLHALAFRGLHVLTFRGLHALAFRGLHVLTFRGLHVLAFRGLHALAFKAYRGLHVLAFRGMHALAFTGLH

SEQ ID NO: 186593 - protein, 281 aa, Glycine max
  Coding DNA Sequence Number=SeqID_69815
MEDICKRWTEYLDSTRSRVNHPQSINCDFCGEEHFNDNCHLYSMKNSWWGQELYPYNQYEERTPNLESVFTKFTAYHPSSTANQNSMQNQEIQVGNSYSMENYQWEQELQPYNQYEEERTSNLDTLLMQFKEVTEYTQQAFKSLEIQVGKLAEEVTKFMARREENFIKVEAQEESPVRKHDSKEKDEDKSEEKAQQWEKYSQVEIQQESILQVNTHPHQLIVKEERHGEHEKALSAILSLITSTSLAMIWKVLSEYMTFMESLARRQKYKEYVFFVTFMPP

SEQ ID NO: 186594 - protein, 76 aa, Glycine max
  Coding DNA Sequence Number=SeqID_69816
MAELNSTKPAFKVMIAPTFIRSGPLEHGQRLFSDSSDSNGQLILLHLLKLYQSTEPEQEFWSYPLLHVLVHPGMLL

SEQ ID NO: 186595 - protein, 130 aa, Glycine max
  Coding DNA Sequence Number=SeqID_69817
MLTDHLIRKQLQASLLRHQWRKTIEMPTSTIDADDARRWTLVRGSWLLLTATPLPSRWFVKNATKKKKNATKKNDFVGGKKKNARKKRLQGRKKTNAGKKKSAGCARRRERVAGERESDVFFLKLTQGHN

SEQ ID NO: 186596 - protein, 56 aa, Glycine max
  Coding DNA Sequence Number=SeqID_69818
MAQAVLELYPNMLDISPWGFKLTICKRIKSMGFNHVRLTWPLLLLTTKVGSTKNEA

SEQ ID NO: 186597 - protein, 138 aa, Glycine max
  Coding DNA Sequence Number=SeqID_69819
MESLDFVVVCQEVGVMVANVTIIASIIRTSPLRPTPQDIVLPGDKNKKKKAKRAFTLVPGKEFFNSTYHPQNLMSSSVVIDYGKDILQNTDVTSNWALYSELESRVAVVAQHMILRGGIWLQFKTSLRRLLGIPECQL

SEQ ID NO: 186598 - protein, 125 aa, Glycine max
  Coding DNA Sequence Number=SeqID_69820
MNHSIEIEEKVEEPRRVVNTIAEGFARGGSTSTARKKHLHNVRFVSLVAMRNRVYMLDITFTGADFKGLDPKQDDPMAITIQVANFLYFLQPFAWPTRDTKTLGCQHGNPGGTRPRITLGFRSKN

SEQ ID NO: 186599 - protein, 106 aa, Glycine max
  Coding DNA Sequence Number=SeqID_69821
MWNKDLKVLKYSAKPNTRVPPHLYTYRKHVAMKYSGKTPMRPQEKYDSDNLIYGGSTTYATTDDRATSHDSNILPHVSNDHEEAIQVMREEIINMHRRHAEDIEPL

SEQ ID NO: 186600 - protein, 515 aa, Glycine max
  Coding DNA Sequence Number=SeqID_69822
  Gene Ontology: Mol. function=RNA-directed DNA polymerase activity; Cellular component=intracellular; Biological process=RNA-dependent DNA replication
  Pfam annotation: Domain name=RnaseH; Domain location=251-376; Score= -26.0; E_value=0.015; Accession=PF00075.14; Description=RNase H
MVRKANDRWRMCTNYTNLNKACPKDAYPLPIIDRLVDGAARHQILSFLDVYFRYKIFMHPRDEEIIAFITESTNYCFQLMPFNLKNAGAIYQHLTDKIFKDQISKSMEVLLGFMLSHQGIQANLDKCQVVIDVQSPRALKEIKKLIGRIASLIRLLPWIVEKLKPIMNLLKKTKTFRWDQECEKVFKNLKLTLATPLGLAKLDAQKKLIIYLSIFDEALSEFDIRYEPRGSIKAQHLAYFLNELHPIDHFDNQWWTLHVDRSSNKQGCRARVLLEGPNQVILEQFLKFEFKASNNQAEYEAFLVGSRLAKEVNTKWLKCWSDSKVTSDQINREYQVKEPQLLKYYHAFMRLKYDFEEVQVKHIDRDHTTELTEECMNISLEGEDWRSSIVENLTKGIAPKNPLEAKCLCQDQANYIIRELHEGVCRALHYVGNGSTLTISNSQRAMQASTVVVDYFTKWIEKKFDKAKGRWTKNLLEVLWGVKCMSLSTIGETPFRSVYGTDALVPTEIGEPSFR

SEQ ID NO: 186601 - protein, 44 aa, Glycine max
  Coding DNA Sequence Number=SeqID_69823
MATSFKVIEYRSGKLATESGRRNEMLALTSSTLRCSKLLLKSLI

SEQ ID NO: 186602 - protein, 94 aa, Glycine max
  Coding DNA Sequence Number=SeqID_69824
MWGLSRRSGEGTENQQTPSEVCLERRLVPNSKMVGSERGPNYKSSSTAAGNVRGSQPNDFSLSCNFECDHDHGFFLVPPFIEAPHFKFTRESRD

SEQ ID NO: 186603 - protein, 215 aa, Glycine max
  Coding DNA Sequence Number=SeqID_69825
  Gene Ontology: Mol. function=carboxypeptidase activity; Biological process=DNA integration
  Homolog annotation: Hit_ID=Q1S9U8; Match level="QueryCoverage=96%, HitCoverage=42%, E-value=2e-95, Identity=77%"; Hit description =Carboxypeptidase regulatory region
GVIKLDSLVYVPPRNGPTLWEIGFPDRTSAEFYVPDPYPTLMNKLYNEEHRDKFRQYGLWERYTDLYPNDDLVYTVGVSKYRKDWFYAHVTRSTGNKTYQPTTWQIVFEHPNQIIRGNYTLQLALACTADADLQVRVNNPSANPPDFATGKMGGDSAIARHGVHGLYRLFSINVPSDRFVKGTNTIYLRQSRAMNPFQGVMYDYIRLERPPLTLI

SEQ ID NO: 186604 - protein, 689 aa, Glycine max
  Coding DNA Sequence Number=SeqID_69826
  Gene Ontology: Mol. function=binding; Cellular component=thylakoid; Biological process=photosynthesis
  Homolog annotation: Hit_ID=Q5QNE5; Match level="QueryCoverage=99%, HitCoverage=100%, E-value=0.0, Identity=53%"; Hit description =Tetratricopeptide repeat protein-like
  Pfam annotation: Domain name=TPR_1; Domain location=206-239; Score =14.7; E_value=0.093; Accession=PF00515.18; Description =Tetratricopeptide repeat
  Pfam annotation: Domain name=TPR_1; Domain location=240-273; Score =32.2; E_value=1.8e-06; Accession=PF00515.18; Description =Tetratricopeptide repeat
  Pfam annotation: Domain name=TPR_1; Domain location=274-308; Score =2.1; E_value=3; Accession=PF00515.18; Description=Tetratricopeptide repeat
  Pfam annotation: Domain name=TPR_1; Domain location=398-431; Score =16.2; E_value=0.063; Accession=PF00515.18; Description =Tetratricopeptide repeat
  Pfam annotation: Domain name=TPR_1; Domain location=444-477; Score =9.9; E_value=0.36; Accession=PF00515.18; Description=Tetratricopeptid e repeat
  Pfam annotation: Domain name=TPR_1; Domain location=478-511; Score =38.6; E_value=2.1e-08; Accession=PF00515.18; Description =Tetratricopeptide repeat
  Pfam annotation: Domain name=TPR_2; Domain location=206-239; Score =16.1; E_value=0.13; Accession=PF07719.7; Description=Tetratricopeptid e repeat
  Pfam annotation: Domain name=TPR_2; Domain location=240-273; Score =26.1; E_value=0.00013; Accession=PF07719.7; Description =Tetratricopeptide repeat
  Pfam annotation: Domain name=TPR_2; Domain location=274-308; Score =4.0; E_value=11; Accession=PF07719.7; Description=Tetratricopeptide repeat
  Pfam annotation: Domain name=TPR_2; Domain location=398-431; Score =17.0; E_value=0.067; Accession=PF07719.7; Description=Tetratricopepti de repeat
  Pfam annotation: Domain name=TPR_2; Domain location=444-477; Score =21.6; E_value=0.0028; Accession=PF07719.7; Description =Tetratricopeptide repeat
  Pfam annotation: Domain name=TPR_2; Domain location=478-511; Score =27.1; E_value=6e-05; Accession=PF07719.7; Description=Tetratricopepti de repeat
  Pfam annotation: Domain name=TPR_4; Domain location=240-265; Score =16.6; E_value=0.088; Accession=PF07721.5; Description=Tetratricopepti de repeat
  Pfam annotation: Domain name=TPR_4; Domain location=274-299; Score =2.6; E_value=19; Accession=PF07721.5; Description=Tetratricopeptide repeat
  Pfam annotation: Domain name=TPR_4; Domain location=398-423; Score =5.4; E_value=8.4; Accession=PF07721.5; Description=Tetratricopeptide repeat
  Pfam annotation: Domain name=Thioredoxin; Domain location=607-686; Score=11.5; E_value=1.9e-05; Accession=PF00085.10; Description =Thioredoxin
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _4::TPR_4::TPR_4::Thioredoxin; Domain location=206-239::240-273::274 -308::398-431::...
  Pfam module annotation: Domain location=444-477::478-511::206 -239::240-273::274-308::398-431::444-477::478-511::240-265::274 -299::398-423::607-686
MSHSGKKPVSSELGLTERFRDSLSCSDDNKPDFRELDLSSPVSTLRPRQHHSAPTTTSSSSTSTSSGSTGSGSGRNGNNNAVSKRSHSGELSGSSETNSPTRVSKPGHRRSNSGQSQRSPSSSSSAVNSPPLNVLPAGNICPSGRVLKAATAAVAPSRSSRSDVLGSGTGNYGHGSIMRGGKGGGGGGGGGGDVRIAGESAKGVDPEEVKRIGNEEYKRGHFVEALCLYDRAIAMSPGNAAYRSNRAAALTGLGRLPEAVKACEEAVGLDPNYGRAHQRLAMLFLRLGQVEDARKHLCYPGLQLDPAELQKLQIVEKHINKCGDVRRIRDWKGVLREVDAAVAAGADSCVQLFMCRAEALLKLHQIDDAESCISWIPKSKPHPGSLSQARFFGMFSEAYCFFVRAQIEMAFGRFENAVTTAEKASQIDPRNVEVAVLLNNVRMVARARLRGNDLFKSERFTEACSAYGEGLRLDPSNSVLYCNRAACWFKLGQWERSIEDCNQALHIQPDYTKAILRRAASNSKVNGVIPCLVMQLERWEEAVTDYELLRRELPDDNEVAENLFHAQVALKKSRGEEVHNLKFGGEVEDISGLEQFRAAISLPGVSVVHFETASNLQCKQISPLVNTLCSRNPSINFLKVNIQTSPAVAAAENVRVVPTFKIYKNGSQVKEIICPSHDMLEHSIRHYSL

SEQ ID NO: 186605 - protein, 400 aa, Glycine max
  Coding DNA Sequence Number=SeqID_69827
MEIIEAMASNAYNGVGDRIILRRSSGVHQVEANSSSSSLEQKIDMETRHVVGDCPYTQALKEVNYASGKSIGYDLYSNTYNQGWRDHPHFSWKEWRDQRQVMKSSNPWNPTSNLVTLVSQRTPDTLPSQTKANPKNEDMNVVKTKSRKFMPESKKNEKMYKKLHVNIPFDEEIVEMPKYDKFLKEITSNKKKMEDFTIVSLNEECSIVVLKKMPLNLKDPRSFLVLCAISNLSFDRSLCDDEDIPIILGSPFLNTGGALIDVKEGKLTWWLGDEEEVFKVFGTTESSFSPPFYNFVQVTNKMEVTVVKPHPSVGMKDPPRNKVIPKNTRCSKKKGDDITIEALGYGVDDYSRGSMKNMFEGRGWLGWRGYKNLRYRFRFKRSLTIERDVNTSPSMQCQNP

SEQ ID NO: 186606 - protein, 77 aa, Glycine max
  Coding DNA Sequence Number=SeqID_69828
  Subcellular localization annotation: CTP_CleavageSite=65; ConfidenceScore=5.35e-01
MGRELLRAPSIIVGAPSIIVGAPSKQFFRKSSGNNFSGKFPEESSSGRIICVFRKYSQTTSGRTSSGMFPEEASSGS

SEQ ID NO: 186607 - protein, 396 aa, Glycine max
  Coding DNA Sequence Number=SeqID_69829
  Gene Ontology: Mol. function=carbohydrate binding; Biological process= DNA integration
  Homolog annotation: Hit_ID=UPI00005DC1AF; Match level="QueryCoverage =91%, HitCoverage=78%, E-value=1e-109, Identity=53%"; Hit description= lyase
  Pfam annotation: Domain name=Rhamnogal_lyase; Domain location=1-217; Score=295.5; E_value=9.8e-86; Accession=PF06045.2; Description =Rhamnogalacturonate lyase family
MSFISRRGLRETLAKKSRTSNSGVMLNSNNRQQLVVDNGIVAVTFSKPEGYILGISYNGIHNILEDENEDQDRGYLDVVWNTPGKPSNCQRIYGTKFSVIAADENMVEVSFSRTWTSSMNDSSVPMNIDMRYIFRNGDSGFYSYAIFDRPEGLPAAEIDQIRIVFKLKKDRFNYMAISDERQRNMPTMRDREAGQILAFPEAVLLTRPISPKFRGEVDDKYQYSCENKDNNVHGWISVDSSNAPSVGFWMITPSNEFRNAGPIKQDLTSHVGPITLAMFMSTHYAGKEVTMAFQQGETYKKVFGPVFAYFNNASREDDILSLWSDAVQQQSKEVTSWPYDFPKSVDFIPPNQRGIVLGRLLVQDRYFRGGKLLYANNAYVGLALPGDEGSWQIESK

SEQ ID NO: 186608 - protein, 219 aa, Glycine max
  Coding DNA Sequence Number=SeqID_69830
  Gene Ontology: Mol. function=RNA-directed DNA polymerase activity; Biological process=RNA-dependent DNA replication
  Homolog annotation: Hit_ID=Q1SWC8; Match level="QueryCoverage=40%, HitCoverage=7%, E-value=2e-10, Identity=39%"; Hit description=RNA -directed DNA polymerase
GNGSRQVSMDVRIGVRGRSLRIVFAIFIPCRVFHEEKSDCHLIDIPLEGRSYTKSTKRRLHLENVWLPKKDVEEVVRDGCNQDGIGEEEVTTTKKDPEWYRKFDDNTLVSKMKSLKEKLAKVLMKDDVYWRQRAKMLLLQKGGYNSKFFHSMALVRKKVNGIKQLLNEQGEAILSESIGSYDVVVEVLELVVTSEVNCMLSVPLSKDEVHDAFFRMHQD

SEQ ID NO: 186609 - protein, 284 aa, Glycine max
  Coding DNA Sequence Number=SeqID_69831
  Gene Ontology: Mol. function=nucleic acid binding; Cellular component= intracellular; Biological process=DNA integration
MALIAHFDLELHQMDVKTTFLNGDLSETVYMQHPEGFCISGNEDLDLGEAYFMLGIEIHRDRSCHTLGLSQKAYIDRVLERFNMHNCKPRDVSVVKSDKFNKDQCPKNKIEQTEMNDIPFFGVLWEVSCMLRRVDNLEVAGYTNSDLGGCSDDRRSNSGYIFMMAKGAISWKSKKQTLIPSSILQAEFIAYFATSTHVIWLRNLMRRLRIMDSIARPLKIFCDNNVVVFYTKNNKISRGSMHLELKYLIVRDLVKDGSIVVDHVDTHSMLTGPLTKGLKPVVFK

SEQ ID NO: 186610 - protein, 350 aa, Glycine max
  Coding DNA Sequence Number=SeqID_69832
  Gene Ontology: Mol. function=transcription regulator activity; Cellular component=nucleus; Biological process=regulation of transcription
  Homolog annotation: Hit_ID=Q1SL31; Match level="QueryCoverage=98%, HitCoverage=98%, E-value=3e-84, Identity=52%"; Hit description=Helix- loop-helix DNA-binding
  Pfam annotation: Domain name=HLH; Domain location=270-317; Score =32.5; E_value=1.5e-06; Accession=PF00010.16; Description=Helix-loop -helix DNA-binding domain
MEPAGAFPDGEWDFFRRIFAGEDHEHDLFTPQFPLLLDGDDELNIVTQPTFCAAPEVGENERMFYSLDAHHSNSSQYISQESSHSNSSNCSGDDTIFIANPGSTNYYFSYPDHVLANNACVYSMDEKYFASFVPSLADIVTEESVKLHEDVASDDRLENSECNQMEPIVFPSKQLQLKRKLDVPAEDKMNKGSENQKKRARALKDGQGCMKNTWSKKNQKHASNGEEAEETNAGSDGQSSSSNMSEDDNISKSALNSNGKTRASRGSATDPQSLYARKRRERINERLRILQNLVPNGTKVDISTMLEEAVNYVKFLQLQIKLLSSDDLWMYAPLAYNGLDIGLNLNSLSL

SEQ ID NO: 186611 - protein, 50 aa, Glycine max
  Coding DNA Sequence Number=SeqID_69833
MELFSPTLGLIMCFIDQGFFKPLPKVVQWPVQFPKNNEDLTQLCLKTNAI

SEQ ID NO: 186612 - protein, 209 aa, Glycine max
  Coding DNA Sequence Number=SeqID_69834
MTTFHPGCANAKRILYGLHGVSRDGMFVNVVTQVAQVQARDCTRGVGKVLEHGGVEAKSVVVKSAQEAPTSISLLYAPPCHNIHIFHFDIALVLQKSCNVFPTAEDVLAGLDNSLGVERKLDVIVVVGHRKPLEEQKSCAYWKTYHDIDHDFGGVRLTQSKMALEACEEIEYFFFVWDMFPNCSKVAAETFESVNVFVKCFGHLACENM

SEQ ID NO: 186613 - protein, 147 aa, Glycine max
  Coding DNA Sequence Number=SeqID_69835
  Homolog annotation: Hit_ID=Q9ZTX0; Match level="QueryCoverage=20%, HitCoverage=10%, E-value=5e-08, Identity=80%"; Hit description =Similarity to SCAMP37
MAFSMGNMVAVTVMVVAFQTGFEERCERFRCSSEEEGSGEGDKSFVQDQRCAAAKAGLDAIREVAKEHPYPTQEVHPQAETQDGPASASCHLDLSVADIVGFGGLETISLKIWFLAIIYFIGGVPEAYVMWYCPLYRAFRKLAFDFY

SEQ ID NO: 186614 - protein, 89 aa, Glycine max
  Coding DNA Sequence Number=SeqID_69836
MTKYNKLLAKWERSNTLNLIAIKKTISKHLLSGLPKKAIVKEFLDALGKRYQGSENQVKGRRGIRNLIVESSRLGYRQKLREVQKFKGT

SEQ ID NO: 186615 - protein, 132 aa, Glycine max
  Coding DNA Sequence Number=SeqID_69837
MPPTVPVNHYSDPEGQHNRIRILWCYPMLMYTERRLALSTLISSKSASPAEGTSRPVHTGGGPIDPTQGPTTSFLTATTYIYAIGAGITAAAGTRLALQWILVKGFTLYSFQLPYSMSPVLLFIVTTSPCHD

SEQ ID NO: 186616 - protein, 90 aa, Glycine max
  Coding DNA Sequence Number=SeqID_69838
  Pfam annotation: Domain name=zf-CCHC; Domain location=52-69; Score =10.9; E_value=0.016; Accession=PF00098.13; Description=Zinc knuckle
MDSLITRLLRVPHALKEENPADVVETSAMAAPRGRGGGRNSRGGRGGRGGRPQCTYCKRMGHTQETCYSLHGFPDKVAQQLQTPNFCMIV

SEQ ID NO: 186617 - protein, 145 aa, Glycine max
  Coding DNA Sequence Number=SeqID_69839
QNRGGACHPACPGELGCFLQKQPPSGGRIWKAQVGLLSKKLRKLTDCVTILPFGFCHIMEFHGLRNQRIVIIKKGENVEAMSSKVILMMPKNQELSKFQRFKNQVLKNHDSRFKDNQDQDSRLKIQESREDSIKISTKKVFQNIE

SEQ ID NO: 186618 - protein, 40 aa, Glycine max
  Coding DNA Sequence Number=SeqID_69840
MAHKFCFEALDQSLRDIIKHKSKDNTIFGDPASHSKRQPQ

SEQ ID NO: 186619 - protein, 294 aa, Glycine max
  Coding DNA Sequence Number=SeqID_69841
  Gene Ontology: Mol. function=cystathionine beta-lyase activity; Cellular component=cytoplasm; Biological process=amino acid metabolic process
  Homolog annotation: Hit_ID=Q0MFZ3; Match level="QueryCoverage=100%, HitCoverage=75%, E-value=2e-82, Identity=51%"; Hit description =Cystathionine beta-lyase
  Pfam annotation: Domain name=Beta_elim_lyase; Domain location=8-252; Score=-88.8; E_value=9.5e-05; Accession=PF01212.11; Description=Beta- eliminating lyase
  Pfam annotation: Domain name=Cys_Met_Meta_PP; Domain location=2-294; Score=202.3; E_value=1.1e-57; Accession=PF01053.10; Description =CysMet metabolism PLP-dependent enzyme
  Pfam module annotation: Pfam domain module=Beta_elim_lyase::Cys_Met _Meta_PP; Domain location=8-252::2-294
MIARFRGESDQPLYSRVDNPTVKALQDKVAALEGGDACLAFASGMAAISNAILSVVQPGAKVVCVNHVYPDTYRFLRGFCQRFGITTQFVDGDDEAAIAAALPGASLLYLESPSSWVMSEQNLRQLATLARDAGVVTLIDNSWASPIFQQPLLCGIDIVVHSASKYISGHSDVVAGLVIASRQHINNIARHISPFLGGKLSANEASLLMRGLRTLPLRMKQHQHSALQLAQKLRDHPQVSAVCHPGLNPRARSTMRGNSGLFSFAVTEQVDIPQFCNAMQLFHMGVSWGGFESL

SEQ ID NO: 186620 - protein, 56 aa, Glycine max
  Coding DNA Sequence Number=SeqID_69842
MVGTLNIEILDRGCLPYLSRITSAMAATYPNYDVGEKPSWKGKGTSMVLLQLWMKK

SEQ ID NO: 186621 - protein, 129 aa, Glycine max
  Coding DNA Sequence Number=SeqID_69843
  Homolog annotation: Hit_ID=Q9LIG6; Match level="QueryCoverage=40%, HitCoverage=21%, E-value=7e-12, Identity=60%"; Hit description=NifU -like protein 4, mitochondrial precursor
MKREEKKETVDCEERFSKGRIDGGTSNFHDRLSGIKHERRGIWRGLRLDEHAPALPMSAKEYEALDYSDDDRGGGTHKSHDGGGGRVANDETTTLDARSITSLARFVALVVCERELCERLRERERKAMI

SEQ ID NO: 186622 - protein, 130 aa, Glycine max
  Coding DNA Sequence Number=SeqID_69844
  Gene Ontology: Mol. function=DNA binding; Cellular component=nucleus; Biological process=regulation of transcription
  Homolog annotation: Hit_ID=Q0PJJ5; Match level="QueryCoverage=87%, HitCoverage=55%, E-value=3e-51, Identity=82%"; Hit description=MYB transcription factor MYB98
MQRHQFHTPKEIQHCGWSKIAKHLPGRTDNEIKNYWRTRIQKHLKQASSSFQQQSSNSEIIYHPQACTSQVSTMAQPIETYSPPSYQGMLDPFSIQFPTNPHHSSCCTNDDDNNNYWSMEDIWSMQLANY

SEQ ID NO: 186623 - protein, 150 aa, Glycine max
  Coding DNA Sequence Number=SeqID_69845
  Subcellular localization annotation: CTP_CleavageSite=62; ConfidenceScore=5.37e-01
MDGKKKHHVYAVRPRFLLGKSSSSKFLQVRGWRRGPNSLPTPSNMFAALSGREVDHGSGNVTVMEKMVNTVNRKYIEHKVGKWIGQGKTHPLYAKYAKIQPNIHGRHLNANLRFYSQASKCGVFFHVLNGGVSLVLCLFIFFPQHAESLF

SEQ ID NO: 186624 - protein, 37 aa, Glycine max
  Coding DNA Sequence Number=SeqID_69846
MDWTRDTVHGFTAPSRQLGIQRVGSDTDSGFPLLVRK

SEQ ID NO: 186625 - protein, 348 aa, Glycine max
  Coding DNA Sequence Number=SeqID_69847
  Gene Ontology: Mol. function=nucleic acid binding
MASAEQPLKKRKLYEPLPEPPPSSPPPESEATPPSPQTLPTPSTPSLSQEDILAKRWNKDEIRSVYEGYKRIKRCLLRKDARSSMSELEQSYLALITSSRGCMRVQRIVADLIPRYACHCPTALEAAAKVVINMHNLSLTLISRGEDSSGIAFETARACICGLADVCCVASSVAPTSAVIRGICAAVFQNVLTFFIALFEGKDVLQMVDKNFLNMQDTPEAFSELKQKVLDEDESSLTKLSKLRVLCLLWIFFSCPKDLLAACLDLLGSATKEGTNDEGQHFLSLVTSTFDDDKAVHLLERAIGGPKSCTDSIGSGIRDNEAGETIMTEDKHASGGDSSVGKSCLLIQ

SEQ ID NO: 186626 - protein, 1023 aa, Glycine max
  Coding DNA Sequence Number=SeqID_69848
  Gene Ontology: Mol. function=nucleic acid binding
  Homolog annotation: Hit_ID=Q1SL28; Match level="QueryCoverage=86%, HitCoverage=87%, E-value=0.0, Identity=65%"; Hit description=RNA -binding region RNP-1
  Pfam annotation: Domain name=RRM_1; Domain location=248-314; Score =14.0; E_value=0.0073; Accession=PF00076.12; Description=RNA recognition motif. (a.k.a. RRM, R
  Pfam annotation: Domain name=SPOC; Domain location=818-912; Score= -0.5; E_value=0.0068; Accession=PF07744.3; Description=SPOC domain
  Pfam module annotation: Pfam domain module=RRM_1::SPOC; Domain location=248-314::818-912
VLNKDPSLLKWMLCRCKKLLDLLSNASLEIASLVRGILGMFPQQTDLEDCQADSDEDKSDSSIYMNSNYIVPRISEEHESIGESSVKGSSLRVHVGSSNDDFTDKVSDKYVMAHSSAVSLDHAPALKVGLLYDNGVSKPMSIGVGEDGNMPTPRDSISHQMFSPAVRTPVNFRSNSFEGRNDFLNVEKNQVLNFNSPPLGSSSGSVSNSLASPNHHFMSPSASTKGQIVWCCDGDPAAMGIVSASKQLWIGYVGPDVPESHIRFHIERFGPVEQFIFFPVKGFALVEYRRIVDAIKTRHCLPGCFPCHVKFMDIGLGTRGAMNGVAVGSSSHIYVGNIPSQWAKDEIMHETRKVIHKGPLAFIDLSCEFALLMEFESPEEATTVMLHLRQLRRERSNHNQHFCPGTVNVGIGHAYMDGARPIPAPPPPHLDLKVNNPAGSPHARTLSGSPADSSQTRISHLSTLLASLHTKYNINQNLGLNDNYMTGNNCPPMREEDMVPSSTLCITIPRSSSLFLTDDELMAICNLAIGNTGSIVQLTQANMQMGCSWFVECSNVDGAVSVLKNLRGCPGLFFQIEFSKPGHQNAVPFSVKPENNSMELVSPRINSENHTSGIQGAPLLQSNWHFPGSTEMSEVGARKPDGYDNLSQDPHQGGNVPHSYSGAHGPSIPPPQQIQSFPFVHPVYVPPNGPWDCQGINNHLPVGQFRTGVMPNHFHGNAVVSPFIPASVTPLAQIQGTPMHPYNQQVPPSIMPPPLSSLPPPQPEMPPPLPPSPPPLPQVQPPLVPPLPSSPPPPPPPQLPVQEPVNMECSGQSLQYQWQGNLCKSGVNYCTIYASKADSNICRYSNAIPEPAEWPSKLDMTKRTDLRHVKSTFAATPSHRMSPSIKQSPSTLVLTPQLQEKSSLEVESLVLPFFHIQDMTSSSSTLTENDKTPTKEDKDLGPAANGDQWVDRRCWVWLEINIADGRTSGFVRKPPGCMKITPKNKCAAECWEVVCIALSFPESDFMVLVSGAEGSVPFDSIFL

SEQ ID NO: 186627 - protein, 86 aa, Glycine max
  Coding DNA Sequence Number=SeqID_69849
  Homolog annotation: Hit_ID=Q9ZR72; Match level="QueryCoverage=45%, HitCoverage=3%, E-value=2e-07, Identity=74%"; Hit description =Multidrug resistance protein 1
MVLLFLTNGILDHDNNGIDGENHVGCLNLGVKEPNVPSQRSLQNLGVGGDEARNDGMGIAKCIFPSSPAVVVYVDGSRVRVMWLVG

SEQ ID NO: 186628 - protein, 49 aa, Glycine max
  Coding DNA Sequence Number=SeqID_69850
MTGWTGGCDRLAKQLLTSIQLANQHAWELEALDGYTIVKLTFSNFDAFT

SEQ ID NO: 186629 - protein, 258 aa, Glycine max
  Coding DNA Sequence Number=SeqID_69851
  Gene Ontology: Mol. function=nucleic acid binding; Cellular component= chromatin; Biological process=DNA integration
  Homolog annotation: Hit_ID=Q1T010; Match level="QueryCoverage=68%, HitCoverage=16%, E-value=2e-50, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEDAVEKACDSRISVITESGGSIRDQDVIDCCKKYGVSLLFTNVKHYRHLVFCFGITSCFRYPSVCMEELIQIGPLKVLPDLRDRHMSTRFDQFEMLPDNVVIDDGDLIHFALLADIELLKLNSNGLVVRHKARLVAKGFLLKARIDYKEVFAPVARIETIRLSMALASKRNWFVYHLDVKSAFLNGSLNEDVYVTQLPGFEIKRKEKLVFKLNKAIYGLKQAPRCWNQKINSFLIKHGFKQCPIEYGVYYKEEFESN

SEQ ID NO: 186630 - protein, 62 aa, Glycine max
  Coding DNA Sequence Number=SeqID_69852
  Subcellular localization annotation: CTP_CleavageSite=40; ConfidenceScore=5.28e-01
MRRGGLAGGVGCGGWSWYGNHWSSMKALNVTGLFTSCTATCTLASGFVNMFFAAVFGSFITS

SEQ ID NO: 186631 - protein, 90 aa, Glycine max
  Coding DNA Sequence Number=SeqID_69853
MQMKKSSLWIVMIITVLVVSSQFCSVHGRVLRSEVLKTPVGDGCEDFKGEDSSLGMATFAVASNNSSTRQFARSLAYKLASGPSKKGPGH

SEQ ID NO: 186632 - protein, 106 aa, Glycine max
  Coding DNA Sequence Number=SeqID_69854
  Subcellular localization annotation: CTP_CleavageSite=42; ConfidenceScore=5.12e-01
MKYLPSLTLFTQHHALSLVIFILVLIFFTSSLLAEASRPQPRAFQRSPVSVPINHFHMARVLSGPSHGGIARDHTQVQQKQKFYHLQCIFGIEGTKGHGYLYIVDF

SEQ ID NO: 186633 - protein, 121 aa, Glycine max
  Coding DNA Sequence Number=SeqID_69855
EDLILMWAYLTDRQIDWAHLVRYRMHKALWANAPHTYPQLVTLFLRHFQIPFDDEPFVQVKRSFAIGAGAVTSFGYRKDHDGQWLKKNAQPPQDDYVGEGFDSLDGCFEGMDTCMTQLEED

SEQ ID NO: 186634 - protein, 69 aa, Glycine max
  Coding DNA Sequence Number=SeqID_69856
MTQRLWRGSDALGTFLFYYECEQNKNHEPLQPPNKRALVKVHVLVASEERRAWLKKLEELKESKGHLEI

SEQ ID NO: 186635 - protein, 76 aa, Glycine max
  Coding DNA Sequence Number=SeqID_69857
  Gene Ontology: Mol. function=RNA-directed DNA polymerase activity; Biological process=RNA-dependent DNA replication
MVIKSQSIAQHVADLEKVFGELRKYDMRLNLEKCTFGISKGKFFGFMITHQGIEANPNKCTTILEMCSPTWKKSRS

SEQ ID NO: 186636 - protein, 99 aa, Glycine max
  Coding DNA Sequence Number=SeqID_69858
MAIPLLVEHDADEVITRWHWGGTKRLKDEENSKKLKKGPAQDALSAKTSTDVKRGRDALSVNIDTRTKRATCAKHEYKHPLMCHHFLLFSKPFLHHFNY

SEQ ID NO: 186637 - protein, 60 aa, Glycine max
  Coding DNA Sequence Number=SeqID_69859
MAFKATGIPRIVQNLKFGQNKDYPETETKREWTGHKKTATLVHFPWEWYKHMGFLRNFGL

SEQ ID NO: 186638 - protein, 414 aa, Glycine max
  Coding DNA Sequence Number=SeqID_69860
  Gene Ontology: Mol. function=RNA-directed DNA polymerase activity; Biological process=RNA-dependent DNA replication
  Homolog annotation: Hit_ID=Q1RW99; Match level="QueryCoverage=67%, HitCoverage=45%, E-value=3e-41, Identity=32%"; Hit description=RNA -directed DNA polymerase
MWSEHSGCRKLIEDVWKLPAYGYPMKILRQKLRNVKSALKPSDSLINLETQAQVDLQKALDFEELFWKDKARLNWFTRGDRNTAFVHKFAKQRRALNHISVLGDGDCLLQTQDQIQQHIIHFYSALFATDNKCRPNNLISSLVLPLVTSEDNAFLTNLPSPEEPIAMGNFQFKIISKILADLASIAPKLVSPEQRGIIKGRRVAKCIRTTSVAYNLLQCKSFGGNIALKIDIKKAFGSLKSFNTPLHSLYADDILIFCRGTKRNMYNLLNLFDSYGQASGQMISPEKCLFFLGAMSPRKIYEVKDQLGFLLLGPSPSHTWASLFLLLVNSIINGMLAYSFKVYSWPRSMIKDLDSCIRNFVWVGNPNQRKICTVKWQKVCNPLAEGGLGLRQISAINNAAALMLSWDFIHSKDQ

SEQ ID NO: 186639 - protein, 65 aa, Glycine max
  Coding DNA Sequence Number=SeqID_69861
MTGAASLGDPDFEVVLSKCQKKSSNTRTRLQIQEDFITPALGALSEVVSNEVFVLELQRHCQSRD

SEQ ID NO: 186640 - protein, 54 aa, Glycine max
  Coding DNA Sequence Number=SeqID_69862
MGKEHSAHTLPEHTQGESFPRCTVNTQDDPSTVPHGGLLVNTLSSTASWKLTCP

SEQ ID NO: 186641 - protein, 92 aa, Glycine max
  Coding DNA Sequence Number=SeqID_69863
MQRSLEAFLGWKGTKADLMGAFSRAGEPEMEIKYIIILRGRSSLRNDQILESFKNKSEDFREKSPLGERPCRGDGDLRQCIGSWLKGILHEW

SEQ ID NO: 186642 - protein, 74 aa, Glycine max
  Coding DNA Sequence Number=SeqID_69864
MSGGEWSWLGGQKGRLAKQRTLTLKCVYALACSESMRKLDTYSVENEPWVLIDRGCYSDVATLTDNYRLVDNNY

SEQ ID NO: 186643 - protein, 420 aa, Glycine max
  Coding DNA Sequence Number=SeqID_69865
GALGLRTSAREWPLLEGQEGGPAKQRTLMLKRLFRIEGACLMSGIVALTSRRVTSQSSPKHRQVLSSVGSGSIDRCENCSLFAFVLASCDSFSSSFILFNLQGIPSLTMSLFLFDSAIDMGGSDSGGSIQQPLMDREVISIGGSSSKYTHHGASDNEFFSSERLRVSHCTRGGTSRLRGRAWPSVASLIREPVPITVIFPLSIFRGAWRSGGDVRDDVLKYKSYIISATSVVALQHQMKLTGKIGWVSMNSVSKKLPEFDSNVFHHFKDYFFKVLATDVIANGLPLMFNRYESRLMFYWQSDPTRFKSFDEDLLTFVERVDKAILEQLSASLDVWAVLSLPLASNPFTALDGKCFTLTLVKQAKPPFMSKLAACILCTEELDKSVESVNGPWRESIVPGQCRPFERRRKDMTQDCIVIGV

SEQ ID NO: 186644 - protein, 54 aa, Glycine max
  Coding DNA Sequence Number=SeqID_69866
MEQVCCGLKAVWVHCLRGFVVATRAWIELYVRVNLGLSVNLTGRVRMGHSIGLE

SEQ ID NO: 186645 - protein, 309 aa, Glycine max
  Coding DNA Sequence Number=SeqID_69867
  Homolog annotation: Hit_ID=Q9AVH2; Match level="QueryCoverage=74%, HitCoverage=99%, E-value=2e-72, Identity=54%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 186646 - protein, 590 aa, Glycine max
  Coding DNA Sequence Number=SeqID_69868
  Gene Ontology: Mol. function=oxidoreductase activity, acting on paired donors, with incorporation or reduction of molecular oxygen; Cellular component=membrane; Biological process=carotenoid biosynthetic process
  Homolog annotation: Hit_ID=Q1QFZ0; Match level="QueryCoverage=64%, HitCoverage=64%, E-value=1e-126, Identity=53%"; Hit description =Putative gluconate dehydrogenase
  Pfam annotation: Domain name=GMC_oxred_N; Domain location=303-567; Score=-52.1; E_value=0.00013; Accession=PF00732.10; Description=GMC oxidoreductase
MKKRAKTLPGVTRRQVLTWSTLGVAAGVTRAADAVSLKGAPGWTPFADNPPEQFQAQGWLFFTEEEARTVEAMVDRIIPADELSVGGKEAGCAVFIDRQLHGFYGTFERLYMQGPFQQGTTEQGDQSPLVPQQRYRQGLAALNRYVQQTSQKNFVDLTPAQQDALLADMEAGKVHFSGFDAQSLFLEVLNNTMEGFFADPIYGGNKDMKLPKTDVVVIGLGWAGSIIANELADEGLEVIGIERGPWRDTARDFNIGTVTDELRYVMREELMLRTRQNTCTMRNNPSQTALPMRTWGSFHPGNGTGGAGNHWAGITFRFQPEEFRLKSHLTERYGASAIPDELVLQDWGTSWEEMEPHYMQFERVAGTSGYAGNIQGQKRTGGNPFEGARSADYPTPPLRQPYGPTLFAEAAKNLGYQPFPVPSSLVSEAYTNPYGVTMGPCTFCGFCTNYGCANYSKASAITTVLPALMRKENFTAYTNCEVLEVLTDASGKQATGVTYIDSSGDKWEQPADLVIVAAFTFENVRLMLLSGIGQAYDPVTNKGTTGRNYAYQTANGVTLFFDNKNFNPFIGAGAVGMGIDEFNNDNFDHS

SEQ ID NO: 186647 - protein, 68 aa, Glycine max
  Coding DNA Sequence Number=SeqID_69869
  Gene Ontology: Mol. function=4-aminobutyrate transaminase activity; Biological process=gamma-aminobutyric acid metabolic process
  Homolog annotation: Hit_ID=Q8D0Y8; Match level="QueryCoverage=95%, HitCoverage=15%, E-value=6e-19, Identity=68%"; Hit description=4 -aminobutyrate aminotransferase
MAAEFHDASGRPSAEIAKAIQQQALAEGLILLTCGVHSNVIRFLYPLTIPDAQFSTALNILTRILSQH

SEQ ID NO: 186648 - protein, 336 aa, Glycine max
  Coding DNA Sequence Number=SeqID_69870
  Gene Ontology: Mol. function=isopentenyl-diphosphate delta-isomerase activity; Biological process=isoprenoid biosynthetic process
  Homolog annotation: Hit_ID=P65559; Match level="QueryCoverage=50%, HitCoverage=92%, E-value=7e-68, Identity=74%"; Hit description =Putative Nudix hydrolase yfcD
  Pfam annotation: Domain name=NUDIX; Domain location=192-323; Score =88.2; E_value=2.5e-23; Accession=PF00293.18; Description=NUDIX domain
LNESSAIAEYLEERFPAPEFERLYPRDREKRAHAREVQAWLRSDLLALRTERPTEVLFAAERFAPLTPAGEQAASKLIAAVQRLLPDGQQNLFGEWSIADTDLAVMINRLALHVDPLPVKLQHYAEFQWQRASVQLWLAESGACWARRKQRKGYRMVDQTAGDGIEWVDIVSEENEVIAQASRAQMRAQCLRHRATYIVVHDGMGKILVQRRTESKDFMPGMLDATAGGVVQSGEDLLESARREAEEELGIADVPFAEHGKFYFEDQHCRVWGGLFSCVSHGPFAMQEEEVDEVFWMTPEEITARCDEFTDDSLKALSLWLSRNSDAVRSKQSSEA

SEQ ID NO: 186649 - protein, 150 aa, Glycine max
  Coding DNA Sequence Number=SeqID_69871
  Gene Ontology: Mol. function=protein binding; Cellular component =integral to membrane
  Homolog annotation: Hit_ID=Q8ZDJ8; Match level="QueryCoverage=93%, HitCoverage=93%, E-value=3e-68, Identity=84%"; Hit description =UPF0208 membrane protein YPO2564/y1623/YP2375
  Pfam annotation: Domain name=DUF412; Domain location=9-150; Score =317.6; E_value=2.2e-92; Accession=PF04217.4; Description=Protein of unknown function, DUF412
  Subcellular localization annotation: CTP_CleavageSite=78; ConfidenceScore=5.04e-01
MANDAGNPGWFGLFQRGQHYMKTWPADKRLAPVFPENRVVTATRFAIRFMPPLAIFTLTWQIALGGQLGPAIATALFACSLPMQGLWWLGKRSVTPLPPTLLHWFHEVRAKLEEAGQAIAPVDGKPTYQALADVLKRAFKQLDRTFLDDL

SEQ ID NO: 186650 - protein, 685 aa, Glycine max
  Coding DNA Sequence Number=SeqID_69872
  Gene Ontology: Mol. function=phosphotransferase activity, carboxyl group as acceptor; Cellular component=membrane fraction; Biological process=organic acid metabolic process
  Homolog annotation: Hit_ID=P0A6A3; Match level="QueryCoverage=53%, HitCoverage=100%, E-value=0.0, Identity=82%"; Hit description =Acetate kinase
  Pfam annotation: Domain name=Acetate_kinase; Domain location=5-361; Score=737.5; E_value=8.9e-219; Accession=PF00871.8; Description =Acetokinase family
  Pfam annotation: Domain name=DRTGG; Domain location=588-685; Score =141.7; E_value=2e-39; Accession=PF07085.2; Description=DRTGG domain
  Pfam module annotation: Pfam domain module=Acetate_kinase::DRTGG; Domain location=5-361::588-685
MSTKLVLVLNCGSSSLKFAILNPASGDEYLSAKALNFIVKTILAQKPELSAQIAAIGHRIVHGGEQLTQSVVIDESVIQGIKDASSFAPLHNPAHLIGIDEAMKNFPHLSDKNVAVFDTAFHQTMPEESYLYALPYNLYKEHGVRRYGAHGTSHYYVTQEAAKMLNKPVSELNIITCHLGNGGSVAAIRNGQCVDTSMGLTPLEGLVMGTRSGDIDPAIVFFLHDTLGMSVDAINKLLTKESGLLGLTEVTSDCRYVEDNYATKDDAKRAMDVFCHRLAKYIGSYTALMEGRLDAVVFTGGIGENAAMVRELALDKLGLLGFEVDHERNLAARFGKSGFINKEGTRPAVVIPTNEEWVIAQDAARLTAVGLTSVSLGVIRAMERKGVRLSVFKPIAQPRAGGDAPDQTTTIIRKNSAIPAAVPLPMSRVESLLGSNQQDVLMEEIIANYHANAKDAEVVLVEGLVPTRKHQFASALNYEIAKTLNAEIVFVMSLGNDSPAQLKERIELTQSSFGGSKNKNITGVIINKLNAPVDEQGRTRPDLSEIFDDSSKASIANIDPKQLFANSPLPVLGCVPWSFDLIATRAIDMCRHLNAEIINEGEIHTRRVKSVTFCARSIPHMLEHFRPGSLLVTSADRPDVLVAACLAAMNGIEIGAVLLTGGYQIEAPIARLCERAFQTGLPVFM

SEQ ID NO: 186651 - protein, 68 aa, Glycine max
  Coding DNA Sequence Number=SeqID_69873
MAANVIKEKGKVMDNGTIKEKEKVMDIDAIKEEKEIRDDKEKSKDVFNKNGIKVDKNKAKDILETSPP

SEQ ID NO: 186652 - protein, 88 aa, Glycine max
  Coding DNA Sequence Number=SeqID_69874
  Subcellular localization annotation: CTP_CleavageSite=77; ConfidenceScore=5.33e-01
MFREENPSRGASVTLPRRFREQIRQGFSSFFTVLHTFFVLSSFFNGFHLHFVHFRFSFLPFLTSFNRSFKPLSRLINDKMNFNRSFAL

SEQ ID NO: 186653 - protein, 228 aa, Glycine max
  Coding DNA Sequence Number=SeqID_69875
  Gene Ontology: Mol. function=RNA-directed DNA polymerase activity; Cellular component=intracellular; Biological process=RNA-dependent DNA replication
MNPPVPVPPVLGRPLILYMIVLDESMGCMLGQHDKSEKRKRAVYYLSKKFTACSPPSKAIHAEQHHLVGVQNGPSQAIKGSALEDYLAQQPINDYQPMHPEFPDEVIMTLFEEEMGDEDREKWIVWFDGKSNALGHRVGAVLVTPDDQCIPFTARLGLDCMNNMSEYEACALGIQAAIDFKVKLLKMNGSGMKKEEREEMQLQGEDESRRSSPPKEAMDKSLEEEGDE

SEQ ID NO: 186654 - protein, 441 aa, Glycine max
  Coding DNA Sequence Number=SeqID_69876
  Gene Ontology: Mol. function=transferase activity, transferring nitrogenous groups; Cellular component=membrane; Biological process =biosynthetic process
  Homolog annotation: Hit_ID=Q8GLH6; Match level="QueryCoverage=95%, HitCoverage=95%, E-value=0.0, Identity=86%"; Hit description =Putative aminotransferase
  Pfam annotation: Domain name=Aminotran_1_2; Domain location=70-432; Score=142.6; E_value=1e-39; Accession=PF00155.11; Description =Aminotransferase class I and II
  Pfam annotation: Domain name=Beta_elim_lyase; Domain location=126 -377; Score=-132.2; E_value=0.086; Accession=PF01212.11; Description =Beta-eliminating lyase
  Pfam module annotation: Pfam domain module=Aminotran_1_2::Beta_elim _lyase; Domain location=70-432::126-377
  Subcellular localization annotation: CTP_CleavageSite=14; ConfidenceScore=5.03e-01
MRFAPLNPAKPGYRAKTQRCPSFVTVKRTLPIKAVTMNFQIDKSGKLENVCYDIRGPVLKEAKRLEEEGNKVLKLNIGNPAPFGFEAPDEILVDVIRNLPSAQGYCDSKGLYSARKAIMQHYQARDMRDVTVEDIYIGNGVSELIVQAMQALLNSGDEMLVPAPDYPLWTAAVSLSSGKAVHYLCDESAGWFPDLDDIRSKITPRTRGIVIINPNNPTGAVYSKELLLEIVEIARQHNLIIFADEIYDKILYDEAQHHSIAALAPDLLTVTFNGLSKTYRVAGFRQGWMVLNGPKKHAKGYIEGLEMLASMRLCANVPAQHAIQTALGGYQSISEFIAPGGRLFEQRQRAWELINDIPGVSCVKPQGALYMFPRIDAKKFNIMDDQKMVLDFLLQEKVLLVQGTAFNWPWPDHVRIVTLPRVDDLEMAINKFGRFLQGYRQ

SEQ ID NO: 186655 - protein, 146 aa, Glycine max
  Coding DNA Sequence Number=SeqID_69877
  Gene Ontology: Mol. function=phosphoglycolate phosphatase activity; Cellular component=cytoplasm; Biological process=metabolic process
  Homolog annotation: Hit_ID=P77625; Match level="QueryCoverage=93%, HitCoverage=63%, E-value=2e-37, Identity=56%"; Hit description =Phosphatase yfbT
LEAEDTAGVQAIAGAHALLTTLNALDIPWAIVTSGSIPVAHARHKAAGLPLPEVFITAEDIKFGKPNPEPYLLGAERLGLSAPECVVVEDAPAGIIAGLEAGSAVVAVNPPADAPRLSEVALQVENLQPLHISKQPDGYFSVTLRA

SEQ ID NO: 186656 - protein, 108 aa, Glycine max
  Coding DNA Sequence Number=SeqID_69878
MVGSWYVTQATKNAMKMQGSCMSKHENKSAPCVVKKVIWTFQLPMTKDETNIQHSPVESPTIATYPPAGGRREGSRVRLPWEKDARSRHQCLFEENVVKTGKDVVYEL

SEQ ID NO: 186657 - protein, 46 aa, Glycine max
  Coding DNA Sequence Number=SeqID_69879
MKGRQRKGSKGQKIVSRSNALTILSAFQNLKHRFKVEHLKGLFVRD

SEQ ID NO: 186658 - protein, 208 aa, Glycine max
  Coding DNA Sequence Number=SeqID_69880
MMEAMLSMRKMMEVNTVTVIAVSIATKVDPTHLYGLNQVNCPASDMVGQGSEALRSVGGPHFVQEQVPQPMGETHEVPRDHTLANSEPCLGYATEGQAFGGPSVSPTTITLTFCGGKTASCHGDGNYAFADMKELCLVPNVVIPPKFKVSDFDKYKGTTCPKNHLKMYCKKMGAYAKDETLLMHFFQESLNGAAITWYTNLESSRVRS

SEQ ID NO: 186659 - protein, 354 aa, Glycine max
  Coding DNA Sequence Number=SeqID_69881
VQQNVSAEEIPSCARTSPTPEADAVNVEKWGEGQGIGSSSPHGWAEVDDPHEPNQSDNTIPHESSQKSSSEENFFDEDAIKEAEAGGSDIYPVSSTSKLSASIGIAEDTFIQMQNGDPAAALRLLLNTSQANTSSEKIPGASSSSDAEINSSVRQDSLLLKLSTEYARKDVLKSIEENPSAAFGHLNFLKKLHNPLTSDETLGKVIQIEAIIDQFASTVQRKRENGTRLDAQKQAHILLLEKARAAQHEVERLTKEAKEGSSEIKDCDDNISSWEATITDLLFQVDDLRQKIVTEQAKRKELQEKAANSIQKLVDEKGREGLKAFSASQAVVDEAKVMESADQVLTKEMATLKK

SEQ ID NO: 186660 - protein, 67 aa, Glycine max
  Coding DNA Sequence Number=SeqID_69882
MCASQRASKPVRRKEADWWDPPNWRCGMNRKLGYGAQLRANLDPTKGVGRLRQQDGGHGSRDPLRSV

SEQ ID NO: 186661 - protein, 313 aa, Glycine max
  Coding DNA Sequence Number=SeqID_69883
  Homolog annotation: Hit_ID=Q6CQE5; Match level="QueryCoverage=21%, HitCoverage=77%, E-value=1e-11, Identity=49%"; Hit description =Protein TAR1
MAHLELSIPWRGSTEQPHRPTYLNYPEGNFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSRE

SEQ ID NO: 186662 - protein, 84 aa, Glycine max
  Coding DNA Sequence Number=SeqID_69884
MNPDFNQPRGGCSREVSIHPAQQHCYMFALGKRCSVDFSQRRGQRTAHVAAIRTLHRTIQSVGATGGVYKGQGRSQRELMTRAY

SEQ ID NO: 186663 - protein, 108 aa, Glycine max
  Coding DNA Sequence Number=SeqID_69885
MFQFDLVPQEACKHAHAEGSGATLLYRIYGPKPIQRISVPSCSNLTVPQRKRGFCAVKVGSVHTDKDYHEALCTSFRLPRLPNLTFPIFHGISRIQVITGITIAVGEG

SEQ ID NO: 186664 - protein, 98 aa, Glycine max
  Coding DNA Sequence Number=SeqID_69886
MGLFSNIFLRGTLFSRKSHAWHHHHWRFRGGGDTWRWCRHSHQRLAFWLHGVGDASSNGAFSMAPVKLATYAFGRESSFGGRESSSFSVRAASAGKRK

SEQ ID NO: 186665 - protein, 446 aa, Glycine max
  Coding DNA Sequence Number=SeqID_69887
  Gene Ontology: Mol. function=endonuclease activity; Cellular component=membrane; Biological process=RNA-dependent DNA replication
  Homolog annotation: Hit_ID=Q1RY72; Match level="QueryCoverage=66%, HitCoverage=84%, E-value=6e-47, Identity=37%"; Hit description =Endonuclease/exonuclease/phosphatase
  Pfam annotation: Domain name=Exo_endo_phos; Domain location=136-368; Score=16.0; E_value=0.0012; Accession=PF03372.13; Description =EndonucleaseExonucleasephosphatase family
MVTNECTTHKLGVSYARMLVEVDITRKLVEAIAIKDKDGRKMMQPKPKPQCQKIGHQCGNGVKKKKWQPKPQQERKHEIPVEVSTPRKETTTSKANGDEGKTWIRTAEHDEETWTKVSKASKDRGFEWPPSLRLGTMIVSWNVRGLNKAGKLREISSRLLELQPEIAILIKTRVKENKAAKVREKLRLNGNYLDNYTCHANGRLWIHWDLNRVDVKCVSRTSQLIHCGVYDVTGNFKFWLTAIYASNALDRRKILWKDIEKIHETHQGAWCVVGDYNNVAKAQDRIGGKMVTEAEFVDLQNMMDVTGLSEMDSIGDFFTWSNKRSADPIYSRIDRVLANVLWFQENTDKVLNVLPPNVSDHSLLYLNVDRARRTHGFKEVVQESWKQPTKGSPMGVLWHKLKRLKQVLKDFNKPANDIKQKIVKARQELHNAQNELINCRKRNLTG

SEQ ID NO: 186666 - protein, 134 aa, Glycine max
  Coding DNA Sequence Number=SeqID_69888
MTATTTKRGRGRGRPKSTVPSSTKNQNSPEPQSEMETGKHDEIEDENKLDGEKLIEERSKEVETPKDDPKGNQEARRLWVDVISENRNPTKGRMMSYVAPKMVEGQIEIEIEDEDIESEIRYWENALILYVLGG

SEQ ID NO: 186667 - protein, 56 aa, Glycine max
  Coding DNA Sequence Number=SeqID_69889
MWWGPIEHGRGKFKGGLSNQVMRKIQHKILDLVKSYSKLLQSIIDSKYFSNVKPNM

SEQ ID NO: 186668 - protein, 56 aa, Glycine max
  Coding DNA Sequence Number=SeqID_69890
MNFDDVKEESNKAATKDKHYFKTNTRLLQQTKPCFKITLRSSLASKQIVSKTCKVL

SEQ ID NO: 186669 - protein, 162 aa, Glycine max
  Coding DNA Sequence Number=SeqID_69891
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=6e-58, Identity=67%"; Hit description=Chromo
MDQEKVQAVLNWPYPINLKQLRGFLGLTGYYRKFIKGYVSIATPLSNLLKKENFHWNDHTSMAFDNLKAAITKAPVLALPDFSKAFTLETDASGIGIRAVLSQEQHPIAFFSKKLTPRMQRQSAYIRESYAIIEAVAKFRHYLLGQRFVIKTDQRNLKSLTE

SEQ ID NO: 186670 - protein, 71 aa, Glycine max
  Coding DNA Sequence Number=SeqID_69892
MTTLTQIWMTFLLSNILPSDHNAYLPLRKDHAHKTPSGPEGVQQGPGVSSFGYGPLSVLQGARPPSKVMPS

SEQ ID NO: 186671 - protein, 321 aa, Glycine max
  Coding DNA Sequence Number=SeqID_69893
  Gene Ontology: Mol. function=RNA-directed DNA polymerase activity; Cellular component=chromatin; Biological process=chromatin assembly or disassembly
  Pfam annotation: Domain name=RnaseH; Domain location=75-196; Score= -28.0; E_value=0.024; Accession=PF00075.14; Description=RNase H
  Pfam annotation: Domain name=zf-H2C2; Domain location=270-311; Score =10.2; E_value=0.016; Accession=PF09337.1; Description=His(2)-Cys(2) zinc finger
  Pfam module annotation: Pfam domain module=RnaseH::zf-H2C2; Domain location=75-196::270-311
MVQWPTPSSAKELRSFLGLTGFYRKFIKNYAMITAPLTSLCSKEPFEWPSEAQSAFDRLKTAMTSAPVLALPDFDEPFIIETDASDAGMGAVLMQKGHPLAFFSKQFGPRMVHASTYVRELHAIVAAVRKWRQYLLGHPFTIFTDHKSLRELMSQVIQTPEQHYYLSKLLGFDYTIQYKVGSSNAVADALSRTTPSGEFLLLSVPHLDFMRDLRNTLHSSNEFQELLSKVRDNPGDFPDYRIHQGLILFKNRIWLNNDNPSIPSLMFEFHATPIGGHLGVTKTTHRLESNFFWSSLRKDIKRFVKECTTCQQTKSSTQRPA

SEQ ID NO: 186672 - protein, 72 aa, Glycine max
  Coding DNA Sequence Number=SeqID_69894
MKSACCKHEIIIQTDPRNFKRKELLQKKLLPASEHDAASAVKVKFSSEFDQCCSIFPGLSLSLPCLITEGWS

SEQ ID NO: 186673 - protein, 217 aa, Glycine max
  Coding DNA Sequence Number=SeqID_69895
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-33, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=7; ConfidenceScore=5.30e-01
MARTCCPLNARACSPLKARMCSPLKARTCSHLKVRVRDPLMVRMCSPLKVMACIPPMARTCCPLNARACSPLKARMCSPLKARTCSHLKVRVRHPLEARMCSPLKVRACSPLKVRTCSPLKVRTCSPLKVMACIPPMARTCCPLNARACSPLKARMCSPLKARTCSHLKVRVRDPLMVRMCSPLKVMACIPPMARTCCPLNARACSPLKARMCSPLK

SEQ ID NO: 186674 - protein, 54 aa, Glycine max
  Coding DNA Sequence Number=SeqID_69896
MRNWKTTLMKTTAVECLERFVSAICTIFGNEYLRRSNNEDIKRLLQMGTARRFP

SEQ ID NO: 186675 - protein, 49 aa, Glycine max
  Coding DNA Sequence Number=SeqID_69897
LKEAQERRLQEQERRMEYEILMKDTSNMSEQQHKDHEKYCEHIRKKLGY

SEQ ID NO: 186676 - protein, 70 aa, Glycine max
  Coding DNA Sequence Number=SeqID_69898
MSLEQTNQWLAPTFQWKLNKQRCVSSPHQVDLAPYASGPYNAQWKAPGLLHDKHTLRSSHILRKMEVEET

SEQ ID NO: 186677 - protein, 114 aa, Glycine max
  Coding DNA Sequence Number=SeqID_69899
MDSSGDSENEVVILSLMAKNYESEEAVTSSNNNLSISFDELQDAFNDLHKESVKLATLDSLKRSWYIDSRCFKHMTKDASKFTHISPKNSGHVTYGGNNKGKNSSSQKNRYESI

SEQ ID NO: 186678 - protein, 101 aa, Glycine max
  Coding DNA Sequence Number=SeqID_69900
MPHAKCEISALSTTFVFSQAQCMTSAKLKSSYSRLAQHRGFRAYLKPVLCKIRDWHKIPEHTTMPILGIELWRQQEEQLLQRYLGFGIRERLLSGRVIVKC

SEQ ID NO: 186679 - protein, 51 aa, Glycine max
  Coding DNA Sequence Number=SeqID_69901
MEEIHIEDAKEHHLDEDALIPHNVALCRACRPWIFYINGVLCFLKINGNLM

SEQ ID NO: 186680 - protein, 38 aa, Glycine max
  Coding DNA Sequence Number=SeqID_69902
MKAKCNQRWLGEAKTGLLAQGKHNHGPLQVSVCLLEPT

SEQ ID NO: 186681 - protein, 55 aa, Glycine max
  Coding DNA Sequence Number=SeqID_69903
MYYSDSINLRTPDRVNYSESKESNKIIKCEIGLKVKESVVTGELKLKEANMRGAK

SEQ ID NO: 186682 - protein, 102 aa, Glycine max
  Coding DNA Sequence Number=SeqID_69904
AVASGGSNLARLGELGGKLLPYFAINRGKSEEERGSAFLAQLILSKLLRKIVSVKKIQAEALPGEMNILTVHDQEWEQELSLYNQYEEERTPNLESVFKEFM

SEQ ID NO: 186683 - protein, 371 aa, Glycine max
  Coding DNA Sequence Number=SeqID_69905
  Homolog annotation: Hit_ID=Q26UV4; Match level="QueryCoverage=33%, HitCoverage=31%, E-value=9e-11, Identity=31%"; Hit description =Hypothetical protein precursor
  Pfam annotation: Domain name=DUF482; Domain location=22-287; Score= -244.8; E_value=0.0036; Accession=PF04339.3; Description=Protein of unknown function, DUF482
MDDELRGRLLGLPLSRLWRPWITWKTRFVGATSTEYTPLPAHVAPEALAEDVTRHAIGDTRLLVVKDLAIDSPLLDDAANAHSAAFLQALLARGFVELEGMPLAWVAIDFDSIDGYLGRLSSSRRKNIRRKLRSRDDLQIDCIATGDPALADPRLQAELHALYLGVYAQSAVHFDQLGLPYFQHLLADSQGQGRMFLYRHQGQLIGWNLCYVHAGKLVDKYIGLAYPQSREHNLYAVSWMHNLEYALQHGLSHYVAGWTDSRIKAELGARFTSTRHAIHARSPLLRAALRRLAPYLQGEPDGRRLSDAGAFPADPGPGRWRAATAPSADPVPAAVARHAAIRLQQRHPGSLQHRGACAAAGPARHSDARQW

SEQ ID NO: 186684 - protein, 180 aa, Glycine max
  Coding DNA Sequence Number=SeqID_69906
MAIAMHSDPWVKARWTLPTMKSQKIFTKVYRALILNHQGAGPSCNSGPNTIQEGCSKQDAYPVAFSDVQHNHSQKAGDTSKNIGPTSKPKGCNKEDLLSVAQPTKETPDKYSKVYTRQKHSLSKARPLQIEENHPQLQQGDDVSLTQTANQDNASNQRYVEAERRLKSIIECSAEVLEEA

SEQ ID NO: 186685 - protein, 78 aa, Glycine max
  Coding DNA Sequence Number=SeqID_69907
MTTLASACQSNLQSPNDAVWITGRCFRMLPDSWVMIEKGGVVDKSEVFAPMYPPFVMRNSGLRSSFKSETKIVSVFSH

SEQ ID NO: 186686 - protein, 116 aa, Glycine max
  Coding DNA Sequence Number=SeqID_69908
LQLVAPPDSIPTVEQFNEWVAWPRTQPPPHRDDEDPAAQVPHQPSDESSESSTPEPLIRKRRVVLTKEAVATPEKSPEATLEPPTPMADTTSPQQAANPSTPEVQTTQSCLQTLLP

SEQ ID NO: 186687 - protein, 101 aa, Glycine max
  Coding DNA Sequence Number=SeqID_69909
MAQNKLLSRKLEILTETLGCSICGEAHETDQCIPIEEKTQEVHYMGNQQRQGYTQGGNNVNKDSGDHTLAINSTRTRVDLPTGQFNKGLTSFRGLLSWRRL

SEQ ID NO: 186688 - protein, 286 aa, Glycine max
  Coding DNA Sequence Number=SeqID_69910
  Gene Ontology: Mol. function=DNA binding; Cellular component=oxygen evolving complex; Biological process=DNA integration
  Homolog annotation: Hit_ID=Q1SLU3; Match level="QueryCoverage=71%, HitCoverage=17%, E-value=1e-42, Identity=40%"; Hit description =Integrase, catalytic region
  Pfam annotation: Domain name=zf-CCHC; Domain location=64-81; Score =6.5; E_value=0.083; Accession=PF00098.13; Description=Zinc knuckle
  Pfam module annotation: Pfam domain module=RVT_2::zf-CCHC; Domain location=75-195::64-81
MSLINVVGNNPLNSGHSCTYYGKHNHTIDRCYRKNGFPQNYASKEGKGTQSNPGRGNSGAKGNKVCKYCGFSNHTVDDCYKKHEYSPGHKLYKVQNPNINNDSVVREEDVNNAFLHGDLNEEVYMMLPQGNDLIEIQGITELLDNAFKIKDLGELRCFLGFEVARKHVGINLCQRKYALDILSDADASSFRRLIGRLIYLTNTRPNITYVVQHLSQFVVALTSAHQQGISDFDWASCIDTKRTITGYAMYIGDSLISWKSKKQATVSRSSSEVEYRALACTICELQ

SEQ ID NO: 186689 - protein, 300 aa, Glycine max
  Coding DNA Sequence Number=SeqID_69911
  Gene Ontology: Mol. function=protein binding; Biological process =response to light stimulus
  Homolog annotation: Hit_ID=Q9LUB9; Match level="QueryCoverage=66%, HitCoverage=33%, E-value=1e-11, Identity=26%"; Hit description =Similarity to bZIP transcription factor
MTPANVAVIRTASELLGMTAGDGLSHVAETRFREVVGTNQEHALTVLRSCMLLLPEAETTACLVSRCIEALVSVHGVSRLNDVNEMQPGDFQIVAESMGRRLEESHDVLYKMVDLYLKENKFEKVTEEERSGICNSIDCTKLSSETLVECVQNPRMPLRLVVRAVMLEHLNTRHSIALAGAQRHQLRFENNTRRQRQRQRRRSMTLGDFLYRDATLRETAKLKTMMDSTDARIRSLEEEVRCMNRVLLRECQVSVLGSERSASFHFVTDENVGSVKNGTFRQRLMIGLKNAFRVPNSVST

SEQ ID NO: 186690 - protein, 355 aa, Glycine max
  Coding DNA Sequence Number=SeqID_69912
MPERESTNGYCSSGEEDGDAAWRAAIDSIAQTTTYVASTTKHNHPNHHIDDDDHKPNTQQLKHYQLKAQKLLNEILENSIEIVRKPVPVVDEDPESNECGIRLFKHAQPGIVFDHFCLLLLCYGNLALCGNFVGGGSRSLVTIVLDLNMKNLRTTLKYEKAALCMLGASAMTCGNGLSQLVGQLNQNYWSRLLHYMAADELQPPRKRPRLLPGGDIDEKSKKQFRKQIRSVAVNGIDIIAAANDAYKKSLARLEAKDAAAKAKAKREEERIENLKKIRGERWLPSMAKEMQGYIPSFMWSSIFNAKWIIDEGTYWRVDNGRDIMLNLPGCKIPPHESNFVEENMRVANIINPESS

SEQ ID NO: 186691 - protein, 93 aa, Glycine max
  Coding DNA Sequence Number=SeqID_69913
MAHVLAMVVDGVGGFVKTLWALQERRWSYTFDAVASAAVSVTMALVLCLLAIRASYRHRRGDIRCTGNDDFLTAGREKLLHDLGLPWSQLIST

SEQ ID NO: 186692 - protein, 1021 aa, Glycine max
  Coding DNA Sequence Number=SeqID_69914
  Gene Ontology: Mol. function=hydrolase activity, acting on acid anhydrides, catalyzing transmembrane movement of substances; Cellular component=membrane; Biological process=calcium ion transport
  Homolog annotation: Hit_ID=Q1S6T2; Match level="QueryCoverage=99%, HitCoverage=97%, E-value=0.0, Identity=86%"; Hit description=Cation transporting ATPase, C-terminal
  Pfam annotation: Domain name=Cation_ATPase_C; Domain location=879 -1021; Score=21.1; E_value=4.7e-06; Accession=PF00689.11; Description= Cation transporting ATPase, C-terminus
  Pfam annotation: Domain name=Cation_ATPase_N; Domain location=116 -197; Score=59.3; E_value=1.3e-14; Accession=PF00690.16; Description =Cation transporterATPase, N-terminus
  Pfam annotation: Domain name=E1-E2_ATPase; Domain location=211-452; Score=229.1; E_value=9.4e-66; Accession=PF00122.10; Description=E1 -E2 ATPase
  Pfam annotation: Domain name=Hydrolase; Domain location=456-783; Score=57.1; E_value=5.6e-14; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=879-1021::116 -197::211-452::456-783
MEEGMWGCKEPETTLSFHCQHLQALRSSCYASYQSGLETTEKSLGQRLIPLVERDCRWPPKEILYMEKLRVAVLVSKAAFQFIQGVQPSDYVLPDEVKAAGFQICAEELGSIVEGHDVKKLKFHGGVDGIAGKLSTSTTTGLSGDSESRHRRQELFGVNKFTESEVRSFWIFVYEALQDMTLMILGVCAFVSLIVGIATEGWPKGAHDGLGIVASILLVVFVTAMSDYRQSLQFKDLDKEKKKISIQVTRNGYRQKMSIYSLLPGDLVHLSIGDQVPADGLFVSGFSVLIDESSLTGESEPVMVTSQNPFLLSGTKVQDGSCTMLITTVGMRTQWGKLMATLSEGGDDETPLQVKLNGVATIIGKIGLVFAVITFAVLVKGLMGRKLQEGRFWWWSADDALEMLEFFAIAVTIVVVAVPEGLPLAVTLSLAFAMKKMMNDKALVRHLAACETMGSATTICSDKTGTLTTNRMTVVKTCICMNIKEVTSNDSTLSSELPDSTLKMLLQSIFSNTGGEVVVNKKGKREILGTPTESALLEFGLSLGGDFHAERQTCKVVKVEPFNSERKRMGVVLEIPGGGLRAHSKGASEIILAACDKVINSNGDVVSIDEESSNYLNSTIDQFAGEALRTLCLAYLELENGFSTEDPIPVSGYTCVGIVGIKDPVRPGVKESVEVCRSAGIVVRMVTGDNINTAKAIARECGILTDDGIAIEGPDFREKTQEELFELIPKIQVMARSSPLDKHTLVKHLRTTFGEVVAVTGDGTNDAPALHEADIGLAMGIAGTEVAKESADVIILDDNFSTIVTVAKWGRSVYINIQKFVQFQLTVNVVALLVNFSSACMTGSAPLTAVQLLWVNMIMDTLGALALATEPPTDDLMKRMPVGRKGEFINNVMWRNILGQALYQFVVIWFLQSVGKWVFFLRGPNAEVVLNTLIFNTFVFCQVFNEVNSREMEDTDVFKGIWDNHVFIGVLGATVFFQILIVEYLGTFANTTPLSLVQWIFCLGAGYVGLPLAVRLKQIPV

SEQ ID NO: 186693 - protein, 79 aa, Glycine max
  Coding DNA Sequence Number=SeqID_69915
MRGLNQLGAVVETIYEEECEFSSSNSSPSSPSPSFSSSSASLHSRVKAWSLKIGRETDVLIRVQGICFRLHKVSVDSPL

SEQ ID NO: 186694 - protein, 846 aa, Glycine max
  Coding DNA Sequence Number=SeqID_69916
  Gene Ontology: Mol. function=actin binding; Cellular component =phragmoplast; Biological process=actin cytoskeleton organization and biogenesis
  Homolog annotation: Hit_ID=Q1S7L8; Match level="QueryCoverage=92%, HitCoverage=89%, E-value=0.0, Identity=58%"; Hit description=Actin -binding FH2
  Pfam annotation: Domain name=FH2; Domain location=423-821; Score =534.2; E_value=1.3e-157; Accession=PF02181.13; Description=Formin Homology 2 Domain
MASETEQQVGPAWNGKRSETHSITDNLNPELAGAPLFPAVSAPPPVTPPPPPPPDIPSSPDIPFFNEYPAGQPPPVQNLPPAKTSGGVIANPTATQPTKPGKKVAIAISVGIVTLGMFSALGFFLYRHRVRHPAETQKLVSRRVLEDSPRAPPLPPPSSFLYIGTVEPARTSLSEPNRMTVNTSPYRKLDSIKLSSDHRYRPSPELQPLPPPHKPPDESHSPPAEFSDSSSSSEEESCETAFHSPRGSSLGREENFFTPVSRHSCLSAAASVVPYSKRTSPKSRFSAPSPDIRNMVVPSVRPSPAELPAPADSTTFHPVKKEMTLGPSRRPKFSSHPPAPNLTHLHSNESTTSLKPPPPPPPPPPPPLPSRKGWSPSISSSSSSVSRKNRESWSPYEGESSGNSVSVRKGPSSEEVYKRREGDDVDGAKPKLKALHWDKVSATSDRATVWDQLKSSSFQLNEDMMETLFGCKSTGSAFKESVTRRSVLPPVEPENRVLDPKKSQNIAILLRALNVTRDEVCEALLDGNPEGLGTELLETLVKMALTKEEEIKLKNYDGDLSRLGSAERFLKAVLDIPLAFKRIEAMLYRANFETEVNYLRKSFQTLEAASEELKNSRLFLKLLEAVLRTGNRMNVGTNRGGAKSFKLDTLLKLVDIKGTDGKTTLLHFVVQEIIRSEGTGGESADENVQNQSNSQFNEDEFRKKGLQVVAGLSRDLGNVKKAAGMDSDVLSSYVSKLEIGLDKVRLVLQCRKPDMHGNFFNSTALFLKDAEEEIVRIKADERKALFLVKEVTKYFHGDAAKEEAHPFRIFMVVRDFLNSLDQVCKEVGRMQDRTVIGSARSFRIAA

SEQ ID NO: 186695 - protein, 109 aa, Glycine max
  Coding DNA Sequence Number=SeqID_69917
MGGCTIWLKSWASYRMAFIQPRVKHQPLYPLVTRWSDRGLWFSGIPRGDVIGYKSRFNNMHRKEVVEPFVWHQTDKVMLQFGLFQDIPNPPHNLDKVHHTDMRGHRDTN

SEQ ID NO: 186696 - protein, 89 aa, Glycine max
  Coding DNA Sequence Number=SeqID_69918
MEDKYTKVASSQKQSVKVELKKKNYPLTKGKLNTKLEEKRLNVCERREYWSLCGGGCGTQGRGKVVDSTCPLVGMWSDICIVRCHRARV

SEQ ID NO: 186697 - protein, 53 aa, Glycine max
  Coding DNA Sequence Number=SeqID_69919
MQFGISGVELAICAPLMDQMTGEEPTLRLEDEGNWRWWIPNTTRCMDYFLGYL

SEQ ID NO: 186698 - protein, 616 aa, Glycine max
  Coding DNA Sequence Number=SeqID_69920
  Gene Ontology: Mol. function=signal transducer activity; Cellular component=membrane; Biological process=response to light stimulus
  Pfam annotation: Domain name=BTB; Domain location=11-120; Score=7.3; E_value=0.00088; Accession=PF00651.21; Description=BTBPOZ domain
  Pfam annotation: Domain name=NPH3; Domain location=197-450; Score =408.9; E_value=7.2e-120; Accession=PF03000.5; Description=NPH3 family
  Pfam module annotation: Pfam domain module=BTB::NPH3; Domain location= 11-120::197-450
MYLHIFVRYVATELATDIVVNVGNVKFYLHKFPLLSKSAGFQKLITNTNEENNDEVHIHDIPGGPAAFEICVKFCYGMTVTLNAYNVVAARCAAEYLEMYETVEKGNLIYKIEVFLDSSIFRSWKDSIIVLQTTKSLLPWSEELKLVSHGIDSIATKASIDTSKVEWSYTYNRKKLPSENSNDPPFNSVRKQQLVPKDWWVEDLCELQLDLYERVIKTIISKGNVSGTVIGEALNAYASRRMPGFNKGVIQGDIVRNRLLLETIIRILPLDVGSVSFSFLVKLLRVAIQLEREELERSELIRRIGMCLEEAKVSDLLICAPVGDTVFDVDIVQRLVEEFVACDQHVQTDTLLEDDFQEEIRSPGMVSESSKAKVAKLVDGYLAEIARDPNLPFAKFVNLAELVSSFPRASHDGLYRAIDMYLKEHPGISKSEKKRICRLMNCRKLSAEACMHAVQNERLPMRVVVQVLFFEQLRATTSSGGNGTPDHPGSIRALLPGGSHGSSRSTITNTEEEWDAVGTMEDIKSLKGELDALKLSGGTSGASSRSDNNDGGKDNAEKVAASKMKGLMSKKIISKIWSSKERSGELSSSDTSESPASTVVEETKSTPSRSRRHSLS

SEQ ID NO: 186699 - protein, 41 aa, Glycine max
  Coding DNA Sequence Number=SeqID_69921
MASTHPIPTNFVEVHGHVVEDVGEPFGGVVAEDSGVEGRDI

SEQ ID NO: 186700 - protein, 72 aa, Glycine max
  Coding DNA Sequence Number=SeqID_69922
MTLAQTSSVFSYSNLAPTSHTSNLNMDRARLVYDLVTNMDMDIGALISGQISSIAQSNSSRLGFPALITALC

SEQ ID NO: 186701 - protein, 152 aa, Glycine max
  Coding DNA Sequence Number=SeqID_69923
  Pfam annotation: Domain name=zf-CCHC; Domain location=80-97; Score =26.0; E_value=5.1e-05; Accession=PF00098.13; Description=Zinc knuckle
EHEMELQRLNQNEETDKKKRSIALKASSSMQEENEEEESKDEEDFSLFVKKFQKFVKKRRIERLQNFNNGRISQENSQILRCYKCIQLGHIKANCPSNEEWPEKSDKKRYEERRTKKAYIAWDDNDSSDGSEKEINVLTKDYESDENISQED

SEQ ID NO: 186702 - protein, 432 aa, Glycine max
  Coding DNA Sequence Number=SeqID_69924
  Gene Ontology: Mol. function=RNA-directed DNA polymerase activity; Biological process=RNA-dependent DNA replication
MGEIEEVQERMKDDMEAMMSMKKIMEVNAAAVAATSAVARVDPIPPSSLNQINYPTLDMVGQGGQKLGSTGGPHFVQVQNKHAFLPYGLPPNYTPPNVSHTPDENFNNSTPILVEIQQPQFDHAHVSQPMGKTHEIPHHNLADFKPRLGYAIEGQAIGGGPLPNTSEHPPFRPQPQPLHFAVGRVPPAMAGKGKLDHIEERLIAIEGGGDYSFADMEELCLVPYVVIPPKFKVPDFDMYKGTTFPKSHLKLYCRKIGAYAKDEKLLMHFFQESLTGAAVTWYTNLEPSQEYAQRWRELAARVAPSMTEKEMITTIVDTLPVFYYEKMVGYSPSSFANLVFVGKRIEVGLKRGEFDYPALTNKKPGANREDEKEEGTHAVTVALTWPNFPPAQQCHYSANISPSHYPPSNQPQSLPAAHPIPNSTLNTNQNTN

SEQ ID NO: 186703 - protein, 213 aa, Glycine max
  Coding DNA Sequence Number=SeqID_69925
MRAGARVMGEIEEVQERMKGDMEAMMSIKKIMEVNAAAVTATSILARVDPIPPSGLNKINYPTSDMVGQGGKELGSTSVSHFVQVQNKHAFPPYRLPPNYTPPNVVHTPDENVNNSTPILVKSQQPQFDHAHVSQPMGKTHEIPHHNLADFDPRLGYAIEGQAFGGVPLPNTLEDPPFRLQPQPLYFALGRVPPAMAEKGKLDHIEERLRAIE

SEQ ID NO: 186704 - protein, 102 aa, Glycine max
  Coding DNA Sequence Number=SeqID_69926
MTTSCRVIVMKLKGNTKVFMEIDQKLKKLKIKGHPFEPPIVGIRAPRPAGMMKIVVKKRDDIHNIIITRMKVIMSLMSFQRIFDTPKDFRLFLVVGETGRQF

SEQ ID NO: 186705 - protein, 125 aa, Glycine max
  Coding DNA Sequence Number=SeqID_69927
  Gene Ontology: Mol. function=DNA binding; Cellular component=nucleus; Biological process=regulation of transcription
  Homolog annotation: Hit_ID=Q0PJJ6; Match level="QueryCoverage=93%, HitCoverage=56%, E-value=6e-67, Identity=100%"; Hit description=MYB transcription factor MYB181
MDSQTSLRWSKIAKHLPGRTDNEIKNYWRTRIQKHIKQAENFQQQISNNSEINDHQASTSHVSTMAEPMETYSPPFYQGMLEPFSSIQFPTINPDQSSCCTNDNNNSINYWSMEDIWSMQLLNGD

SEQ ID NO: 186706 - protein, 199 aa, Glycine max
  Coding DNA Sequence Number=SeqID_69928
  Gene Ontology: Mol. function=chromatin binding; Cellular component =chromatin; Biological process=chromatin assembly or disassembly
MDHSVTGGSFEGVCLRTKRELGEFSVVDSYNNSFHFTIDMTLDEALYGRRYTRPMCWLEPRENLTLGPEVVEHTMKKSRQKSYQDKRRKNLEFEVGDHVFLRVNPWTGVGLALKCRKLTPRFVNPFRILKRVDPVAYQIALPLSLSNLQNFFHVSQLRKYIHDLSYVIKLYDIQLKENLTYETFPLRIEDRRTKHLRGK

SEQ ID NO: 186707 - protein, 47 aa, Glycine max
  Coding DNA Sequence Number=SeqID_69929
MVQKNSPRRAKLAYANLLLNSEGTDSPRFIHDSVGFEGCLLNPETSE

SEQ ID NO: 186708 - protein, 68 aa, Glycine max
  Coding DNA Sequence Number=SeqID_69930
MGFIYLKSLSTLVPSKDIDDVMPPKSDPRNHDEPPNLLLDKVDMRRRRLISHQGLCSLLQTPTIPTCD

SEQ ID NO: 186709 - protein, 60 aa, Glycine max
  Coding DNA Sequence Number=SeqID_69931
MWNFNFLLKETPSELTECQLDAGVGGHVELHPLVRGATVAIHHAVEVLADADGLGHALRH

SEQ ID NO: 186710 - protein, 74 aa, Glycine max
  Coding DNA Sequence Number=SeqID_69932
GSSLMPSLFLLIGVISQKTCHGKEEGGTSTLGERSTTDSCAMIYFTGEVSAQLVELRSCNWVVAITGWMSNCPG

SEQ ID NO: 186711 - protein, 117 aa, Glycine max
  Coding DNA Sequence Number=SeqID_69933
MEERHGKHEKALSVILSLIATTSLAIMWKVLPEYTIFMASLAKRRKCKENSLFRLFLKNSTLEMLHDNCENTGFLEARLSQTVEHESQREKSHSAKKLTCDEFIPCTPVEPKGSKKA

SEQ ID NO: 186712 - protein, 105 aa, Glycine max
  Coding DNA Sequence Number=SeqID_69934
MENNGGLWWLLVAVDDGERSWNVGNDFGRKKEKKWHFSKATRKAKAETLKCFCLRERKRSSHARRHIEDRNGQVVDICPVNLQTNFKKIQQLAKDGQHFYRDNFM

SEQ ID NO: 186713 - protein, 60 aa, Glycine max
  Coding DNA Sequence Number=SeqID_69935
MVCANEGIVEVPSVDTTNFNKIIVATTMNEAWEILEKCHVGAEKAKKVKLQTKRRCYKLL

SEQ ID NO: 186714 - protein, 79 aa, Glycine max
  Coding DNA Sequence Number=SeqID_69936
  Subcellular localization annotation: CTP_CleavageSite=58; ConfidenceScore=5.60e-01
MTSLTLALTVTHLLCSHSCSHLSLALSFSLSLSRSLCGGTTTPFSLLLSLSSLTLILALGHESEKLGLVLGFDDIQFSF

SEQ ID NO: 186715 - protein, 292 aa, Glycine max
  Coding DNA Sequence Number=SeqID_69937
  Homolog annotation: Hit_ID=Q9FYD9; Match level="QueryCoverage=51%, HitCoverage=22%, E-value=8e-30, Identity=44%"; Hit description =Calcium lipid binding protein-like
MQEALILMDNALMSPHLLAFASPQLCGREPKSLPSPSILALHPHRSSTMLTRTQERGCCLTYDYVTDDATDLLGEKDLDSISALRGLLVSRPADLSFSHKNALHRCVEHAKLWLAQDREHMGFVSSFLGVLGFAVGIPLGLLVGFFLFVYSKTKHVKDPVVRPISELGPNALQELLPEIPLWVKTPDYERVYDDDDDDVTVLLILSLHVIQVDWLNKFLLDMWPFLDTAICKIIRSTTQPIFAEYTGKYQIKAIDFDELSLGTLPPTVCGKIGSFPPKTQKYAHFQMKIEDY

SEQ ID NO: 186716 - protein, 222 aa, Glycine max
  Coding DNA Sequence Number=SeqID_69938
MVEPDSWNPILDRLKVAIAHFVVTQASMATKLDVLLLKMDTLLISQNSPSSSSMKAPPTHAPMWTLPPMSILPPCLTLMQQSPTLAPMPTPPPMSIPIPCPTLMQQSHAPLLALLPMAASHLPDLNQARTPVSFDNLFNVVVHYGHATTPNGKTLEERNMALLDMGAEYYGSAMAARKHQPTTFALWMAAKPGDPRRDRPWDPGGPRRTRNTLRTRRIIERK

SEQ ID NO: 186717 - protein, 249 aa, Glycine max
  Coding DNA Sequence Number=SeqID_69939
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-36, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=15; ConfidenceScore=5.47e-01
MARTCSPLKLRACSPLMARTCSPLKVRACSPLMARTCSPLQERTCSPLMAWTCSPLKVRACSPLVVRTCSPLKLRAWNPLMARTCRFLKARCCKPLMVKTCSRLKVRACNPLMERTCSPLKVRACNPQMARTCSPLKVRACSPLMARTCNSLVARTCSPLMARTCSPLKVRACSPLLARRCSSLMVRACNPLIEKTCSPLKARVCSPLMARTCCPLKVRASSPPMARMCCPLKLTACSPLMGRTCSPLM

SEQ ID NO: 186718 - protein, 97 aa, Glycine max
  Coding DNA Sequence Number=SeqID_69940
MGYVGVRELSWRWATGDGGFMRALWMVKLPAFIVDHRVVPGDMSRGSGDLGDVRRAPGSQQIKGKQDHKARRLVVAGQLLENEVRKLRKPLVIDYQG

SEQ ID NO: 186719 - protein, 131 aa, Glycine max
  Coding DNA Sequence Number=SeqID_69941
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=98%, HitCoverage=13%, E-value=1e-13, Identity=54%"; Hit description=D -galactoside/L-rhamnose binding SUEL lectin; Integrase, catalytic region; ...
  Homolog annotation: Hit description=Galactose-binding like; Peptidase aspartic, catalytic
MGTAFAVKKYSKKGICKCTHGNRDNHVVETCFKLHGYPDWHPKGKTTPSTKVDATSKSHISTAVGFVTKSSIPRRRLAVVEGVKDCIIQKMSHNKPIKEHWLVLRMNTYKLKTKRKYGYGINDWDIPLLVI

SEQ ID NO: 186720 - protein, 346 aa, Glycine max
  Coding DNA Sequence Number=SeqID_69942
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-36, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
SESYTPSPSEGYAPSPKEDYTSSPSEVYTPSPSKGNTPSPSNDCTSSPSEDYTSLPLKDYTSSPLEGYMPSPSESYTSSPLEGYTPSHSEDYTSSSSEGYTPSLSDDYMSSPLEDYTSSPTEGYTPSPSEDYTSSPLEGCTPSPSEDYTFLFLEGLHALAFRGLRAHAFRGLHVLAFKGLHVLTYRGLHALTFRGLHFLTFRGLHSLAFRVLHVFTFKGLHVFTFRGQRVPAFRGLGALAFRGLGALTFRGLHVLAFRGLHALAFRGLHALAFRGLHVLTFRGLRLQRATRPRLQRTTCPHLQRTARPPLQRATCRRLQRATRPRLQRTTRPCLQRATCPRLWRTT

SEQ ID NO: 186721 - protein, 223 aa, Glycine max
  Coding DNA Sequence Number=SeqID_69943
  Homolog annotation: Hit_ID=Q2HRX8; Match level="QueryCoverage=57%, HitCoverage=18%, E-value=4e-12, Identity=36%"; Hit description=IMP dehydrogenase/GMP reductase
  Pfam annotation: Domain name=DUF1723; Domain location=146-195; Score =23.8; E_value=0.00061; Accession=PF08330.1; Description=Protein of unknown function (DUF1723)
MVRTRGFGRALGRAIGKVLGRKDVSDDDAPQRRRPIALARRQRQQQRVVKDPPTAAEELIDEQPEAPTEEVVTNVEGFPSGPHDTSILTDFENNIALRVWNGDECSELKLSSHGRKMAKFERPAPQIEGIVAVSGLSPLIAYSLDTGDWGLMSAFMECRHKETSSFHLPVREMTITLDVVASLLHLPIVRVFHSFKLLHVDDVVEMLVELLEVSAAEVRVETI

SEQ ID NO: 186722 - protein, 300 aa, Glycine max
  Coding DNA Sequence Number=SeqID_69944
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSTPASIPDPSARGAAQVTVAPLSSPASTSPWAASRSWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 186723 - protein, 246 aa, Glycine max
  Coding DNA Sequence Number=SeqID_69945
  Gene Ontology: Mol. function=nucleoside-triphosphatase activity; Cellular component=intracellular; Biological process=regulation of transcription, DNA-dependent
  Homolog annotation: Hit_ID=UPI000068D32C; Match level="QueryCoverage =98%, HitCoverage=56%, E-value=1e-58, Identity=50%"; Hit description =putative sigma-54 dependent transcriptional regulator
  Pfam annotation: Domain name=HTH_8; Domain location=202-242; Score =59.6; E_value=1e-14; Accession=PF02954.9; Description=Bacterial regulatory protein, Fis family
  Pfam annotation: Domain name=Sigma54_activat; Domain location=1-54; Score=-171.1; E_value=0.0031; Accession=PF00158.16; Description =Sigma-54 interaction domain
  Pfam module annotation: Pfam domain module=HTH_8::Sigma54_activat; Domain location=202-242::1-54
MPPLRDRKGDIHLLFRKFAIDFAEKYRMPELVLEPSAVHYIENYSFPGNVRQLRNLVEQMTVVERERNISVEKLAEYIPTESHLPMVVNTPNAQKQSDFGNEREIMYKILFDMRNDINDLRSLTSELIKNRGAGDLSSQEKTLINRLYTSDSQQNTNANSLLYFEDNHPVVQTPTIISTPDDSYEDIQDIEIEENKPESLSLQNNEKDLIIKALEKHKGRRNKAADELGISQRTLYRKIKQYNLED

SEQ ID NO: 186724 - protein, 336 aa, Glycine max
  Coding DNA Sequence Number=SeqID_69946
  Gene Ontology: Mol. function=iron-sulfur cluster binding; Cellular component=cellular_component; Biological process=carbohydrate metabolic process
  Homolog annotation: Hit_ID=UPI0000689E92; Match level="QueryCoverage =99%, HitCoverage=69%, E-value=1e-137, Identity=71%"; Hit description= putative SAM/TRAM family methylase protein
  Pfam annotation: Domain name=Radical_SAM; Domain location=77-264; Score=103.4; E_value=6.8e-28; Accession=PF04055.11; Description =Radical SAM superfamily
MTVGVLGCMAERLKTKFLEEEQLVDLVVGPDAYRDLPNLLKETEDGRDAINVILSKEETYADINPVRLGGNGVTAFVTITRGCDNMCTFCVVPFTRGRERSRDPHSILEECKDLWNSGYKEITLLGQNVDSYLWYGGGPKKDFAKASEMQKATAVDFAQLLGLVAQAVPEMRIRFSTSNPQDMSLDVFRVMAKHENICKYVHLPVQSGSNNMLAAMNRQHTREEYLELIRKAKEIVPDISFSQDMIIGFCNETEEDHQDTLSLMREVEYDYGYMFAYSERPGTPAHKKMEDNIPADVKQRRLAEVIALQGELSKKRMKSYVGRVHQILIERSFQKE

SEQ ID NO: 186725 - protein, 46 aa, Glycine max
  Coding DNA Sequence Number=SeqID_69947
MEAKFKEREAKSAGYGEGDKEVDAVWGQIDSTNFIIVKVEHAMKVR

SEQ ID NO: 186726 - protein, 169 aa, Glycine max
  Coding DNA Sequence Number=SeqID_69948
MAPEDLEQLTQKIRDQLEESITKKMQSQGLALSPEPKVGPSVACVSTKESCDDPSGNDPDTGDSEKYGLYVEENPPSLVALGRLYEGSTTIHNMPLRHYQVKVGVEEVRDVDAPILVPTQEGVVGPDKPADRPDHDVNDPLYLMTLTIPQLFLKPLKVMWDATVFELFK

SEQ ID NO: 186727 - protein, 104 aa, Glycine max
  Coding DNA Sequence Number=SeqID_69949
NKNSVNDTICEKYNISKEKWTQFCQSRRDPSWVDVRKKAHVIRKQNAVPHVLSHGGYEFLEKKLMDEKKKKQLEEANDDSLEDQALQDSFIAHGRQDVLTAAIG

SEQ ID NO: 186728 - protein, 113 aa, Glycine max
  Coding DNA Sequence Number=SeqID_69950
SVGLCHPDIGIAPTRHPVDSEKSNRALGFLVLITGLCTGLGTIVAGGGPVAGSYRRTVVTSKVHLCSPAEYTLRQQSQDLSPYAWPTLEEFEAGLQGPSEMELKLGKTMTWPM

SEQ ID NO: 186729 - protein, 91 aa, Glycine max
  Coding DNA Sequence Number=SeqID_69951
MRHLADQQIANHRGQMQLNDNFYYYTPHQHCQDPNPYPWHTPEQFRATIAWPGDRSIFQEEAGPADAQGDGGIAKEDEDMVDPADYFIGGD

SEQ ID NO: 186730 - protein, 209 aa, Glycine max
  Coding DNA Sequence Number=SeqID_69952
  Gene Ontology: Mol. function=transcription factor activity; Cellular component=nucleus; Biological process=regulation of transcription, DNA-dependent
  Homolog annotation: Hit_ID=Q9FK12; Match level="QueryCoverage=71%, HitCoverage=48%, E-value=1e-31, Identity=48%"; Hit description =Similarity to pathogenesis-related genes transcriptional activator
  Pfam annotation: Domain name=AP2; Domain location=100-164; Score =132.9; E_value=8.8e-37; Accession=PF00847.10; Description=AP2 domain
MEQQNSILCKYTEHQTVMKKHMKSKDNTFCSPKVISISLIDPYATDSSSDEENVMRRRRVKRYVNRIELQPAFKPVTTRKRHAGDAATLRKPPAKVTNSCRKFRGVRQRPWGKWAAEIRDPVQRVRIWLGTFKTAEEAALCYDNAAITLRGPDALTNFGRSRPEETPEKEEMVEKEEFTSGKPEMKVVVKPETQVSVSVSGCYDSGDEC

SEQ ID NO: 186731 - protein, 78 aa, Glycine max
  Coding DNA Sequence Number=SeqID_69953
LGGIDGDPVLRGTRMRATWEYVSSVEGGQLGMSGTWRYVAGVKRPWGRQASSWQSTDKRTKTTKQGGLCGGWPAMDFE

SEQ ID NO: 186732 - protein, 125 aa, Glycine max
  Coding DNA Sequence Number=SeqID_69954
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=97%, HitCoverage=5%, E-value=6e-43, Identity=62%"; Hit description=RNase H, putative
MGPHQEETELVDLGTGSGKREVKIGTGMTAPIREELTALLRDYQDIFAWSYQDMPGLSSDIVQHRLPLNPECSLVKQKLRRMKPETSLKIREEVKKQFDAGFLAVTRYPEWVANIVPVPKKDGKV

SEQ ID NO: 186733 - protein, 193 aa, Glycine max
  Coding DNA Sequence Number=SeqID_69955
MSCPAIITPTSLCQSVSWCMPPTRHPLDPDKFNRALGFPALITGLCQSFGVPITPSKVIRPPITRAFIEKYCTPRQAQSDALQAADAPPPPHQADPAGSFGTERYLQHLVRQQAANHRGQVQIHECLYQLSLSQQSQGFAPFACPTLDQFRAEVAWPRDWPEAPAEAPGDAEEARMDEEMTNLLGFLGGSGAT

SEQ ID NO: 186734 - protein, 131 aa, Glycine max
  Coding DNA Sequence Number=SeqID_69956
  Subcellular localization annotation: CTP_CleavageSite=32; ConfidenceScore=5.20e-01
MNPYGSCIYSFFSFRRSYGNSRIVRQHLLLVSASLRNFTDRVNLLPFDFRRVSGLTYRATKGAKYFEAANQRLHIIKGYIYLGIVILRTREGTSLVDQFKWRVHPLGFSKRTREGTSLERNLKNHRRAAMA

SEQ ID NO: 186735 - protein, 293 aa, Glycine max
  Coding DNA Sequence Number=SeqID_69957
LAKRAYRAKRVHPLRMNTHPLAELLVAKQAKRASLAKLPTLSEIFEELVLLSAAFKELSTNPCGTCQLSGPCLAKRPMPSKKRKSVELDEFKVELERRNYHKRLTNLADSSIDLALVKEFYANLYSPEGLSPKQVRIRGHLIKIDADSLNAFLETHVVLAEGESLPAYSRYCRMPTNIREIEDALCIPGRGFILNAEGHPGKILRKDLTTLAQVWSVLSYSNLAPTSHTSDLTVDRARLIFGLVTQLDMNVRALISGQITSMAQSNSSRLGFPALITTLCRSRGVASDSLVFE

SEQ ID NO: 186736 - protein, 58 aa, Glycine max
  Coding DNA Sequence Number=SeqID_69958
AELERKTNDQSEQRAIARANLGVEESNFDSDLIWARLDERKEFSAFALFCLAVIACAV

SEQ ID NO: 186737 - protein, 262 aa, Glycine max
  Coding DNA Sequence Number=SeqID_69959
  Gene Ontology: Mol. function=2 iron, 2 sulfur cluster binding
  Homolog annotation: Hit_ID=Q5PM67; Match level="QueryCoverage=99%, HitCoverage=100%, E-value=5e-95, Identity=63%"; Hit description =Ferric iron reductase protein
  Pfam annotation: Domain name=FhuF; Domain location=16-262; Score =397.5; E_value=2e-116; Accession=PF06276.2; Description=Ferric iron reductase protein FhuF
MAYRTFSFSNDIIWRAPLAPVEHALANAVREKIAAVRPHLLDFLRLDEEAPPFALTLAEWSRPTSLSSLLSTYSDHIYRHQPSQPREQKPLLSLWAQWYIGLLVPPLMLALLTEEQAISLEPEHFRVEFHESGRAACFWIDVHADHDALMLPAQARMDMLVNKALKPVVEALEATGDINGKLIWSNTGYLINWYLGEMKNLLGDEQVNALRQHCFFAKQQASGEDNPLWRTVVLREGLLVRRTCCQRYRLPDVQQCGDCTLK

SEQ ID NO: 186738 - protein, 78 aa, Glycine max
  Coding DNA Sequence Number=SeqID_69960
MGLRIRFDGGGCTNSARKSIRGVPDSMAINLWGSGLDGGGCMNGNQFMGLQIRFDGGGCTNNVRQSIRGAPDSMVEDA

SEQ ID NO: 186739 - protein, 231 aa, Glycine max
  Coding DNA Sequence Number=SeqID_69961
MGKNQAYKAMQRARLGGASAGPDEVEDGMVDGSFHSPEWHAARLASLNTSHTITWEEYKMKQKEEELRKGELEADADRMMREYRAQLDAERARKLSQGRNHSNSKSKHVKGMSGKVAKTWFVLLALFLIPASNETAYSNLQIRGTKFQRSTAAERESIQEDLLHLAPLRHPQTLPVAMKKKEGQEDPSPGPRDQRRKRSPSQEARMLEALVKTRVQFAFQDSLGTSRVNSA

SEQ ID NO: 186740 - protein, 421 aa, Glycine max
  Coding DNA Sequence Number=SeqID_69962
  Gene Ontology: Mol. function=protein serine/threonine kinase activity; Cellular component=nucleus; Biological process=protein amino acid phosphorylation
  Homolog annotation: Hit_ID=Q07176; Match level="QueryCoverage=99%, HitCoverage=100%, E-value=0.0, Identity=88%"; Hit description =Mitogen-activated protein kinase homolog MMK1
  Pfam annotation: Domain name=Pkinase; Domain location=58-374; Score =301.9; E_value=1.2e-87; Accession=PF00069.15; Description=Protein kinase domain
  Pfam annotation: Domain name=Pkinase_Tyr; Domain location=55-374; Score=-1.3; E_value=2.2e-12; Accession=PF07714.7; Description =Protein tyrosine kinase
  Pfam module annotation: Pfam domain module=Pkinase::Pkinase_Tyr; Domain location=58-374::55-374
MEGGGAAPPADTVMSDAAPPPQQAMAMGIENIPATLSHGGRFIQYNIFGNIFEVTAKYKPPIMPIGKGAYGIVCSALNSETNEHVAIKKIANAFDNKIDAKRTLREIKLLRHMDHENVNPLILCVKASNSMAICDNKLQSKVPSCRMVVAIRDIVPPPQREIFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCMTPFNFDFEQHALTEEQMKELIYREALAFNPEYQQ

SEQ ID NO: 186741 - protein, 457 aa, Glycine max
  Coding DNA Sequence Number=SeqID_69963
  Gene Ontology: Cellular component=integral to membrane
  Homolog annotation: Hit_ID=Q4BS12; Match level="QueryCoverage=40%, HitCoverage=52%, E-value=9e-86, Identity=82%"; Hit description=Dyp -type peroxidase
  Pfam annotation: Domain name=Dyp_perox; Domain location=1-189; Score =169.6; E_value=7.7e-48; Accession=PF04261.3; Description=Dyp-type peroxidase family
  Pfam annotation: Domain name=UPF0187; Domain location=228-457; Score =204.8; E_value=2.1e-58; Accession=PF05249.2; Description =Uncharacterised protein family (UPF0187)
  Pfam module annotation: Pfam domain module=Dyp_perox::UPF0187; Domain location=1-189::228-457
MGLSFELATQLMDKLGDAVTVVDEVHGFRYFDRRAMIGFVDGSENPQGRAAADFTIIGDEDPDFAGGSYVIVQKYLHDMAGWNALTVEQQERIIGRKKMTNIELDADVKPSCSHSSLTTLEENGEEIKILRDNMPFGKPGMGEFGTYFIGYARSPAPIEQMLENMFVGRPAGNYDRLLDYSRPEGGDAGNPQELTPVVTGVSEDKFVRNEFERSSLRPIIGSSGSNTMIIRPEQHWFFRLFDWHGSVLSKIVFRLLLNVLMSVIAIISYQWYEQLGIHLTVAPFSLLGIAIAIFLGFRNSASYSRFVEARNLWGTVLIAERTLVRQLKNILPAEEETHKTLVSYLVAFSWSLKHQLRKTDPAVDLYRLLPKEKVAEILASSMPTNRILLLIGNELGKLREQGKLSDITYGLMDNKLDELAHVLGGCERLASTPVPFAYTLILQRTVYLFCALLPFAL

SEQ ID NO: 186742 - protein, 87 aa, Glycine max
  Coding DNA Sequence Number=SeqID_69964
MAPKKLSAKRSRRDVAAEGTNAAPEFNSHRFRSVEHQQRFEAIKGWSFHRERRIQLKDDENANFQEEIFHRRWTSLVTPMAKFDPDI

SEQ ID NO: 186743 - protein, 38 aa, Glycine max
  Coding DNA Sequence Number=SeqID_69965
MEETSQPAKFNEPFENKGLNKDAEYTKAFVRAWISSQR

SEQ ID NO: 186744 - protein, 308 aa, Glycine max
  Coding DNA Sequence Number=SeqID_69966
  Gene Ontology: Mol. function=RNA-directed DNA polymerase activity; Cellular component=chromatin; Biological process=chromatin assembly or disassembly
MPLPTYLNKLKDLYQKVTHLETSSHSLTSSTTNHNPLHPPPSFLHMKLEVSPFEGSDPFCWIFKINQFFAYHDTPKPDSLTIASFYMGGLTFAWFQWMSQNDQLSSWTSSPLPRASPLPLARSLLLTPPKPSSIPFKQLSLEELALHREKGLCFNCDKKFSRSQKCASRLFLLIAKDDENSPQDLLRSTKVCDEGQGIESFPAQISLHTLSGHMAPKTLRLLGHLNGQPVWILIDVGSTHNFIQERLVLALGLPTQPTQPLRVMVGNGHELECHQWCRGINFQVQDQQFLVNFHVFPLCGANLVLGVE

SEQ ID NO: 186745 - protein, 149 aa, Glycine max
  Coding DNA Sequence Number=SeqID_69967
  Gene Ontology: Mol. function=RNA-directed DNA polymerase activity; Cellular component=chromatin; Biological process=RNA-dependent DNA replication
  Homolog annotation: Hit_ID=Q8H7X6; Match level="QueryCoverage=57%, HitCoverage=11%, E-value=9e-19, Identity=63%"; Hit description =Putative retroelement
MEAILKKTMAMEGIRIEADWRWRRCAMDRVNVELAQIGPKSVIHCNLERGEPILDGDGVKNSIIDTETPRPITLLHQQDQRGERTRAWSDDSILQHRIHLEFNFLMEVMMLETETNGGIAELGSLFRVLDVATWKFGLKGAQCGDERTR

SEQ ID NO: 186746 - protein, 101 aa, Glycine max
  Coding DNA Sequence Number=SeqID_69968
MGMTTYTDTGMETKNSKSKNLNIQVRLENVNSIGSLQARETMDKAFLFSFLLLGVIKVWDLLMIKRMTEESKEPVEEREIVPIWFSGSLVMVVQPRLEKTK

SEQ ID NO: 186747 - protein, 335 aa, Glycine max
  Coding DNA Sequence Number=SeqID_69969
MDPPSKKSLDSRKTTTLTTFPMNFSKDLQEDIFSASRMTIEEQSTECVQNVRPDLESNLSPLISQATMDEMYVFFNNYSVPMSVYDDLMARLCNDNDILQLGENSFNEQIPLDDISLEVLKAVEGLTNDTNSTTLLTSNSLEEVEISIPPAAGVVVSEAFTPFQSPSFPLHPNGYASAGASPSVGVSALVAASAGANASVGGIACASVNTNASVSTTVRLATFDPQHPPQIGTSFGNFVFPNTMGNPFTQFQSCSSSASFPMLPYDSSSSSSSYQQSPRYLPFLMTGIGPQGIPATMPQFNQGNFWLRPPPLTDFPNFVHAWEVYSMLKHTKKQR

SEQ ID NO: 186748 - protein, 65 aa, Glycine max
  Coding DNA Sequence Number=SeqID_69970
MKFLDKCLGHPLPHREKAHCLNAWSNGVGASSFGFPNTLGNSLNQFQSLPMHPYDSTSDGVGLSA

SEQ ID NO: 186749 - protein, 50 aa, Glycine max
  Coding DNA Sequence Number=SeqID_69971
MNHFVLGAKYDKTGVLLGAPAELLTSGGMAMASLIGNGGKVFATCDDVLQ

SEQ ID NO: 186750 - protein, 69 aa, Glycine max
  Coding DNA Sequence Number=SeqID_69972
MDHANEEVHELPEEVACVDVPTNVEGFLVGPLSKKRRQKLLMTRLARQIRSARCIHLARHPARLADRKP

SEQ ID NO: 186751 - protein, 94 aa, Glycine max
  Coding DNA Sequence Number=SeqID_69973
TSFGYRKDRNGQWLKKDALPPQDERTPSPPPQRDDSALMNEVLSELRGLRSYVGERFDSLDTRFVSMDIRLTQLEEDVGYIRQSFDLPPPPPPS

SEQ ID NO: 186752 - protein, 54 aa, Glycine max
  Coding DNA Sequence Number=SeqID_69974
MMFYGMNVNVWEGMVFIGVNAAIRIGYLGDLFKGYQGSIHTKINPTSQVQSKKL

SEQ ID NO: 186753 - protein, 111 aa, Glycine max
  Coding DNA Sequence Number=SeqID_69975
MDSSEGSKIVSGKAKSKDDIIPDSDVALCGACRPWIFFINEVLCFLNFDGSGIEKEEYDWRCHFKKKMSLEEAHHHRRSWIRAWRKKEMNEGRGREEHKFLCSKGALKSEV

SEQ ID NO: 186754 - protein, 223 aa, Glycine max
  Coding DNA Sequence Number=SeqID_69976
  Gene Ontology: Mol. function=DNA binding; Biological process=DNA integration
  Homolog annotation: Hit_ID=Q1RVN6; Match level="QueryCoverage=51%, HitCoverage=18%, E-value=1e-12, Identity=34%"; Hit description =Integrase, catalytic region
MTSKCKDLPRKEISNAFFTNKKRSKRIWVSKNKIIPIADVLDNEKDTPIMVLGQWLLMTHDRKKGLKHNFLNISQLCGNGCDVSFNKDECIVQNKDVSLLFFVKRKGNLYKIRLGELSNQNVSCLLPVKENHWSDSGTLLGYSETYKVYIVYNSKTFMVEEAIHVKFNDIEPDKDLLELDEFLAKLRLEEGISSKALVNTNTKVATSTQPLDSPQEEVREPTR

SEQ ID NO: 186755 - protein, 170 aa, Glycine max
  Coding DNA Sequence Number=SeqID_69977
MADNNNNSQFIIEGTSLTRPPGFTGEDYPYWKDKMEIPKVEWTDVDLTTMELNIKAIYTLTCCGINCPVAEAEVGQVTIDSWCLNRDHLQKKDVDDVKSREINFRREEKKSFSKSLKVQMVESNESDNSKGSTDDEVTFMSRKFKQMIKKKGNFHHSSKRKDTRFKRKYC

SEQ ID NO: 186756 - protein, 465 aa, Glycine max
  Coding DNA Sequence Number=SeqID_69978
  Homolog annotation: Hit_ID=Q69KN1; Match level="QueryCoverage=37%, HitCoverage=19%, E-value=5e-08, Identity=26%"; Hit description =Putative SMA-9 class B
MDSSSKTSLESSKTTTQATFPITFPIDLQGDLFSDLFPTSSMIIRDQIMEDVQNVRPDSQSILFPVIRQQAATNEMEAYDDFMTKLCNDIDNDILQMGEDNFKDLLSDEPIPLDGDISLDVLKAMEAGLGQELANTDTTGNSLNQFQSPVIPVHPYYGGASASSGAGVDANAFVAASAGGINASFGVGVNASGGNTSVRLATNPQNPLPVGATFGNFMFPNTTGNTLTHFQSCSSPPSFPVLPHASSSSSSHQQFPRFQSCSSPPSFPVLPHASSSSSSHQQFPRYLPQQMTGINPQGILASMPQYNQGHFWLRPPSLTDFPNFVHAWEGSLVGKIHSYCEFLNQARVVRKPTSPVMTHVKKTNHPKQSKRRKLTAEWSERLKIVLFIPTNAINYTMKIIGGPIDYVFFHIIQFNNLNLYDYMMSKNLCAKIELPSQTLILSITQSKYHYLGAIFPEDTIFVEPA

SEQ ID NO: 186757 - protein, 52 aa, Glycine max
  Coding DNA Sequence Number=SeqID_69979
MEPKNEIVAIPAINNKEDAARIKQVNNTRELLTQFGATSPTSGGYQAREEIH

SEQ ID NO: 186758 - protein, 78 aa, Glycine max
  Coding DNA Sequence Number=SeqID_69980
MTFYMRGILYVRMRMVLLMTIVVTINMSVTIIVVIDVDDDNSDNHISGDNADDDDNHNGGVSNGDNHVGGCGNDFDIN

SEQ ID NO: 186759 - protein, 336 aa, Glycine max
  Coding DNA Sequence Number=SeqID_69981
MDSPSKRSLESSKIMTETTFPIPFPIDFQEDLISGSSMIVEEQTMEGIQNVRPEAESSLYPLIPQATMNEIYVPSPTNSEPKNIYDDLMARLCNDDDILKLEENNEQIPLDDISLEVLKAVEGLAHSVTNDRNSTTLLTSNSLEEVNISIPPAAGVVVSEAFTQFQSPSFPVHPYGCTSVGASASVGGIGCTSTVNASVVAGASTTVRLATTDPQDPPQIGTSTVNASVVAGASTTVRLATTDPQDPPQIGTSFGNSVFPNTTGNPLTQFQSCSSKSSFPMLPYDSSSNSSYQQFPRYIPYLMTGIGPQGIPAMMPQHNQGKFWLRPPPLSDFPNF

SEQ ID NO: 186760 - protein, 43 aa, Glycine max
  Coding DNA Sequence Number=SeqID_69982
MNHRSEPEKKVRVGAYNHLCLLLNGGLGWRLSSSYPQMQLTIQ

SEQ ID NO: 186761 - protein, 299 aa, Glycine max
  Coding DNA Sequence Number=SeqID_69983
MNDLQEDLFPDLFSASSMTFEEQTTEQGRMQESEITLSPLIPPTTRCEMYDPSPSYYLPTNDYEDFMAKLFNENEFFQLRENIFKYPLQPYEPVPLDDIPLEVVKSVEGLSGFGASASVGVGDTARASVGVDDTASASVGVGDTASACVGASVGYNASAGGIAFANFNADIDSSVVFGANASSSTTLTVATIDPQVAGPSSFGNHSMFNNTMHNPLTQFESCSSPSSFSGLTHHASSSSSSHQQLQRYLPNQMNGINAQGIPAMTPQHISSNSNNQGLFWLRPPPLVDFPYFVPAWEVN

SEQ ID NO: 186762 - protein, 120 aa, Glycine max
  Coding DNA Sequence Number=SeqID_69984
  Homolog annotation: Hit_ID=Q1T344; Match level="QueryCoverage=75%, HitCoverage=30%, E-value=7e-07, Identity=31%"; Hit description=RNA polymerase, RBP11-like
MKKECGVNEPHVDCSDAFNTSLARSVAHENGFVAVIIRSDTNTSSRGRTSFVLIGCERSGEYRCRKKEFIRRDTGTRKYGCPFELRGKPVVGGQGWMVKLMCEIHNHELAKSLVGHPYVG

SEQ ID NO: 186763 - protein, 97 aa, Glycine max
  Coding DNA Sequence Number=SeqID_69985
MDWQWLKKDAQPPQDKHIPSPSPQRDDSSALMHEVLSELRGLRTYVGECFDSLDGRIDAIDARFEGMDTRITQLEEDELNCHHQKGGDCRSKGILMF

SEQ ID NO: 186764 - protein, 146 aa, Glycine max
  Coding DNA Sequence Number=SeqID_69986
LGWRLTKGVEDDVSLCMLSCSGSHGLQKNVYRDNHLGISACAQLHGLVMTEFDYAEEDVHLRITTWVFPPATYLHGFVMIEIDCVEDVVNFRVSMGSDRDWQRVQKTTLVSTCYRALEIDSAEDDVNLRMSTGSLAAIDKWCRRRH

SEQ ID NO: 186765 - protein, 184 aa, Glycine max
  Coding DNA Sequence Number=SeqID_69987
  Homolog annotation: Hit_ID=Q6CQF2; Match level="QueryCoverage=40%, HitCoverage=92%, E-value=1e-18, Identity=64%"; Hit description =Kluyveromyces lactis strain NRRL Y-1140 chromosome D of strain NRRL Y- 1140 of Kluyveromyces lactis
MSTTGRGRHSVLRIFKGRRGRTGHHATCGALPAAGPYLRLSRFQATAAPSYSSGLGPCPDGRSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQVPRHAKGARCHPQSR

SEQ ID NO: 186766 - protein, 105 aa, Glycine max
  Coding DNA Sequence Number=SeqID_69988
  Homolog annotation: Hit_ID=Q09JM0; Match level="QueryCoverage=47%, HitCoverage=91%, E-value=6e-07, Identity=58%"; Hit description=10 kDa putative secreted protein
MNRKAGLRCQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 186767 - protein, 93 aa, Glycine max
  Coding DNA Sequence Number=SeqID_69989
MHYEAEALEHMKKRHIGHQSVSLENKTGDSTVLKIGDSAKVVIKQDMKGGEHKYGFNNNKREKPEKVRLVDDETGDKHELYEVLRMPSSTKNQ

SEQ ID NO: 186768 - protein, 82 aa, Glycine max
  Coding DNA Sequence Number=SeqID_69990
MLKSIAAWMPRAHASYSAMLLVQSDPSLAVKGVDGDPMLRGTRIRATWGYVSSVEGGQLGMVGSCLICGCGRVYLHHRPIAT

SEQ ID NO: 186769 - protein, 163 aa, Glycine max
  Coding DNA Sequence Number=SeqID_69991
MTSPHTIKLDHFWDFDSLWIGRVWATICCLRVSSDLLSLDDEGADNHEVSLHAIGPSSHNSRVVCTDNHKVSPYAIGPSSDHSRIVCTDNHKVSPYDIRPSSHDSRFVCMNNHKVSPYATRPSSHDSKGESFLRSRLEDADISGKGADDHIGICVSTGSLASS

SEQ ID NO: 186770 - protein, 132 aa, Glycine max
  Coding DNA Sequence Number=SeqID_69992
  Homolog annotation: Hit_ID=Q3BPL7; Match level="QueryCoverage=94%, HitCoverage=55%, E-value=6e-18, Identity=37%"; Hit description =Putative secreted protein precursor
MIPCLALLLLTACNPETAMNQERAAAEADVAQGGRGLAKLNPSPRKAYELVLRLKDAPGDFAVVEGVAQYDVTNEDQCGHIEPATGTAARITSQEPVELRKVADGEYRGTLYVDRMLDEDYYGRGVCKWEFT

SEQ ID NO: 186771 - protein, 223 aa, Glycine max
  Coding DNA Sequence Number=SeqID_69993
  Homolog annotation: Hit_ID=Q3BPL7; Match level="QueryCoverage=75%, HitCoverage=79%, E-value=1e-29, Identity=38%"; Hit description =Putative secreted protein precursor
MQDAAMDVAMPTRKGRHLVPMGLLLALTACSPYADAERDVAAGGRGLAKLNPSPQQGYELVLTLKDAPGPFAIVEGSAQYDASNYADCGRIVPATGTAGRITSQEPVSLHKVGEHEYRGTFYLDRMLDEDYYGRGVCHWSLTGVGAMLRATNGKADTRFLTFIDKKRMDAGSQLTRYYPRADYPRIEEITGYGASGKEDPSAYKEELRNALFSTTTTVQKLVP

SEQ ID NO: 186772 - protein, 125 aa, Glycine max
  Coding DNA Sequence Number=SeqID_69994
MDGILISSVVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 186773 - protein, 108 aa, Glycine max
  Coding DNA Sequence Number=SeqID_69995
MVGYASSSFADLVFTGERIEVGMKRGKFDHLAWTNEKTGANEEGENEGETHAATAVPSWKILHQLNNVITQPILALLITHHPVIHKSHPQISHKACLLTTRPMPKHYL

SEQ ID NO: 186774 - protein, 107 aa, Glycine max
  Coding DNA Sequence Number=SeqID_69996
MEDEYSEATILEPFTAEEEVGDTKTTQVAAAIPERSLEAISLPPAPAVDPSSPQHTTNPSTLVLEILKGQTTPVLTLDTSSPATPMLHLTDEEDVQTQDTQDQSQEF

SEQ ID NO: 186775 - protein, 149 aa, Glycine max
  Coding DNA Sequence Number=SeqID_69997
  Pfam annotation: Domain name=zf-CCHC; Domain location=77-94; Score =31.1; E_value=3.8e-06; Accession=PF00098.13; Description=Zinc knuckle
MELQRLDQNEETDQKKRSIALKASSSIQEKNEEEDSDDEEDFSLFVKKFQKFVKRRRRERRQNFNNGRRSQEDSQVLRCYKCNQLGHIKANCPSNEEWPEKSDKKRYDERRTKKAYIAWDDNDSSDGSEKEINLLTKDYESDEKISQEG

SEQ ID NO: 186776 - protein, 90 aa, Glycine max
  Coding DNA Sequence Number=SeqID_69998
MFLGGGDNNGDGDDFSSNDDDRYINGDRNDNGCGNGGGSDNVATTMVVVEMLVVLEAMTMVWWCNNASSDGIVSDGFKFIKTWRLRAHFG

SEQ ID NO: 186777 - protein, 409 aa, Glycine max
  Coding DNA Sequence Number=SeqID_69999
  Gene Ontology: Mol. function=N-acetyltransferase activity; Biological process=metabolic process
  Homolog annotation: Hit_ID=Q42381; Match level="QueryCoverage=96%, HitCoverage=99%, E-value=1e-163, Identity=68%"; Hit description =Putative N-acetyltransferase hookless1
  Pfam annotation: Domain name=Acetyltransf_1; Domain location=64-167; Score=60.5; E_value=5.6e-15; Accession=PF00583.14; Description =Acetyltransferase (GNAT) family
MGESEFVPSVAVSVREFDPTKDIEKVEAVERICEVGPSGKLSLFTDLHGDPICRVRNSPTFLMLIAEIGQETVGMIRGCIKTVTCGKKLHRQGKNNTEPKQVPIYTKLAYILGLRVSPHHRRMGIGMKLVKKMEEWFRDNGAEYAYMATEKDNVASVKLFTDKCGYSKFRTPCILANPVFSHPARISHKVTIIELSPSDAEILYRSKFSTTEFFPRDVDSVLRNKLSLGTFLAVPKGLYRADTWPGSTRFLEGPPPCSWALVSVWNCKDVFTLEVKGASRVKKTLAKTTRVLDRAFPWLRLPSVPNFFEPFGFHFLYGLGGEGPQAQKMIRALCGFAHNLARDRGCEVVATEVSSQEPLRCAIPHWKMLSCEEDLWCIKRLGEDYSDGSLGDWTKSPPGFSIFVDPREV

SEQ ID NO: 186778 - protein, 193 aa, Glycine max
  Coding DNA Sequence Number=SeqID_70000
MVAASVVTKGDINGDSVVGGDNKGGNVTNDDGNSDVGGDGDGSGADNDNSSDRNVGGDGGCINGGGDNNDSGVIVVVVMVTISGGSGSGCRDISGGYGEDDRRGIVGSGDGGGDNDTDNNIDVMIITLVIVVTPSDGDNNDDDGGNELVTTNYNSDSDTGVVVTMTTMILAMVIMTMVVMIITMMIVKSVIVR

SEQ ID NO: 186779 - protein, 191 aa, Glycine max
  Coding DNA Sequence Number=SeqID_70001
  Gene Ontology: Mol. function=nucleic acid binding; Cellular component= nucleus; Biological process=DNA integration
  Homolog annotation: Hit_ID=Q1S1X7; Match level="QueryCoverage=99%, HitCoverage=17%, E-value=2e-47, Identity=53%"; Hit description =Integrase, catalytic region; Zinc finger, CCHC-type; Peptidase aspartic, catalytic
MEVEKLDVKTTFLHGKLEEEIMMIQPEGFEVQGKEDSIFRLKKSLYGLKQSLRQCKVEDGSNIYLLLHMDDMLIASRDKSEIQKLKSLLNSEFEIKHMGAARKILGMEIRRDHAQNKLFLCQKKYIQKVLNHFGMATTKSMCTPSITSIHLFELNATQSKSKKEYMSYVPYANVWHGMHKARSSTSSQCSE

SEQ ID NO: 186780 - protein, 202 aa, Glycine max
  Coding DNA Sequence Number=SeqID_70002
  Gene Ontology: Mol. function=nucleic acid binding; Cellular component= nucleus; Biological process=DNA integration
  Homolog annotation: Hit_ID=Q1S1X7; Match level="QueryCoverage=88%, HitCoverage=15%, E-value=3e-37, Identity=40%"; Hit description =Integrase, catalytic region; Zinc finger, CCHC-type; Peptidase aspartic, catalytic
MKPLPWIIGDQCYKRIEKEERSWFVTYEAKSSGNDMMGNNAPSKTVGIAYIQIKMHDGIVRTLTNVYHVPELKWEPCIQKGTKQGNLYILQGSTMIGSILIVSQVGSHASNDNSLWHMHLGQKSEREMEILSKQGLLGNHKVEHLQFSKHCIYGKQYKMKFLKVVLITKATLDYVHSDCWGSSRVPFLGGARYLLSIIDDYS

SEQ ID NO: 186781 - protein, 94 aa, Glycine max
  Coding DNA Sequence Number=SeqID_70003
  Subcellular localization annotation: CTP_CleavageSite=70; ConfidenceScore=5.03e-01
MESFEQKRCLDDTAWIVQSSSLLYGPLMSIWWNSSSRATGRTPNPLSYLLDGLGSSSSMDSFASWKMNGSGMEKEEREEMPLQGEDESRRSSPP

SEQ ID NO: 186782 - protein, 1003 aa, Glycine max
  Coding DNA Sequence Number=SeqID_70004
  Gene Ontology: Mol. function=RNA-directed DNA polymerase activity; Cellular component=chromatin; Biological process=chromatin assembly or disassembly
  Pfam annotation: Domain name=rve; Domain location=780-902; Score =19.1; E_value=0.00015; Accession=PF00665.16; Description=Integrase core domain
  Pfam module annotation: Pfam domain module=RVT_1::rve; Domain location=363-610::780-902
MADATRNRVLEREIEDRVENRLSSKIDERFMEMVASMQQTLHDSLTQSFALSISQQMQNLLHNNTRIDFPCFFGNDVKQWLIQCDTFFSIDNTPEEFKNLPPWSEYTRILIERFGEVCDDPMAELMQLRQKGLIVEYHEAFDAIASSKPPLLPTPPKTISKTQDIPKRKQQASKTLTPAYMSDRRAKGLCYFCDEPFTPEHGLSHKTLQLHVMEVDELQEGAEEEVSLENSTGSSSIDPQIFVHALMGIANFHTMRVTGYHQKKPLHVLIDNGSTHNFLDIEVAKRLGCKSNAFDSLSMVVADGTQLNVFVVVRGFQWGIQQTKFTSDMLLIPLGCCDLVLGVEWLVFLGDIVWNFNKLQMEFYVKGRRHVLRGASTGLKTVKRQQLGKAMSTGVHLSILQVCDGQRGFLNSFTTQAVDKEVPPTLAKLLDEFSDLFQEPSGLPPRRPGHDHRIPLVQGVGPISKRPYSSPLASPVVLVGKKDESWRLCSSIFSKIDLRSRYNQVRMDPADVYKTAFKTHAGHFEYLVMPFGLTNAPATFEGLMNLVFKEFLRKFMLVFFDDILVYRCSLEDHLLHLHKVLATMRANSLFAKRSKCYFGVSKVEYLGHFISKEGVSTDPAKGYGGIAKPLTNMLKKYNFIWSDAAKLAFQQLKKKLTETPVLALPDCSKTFVVEGHDNVAADALSRVEPVACQALAVHQVVSELVIKIKASWDSDPAIQRLISELQANSGSHKHYSWKDGELMKKGRLVVGRDDALRQDILLHFHASAAAGHSGRNATLQRLKSVVYWKGMSKDVIFVVVDRLSKAAHFMALSHPYSAADVAQSFLDHDLMAFQGVQVQLFTAYHPQTDGQTKIVNKCLETYLRCMCADSPSQWSKWLPLAEWWYNTTFNSSIRATPYEVLYGQPPLVNLPYLAGASKIELVDRSLLSREEMLKLIKFHMMEDKHRSERQFSVSDMVLEQIGADAILPRKGPVARAMSKRLQEDWAGAAEEGPRVLMNLWVDF

SEQ ID NO: 186783 - protein, 114 aa, Glycine max
  Coding DNA Sequence Number=SeqID_70005
  Gene Ontology: Mol. function=binding
MFYNKAVARAKTMDMGNVHMLGDALRACEDRNLLRLRKPKCNIVDVFVRGGRHFGHCKLETMVLLRWGKRFKHSHHKVCSNTNKALDSFMKVIESGFALNMVDAGLIYWKMERR

SEQ ID NO: 186784 - protein, 107 aa, Glycine max
  Coding DNA Sequence Number=SeqID_70006
MALTIFFGLTDFYRHFVRNYASLTSPIIDLLKIDNFTRSLQVGTMIMTRTNVIVHALQLSKALKAHYEYDESTTVIIIDGVEVLGCYGLTTALLVTTIILVDHGPLG

SEQ ID NO: 186785 - protein, 121 aa, Glycine max
  Coding DNA Sequence Number=SeqID_70007
  Gene Ontology: Mol. function=monooxygenase activity; Cellular component=integral to membrane; Biological process=electron transport
  Homolog annotation: Hit_ID=Q1T381; Match level="QueryCoverage=70%, HitCoverage=68%, E-value=7e-23, Identity=63%"; Hit description=E -class P450, group I
MALHLPSFMKQLGQLPVWVVSSANLAREVMQTHDPVLASRPHLPATEILLYECKDVGHSSNGETWREKRKLCVNELLSMKRVRSVQFIREEEVEALVSYIRKACSVINLSEMLVTASRTSC

SEQ ID NO: 186786 - protein, 81 aa, Glycine max
  Coding DNA Sequence Number=SeqID_70008
MVEYSKVLIAEQYRVGSETYYAPCLGSFFLSPIMGDEMPLELVVLDLARRFLFSIFVELLQGCREKDGSGGGLLLLTRLEA

SEQ ID NO: 186787 - protein, 72 aa, Glycine max
  Coding DNA Sequence Number=SeqID_70009
MENILSHDKDDNYIDDDESDADFLMPTFLDLEKVYGSGESDMGCALLVSSITNCHFLFLLFGVLCCCIHHYG

SEQ ID NO: 186788 - protein, 328 aa, Glycine max
  Coding DNA Sequence Number=SeqID_70010
  Gene Ontology: Mol. function=oxidoreductase activity; Cellular component=integral to membrane; Biological process=electron transport
  Homolog annotation: Hit_ID=P24465; Match level="QueryCoverage=86%, HitCoverage=59%, E-value=3e-67, Identity=45%"; Hit description =Cytochrome P450 71A1
  Pfam annotation: Domain name=p450; Domain location=45-326; Score= -108.8; E_value=5.1e-06; Accession=PF00067.12; Description=Cytochrome P450
  Subcellular localization annotation: CTP_CleavageSite=16; ConfidenceScore=5.19e-01
MAFLSSVLKQLAYEPSSTHYLTAFFCFVSLLLMLKLTRRNKSNFPPSPPKLPIIGNLHQLGTLPHRSFQALSRKYGPLMMLQLGQTPTLVVSSADVAREIIKTHDVVFSNRPQPTAAKIFLYNCKDVGFAPYGEEWRQTKKTCVVELLSQRKVRSFRSIREEVVSELVEAVREACGGSERENRPCVNLSEMLIAASNNIVSRCVIGRKCDATVGDSVNCSFGELGRKIMRLFSAFCVGDFFPSLGWVDYLTGLIPEMKATFLAVDAFLDEVIAERESSNRKNDHSFMGILLQLQECGRLDFQLSRDNLKAILMVFLFIYLPIYIMHRK

SEQ ID NO: 186789 - protein, 222 aa, Glycine max
  Coding DNA Sequence Number=SeqID_70011
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q8W4M7; Match level="QueryCoverage=50%, HitCoverage=14%, E-value=3e-34, Identity=80%"; Hit description=DNA repair helicase UVH6
MCGCSSLLSLTVFLLSSLHLLLEMSTGTGKTIALLSLIISYVLSKPHSPLKLLYCTRTVHEMEKTLVELRSIFSMITSFATSAPLPRSSPSASRLGRIYALTRGFSPLRIVTPWTPMPEADRVVGSGGGHGESQRADVCFFDEEVIVEHESKNMKNDHSDVKDFLGILLHLQECRRLDFKLTRDNLKGILMDMIVGGSDTTSTNLEWAFVDLFRKPNTMNKA

SEQ ID NO: 186790 - protein, 308 aa, Glycine max
  Coding DNA Sequence Number=SeqID_70012
  Gene Ontology: Mol. function=oxidoreductase activity; Cellular component=integral to membrane; Biological process=electron transport
  Homolog annotation: Hit_ID=P24465; Match level="QueryCoverage=50%, HitCoverage=32%, E-value=6e-50, Identity=58%"; Hit description =Cytochrome P450 71A1
  Pfam annotation: Domain name=p450; Domain location=1-238; Score= -144.0; E_value=0.0002; Accession=PF00067.12; Description=Cytochrome P450
  Subcellular localization annotation: CTP_CleavageSite=71; ConfidenceScore=5.23e-01
GVYPDLSSFTGSGVYPDLSSFTGSGVYPDLSSLTGSGVYPDLSSFTGSGVIQIFVACIKRSAPTQLLRKPNTMKKAQEEIRRVVGINSRVVLDENCVNQMNYLKCVVKETLRLHSPVPLLVARETSSSVKLRGYDIPAKTMVFINAWAIQRDPELWDDPEEFIPERFETSQIDLNGQDFQLIPFGSGRRGCPAMSFGLASTEYVLANLLYWFNWNMSESGMLMHNIDMNETNGLTVSLKPRSPSNPSLPILNTIHLKLPRNLALSTTSIVCSGARAVSMHSEVARAVTCVASPRSVVAVTRLPVVFAP

SEQ ID NO: 186791 - protein, 366 aa, Glycine max
  Coding DNA Sequence Number=SeqID_70013
  Pfam annotation: Domain name=DUF747; Domain location=275-365; Score= -171.9; E_value=0.0036; Accession=PF05346.2; Description=Eukaryotic membrane protein (cytomegalovirus gH-receptor) family
MALRNDGRKISFEVLSVEGQSDPTERNHKKRRHRASKKKKKLLDRAGDSFDPHSVPLENGGACNGFELDASRYCCGGGGGSFVVCEEVREAESVCAVAEAREAESEEATAVRGGMEGFNFGELRQRNVNCGSSEDIAAYVVVRDEKEDGGVNASPVEKPTNEPDRNVVKKLETVESLDWKRIMAEDPNFVYSVEKSPVSYFLEEMHNGNSLRSTTTLGNEKERERVYDTIFRLPWRCELLIDVGFFVCFDSFLSLLTVMPARIMMTIWRLLKTRQFKRLSTMEVSDFGCFLILSSGVVLLQQTAQAITLSTCIVAHNNALLALLVSNNFAEIKSNVFKRYSEDNVHSLVYFVSASLASILAFGLKA

SEQ ID NO: 186792 - protein, 151 aa, Glycine max
  Coding DNA Sequence Number=SeqID_70014
  Gene Ontology: Mol. function=hydrolase activity
  Homolog annotation: Hit_ID=Q6ZJ14; Match level="QueryCoverage=75%, HitCoverage=35%, E-value=8e-40, Identity=62%"; Hit description =Calcineurin-like phosphoesterase family-like
MSDKIVLGMYYFDDLIKIECMTEAQREGDIMVSSNGLATTQPLFSFGLISDVQYADIPDGRSFLGVPRYYKHSILVLRRAVKEWNTHQKHKFAINFGDIVDGFCPKDQSLGTIKKLVDEFEMFRGGPVHHIIGNHCLYNLPRSELLPLLKI

SEQ ID NO: 186793 - protein, 299 aa, Glycine max
  Coding DNA Sequence Number=SeqID_70015
  Gene Ontology: Mol. function=ribonuclease H activity; Biological process=RNA-dependent DNA replication
  Homolog annotation: Hit_ID=Q1T293; Match level="QueryCoverage=77%, HitCoverage=39%, E-value=2e-42, Identity=39%"; Hit description =Ribonuclease H
MSSDTMWVIGNGQNIDFWSHRRTSQTLVLAVQIPSHFQLAPNIANEIENRIIPLFEEEDRSVWQVWSIWDYCNKSKFQNQKPNFLRASMAIEASTRLVWDLTSSSMPPSIYEFSKLKAFNVCCHPRKLQVIKQVRWHPPLAEYIKCNTNEATKGSLGVASCPGIFRNHHTSIVGCFTSFLGIKHALFGEISTAITTIKIVHEKGWRNLWLECDLLMVVQAFKKVNLVPWSLRNRWRNAVIRTRDMNFIVGHIYREGNTCVDKLVSYRTDIQDFCWWDFVPTFIFEIFLKGQTRFSLLQF

SEQ ID NO: 186794 - protein, 68 aa, Glycine max
  Coding DNA Sequence Number=SeqID_70016
  Subcellular localization annotation: CTP_CleavageSite=59; ConfidenceScore=5.40e-01
MDLSIVLLVRLMHFPKSTNKGRGPSFTYVVKAKGGLVLGSFANFPPSDIVCSRVPPSVRIMLRSQSSG

SEQ ID NO: 186795 - protein, 91 aa, Glycine max
  Coding DNA Sequence Number=SeqID_70017
  Gene Ontology: Mol. function=hydrolase activity
  Homolog annotation: Hit_ID=Q6ZJ14; Match level="QueryCoverage=71%, HitCoverage=19%, E-value=4e-22, Identity=65%"; Hit description =Calcineurin-like phosphoesterase family-like
MNLIHKYNCVKVCLAGHYHRGGYSIDSHGIHHRVLEAALECPPGTDAFGYIDVYDDRISLVGTDRMKRINQFVLNMFLPFERGNDATCSIT

SEQ ID NO: 186796 - protein, 95 aa, Glycine max
  Coding DNA Sequence Number=SeqID_70018
MVDDLPHRLYLDQNPRSVYKVTYRLLHHCWKIPFCVVLNSLHTSREDGSLTINWGARNKESYNHENWKSMSSIYYGPKWPHKHKEEKASINLEDL

SEQ ID NO: 186797 - protein, 102 aa, Glycine max
  Coding DNA Sequence Number=SeqID_70019
MFPLRRSHASSRKASGDHDRCLKSGGRWSRNGGGDAWVSSFVMGMEDGDRHNPWVLGLCGGRGTSHDGLENDMALLGFFLSALLNAKGHHNLYDQEWIRPVR

SEQ ID NO: 186798 - protein, 126 aa, Glycine max
  Coding DNA Sequence Number=SeqID_70020
  Subcellular localization annotation: CTP_CleavageSite=3; ConfidenceScore=5.38e-01
MSLASLARKRACCDSCSCVLHHRVWSPANSLPSVVRQFSILHSPSFIRRPMNSLPSAAHVSSTNESGAPRIHCLALFANSPFSILFGDPRIHCLALFMNPSLSSTEPPVTGKKKREEGVETRVVID

SEQ ID NO: 186799 - protein, 61 aa, Glycine max
  Coding DNA Sequence Number=SeqID_70021
MGHLSDQGVPTDLKRIKVILDWPTPPSIREIWGWHDLTNFYKRDRAVKEGPRVLMNIKETF

SEQ ID NO: 186800 - protein, 271 aa, Glycine max
  Coding DNA Sequence Number=SeqID_70022
  Gene Ontology: Mol. function=oxidoreductase activity; Cellular component=cytoplasm; Biological process=electron transport
  Homolog annotation: Hit_ID=Q1R197; Match level="QueryCoverage=79%, HitCoverage=93%, E-value=2e-46, Identity=51%"; Hit description =NAD(P)H dehydrogenase
  Subcellular localization annotation: CTP_CleavageSite=35; ConfidenceScore=5.45e-01
MVAHSSNTSPHARPDPACPPRAPLLQCPPRRAGGRAAEARPLAGGCGRPVCGRLRSAGSGLAPSTAPAARALRCPARTTPQRRTGAVTRRCATSPVPAAGRRPGDPAVPAVVVRGASHPQGLAGPRAGIWADVQQPSAPRTWRDAGQACIAERHHRFIGTGMRGGRPRRQHPIAAVAVDVQPALRRLQAERVQAHDEALVAATLSYRERLTHWRQWPIVPFNDSDDFEDGGGAARGRDCAQPLHPPPRRGMNLRLQALPESLILRTLPKHL

SEQ ID NO: 186801 - protein, 174 aa, Glycine max
  Coding DNA Sequence Number=SeqID_70023
  Gene Ontology: Mol. function=hydrolase activity; Cellular component =integral to membrane; Biological process=tRNA processing
  Homolog annotation: Hit_ID=Q3QZE2; Match level="QueryCoverage=90%, HitCoverage=77%, E-value=6e-62, Identity=70%"; Hit description =Cytidine/deoxycytidylate deaminase, zinc-binding region
  Pfam annotation: Domain name=dCMP_cyt_deam_1; Domain location=10-113; Score=135.2; E_value=1.8e-37; Accession=PF00383.13; Description =Cytidine and deoxycytidylate deaminas
MTDALGVPVHDTDEHWMRHALALAERAQREFDEIPVGAVLVGADGQLLGEGWNLNIASHDPSAHAEIVAMRAGGKLLANHRLLGSTLYVTLEPCAMCAMAIVHARVARLVYGASDPKTGACGSVFDLIGDARHNHRVEIHGGVLAKEASTRLTNYFRAKRGKPPLLLEDHVGEG

SEQ ID NO: 186802 - protein, 231 aa, Glycine max
  Coding DNA Sequence Number=SeqID_70024
  Gene Ontology: Cellular component=mitochondrion
  Homolog annotation: Hit_ID=Q56XW3; Match level="QueryCoverage=99%, HitCoverage=77%, E-value=1e-96, Identity=80%"; Hit description =Cytochrome c biogenesis orf452
MDGAKSGVLVRASRPILLPDIIGRSSSETRAGNASFRFVPVLHFLLLESKGDFSYLESFCGVLCLLFFRTLFSLPRDRSAKRERARRRKRQTLRPKPNGNEQQRNDKMGCSGHPHLERRVEGFGPVAFPVPPSSGGACVGGVPPEPEIGLEALALPTSRQLMAVGHDYHQKAPMKMNISHFGVCICMLGVLLSCDPAAYVRPVAHASYLFRAGGVNSDSIRVFNPAAEMLS

SEQ ID NO: 186803 - protein, 144 aa, Glycine max
  Coding DNA Sequence Number=SeqID_70025
MVVEQGACLLTPDRAKLVYGLVMKMSMNLGSLISSQISLIAQSNSSRLGFPALITTLCKARGVTSDSLTFESLSPAINLAYIKKDCWNLDEPSVTFPGTQKSRARRSEAPSTSVAPAPPTSAPSTSVFPSPPGAPVLLGPSTQS

SEQ ID NO: 186804 - protein, 464 aa, Glycine max
  Coding DNA Sequence Number=SeqID_70026
GCINYNLVLAIRQLGYPMRGALSEESIMPFIARGFSDPKARIFQGVRKAWSVVKRKDKELRGSSNGIIGSYHKWLKARTQELVWLPKLKASSEEEAETPEESKEVQALKAELERAQAIKEKFKMIAIKVWKEYDELRDINVATAEALERETKRARKEEPVKSRRHDIGGQVEGLPKAIIDQYKEKLSLAATHEQRLQDEYAKRSNDVDGWFAFTLNGSQELPRLLAKAKVMVDVYSALEEAINTITEHALRHPYRTRSKTRVMGDIEEVQEQMKADMEAMKDQVASMMEAMLSMKRMKERNTAAIVASSTATEANPTHPSAINQANQPAPDMVGQGGEVLGSTSGPHMGYNRNAYAYGLPPNYTPPTMHMPNENINHVVPVTFEEHAQGDFDSYPTFTAEGLALEGREKLDLIEERLRVVEGFGDYPFADMTELCLVPDVVIPPKFKSSDIPIWRPFVSAHGRI

SEQ ID NO: 186805 - protein, 282 aa, Glycine max
  Coding DNA Sequence Number=SeqID_70027
  Subcellular localization annotation: CTP_CleavageSite=23; ConfidenceScore=5.45e-01
MIQRNSVASLVDIFFLPKSSSPLANLPARISSSRTELALSLSFGLTFAFPCVLGLHQRAGCHEDLPTTGYTARARDVGNLGRRQVISDRLVLPSVGLLRGVPPWGHLVTLVRERDRLLTRDRLEASGLLCGSISGEVDHKLFGLARAFVSSLLLASPISNWPWSIIPCSKSSATGHASTSCVAPGCIKQDGSEFHKFLYRKIPSRIDACARIRAAGGARLCRNRVLSGGPLWLSGCLLLEGRWTGGGFGQVGADVTAWASHSFFFAPLILNLLLLVPAGRHN

SEQ ID NO: 186806 - protein, 110 aa, Glycine max
  Coding DNA Sequence Number=SeqID_70028
MGEVEEVQEKMKSDMSTLKDQMASLMEAMLSMKRLIESNAAMVVAASTVVEADPALSSVVNLAHKLAPHMMGRGGEILGNTNSPRQRYNRHAYPYGLKSVKGTRKKEEPH

SEQ ID NO: 186807 - protein, 71 aa, Glycine max
  Coding DNA Sequence Number=SeqID_70029
MDDKQENLLTLSLPSQLVSIDEELWRMAEDRVQEILWTIEPNVLSEVNRKDVIDYVQRLIKGYYGAKVRIL

SEQ ID NO: 186808 - protein, 104 aa, Glycine max
  Coding DNA Sequence Number=SeqID_70030
MQWRFQRQKRCKDKMKLTRNKHRTMVTSKENERDARKLLAHSRNLLKDPNGQIMENCLVKFKTKFREDPTVNEGWAALLPRELHVVFSRSFIKRLPPEASLRGF

SEQ ID NO: 186809 - protein, 140 aa, Glycine max
  Coding DNA Sequence Number=SeqID_70031
  Gene Ontology: Mol. function=ribonuclease H activity
  Homolog annotation: Hit_ID=Q1S4N4; Match level="QueryCoverage=98%, HitCoverage=42%, E-value=1e-18, Identity=40%"; Hit description =Ribonuclease H
MTLLTVLTSNINDAFNQPTLLFVKWNPPPPSVIKINVDDSSFGNPEDSGFGGLLKDHLGTSNMTGELFDIYYGIKLVRELGYPVVICESDSKMTLQFIKDGVADHHPHASAFMLFVGYNSLLGMCLFSTPLEKEITLLML

SEQ ID NO: 186810 - protein, 326 aa, Glycine max
  Coding DNA Sequence Number=SeqID_70032
  Homolog annotation: Hit_ID=Q9LUA7; Match level="QueryCoverage=95%, HitCoverage=95%, E-value=4e-61, Identity=42%"; Hit description =Arabidopsis thaliana genomic DNA, chromosome 5, P1 clone:MIF21
  Pfam annotation: Domain name=DUF868; Domain location=25-324; Score =422.1; E_value=7.5e-124; Accession=PF05910.3; Description=Plant protein of unknown function (DUF868)
MQDAIGIPACFSSALKSSDDHTTVTRLGQSVHMSLYRTKIADQCRLITITWCKNVMLHGLSVSVEGPEGEAQYCCKVELKPWYFWRKQGSKHFIVHGDKAVDVFWDLKAAKFHGETEPTSEYYVAVVCDKEVVLLIGDLKKEAYRRTGCRPALIDPILVSKKEHIFGKRKFSTRARFHEKGRCHEISIECKNKSNNNIGGDGDKIQPEMEIKLDGHVVIHVKRLQWKFRGNESIHLNKMRVEVYWDVHDWLFSPGLKHALFIFKPVLSSSNISLSSSHSISSSSPPLSSSSTPLSTQTGSSGSLEGFSVSESSEFCLFLYAWKVEQ

SEQ ID NO: 186811 - protein, 615 aa, Glycine max
  Coding DNA Sequence Number=SeqID_70033
  Gene Ontology: Mol. function=nucleotidyltransferase activity
  Homolog annotation: Hit_ID=Q2RBE2; Match level="QueryCoverage=46%, HitCoverage=37%, E-value=1e-76, Identity=51%"; Hit description =Nucleotidyltransferase family protein, putative, expressed
MFYLFVDYLQVLPFGSVPLKTYLPDGDVDLTTLIHEDAEEDLAQAICNILKSGDDSEYQVRLVKCTVKNIAVDISFNQMAGIYTLRFLEQVDQLVGKNHIFKRSIILIKAWCYYDSRLLGGHYGLLSTYAVEILVLYIINRFHSVVRGPLEVLYIFLDYYSSFDWDHNYVSIWGPKSLSSLPEIVETPECDQGEFLLQKEFLTNYKNMCSYPTRASETLTHEFPVKFMNILDPLRNDNNLGRSVSIASLHRLRFAFAYSAQKLKQIFTLPGENMGAALEKFFFSTLERNGKGERADVGVPVAPFGTGRFEEPVLNGDCENYCGGSQYVQLYHNYAMPVIVDSSSLALPDDILASSTQQNWSLFYHGGTDVYIPRHTLYHPTYNLEGGGKSRGTGTYIPDLNYNSYWDMSTKAPRPRRFPSSKHNAFPRSRLKKKQVEEVHSEIDINANSDSRLFEFLNEDFPVLPCNSKAIPPTQAEESTPLEKFHSETDMDGTSRSFEFSNEDFPLLPKVCSETHMDGNSRSFGLSKKDSPLLQSARKTILSGSANLTKQAKSFPFSKVSKLKNIEFGTFKKSQSLTEPSVSTKDEKEDSDISLSKKNCACIFEGGDREERLIS

SEQ ID NO: 186812 - protein, 112 aa, Glycine max
  Coding DNA Sequence Number=SeqID_70034
MHKILMTKIFNTLTECLIGFNFDAKAENALEDEDAGFPDKHTALEVESKVKDFEQSKETTITPPKDLPKQDCLELVIMQGHGVAQGFDGCLLDPETKPQGREKWYFHKNFWP

SEQ ID NO: 186813 - protein, 41 aa, Glycine max
  Coding DNA Sequence Number=SeqID_70035
MLLGIVLSYIASSLSRGDKQWMFGRIWKRWLEIIDGLPLKP

SEQ ID NO: 186814 - protein, 84 aa, Glycine max
  Coding DNA Sequence Number=SeqID_70036
  Subcellular localization annotation: CTP_CleavageSite=71; ConfidenceScore=5.13e-01
MEVLKLDCNNLIVLKLNLRAQNTLNQRLQSKCMQVTKGATSNIRKQTSFVFVTRRRHGEGERDQLHKLPLPSSTSSYECKGDSA

SEQ ID NO: 186815 - protein, 537 aa, Glycine max
  Coding DNA Sequence Number=SeqID_70037
  Gene Ontology: Mol. function=protein serine/threonine kinase activity; Cellular component=cytoplasm; Biological process=protein amino acid phosphorylation
  Homolog annotation: Hit_ID=Q84RS1; Match level="QueryCoverage=98%, HitCoverage=100%, E-value=0.0, Identity=72%"; Hit description=ZIK1 protein
  Pfam annotation: Domain name=Pkinase; Domain location=27-285; Score =189.7; E_value=7.2e-54; Accession=PF00069.15; Description=Protein kinase domain
  Pfam annotation: Domain name=Pkinase_Tyr; Domain location=28-285; Score=39.3; E_value=7e-15; Accession=PF07714.7; Description=Protein tyrosine kinase
  Pfam module annotation: Pfam domain module=Pkinase::Pkinase_Tyr; Domain location=27-285::28-285
MPPDSSEQDLDDPDIEFVEIDPTGRYGRYKEVLGKGAFKKVYRAFDELEGIEVAWNQVKVADLLRNSDDLERLYSEVHLLKTLKHKNIIKFYNSWVDTKNENINFITEIFTSGTLRQYRKKHKHVDLRAVKKWSRQILEGLLYLHSHNPPVIHRDLKCDNIFVNGNQGEVKIGDLGLAAILQQANSAHSVIGTPEFMAPELYEEEYNELVDIYAFGMCLLELVTVEYPYIECTNAAQIYKKVTSGIKPASLAKVADLEVKAFIEKCIADVSERLSAKDLLIDPFLQSDYDNDSVGRSSRSQTHHSGNNSHNQAIAEDNSVETSREFTVEGNIRNIHFPFDTEADTSISVASEMVEELELTDQDVTTIAGMIDSEIRYHIPSWNFSETPVDFNHQDSSYTSETRPEASPMKIDSVVAPGSLALEILPSGRVNSEEDNPTANGGISADDCVDGTIEQECDEIADSPSSEKSEMEYINQITTKLENLLVKQREELDELKRKHKLAVSDLLMEIPPEMCQKVLNICNLQMPDSEMARLALH

SEQ ID NO: 186816 - protein, 33 aa, Glycine max
  Coding DNA Sequence Number=SeqID_70038
MSCIVPRTMMAMADTMMTIVSGREVTSARERKS

SEQ ID NO: 186817 - protein, 69 aa, Glycine max
  Coding DNA Sequence Number=SeqID_70039
MVPMFTWGFLRSNLPRAARTVKVRRGVVVEEGERKGVELREEDDDAWGNSMSLEEAVAEETAMAGGEFG

SEQ ID NO: 186818 - protein, 229 aa, Glycine max
  Coding DNA Sequence Number=SeqID_70040
  Pfam annotation: Domain name=Di19; Domain location=45-228; Score=4.3; E_value=1.8e-09; Accession=PF05605.3; Description=Drought induced 19 protein (Di19)
MTKECDSPKEQQPRVLAIRRNLEKLKLELHNINRGIDSHVQGKRVNGTWGASRYLIGEEDDTESDGDEDDDAQSLLRCPSCDFEIDFSSLRIHLEEMHCYDPKNMLCPVCDETLGEDAIRVAQNSSAQKSDKSSISSGDSVVLEKKLPDRGSKHEPVPDPLLSPFVRNVSVRNSHGIHPGEGSSRNAAYIFNAKGSRTDAPQDSADEQDIEERRLRASFVQELVSSTLI

SEQ ID NO: 186819 - protein, 53 aa, Glycine max
  Coding DNA Sequence Number=SeqID_70041
MTQCDVTSSLISPIICLTNMFSSESNLIHLVEFALGQMHPRIPVMNRLSKAKG

SEQ ID NO: 186820 - protein, 64 aa, Glycine max
  Coding DNA Sequence Number=SeqID_70042
MVIFNHGVAAEDKGKEHIGKEYAARIFQKNIPRICQRHLSIFLEKLERGNYTPLDAMLPPKGIG

SEQ ID NO: 186821 - protein, 1150 aa, Glycine max
  Coding DNA Sequence Number=SeqID_70043
  Gene Ontology: Mol. function=histone binding; Cellular component =nucleus; Biological process=chromosome condensation
  Homolog annotation: Hit_ID=Q7XAM6; Match level="QueryCoverage=93%, HitCoverage=80%, E-value=0.0, Identity=59%"; Hit description =Putative condensin subunit 1
  Pfam annotation: Domain name=HEAT; Domain location=162-198; Score =11.7; E_value=1.6; Accession=PF02985.12; Description=HEAT repeat
  Pfam annotation: Domain name=HEAT; Domain location=202-238; Score =8.1; E_value=4.3; Accession=PF02985.12; Description=HEAT repeat
  Pfam annotation: Domain name=HEAT; Domain location=787-819; Score =7.3; E_value=5.4; Accession=PF02985.12; Description=HEAT repeat
  Pfam module annotation: Pfam domain module=HEAT::HEAT::HEAT; Domain location=162-198::202-238::787-819
NAFFMFEDATLLKDSDLKDALCRIIGACSTKYHYTAQSCASIMHLIHKYDFVVTHMADAVAGAEKKYADGSLAMSLVREIGRTNPKDYVKDTVGAENVGRFLVELADRIPKLISTNIGILVPHFGGESYKIRNALVAVLGKLIAKAFKDVDGGEVTSKSIRLRTKQAMLEILLERCRDVSAYTRSRVLQVWAELCEEHSISIGLWNEVAEVAAGRLEDKSAIVRKSALNLLIMMLQHNPFGPQLRIASFEATLDQYKKKLKELEPSEGAEPSSDTDIYNGDGEVDDLNCENVVKGQQLDSLTDSCLSQSEEAIPLQNSSVPDVGNLEQTRALVASLEAGLRFSKCIGATMPTLVQLMASSSATDVENTILLLMRCKQFQIDDSEECLRKMLPLANVIATVVADCNLKPCCETRIFKDKSIYEAVESAFHTIYIRKSPIETANNLLSLATDSNIGDLAALEFIVGALVSKGEISSSTISALWDFFCFNVGGTTAEQSRGALSVLCMVAKTSSGVLGSHFQDIIDIGFGRWSKVDPLLARTACLAIQRLSEDDKKKLLASSSARIFGFLESLITGFWLPANIWFAAADKAIAAIYAIHPTPETIAADMIKKSLSSVCNDGGVNVQSDIDTSSGSMPLTVQKQKLTKEKKDNENQNLDSNGTVSTGTQKDNDINAELGFAASEDAALDALFEKAEKEIVSGGSNEKNLIGICATFLSKLCKNLGLMQKYPELQASAMLALCRLMIIDADFCDANLQLLFTVVEGAHSEIVRSNCTIALGDLAVRFPNLLEPWTENMYARLKDPCASVRKNAVLVLSHLILNDMMKVKGYINEMAVRLEDEDERISNLAKLFFLELSKKGNNPIYNLLPDILSKLSQQNLSKDSFCNIMQFLIASIKKDRQMEALVEKLCHRFSGVTDVRQWEYISYCLSQLSFTEKGMKKLIELFKSYEHVLSEDSVMDHFRNILNKGKKFAKLELKACIEEFEDKLNKFHTDKKEQEVTARNAQIHQQKIGSREGFTVTINSEDHLSSNSSSDETEGEIIDAYTEEATMPLNERSESKLVSESHSGASSELTESDQGDIETRDIEIQSPQEFNGPELIKAMLKVEPKELFDQRVDMRSPLYLSRRGLDILSMKFAGLNIYGWSDKNPIVVTR

SEQ ID NO: 186822 - protein, 162 aa, Glycine max
  Coding DNA Sequence Number=SeqID_70044
MTKEKPQALALRRKLDKQLKLELTNSSPRTWGSSIYGIGVDADDLKSDGGNYSVFNYTDEDQHAKSLFRCPFCDFEFEFSSAHICLEELCPMCDKKLGKDAIRVAHNSSPQKRTLKSDKSSILSGDSVAIDKKIGKGFSSVASDISNAIGYDTSFGLYFVLV

SEQ ID NO: 186823 - protein, 50 aa, Glycine max
  Coding DNA Sequence Number=SeqID_70045
  Gene Ontology: Mol. function=protein serine/threonine kinase activity; Cellular component=integral to membrane; Biological process=protein amino acid phosphorylation
  Homolog annotation: Hit_ID=Q1S9G6; Match level="QueryCoverage=96%, HitCoverage=10%, E-value=2e-14, Identity=73%"; Hit description =Protein tyrosine kinase, putative
MGTFGYIAPEYACTEMLTEKSDVYSFGILIMELITGRRSPVDYSKPQGEA

SEQ ID NO: 186824 - protein, 66 aa, Glycine max
  Coding DNA Sequence Number=SeqID_70046
MMCEHGGGASVTREMTMHEHDGGKRKWCIGASATREQIMYEHNCTTTKKCRGGTTSAGQRRPGGAA

SEQ ID NO: 186825 - protein, 1088 aa, Glycine max
  Coding DNA Sequence Number=SeqID_70047
  Gene Ontology: Mol. function=exonuclease activity; Cellular component= intracellular; Biological process=DNA integration
  Pfam annotation: Domain name=rve; Domain location=378-504; Score =91.6; E_value=2.4e-24; Accession=PF00665.16; Description=Integrase core domain
  Pfam annotation: Domain name=zf-CCHC; Domain location=139-156; Score =30.6; E_value=5.6e-06; Accession=PF00098.13; Description=Zinc knuckle
  Pfam module annotation: Pfam domain module=RVT_2::rve::zf-CCHC; Domain location=673-927::378-504::139-156
MSSTKFDVEKFTGKNNFNLWRVKMLALLTQQECELALEGEEMLSAELTAAQKRDQAVLLLSSLPRAYDNFVDTIIFGRSSLSMEEVKTALQSWELKRRITDSYGGTSSGEGLMVRGRMDERKSFQRRRSKSRSKNKNNNKCHNCQKEGHWKRNCPELKKDKVSTLEFGGAAVVSEESDGGNVLFVSSNVNDDDWILDSACTFHMTPNRDWFATFQNVDGGKVLMGNDGACSIAGKGTVQIKMNDGIVRTLTDVRYAPELKKNLISLSTLDSLGCTYRAGGGDLRVSRGSLIVMKGKLKNGLYILQGSTVEGTTAVSSISNTDQSRLWHMRLGHMSERGMDELSKRGLLGGRRIEKLDFCEHYVYGKQSRVKFSTSVHRTRGTLDYIHSDLWGPSTVPSHGGAKYMLTFIDDYSREVWIYVLKQKSDVFLKFKQWKSLVEKQTEKKQNGVAERMNRTLLERARCMLSNAGLPKQFWAEAVNTACYLVNRSPSTAIDCKTPEEMWSGSTANYSILRVFECPAYAHINEGKLEPRAKKCILLGYQDGVKGYRLWDPKESKLLISRDVTFDETAMLNPRPHKDHDNKVEVHGDIKKVEFEVEARKPEEIYDESEVTPTEFEHTLASDRPRRQTRPPQRYDDFVAFALNMAESIDDEQEPSSFHEAVTCDEASQWIGAMKEELESLHKNHTWKLVEKPVDQKIVGCKWIYKKKDGIRFKARLVEKGFTQRKGIDFNEVFSPVVKHSSIRVLLALVSLLDLELEQLDVKTAFLHGDLEETIYMQQPDGFIVPGKEDHVCLLKKSLYGLKQSPRQWYKRFDSFMIDIGYIRSEYDSCVYHKKLFDNTYIYLLLYVDDMLIACMHPNEINKVKTQLSGEFEMKDLGPAKRILGMEIIRDRKIGRLCLSQKSYVEKVLQRFGMHNAKAVSTPFAAHFKLSANMSPQTKEEEEFMSRVPYSNAVGSLMYAMVFTRPDITHVVSVVSRYMANPGKSHWQAVKWILRYLRGSTNLGLVFGKATNECNGHVIGYCDSDYAGDLDRRRSLSGYIFTLGGSAISWRATLQSTVALSTTEAEYMAATEAVKEALWLKGLVRDLG

SEQ ID NO: 186826 - protein, 103 aa, Glycine max
  Coding DNA Sequence Number=SeqID_70048
MEDAPVSPRVALPPKGRLRQEPNRFMIGTMHGRAQEKRGLDSAFAKVNLIRNDLRWLDCFVPLSLLGCGFIAFIDINVAPCRACRPWNFFINGVLCFLKIKGS

SEQ ID NO: 186827 - protein, 109 aa, Glycine max
  Coding DNA Sequence Number=SeqID_70049
  Gene Ontology: Mol. function=oxidoreductase activity, acting on single donors with incorporation of molecular oxygen, incorporation of two atoms of oxygen
  Homolog annotation: Hit_ID=Q1S0D0; Match level="QueryCoverage=85%, HitCoverage=49%, E-value=2e-28, Identity=65%"; Hit description =Glyoxalase/bleomycin resistance protein/dioxygenase
MKMEIEEVGNCEALPLLSLNHVSLLCRSVWVSMRFYEDVLGFVPIKRPSSFKFTGAWFYNYGIGIHLIENPNIDEFDTCVNEERPINPKDNHISFQVRPDFERPEPSLQ

SEQ ID NO: 186828 - protein, 219 aa, Glycine max
  Coding DNA Sequence Number=SeqID_70050
MRGEGCTAARLPLEVTCLPRRAGEGSSAAPPAKIEFNGYRFRSEEHQHHFEVIKYWFFLKERRVQLVEGEYAEFQAEVAKRRWTQLTEPMAKYDPKPTEEGVVYKRSWVWGQWILYDTDAINQFLGHPLILEEGKRCKYIERRSQFSGFDEEAIGQLLFSPGDDFAWSIAGRRLISDAIHQFVGIAPLRHPVDLEKSNRALGFSALITGLFQFYEYRLH

SEQ ID NO: 186829 - protein, 418 aa, Glycine max
  Coding DNA Sequence Number=SeqID_70051
  Gene Ontology: Mol. function=pyridoxal phosphate binding
  Homolog annotation: Hit_ID=Q0X7A5; Match level="QueryCoverage=76%, HitCoverage=80%, E-value=5e-61, Identity=44%"; Hit description =DegT/DnrJ/EryC1/StrS aminotransferase
MTSSRADGAIEVTQDAPVHGQSRAGQHLQYSGCLFTGLPGAVAKGQHACGEVACVGHVVLRHDAAQVRVVGQGMDEHAAGAEPAWPQVFQYGIAGALAGQQQHQHRPGATATGKAVDHLNGWQLCQLHAQLQCTQAPCLQEGRQAPRGTGTDVLPPLADPVLRNLQRENVTDRFFQVATLQRTAQRIAVHQRQQRWPIAGGQAKQLQTAQQFPAQAGTHLFGGMSGQRGTQLVIAADQQAAFVQAQALAGGQAEESDIATQADTAAADPCTERLRGILDHPGASAARNLAGQLDIGDAPAQVGGQDRQRACVGQALELAGVEVEMAVAGIAQLHAQAQAVNCSGGVPSWLARIARRSPPPGRKSLACIGRPAVGGSSRANRLIAGGSRGAFGGAVRVVGFRAAEADDAGHDQHRTEQM

SEQ ID NO: 186830 - protein, 252 aa, Glycine max
  Coding DNA Sequence Number=SeqID_70052
MVKMLMEQKGITYNDAKNASMEQNNGLEDKESAMEPEPSSTSEDEENKPEADSILNSSHHYWAKGVKMPMFEGEDLLGWIVRAEKFFVVQHVQQSTKVRLAFINMEGNALHWFQYWKQKTKRKSWFVFKATLIKRYGGIRGAGGSSLMYKGSAIVRIFFEGLHKEIYAKIHPHKPKDLSSAMELATDFEEAEKEGNPEVELHSRGFHFQPKGEMWIHNVEGSTTNTFHNNQRQNQTLTGEARSSVNVMAANQ

SEQ ID NO: 186831 - protein, 178 aa, Glycine max
  Coding DNA Sequence Number=SeqID_70053
  Gene Ontology: Mol. function=DNA binding; Biological process=DNA integration
  Homolog annotation: Hit_ID=Q8LLX4; Match level="QueryCoverage=57%, HitCoverage=12%, E-value=3e-18, Identity=37%"; Hit description =Putative retroelement
MELHQYVLVYVDYMSKWVEAMAVPTSDSRVVVKFLKKNTFTRFGTPRAIINDGGTRQKLYKERTKRWHDARIKERQFQVGKKMLVHDSHFHLFPGKLQSRWGSPFEVNKVFPSVVLELKKFDGHTFKINAYQAKAYQEGLQQVADHGLDHFITTVNHGGMIKALIIQPKNFVKISMRL

SEQ ID NO: 186832 - protein, 181 aa, Glycine max
  Coding DNA Sequence Number=SeqID_70054
MDYYTRVSEVEREPIMEYSTPRPMMGNYHHPNAHRVLNEKIVYEEDVIGGSRHNHMHHHHPETHERVKVVEYEQVPERRVVYEEKVAYDNDRYYSPRSGDYRTHVSEVERESSTVEYPNAHVSLNKKVVYEESEIEGSHHHHHHLFHRHHHPETRESVKVVEYEQVPERRVAEVVYEENRT

SEQ ID NO: 186833 - protein, 68 aa, Glycine max
  Coding DNA Sequence Number=SeqID_70055
MAMIDCQDFVVIRIIVFIMMMRIKLLPPGDYRGHKEKQDVCQPWKILLLRVVMNTFNVAEEEVSNAEN

SEQ ID NO: 186834 - protein, 350 aa, Glycine max
  Coding DNA Sequence Number=SeqID_70056
  Homolog annotation: Hit_ID=Q84VI1; Match level="QueryCoverage=99%, HitCoverage=63%, E-value=1e-125, Identity=58%"; Hit description =Envelope-like protein
MATSPKETAASGSPSVPSSPHQEQPEFNIQPIQIIPGQASVPEKLVPRRPQGVKIAENPSPATSPREVDTEMDKKIRSIVSSILKDASVPEADEDVPTSKVTKQKGKTPIKRSGRIKTMAQKKSTPVTPATSRRSKVAIPSKKRKEISSSDSDEDVELDVSTSKRAKKSGKKVPEKVPDAPLDNISFHSIGNVEKWKYVYQRRLAVERELGRTALDCKEIMDLIKAAGLLKTVTKLGDCYEGLVREFIVNIPSDISNRKSDDYQRVFVRGKCIRFSPAVINKYLGRPTEGMVDIDVSEHQIAKEITAKRVQHWPKKGKLSAGKLSVKYAILHRIGAANWVPTNHTSTVAT

SEQ ID NO: 186835 - protein, 972 aa, Glycine max
  Coding DNA Sequence Number=SeqID_70057
  Gene Ontology: Biological process=pollen maturation
  Homolog annotation: Hit_ID=Q5Z6I4; Match level="QueryCoverage=98%, HitCoverage=99%, E-value=0.0, Identity=44%"; Hit description =Putative Osnop
  Pfam annotation: Domain name=C2; Domain location=4-88; Score=51.4; E _value=3e-12; Accession=PF00168.20; Description=C2 domain
  Pfam annotation: Domain name=C2; Domain location=488-570; Score=77.4; E_value=4.4e-20; Accession=PF00168.20; Description=C2 domain
  Pfam annotation: Domain name=GRAM; Domain location=639-705; Score =78.0; E_value=3e-20; Accession=PF02893.10; Description=GRAM domain
  Pfam module annotation: Pfam domain module=C2::C2::GRAM; Domain location=4-88::488-570::639-705
MLRLYVCVLETKDLPVKDTYVTLRLGKLKCKTRILRNTWNPVWNEEFGFKVHGAEDVLVVSVVVNHDNNNKCRSVTNGSVVEFVGEVRIPVGSVAFEDKQTLLPTWFSLESPKSGRFFNKYCGKILLTVSLHGKGRSFMNHKHSPNSTIAVENSRDLEGKQLLKDIANGLHRIFKKKEGNSNFGDSSELSSSLSDYEDSVHENTFPCSFEESIALMESRDDNKPEMPENLPVGILVDQIYLVSPNDLNVFLFAPNSQFSKDMAELQGTTNVQEGPWTWKNGDTSCLTRVVTYMKAATKLIKAVNAIEEQTYIRVSRKEFAILVSVSTPEVPYGNSFRIELLYKIMPGEVSSGEESSHLVVSWGIVFLQSTMMKGMIEGGARQGLKESFSQFSDQLARNFKVLDKADLPDKEHLLATLQTEDQWCGPNLLQGLEFSGLELPDSFGELITSGILIIQLQRVYNMVSHFVQARFQMGTDHGLKAHGDGWVLTVALIEGVDLASLESEGLSDPYVVFTCNGQTRSSSVKLQTSDPQWNEILEFDAMEEPPSVLHVEVFDFDGPFDQDVSLGHAEINFLRHTSTELADMWVMLEGKLAQSSQSKLHLRIFLDNNNGVETIKEYLEKMEKEVGKKLNLRSPQRNSTFQKLFALPPEEFLIKDFTCYLKRKMPLQGRLFLSARILGFHANLFGHKTKFFFLWEDIEEIQVLPPSLATLGSPTLVIVLRRGRGLDARHGAKTQDEEGRLRFHFQSFVSFSAASRAIKALWRTRILNPYQKEQISEEHEDQERFVIPEDSASILEDEEKMSRIFSAELPIKMKSVMGIFDGGNLEHKIMQRTGCTNYETTSWEQVKHDVFERRVSYQFNRHVSAFGGEVTCTQQKFPNANTGGWTVIEVMDLHGVPFADHFHIHFRYEIEKSSLGDCACKCDAYIGIMWLKSSKFQQRINRNITAKFNLRLKEIFELVQKEILLMSQNSHG

SEQ ID NO: 186836 - protein, 58 aa, Glycine max
  Coding DNA Sequence Number=SeqID_70058
MDDYEEHIPGISAAQLVDLRTVLCENDLRFLQFELECISVVPKADCLIVNLRPSKKRS

SEQ ID NO: 186837 - protein, 84 aa, Glycine max
  Coding DNA Sequence Number=SeqID_70059
  Gene Ontology: Mol. function=transferase activity, transferring hexosyl groups; Cellular component=integral to membrane; Biological process=metabolic process
  Homolog annotation: Hit_ID=O64733; Match level="QueryCoverage=97%, HitCoverage=24%, E-value=4e-21, Identity=49%"; Hit description =Putative glucosyltransferase
MSALYISLGSFLSVSCAQMNEIVTALNTSGVCYLWVVLSHPSVGGFWSHCGWNSTLEAVFPGVPMLTFPLYFDQVPNSRQILEE

SEQ ID NO: 186838 - protein, 74 aa, Glycine max
  Coding DNA Sequence Number=SeqID_70060
MRDKTEGKWLLVESWGCSLQPSHVPKTAIQYAHKLTVASQVFVGLEITLLEGDQVEADKEKFNKARKGSSVQLN

SEQ ID NO: 186839 - protein, 176 aa, Glycine max
  Coding DNA Sequence Number=SeqID_70061
MAERYSPFVYVEDQDVLYEICGYVVERVLGLDASVPVEGSSSEESVGSGSGVRGYNDEVFEVSSDSHSLGLNFSSSIDLLAIEGSSDILPFLSQLQKNMGKKVGGSVVALMVATIAETGTSTGAFPQPKKRSVLKEKCLPPPITLLGYMWVDREVCTYFSIAVVFVLVLVISMNSQ

SEQ ID NO: 186840 - protein, 114 aa, Glycine max
  Coding DNA Sequence Number=SeqID_70062
MHDGFPVIDESPFIDAPKLCWLESRIRKGITLDDIGIEEEEIDMYVVLLGLDSSSWIDLWVSWSVQAMDHFFKSMTMLDFRLASHNPWALQTRGPVCLAHGIRKTGGDQCIKFM

SEQ ID NO: 186841 - protein, 296 aa, Glycine max
  Coding DNA Sequence Number=SeqID_70063
MDDARKNEIMVMRLAMKISQRQVPQVNEEKIAKRRKKPIKTVTKRKHESASASIPSGKRSRTTPTKRSPKKQTMETNTNTRLKDPGEIKDEEVPKLQQKRKIVAPQALFAPKKPKVVKVAPSVKKPIIIDDVSFDATISPQDRRPPSPPRQRPPTSLVNLNKFKNNKKMNTPMSEKERTTMLKQHDLVLSCTEYSMTGGILARMYAFNQAISYPPSLHISKTIDNKIALDFCCPRLPDSKDDGFISRLKQLPIRFNNIVYDLMKMDERDFKDQKNMLRKNLNSSLSDTSLLSAIPW

SEQ ID NO: 186842 - protein, 1057 aa, Glycine max
  Coding DNA Sequence Number=SeqID_70064
  Gene Ontology: Mol. function=methyltransferase activity; Cellular component=intracellular; Biological process=DNA methylation
  Homolog annotation: Hit_ID=O49022; Match level="QueryCoverage=98%, HitCoverage=66%, E-value=0.0, Identity=78%"; Hit description =Cytosine-5 DNA methyltransferase
  Pfam annotation: Domain name=BAH; Domain location=261-395; Score =175.3; E_value=1.5e-49; Accession=PF01426.8; Description=BAH domain
  Pfam annotation: Domain name=BAH; Domain location=435-575; Score =161.2; E_value=2.6e-45; Accession=PF01426.8; Description=BAH domain
  Pfam annotation: Domain name=DNA_methylase; Domain location=620-1049; Score=131.6; E_value=2.2e-36; Accession=PF00145.8; Description=C-5 cytosine-specific DNA methylase
  Pfam module annotation: Pfam domain module=BAH::BAH::DNA_methylase; Domain location=261-395::435-575::620-1049
MSQNENQDHSYFIPFRYRLGKPAKQYAPWYDTVLKTARLAISIITLLKEQSRVSRLSFGDVIRKVSEFNQKDGSYISSDPLTVERYVVVHGQIILQLFAEFPDDNIRKSSFVTGLTNKMEERHHTKWLVKKKKVVPRSEPNLNPRAAVGPVVSKRKAMQATTTRLINRIWGEYYSNHLPEDSKEGIASELKDEDEVEEQEENEDDDNEEETILLEGTPKAHSASKQTKKISADTEIRWEGEPEGKTSSGYPVYKQAIIRGEVISVGRSVLVEVDETDEFPDIYYVEYMFESKIGRKMFHGRMMQCGCQTVLGNAANEREVFLTNECRDLGLHDVKQTVVVNIQNRPWGHQHRKDNIIADRVDRTQAEERKKKGLPTDYYCKSLYWPERGAFFTLPHDTLGLGSGVCPSCKIQDAEKEKDVFKVNSSKSGFLFNGTEYSLDDYVYVSPFEFEEKIEQGTHKSGRNVGLKAYVVCQVLEIVVKKEIKQAEIKSTQVKIRRFFRPEDLSNEKAYCSDIREVYYSDETYIISVESIEGKCQVRKKNDIPECSALGGIFQNVFFCELLYDPATGSLKKLPAHIKVKYSSGQTSDAAARKRKGKCIEGDGVSESTKEGKTLNDKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAASPEDVLPEWPEPVHVFSAPELKITLSENVQYAAVRSTANGAPLRAITVRDTIGDLPAVGNGASKGNMEYQNDPVSWFQKKIRGDMVVLTDHISKEMNELNLIRCQKIPKRPGADWRDLPEEKIKLSSGQVVDLIPWCLPNTAKRHNQWKGLFGRLDWQGNFPTSVTDPQPMGKVGMCFHPDQDRILTVRECARSQGFPDSYEFAGNIIHKHRQIGNAVPPPLASALGRKLKEAVDSKSST

SEQ ID NO: 186843 - protein, 164 aa, Glycine max
  Coding DNA Sequence Number=SeqID_70065
  Homolog annotation: Hit_ID=Q1SFS3; Match level="QueryCoverage=68%, HitCoverage=22%, E-value=6e-08, Identity=29%"; Hit description =Lambda repressor-like, DNA-binding
MGSNQVPSFKKRFYHVKIKSLEVVDLQELGQQMGQLQLQAFYKTYGKIWDLAMIEVSVEAIASLVQYYNQPLRCFTFGDFQLVPTIEEFEEILGCPLGGRKRYLFSGLHPSMARMAKVVKVLAQELDRVKQNRNGVVRIPRKHLEEKAKALADQEPSSFQIWMG

SEQ ID NO: 186844 - protein, 96 aa, Glycine max
  Coding DNA Sequence Number=SeqID_70066
MEDEGPTAQVAQHLEDDSSKATIPEPFLVEEEAEPPALVVDLSSPQYAADPSTPILEIPEDPTTPVLTLSTSLPATLVLHLTDEEDVQTQDTQDQS

SEQ ID NO: 186845 - protein, 172 aa, Glycine max
  Coding DNA Sequence Number=SeqID_70067
MARRDKLWSSAPFLLSRDKRVRWHAETNYGHLHPLCYLETSESDGTRRQIMVIYTLFVIQRQRQSSPMAREDKLWSSAPPLLSRDNQVRWHAETNYGHLQHLCYPETIKSDGTLKQIMVICTSFVIQRQSSPMARRDNYGHLPLCRRLQCFSTETIKVSFAIQRQSSLSVYV

SEQ ID NO: 186846 - protein, 229 aa, Glycine max
  Coding DNA Sequence Number=SeqID_70068
  Gene Ontology: Mol. function=transcription factor activity; Biological process=regulation of transcription, DNA-dependent
  Homolog annotation: Hit_ID=Q92N94; Match level="QueryCoverage=95%, HitCoverage=73%, E-value=3e-68, Identity=58%"; Hit description =PUTATIVE TRANSCRIPTION REGULATOR PROTEIN
  Pfam annotation: Domain name=LysR_substrate; Domain location=15-222; Score=158.0; E_value=2.4e-44; Accession=PF03466.10; Description=LysR substrate binding domain
MIEAQAAETVVHRRLAEPSGTVRITASVPVAQFQLADRLPVLARRYPKLRIQLHVTDRFVDLVQEGFDIAIRSHFAALPDSDLVQRRMAEEPITLVAAPSYVAERGAPQAPQALGDHDGLMAGMATKSWRLGDASGHIVEVAPRPRLHADESTALMQAAQAGLGIVCLPRTISAQAVSEGTLMRVLPAWTAGRVTTTILTPHKRGQLPAVRAVIDFLTQAEGAGDGAVA

SEQ ID NO: 186847 - protein, 69 aa, Glycine max
  Coding DNA Sequence Number=SeqID_70069
  Homolog annotation: Hit_ID=UPI0000382D8E; Match level="QueryCoverage =51%, HitCoverage=32%, E-value=9e-07, Identity=58%"; Hit description =COG1145: Ferredoxin
MPWLDVLAAGLQAMLRRGLQAGPIAVEAKARTRLDILVMSRHGVLLVFDRDEPVQQTPCRGARACLARI

SEQ ID NO: 186848 - protein, 326 aa, Glycine max
  Coding DNA Sequence Number=SeqID_70070
  Homolog annotation: Hit_ID=Q0KFG3; Match level="QueryCoverage=35%, HitCoverage=91%, E-value=1e-34, Identity=60%"; Hit description =Lactoylglutathione lyase or related lyase
ARQRVGMGVAAVFLYGVVARRDEHREGQRDAPEQPGVLDQDAPHGRAPFSRRERGRRRGEVQDALARQHQRDEEESGGEHPVRGARGVPGEGQRGAPGHQRATGLDEERFQLRAGEQHHRDHHHRRQDDTAQDEGILDHLLVRRQPAGLHQHDGVARAQASQGAAPAQRVEADEARGAEAGCAHQDRRGHGPLEKGCGHGRDSQGLSSVMAHRFDVVAVGIQDEGAVIVRVVLRTQPGAAVVAPAGRQRRAMERIHLGPVAGAKRYMHARRAGRALVDPEFAARVAGVVRLTHAEAHAGGQLLARHVAQGRQRLQVEGAAAFEVAH

SEQ ID NO: 186849 - protein, 162 aa, Glycine max
  Coding DNA Sequence Number=SeqID_70071
  Gene Ontology: Mol. function=DNA binding; Biological process=DNA integration
MARRLQEDWARDVGEGPRVLMSLRGYPKETKGYYFYNSFEDKVFVVRTKVFLEKEYISNPMEPEAIIEPEYEKWLTGIGSKMESMYTNQVWTLVDPPKVVSRKFEMDAKTVFLNETLLEDVYMTQPKGFNDLKEVGNNEDEPCVYKKVRGSRGVHGVVWFGF

SEQ ID NO: 186850 - protein, 56 aa, Glycine max
  Coding DNA Sequence Number=SeqID_70072
MDHKDLSMGTRLTRILSEKSNVLERHASQHNNVDGSRGQMVLPPRVMKRIWVLKTI

SEQ ID NO: 186851 - protein, 108 aa, Glycine max
  Coding DNA Sequence Number=SeqID_70073
MENYGGSWWLWVKDKNLGTLEMIFGRKKEKENGIFPRLHKIQRLKHSSASALEKGSFSHTLEVISEIATTKFQKDPTVNKDRMALLPRQLQTASLRSFIKRLPREASS

SEQ ID NO: 186852 - protein, 91 aa, Glycine max
  Coding DNA Sequence Number=SeqID_70074
  Subcellular localization annotation: CTP_CleavageSite=39; ConfidenceScore=5.01e-01
MVLKLLSFNAKEVSITVTKFWWLSERLKALRSNIISFVSVKFVGGNSNSTNEEKELKMLCLVCMVFSTAMVTVANAHIDDCLVMAIKKNEL

SEQ ID NO: 186853 - protein, 754 aa, Glycine max
  Coding DNA Sequence Number=SeqID_70075
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=97%, HitCoverage=92%, E-value=1e-177, Identity=44%"; Hit description =Probable Na/H antiporter [imported]-Arabidopsis thaliana
  Pfam annotation: Domain name=Na_H_Exchanger; Domain location=40-424; Score=173.2; E_value=6.4e-49; Accession=PF00999.11; Description =Sodiumhydrogen exchanger family
MEEPENHTLHSQLIVDNPNEIWKSENILRFFLPQFTLLLFFIVSMTRFIHYILRPFNQPHFVAEFFAGLLLCPEIVGKSEITAYVIPPKALLGVETVAHVGLIYNVFLTGLEMNLDAVLLARKKATTIAIAATIIPMALGTAIYSLGQALYPDDKSSFNTPSAYLFCALVLSVTNYPVLAHILADLKILYTGLGRVAVTAATINDFYNWAMFVILIPFATHSEKPFVSVMLTMIFVLFCYYMLRPSLNRLIEKITDKNEWDNYKLSYVLVGVLFCAHVTEMLGTHSIVGALVFGLILPRGKFADMLMERSDDLVSMYLAPLFFIGCGIRFNFATFEKTKLRNVMIITLLSCCTKIVSTVIATGFYRMPFRDGVALGALLNTKGLLPLVMLNIASDREILSRDFYTIMTTANVLMTILVSPTINYIYKPRKQFEKDKLRTIQNLKADADIRVVACVHNARQAAGMITILEACSATNASRLRVFSLQLIELKGRGTAFLVDHNSSHQSQADTEAIANIFAEISPEQGHTNTSLETLSAVSSYETIHKDIYNIADEKRASLILIPFHKHSSAEGTLEVTNPAFKEINQNVMNYAPCSVGILVDRGHGSLSKVSLRVCVVFIGGPDDREALAISWRMAKHPGIHLSMVHVLLYGKAAEVDTNATTNDESHGILSTIIDSGKEKELDEEYVSLFRLMAVNNEDSITYSEKEVHTGDDIPLVLNELDRGSYDLYILGHGKGRNSLVLSNLMEWTDCPELG

SEQ ID NO: 186854 - protein, 332 aa, Glycine max
  Coding DNA Sequence Number=SeqID_70076
  Gene Ontology: Mol. function=isomerase activity; Cellular component =chloroplast; Biological process=protein folding
  Homolog annotation: Hit_ID=Q7XIJ9; Match level="QueryCoverage=95%, HitCoverage=65%, E-value=1e-112, Identity=66%"; Hit description =Putative peptidyl-prolycis-trans isomerase protein
MEGNRTLNFDNFLPHQIAVDEKDSILASIPAELKEKGSLVHASLIEGKGGLQTLLQSIKEQDADKVSVSLTSTLDTVAELELLQAPGLSFLLPEQYAQQYPRSVTPTESLSITTLMLSGRGTVEFTIEKGDGSTFSPVGGEQKNTATVQVVIDGYSAPLTAGNFAKLISKLYNLVETTLSPIILQVMDGAYNGAKLNCINQAVISDNGVDKNTGYSVPLEIMPSGQFEPLYKTTLSVQDGELPVLPLSVYGALAMAHSEASEEYSSPYQFFFYLYDKRSAGLGGISFDEGQFSVFGYTTTGRDILPQIKTGDVIRSAKLIEGQDRLVLPKES

SEQ ID NO: 186855 - protein, 297 aa, Glycine max
  Coding DNA Sequence Number=SeqID_70077
  Gene Ontology: Mol. function=protein dimerization activity
  Homolog annotation: Hit_ID=Q6RZV0; Match level="QueryCoverage=38%, HitCoverage=17%, E-value=1e-17, Identity=40%"; Hit description =Transposase-like protein
  Pfam annotation: Domain name=DUF659; Domain location=1-105; Score =32.2; E_value=5.7e-10; Accession=PF04937.6; Description=Protein of unknown function (DUF 659)
MSNAWTGRKQRSIINFLVNCPTGTMFYKSIDASNFVKTGEKIFELLDSIVEEIEEEKVVQVITDNESNYVLVGDALVKVLRLVDNEKKPTMAYIYEAMEKDKEAIMKSFEYNESKYKQVFEIIGSRWTCQLHCPLHAAGHFLNPDLFFNNPSMEFDFEVVNGLYVCIEKLVPDQKVRQKILIELPIYKMGGDEIDPISLNDIDECNEWLVGQMYGDDGLPWDKGTLGVEDVAPKTKRGQVRGFSSLRGKEKMIEVEDNAILEESEKELQNNFGDSQEVVEGHHPLLDNEDYDYIGEG

SEQ ID NO: 186856 - protein, 95 aa, Glycine max
  Coding DNA Sequence Number=SeqID_70078
MQQRKERQRFSTSDDSAMTKQVQATHAPDGREIDVKPILQIVDEILVRFIARTVEGYEVKRDQDALEMTAALAEFDMLDSLAYIINKISCEVVFI

SEQ ID NO: 186857 - protein, 44 aa, Glycine max
  Coding DNA Sequence Number=SeqID_70079
MPFCPMTQPPTSLSTIYGGLPWMKVRVSIQSEANSSQVNFAVMG

SEQ ID NO: 186858 - protein, 180 aa, Glycine max
  Coding DNA Sequence Number=SeqID_70080
  Gene Ontology: Mol. function=oxidoreductase activity; Cellular component=nucleus; Biological process=electron transport
  Homolog annotation: Hit_ID=Q84XG2; Match level="QueryCoverage=97%, HitCoverage=35%, E-value=7e-46, Identity=53%"; Hit description =Putative polyamine oxidase
MVAKKPLIVIIGAGMAGLTAANKLHSVSASKDLFEVCVVEGGNRIGGRINTSEFGGDRIEMGATWIHGIGGSPIHKIAQQIHALDSEQPWECMDGNENKATTIAEGGFVLNPSSHVDPITKLFNNLMDHAQRKMPTTTKGDCGNLSVGSFLKQGLDGYCGSSKEEEELKGFGKWSKKVTQ

SEQ ID NO: 186859 - protein, 87 aa, Glycine max
  Coding DNA Sequence Number=SeqID_70081
  Pfam annotation: Domain name=UPF0197; Domain location=1-87; Score =33.8; E_value=5.9e-07; Accession=PF05251.3; Description =Uncharacterised protein family (UPF0197)
MQRRHFKVVVVSMPYLGQTDIDGCRGNMGEFTVLCCLALCNLVRQSYEATSSRKSRSLVQELTTGAVASVFLGFGSLFLLLASGVYV

SEQ ID NO: 186860 - protein, 109 aa, Glycine max
  Coding DNA Sequence Number=SeqID_70082
  Homolog annotation: Hit_ID=Q1SDS1; Match level="QueryCoverage=95%, HitCoverage=27%, E-value=1e-07, Identity=34%"; Hit description=IMP dehydrogenase/GMP reductase
MVEVSTEAIASLAQYYDQPLRCFTFGDFQLSPMVEEFEEILGCPIGGRKPYLFTGFYPSLARISKIVQISAQELDHRKYSRTVDFRGSPLSECGWVGGPGSDRHFSHLS

SEQ ID NO: 186861 - protein, 615 aa, Glycine max
  Coding DNA Sequence Number=SeqID_70083
  Gene Ontology: Mol. function=transferase activity, transferring glycosyl groups; Cellular component=cytoplasm; Biological process =carbohydrate metabolic process
  Homolog annotation: Hit_ID=Q9SCM1; Match level="QueryCoverage=95%, HitCoverage=90%, E-value=1e-124, Identity=36%"; Hit description =Imbibition protein homolog
  Pfam annotation: Domain name=Raffinose_syn; Domain location=1-602; Score=396.6; E_value=3.7e-116; Accession=PF05691.3; Description =Raffinose synthase or seed imbibition protein Sip1
MAREISRLNESQVVVYALGQIPGGYKLLSLFRVKIWWMIPPVGRSASDVPMETQLLLLKKEKSLRLRMSFLLTLKSQLQRTLATFSFCLFWMDSFAQLCRELNQMSSSSALKLYDFRFLNASGDAYVQASQSLEAAFVNSGDNPFELIRDSIKILEKHKGTFCHLENKRIPAHLDWFGWSTWDAFYTEVSPQGIKEGLQSFLNEGCSPKFIIIDDGWQETLNTFRKEGESVIEGTQFATRLIDIKENKKFTNAGSENSCNNLHDFVDSIKQNMNVKYVYMWHTLTGYWGGVLPSSDALKKYNPKILYPIQSPGTTGNLRDVAMDSLEKYGVGIIDPEKLYDFYNDSHSYLASCGVDGVKFKNSAAARASEDFMPREPTFQTLHIASVAFNSLLLLGESKHETAESHAAARSIGGCAVYVSDKPGNHDFKILKKLVLPDGSVLRARYAGHPTRDCLFEDPVMDGKRRLQLPRSRKLVTEIIGSRTLVHNHLRESLLSKVSCRGKLEVSLETLQCEIYTVSPIRVFGHDVQFAPIGLLDMYNSGGAIEALDCTMDVAQCVVKIKGRGCGRFGAYSNVRPKSCVVDMKEEEFSYIPEDGLLTITLGCEGNSRDMEFVY

SEQ ID NO: 186862 - protein, 190 aa, Glycine max
  Coding DNA Sequence Number=SeqID_70084
  Gene Ontology: Mol. function=nucleic acid binding; Cellular component= ribonucleoprotein complex; Biological process=mRNA processing
  Homolog annotation: Hit_ID=Q8SMH8; Match level="QueryCoverage=82%, HitCoverage=90%, E-value=6e-41, Identity=55%"; Hit description=RNA -binding protein
  Pfam annotation: Domain name=RRM_1; Domain location=104-175; Score =81.4; E_value=2.9e-21; Accession=PF00076.12; Description=RNA recognition motif. (a.k.a. RRM, R
  Subcellular localization annotation: CTP_CleavageSite=73; ConfidenceScore=5.87e-01
MAESCLLSSPSSLFHTKTKPSLFTPPSKPLTLQFSCLNSSVSLSLAAPTHRSPLVTFVAQTSDWAQQEEEQSLAETEAGLESWEPNGEDAGDESFVEPPEEAKLFVGNLPYDVDSQKLAMLFEQAGTVEIAEVIYNRETDQSRGFGFVTMSTVEEAESAVEKFNRYGCQMLTLKLHAGCTHDKDLARMHM

SEQ ID NO: 186863 - protein, 168 aa, Glycine max
  Coding DNA Sequence Number=SeqID_70085
  Gene Ontology: Mol. function=oxidoreductase activity; Cellular component=integral to membrane; Biological process=electron transport
  Homolog annotation: Hit_ID=P24465; Match level="QueryCoverage=63%, HitCoverage=22%, E-value=4e-34, Identity=61%"; Hit description =Cytochrome P450 71A1
MDTYLCVIGDSINGVQRGWGHKSLFEDSPSKCGGGGATDTAGTDTTFITLDWTMTELLMNPQVMEKAQKEVRSILGERRIVTESDLHQLEYMRAVIKEIFWLHPPVPVLVPRESMEDVVIEGYRAPAKTRVFVNAWAIGRDPESWEDPNAFNPESWEDPKFIIDFFFL

SEQ ID NO: 186864 - protein, 238 aa, Glycine max
  Coding DNA Sequence Number=SeqID_70086
  Homolog annotation: Hit_ID=Q6ZI49; Match level="QueryCoverage=78%, HitCoverage=81%, E-value=5e-56, Identity=46%"; Hit description =Rhodanese-like domain-containing protein-like
  Subcellular localization annotation: CTP_CleavageSite=54; ConfidenceScore=5.50e-01
MEALSLPINTLTNSSAKQHIYLSASSNYASVSSSLQLNPSLPTRPLTLRKSAVRVQAENEDFELKQMRDMAAARKRWEALIRDGKIKVLTPREAGYAVQLSNKPLLDVRPSNEHKKAWVRASTWIPIFDVDNKLDFGTIPRKVTSFVMGGWWSGMPTLSYDSQFLAKVEEKFPKDAELIVVCQKGLSWTDQQRAAAAKEGWGYRLVFSARLIGLILVVDALYIGAQQIGRYLQDIRTH

SEQ ID NO: 186865 - protein, 676 aa, Glycine max
  Coding DNA Sequence Number=SeqID_70087
  Gene Ontology: Mol. function=galactose oxidase activity; Biological process=cell wall catabolic process
  Homolog annotation: Hit_ID=Q10NU0; Match level="QueryCoverage=78%, HitCoverage=95%, E-value=1e-108, Identity=41%"; Hit description =Glyoxal oxidase, putative, expressed
  Pfam annotation: Domain name=DUF1929; Domain location=565-673; Score =93.3; E_value=7.5e-25; Accession=PF09118.1; Description=Domain of unknown function (DUF1929)
  Pfam annotation: Domain name=Glyoxal_oxid_N; Domain location=163-410; Score=357.0; E_value=3e-104; Accession=PF07250.2; Description=Glyoxal oxidase N-terminus
  Pfam module annotation: Pfam domain module=DUF1929::Glyoxal_oxid_N; Domain location=565-673::163-410
MDQSRKETEFALSALMEIPSQYKATLELNILGARRGKDIDRTPLPPPLYGAASFNSPKTSRQNSFRPSAPSSRHDVSTNPPATSASDNQVVVTAVACLLLLGITLNPRIGSVFLGCPICLTDPKDMAFWLRASDMLNGVNVRSSEGRKGQWQLLLNNTGVVGMHVALTYKDTVIMFDQTGAGQSGYRLRRRFNGSRCTINHHDLLDSTCYAHSVEYDISANKVRPLRLDTDPWCSSASFLSNGTLLQTGGFEKGAKRVRFYRPCGNHQCDWIQSKKTLSDERWYASSQILPEHNRVVVVGGRRVFTYEFVPKTSPGEKSFDLPFLHQTNDRDGGGNNLYPFLHLSSDGNLFVFANRDSILLNLRRNRVIKTFPRIPGEGSRNYPSSGSSVMLPLDHRDNFQKVEVMVCGGSSIGALEAARKGRFLEGLRSCGRMVITGNNNKWEMEYMPKPRLLHDMLILPTGNILIINGAKHGCAGYENARNASLEPYLYSPNKKLGKRFTMLKSTKIARMYHSSATLLSDGRVLVAGGNPHGRYIFHNVAYPTELRLQAFVPHYMESRYHNWRPSNMTIYGGGGRHAIGYGKEFRVEFFLEKRMQNNEVGFSAYAPPFTTHSFAMNQRMLKLRCKSLDRKGGGWVVAVLEAPPSPNVAPSGYYLLTVVNGGIPSMSQWVQFAHA

SEQ ID NO: 186866 - protein, 175 aa, Glycine max
  Coding DNA Sequence Number=SeqID_70088
  Gene Ontology: Mol. function=DNA binding; Cellular component=nucleus; Biological process=regulation of transcription
  Homolog annotation: Hit_ID=Q1SZA2; Match level="QueryCoverage=89%, HitCoverage=47%, E-value=2e-76, Identity=84%"; Hit description=No apical meristem (NAM) protein
  Pfam annotation: Domain name=NAM; Domain location=11-139; Score =276.4; E_value=5.5e-80; Accession=PF02365.6; Description=No apical meristem (NAM) protein
MDKDANSEIQLPPGFRFHPFDEELIVHYLRNKVTSSPLPASFIAEIDLYNYNPWELPSKALFGEDEWYFFTPRDMKYPKGVRPNRAAASSYWKATGTNKPIFTSCGMKSIAVNKALVFYKGRPPKGSKTDWIMHEYRLHDSMISNSKQGGSMRVGQFHEFNFSIWWFLMTNRVNY

SEQ ID NO: 186867 - protein, 163 aa, Glycine max
  Coding DNA Sequence Number=SeqID_70089
MISIQKKTKIMKKFSEDKSEDFKFKSLTSSGRIIHWICMYSMLPRVGTFQKINNHDPLVICCLLKKVPFSSPHLIINYMIKATQPMKSTFSVLYGMLMTLGEKNVATSKLIPHPGLKKACRCFDEEEEQNKEKKRNKKNEKEEKERKDTKRSPQLLTNFIKSG

SEQ ID NO: 186868 - protein, 38 aa, Glycine max
  Coding DNA Sequence Number=SeqID_70090
MAKQYLGTKILEIDRHKRSMPNLSPCEGVHLHVHPLRH

SEQ ID NO: 186869 - protein, 203 aa, Glycine max
  Coding DNA Sequence Number=SeqID_70091
AFVSPTGCPFPPARSRHQDIGIVPTRHPVDPKEPNRALGFPALVTGLSVSTTGCSFPPARSRHHDIGVAPTRHPVDPEEPNRALGFPALVTGLFQSYRVPVPLASSCHRDIGIMPARYSMDPKKSNRVLELPALIMGLCRFYGVPIAPSKVIRPPTNRAFIKKYCAPRQVQGETPQQPGDGRQWATDAPPPPLEFTSAHPQKG

SEQ ID NO: 186870 - protein, 181 aa, Glycine max
  Coding DNA Sequence Number=SeqID_70092
MQTSNRNEHPIANEDPIIRFHDENMEDFSEDENQQFFDHINKDSDDQSDDEGVGRPTTPLSPPLQYLQPRCPVDLNIDHLPHYIDRHHFVQQQHNVQPPIGALESLGACNSKRHNKWIIKSIRGHHICLVPMLEQDHWQLDKHIIAQIIQPIVKTNPTVSIKTLIAEIKIFMNYTPSYKKT

SEQ ID NO: 186871 - protein, 366 aa, Glycine max
  Coding DNA Sequence Number=SeqID_70093
  Gene Ontology: Mol. function=nucleic acid binding; Biological process= transport
  Homolog annotation: Hit_ID=Q8H6Q8; Match level="QueryCoverage=59%, HitCoverage=7%, E-value=4e-17, Identity=27%"; Hit description=CTV.20
  Pfam annotation: Domain name=zf-CCHC; Domain location=97-114; Score =30.4; E_value=6.5e-06; Accession=PF00098.13; Description=Zinc knuckle
MVKRFPKQKVALKICQDDKIQRQLAKEKAQTKRDLGSFCEQFGLPACPKQKKKQTSRKEAQDHKPANRRRFSKRRYSQKPSTSREMENPKQKIKLKITCYNCGKQGHISKYCRLKKKLRNLNLEPSIEEQINNLLIETSKEETETETSSSVLSDENLNLIQQDDQLSSTNDDGQINTLTREQELLFEAINSIPDPQEKKVFLEKLKKTLEVKPRQKDFITNNKFDKFIRSFFPGKIKWDEVTLPERWVMDKATPSIPRPAPTIEHIKQDNSGKVEITFNRRNSFSSRIEASRSEYESARRSFSVRTRSIPVGLTRSESHNQFPTVNLQGLDTTSSIPRTTYNQEQEDDQKSIQSPTYSSMEPYDVI

SEQ ID NO: 186872 - protein, 295 aa, Glycine max
  Coding DNA Sequence Number=SeqID_70094
MDKSKEVATPMTTNCYLSANGKGKSMDQIKFKGVEISLVGYSDSNFVGCKLDRKSTNGTFHLLEHIPFRCENTSAISLTKNPIMHSRIKHIEIRDHIRKELLEYHGLKKLVEMKGTFYLELVIFFYTIGHIDGEFCYLCDEAKGKQIVMTHEIWEDIVGLSLERMMVNEKGLKDAGGNSIRQGKGKILHMLLGKVKLNLVNVMVDNMMKAKRIGSFKCPYTVLISRILDHLKPEFEVKTKVLKQMSYTEVDKEGMDKLMRMHKEDYGELKAFFETISERLGDGSLLVGLLWRLDL

SEQ ID NO: 186873 - protein, 99 aa, Glycine max
  Coding DNA Sequence Number=SeqID_70095
  Gene Ontology: Mol. function=RNA-directed DNA polymerase activity; Cellular component=intracellular; Biological process=RNA-dependent DNA replication
MDVVERLPPPRDEKAVISFLGHARFYRRFINDFSKIARPLINLLAKDFPFHLNSDCLKAFEFLKGKLMTSLIILALNYGKEFELIHDAKGYAMRFVLRQ

SEQ ID NO: 186874 - protein, 112 aa, Glycine max
  Coding DNA Sequence Number=SeqID_70096
MTTSGRRSSGSYEGQFRASSGSGEGQFRKKFFRKLLPEDLLPECVVNFWMWLYDNLNVLVYDAYVLKMDEDQWRYDFAMSQEVHMDYDYDNQEECGVNEPHVDCSNAFNTSQ

SEQ ID NO: 186875 - protein, 110 aa, Glycine max
  Coding DNA Sequence Number=SeqID_70097
LCSVYVSHREWRSIYGHAGSLTRLMIVKPHLKFFSFGDALSLVVPIAAVLLPKRMISLEAVGTNHRGVQGDLRMPDRRKEAIPLLWVLPFYGKSGGSSQDLGARVRSSEA

SEQ ID NO: 186876 - protein, 58 aa, Glycine max
  Coding DNA Sequence Number=SeqID_70098
MTPLVQGPSMQDRHRGDGGMAAWRRHGCANETRKKKQRNLAGGQVAHRRDRKERSNRS

SEQ ID NO: 186877 - protein, 100 aa, Glycine max
  Coding DNA Sequence Number=SeqID_70099
  Homolog annotation: Hit_ID=Q9LS27; Match level="QueryCoverage=56%, HitCoverage=16%, E-value=9e-15, Identity=65%"; Hit description =Arabidopsis thaliana genomic DNA, chromosome 5, BAC clone:F10E10
MKLEELVQEDSRIDRYPKLVKGESKVVWEWQVEGSLSASKMKKRRDASKTMVNESTDLNHQQHPAMKTVKLFCRAINLMQSLRYHFFDLETPPNSDYFPL

SEQ ID NO: 186878 - protein, 248 aa, Glycine max
  Coding DNA Sequence Number=SeqID_70100
  Homolog annotation: Hit_ID=Q1SH04; Match level="QueryCoverage=26%, HitCoverage=40%, E-value=2e-11, Identity=68%"; Hit description =Adenylate cyclase
MTYSLFHVSYLCIANLSIRASFVGSITMHRGNMKGYIKAMSYNKGSSYFDKNKNRTAWVLLHAAHAVHQHHPSLQRSDAVLVVAVEAEAEEDAAHRELEGGTIEEEVLLAALASVIRNLTSTSIGEETRESAVRILRGETNAMGLGRGIFAIAIQLTEESSGASGGGGGGGGGIAAASFLEFFFVFNLDFDFNWLSSQHFVTMMLISLSTPISILDLVGDVGCSIYIKRYYNARINQFVISYQMTGLH

SEQ ID NO: 186879 - protein, 338 aa, Glycine max
  Coding DNA Sequence Number=SeqID_70101
  Homolog annotation: Hit_ID=Q9LS27; Match level="QueryCoverage=86%, HitCoverage=73%, E-value=1e-60, Identity=44%"; Hit description =Arabidopsis thaliana genomic DNA, chromosome 5, BAC clone:F10E10
MKQNDRPRECLSNSNSEGCSLSLMGREPPQNLLPSKHDFPRLVLVIALASLVAWTCNFLFTSLFHPPSKPFCDTNLHSPDYFLDICQPCPSNGECNDGKLECHQGYQRHGNLCAEDGDINESARKLLERVEHHLCEKYAQFLCTGTGIIWVHEDDLWNYFEPVGNVKVDNALYNYTKQRAVETMGKLLETRLNSSHGYILFSCFLIKMKEFKCPDQLAEHYKPYTCCIRQWISQHILVVLPICAMLVGCTALCWNVRQKLSMSRRVEELYDKVCEILEDNALTSKSANGECEPWVVASRLRDHLLLPRERKNPLLWKKLTPCLSWTSAEVTLVHELIL

SEQ ID NO: 186880 - protein, 129 aa, Glycine max
  Coding DNA Sequence Number=SeqID_70102
  Gene Ontology: Mol. function=cytochrome-c oxidase activity; Cellular component=mitochondrion; Biological process=electron transport
  Homolog annotation: Hit_ID=UPI0000162F59; Match level="QueryCoverage =88%, HitCoverage=84%, E-value=1e-17, Identity=40%"; Hit description =cytochrome-c oxidase
  Pfam annotation: Domain name=COX6B; Domain location=63-128; Score =25.6; E_value=2.7e-07; Accession=PF02297.7; Description=Cytochrome oxidase c subunit VIb
MSAAQVDPHDKMRARDVNKVARGEQAPRPAHEFGTVSPPPPPSSTHSIDTKRNKKDEKPSIAENGAELANSTDYKTRQCYVKYVECIQQKGEKATDCEKLGTHFRSFCPTEWIAEWDKEREEGKFPAEI

SEQ ID NO: 186881 - protein, 170 aa, Glycine max
  Coding DNA Sequence Number=SeqID_70103
  Homolog annotation: Hit_ID=Q941L2; Match level="QueryCoverage=95%, HitCoverage=85%, E-value=2e-16, Identity=35%"; Hit description=BON1 -associated protein 1
  Pfam annotation: Domain name=C2; Domain location=2-84; Score=13.3; E _value=0.015; Accession=PF00168.20; Description=C2 domain
MTILSAENLQMNRKSIRGSTFVTVQSDASSDDTSAATKVDLEGGSYPSWNEKVVMDVPLHARFITVEVKCKTSSSGSNSVGVAQIPVSDFIGGYMPENQLHFLSYRLWDGKVRRNGVINISVRVKVAEHSSCNLNSMSLSAVTGVPVAGDGSSGVVTGIPAVWVNYQRNH

SEQ ID NO: 186882 - protein, 520 aa, Glycine max
  Coding DNA Sequence Number=SeqID_70104
  Gene Ontology: Mol. function=GTP binding; Cellular component =intracellular
  Homolog annotation: Hit_ID=UPI0000162CAC; Match level="QueryCoverage =65%, HitCoverage=42%, E-value=5e-67, Identity=38%"; Hit description =GTP binding
  Pfam annotation: Domain name=GTP1_OBG; Domain location=193-357; Score= -104.7; E_value=0.045; Accession=PF01018.12; Description=GTP1OBG family
  Pfam annotation: Domain name=MMR_HSR1; Domain location=399-503; Score= 61.0; E_value=3.8e-15; Accession=PF01926.13; Description=GTPase of unknown function
  Pfam annotation: Domain name=Ras; Domain location=4-118; Score=32.3; E_value=1.1e-11; Accession=PF00071.12; Description=Ras family
  Pfam module annotation: Pfam domain module=GTP1_OBG::MMR_HSR1::Ras; Domain location=193-357::399-503::4-118
  Subcellular localization annotation: CTP_CleavageSite=30; ConfidenceScore=5.07e-01
MASVFLGDQSVGKPASSLASCMTNLTTLIRDTAGQERFRSLIPSYIRDSSVAVRIERGSDAIIVHVGNKTDLVNKRQVSTEEGEAKSRELNVMFIEASAKAGFNIKDILCENFLEHLNLIVPHCSATIAAATTAPLNCSATRLVVALEDKATVIKHTEAFTQRCISRWSVTLYARYSDIPQNKSKLAPLQRRMVDQCKMFAKAGDGGNGCSILRKGRSDEMWMLCNGGYDNATLVSVFNVGGNGGRGGDVILLTACVSIGTVLHLVNGDIPSVVKTQSSTDVDPWDIPGALVDDVPDPSNGSTSSVTNEETDVKKSEKSRQVASTDVFSQLSTSNGAPEFGTEDIGEKQEILYNVAELTEEGQQIVIAHGGEGGLGNVSCSKDSRKPVTVQDPDTLSANAGKSTLLGAISRAKPAVGDYAFTTLRPNLGNLDYDDLSITVADIPGLIKGAHQNHGLGHAFLGNTKCTKGIPPWEQLRNLILELEYHQDGLSNRPSLIVANKTDEEGIADLKAGLKDARQC

SEQ ID NO: 186883 - protein, 251 aa, Glycine max
  Coding DNA Sequence Number=SeqID_70105
  Gene Ontology: Cellular component=extracellular region; Biological process=sexual reproduction
  Homolog annotation: Hit_ID=Q850K7; Match level="QueryCoverage=95%, HitCoverage=94%, E-value=1e-83, Identity=63%"; Hit description =Expansin-like B1 precursor
  Pfam annotation: Domain name=DPBB_1; Domain location=63-141; Score =79.6; E_value=9.7e-21; Accession=PF03330.8; Description=Rare lipoprotein A (RlpA)-like double
  Pfam annotation: Domain name=Pollen_allerg_1; Domain location=149 -229; Score=28.9; E_value=6.8e-06; Accession=PF01357.11; Description =Pollen allergen
  Pfam module annotation: Pfam domain module=DPBB_1::Pollen_allerg_1; Domain location=63-141::149-229
MALYLFCRLFAITLIFMQTLADTSCTDCFIHSRAAYYPNSEEHGTDVGACGFGSFGATVNGGDVSAASSLYRNGVGCGACYQVRCTNSAYCSENGVNAVITDQGSSDNTDFILSKHAFSRMAQTTDAAASLLALGVVDIEYRRFPDKNITIKIDESSNNPYYLAFVIWYQQGRRDITAVQLCETQNFVCKLLDRSHGAVWTTTSPPRGPLSLRMLFSDEEEEEETWLVPVNNIPGDWKAGETYDSGIQVNQ

SEQ ID NO: 186884 - protein, 493 aa, Glycine max
  Coding DNA Sequence Number=SeqID_70106
  Gene Ontology: Mol. function=histone-lysine N-methyltransferase activity; Cellular component=nucleus; Biological process=chromatin modification
  Homolog annotation: Hit_ID=Q8VZ17; Match level="QueryCoverage=45%, HitCoverage=30%, E-value=2e-59, Identity=56%"; Hit description =Histone-lysine N-methyltransferase, H3 lysine-9 specific SUVH6 (EC 2.1.1.43) (Histone ...
  Homolog annotation: Hit description=H3-K9 methyltransferase 6) (H3-K9- HMTase 6) (Suppressor of variegation 3-9 homolog protein 6) (Su(var)3- 9 homolog protein 6)
  Pfam annotation: Domain name=YDG_SRA; Domain location=330-482; Score =269.5; E_value=6.8e-78; Accession=PF02182.8; Description=YDGSRA domain
MTILLAVRDFPDGCGAFPKFVEDIKNKNDQHLARRYLPPRKASAVRDFLPLFGACNDMDVCQEEGKKVGLQNLAVDDNNQLKKVSAADDVKEEVKSNIQDDYSRKRNIVDFYQNQTDSERNVTEGLKELRAFEEPSSQMKMAPEKKKFYRLQVSSSDMKVVLGFMVKSECPWRSGQVSSHFKLGDAKNEDKRKKVVSFALPDRSRRAIKTKCNFGQKPFKKKANSASEGMGELEIWGKEGWLDPVENSEESHEFDVNVTPSSHSNFTGGDESDSDVTREKVREALRLFQVVCRSLLEEGESKSNELGKRKRVDLIAARILKDNGIHVNSGKKILGPVPGVEVGDEFQYRVELNIIGLHLQIQGGIDYVKHNGKILATSIVASGGYADYLVNSDVLVYSGQGGNVMSNDKKPEDQKLKRGNLALKNSSEEKNPVRVIRGSESMDDKYKTYVYDGLYVVESYWQDRGSHGKLVYRFRLKRIPGQKLALKEVKKSK

SEQ ID NO: 186885 - protein, 281 aa, Glycine max
  Coding DNA Sequence Number=SeqID_70107
  Gene Ontology: Mol. function=nucleoside-triphosphatase activity; Cellular component=mitochondrion; Biological process=ATP-dependent proteolysis
  Homolog annotation: Hit_ID=O64948; Match level="QueryCoverage=99%, HitCoverage=37%, E-value=1e-104, Identity=62%"; Hit description=Lon protease homolog 1, mitochondrial precursor
MEQVEQDPDFIMLSRQFKATAMELISVLEQISMLDSVDPKVRLSKATELVDRHLQSIRVAEKITQKVERQLSKSQKEFLLRQQMRTIKEELGDNDDDEDDLAALERKIQSAGMPENIWKHAHRELRRLKKMQPQQPGYNSSRAYLDLLADLPWQKASRELELDLRAAQERLDTDHYGLVKVKQQIIEYLAVRKVFNTLLLCLPLKSDARGPVLCFVGPPGVGKTSLASSIAAALGRLKFSRVAVCNPVMLLDEIDKTGSDVRRDPASSLLEVLDPEQKQNI

SEQ ID NO: 186886 - protein, 90 aa, Glycine max
  Coding DNA Sequence Number=SeqID_70108
MTLRGLVLPVGGLENQESRSCASTTSLRRVCAALEMQVRAMKAHADLLTAGAPPPTPIGLLRPHKNCPYLRRNPTPPPSSTLRATQNQPW

SEQ ID NO: 186887 - protein, 2548 aa, Glycine max
  Coding DNA Sequence Number=SeqID_70109
  Gene Ontology: Biological process=protein localization
  Homolog annotation: Hit_ID=Q336R4; Match level="QueryCoverage=81%, HitCoverage=98%, E-value=0.0, Identity=56%"; Hit description=C2 domain-containing protein, putative, expressed
  Pfam annotation: Domain name=DUF1162; Domain location=1423-1728; Score=-88.4; E_value=0.02; Accession=PF06650.2; Description=Protein of unknown function (DUF1162)
  Pfam annotation: Domain name=DUF946; Domain location=406-908; Score= -395.9; E_value=0.0041; Accession=PF06101.2; Description=Plant protein of unknown function (DUF946)
  Pfam module annotation: Pfam domain module=DUF1162::DUF946; Domain location=1423-1728::406-908
TGFNLTAASSEAIIYMGNGKKLQFRNVVIKVGQHLDSCVFLGANSSYSALEDDHVYLEELVESPQSRSLRGSVDELPSQNSAVNNSTELIIELQAVGPELTFYNTSKDVGGLLNLSNKLLLAQLDAFCRLVLKGSNTEMSADVLGLTMESNGIRILEPFDTSLKYSNASGRTNIHLSVSDIFMNFTFSILRLFMAVEDDILAFLRMTSKKMTIVCSHFDKVGTIKNSHTDQTYAFWRPHAPPGFAVLGDYLTPLDKPPTKGVLAVNINSVTVKRPISFRLVWQLLTSVGIEGEEVNNSDLLWKTEADAICSIWFPEAPKGYVALGCIVTHGKTPPPLSSSFCIPSSSVSPCSLRDCITIGSTDISPSSVAFWRVDNSVGTFLPVDPVSLSLMGKAYELRCIKYDFLKPSSAALSSLDSHAPSGGHQALQPDQSVGANSNRRCEPVASFELVWWNQGSNSRKRLSIWRPVVPMGMVYFGDIAVKGFEPPNTCIVVHDSRDENIFKTPLDFQLVGQIKKQRGMESMSFWLPQAPPGFVSLGCVVCKGKPKQNDFSTLRCMRSDLVAGDKFLEESVWDTSDAKHVTEPFSIWAVGNELGTFIVRGGFKRPPRRFALKLADSNVPSGSDATVIDAGIGTFSMALFDDYSGLLLEELVVYKVLEPPWKASPGAAVKLCLGDLLVMGSNPETASLHMQGTGYLNCTVGFSLAARSYNDKYEAWEPLVEPVDGFLRQPAKRPQLQRARGSAVKEAYQHLLRCGNIGAVRMGIVPWSSKIGPLDQLFLGVDEGIYILYFGHITSRCGISNTVIQLHSQDAFSPTYGGNSIIDTLHKKNYYIIPQNKLGQDIFIRVTEARGLQNIIRMPSGDMKAVKVPVSKNMLESHLKGKLCRKIRTMVTIIIAEAQFPQVEGSDSQQYTVAVRLYSNQSLPSDSSVYQQSARTRGRRAHHLLPSDLELVKWNEIFFFKVDSLDAFSKKPCKLQCAILVHNSEVETNNQLSNYDAHKSGFIQISPSKEGPWTTVRLNYAAPAACWRLGNAVVASEASVKDGNRYVNIRSLVSVRNNTDFVLDLCLTSKSLSEKGNLLKNSINSESIHTESYRIQTDEFFETEKLTPHIGWVHCSGYSENQMSDRGKSHQVFPGIDLPPGWEWIDDWHLDTKSPNTSDGWIYAPDVESLRWPESFDPKVSLNSARQRRWLRNRKLIAEDLKHEISVGQLQPGETAPLPLSGLTQSVQYFLQLRPSENSCEYSWSSVVDRPRQPEEIGRGGQCSNLCVSALSESEELLCCSEVHGTSGGSHKLWFCVSIQATEIAKDIHSDAIQDWCLVVKSPLIISNFLPLAAEYSVLEMQSSGHFLACSRGVFLSGKTVHIYSADIRNPLFLSLLPQRGWLPIHEAVLISHPHENPSKTISLRSSISGRVIQIILEQNYNKEHTLLAKTIRVYAPYWLEVARCPPLTFRLLDMSGKRHMPKVAAQFQTNKKNGLILEEITEEEIYGGYTIASAFNFNILALSVAIAQSGNEHFGPVTDLAPLGDMDGSLDIYAYDGDGNCLRLIISTKPCPYQSVPTKVISVRPFMTFTNRLGQDIFLKLSTEDEPKVLRASDSRVYFVCRGTGGPEKLQVRLEGTTWSFPLQIVKEDTISLVLRMNDGTIKFLRTEIRGYEEGSRFIVVFRLGSTDGPIRIENRTTNKVFSIRQSGFGEDVWIHLQPLSTANFSWEDPYGNKFLDAKLSDDDSNTIWKLDLERTGLSSAEFGLQFHVIDRGDIIIAKFTNDGMPSSSSYEEIRGPMSSGKGGVSGVQAEMQSSVTPFELLIELGVVGISMADHRSKELSYLYLERVFLTYSTGYDGGKTSRFKLIFGYLQLDNQLPLTLMPVLLAPEQTSDVQHPVFKMTITMQNENKDGIQVTDKCWRLEIHEPIIWAIMDFYNNLQLDRLPKSSTVTEVDPEIRFDLIDVSEVRLKFALETAPGQRPHGILGIWSPILSAVGNAFKIQVHLRRVMHRDRFMRKSSIVPAIGNRVWRDLIHNPLHLIFSVDVLGMTSSTLASISRGFAELSTDGQFLQLRAKQVRSRRITGVGDGFIQGTEALAQGVAFGVSGVVRKPVESARQNGILGLAHGLGRAFLGFIVQPVSGALDFFSLTVDGIGASCSKCFEVFNNKTAFHRIRNPRAVHSDGILREYCEREAIGQMVLYLGEASQQFGCAEIFKEPSKFALSDYYEEHFTVPHQRIVLVTNKRVMLLQCLAPDKMDKKACKIIWDVPWDELMALELAKAGSSQPSFLILHLKHFRRSENFVRVIKCNSVEVFEGREPQAIKICSVVRRAWKTYQSNMKNLILKRQVHFSWTEVDSREPRIPNKAIISSREISSNSTASDDRRFVRHIITFSKIWSSEQEYNGRCSLCSRKQISQDGRICSIWRPVCPVGYIYIGDIARVGIHPPNVAAVYRKIDGFFALPMGYDLVWRNCPEDYVTPLSIWHPRAPDGFVAPGCVAIAGYLEPEPDLVYCIAESLVEETEFEELKYRVMLCILLLYDKARKNPTGSQRGSAPKNVRVPSPKEDSN

SEQ ID NO: 186888 - protein, 145 aa, Glycine max
  Coding DNA Sequence Number=SeqID_70110
  Homolog annotation: Hit_ID=Q6K796; Match level="QueryCoverage=92%, HitCoverage=3%, E-value=4e-28, Identity=45%"; Hit description =Vacuolar protein sorting 13C protein-like
MILEFTSFSNDDEDYEGYDFSLFGELSEVRIVYLNRFVQEVVGYFMGLVPDSPKSVVKVTDQVTNTEKWFSASEIEGSPAVKFDLSLKKPIILMPRKTDSLDFLKLDIVHITVKNTFQWIGGSKSEINAVHLETLTVQVRLKTST

SEQ ID NO: 186889 - protein, 154 aa, Glycine max
  Coding DNA Sequence Number=SeqID_70111
MSLHSSSSVNGEGSTPKDPLGCHSSHTKHHSHRREKDRRPQEVNISLALLGRIASQGSMSVEEYRQQMELLLLRARLREEERTSIARFLSGLNIEVRDKVELFPYRDLDELVQFCIRVEQQLNRKPSKSYGFHSYPRKDQAHEILGDAPSKPKE

SEQ ID NO: 186890 - protein, 115 aa, Glycine max
  Coding DNA Sequence Number=SeqID_70112
MGETHEAPHHNLVDFEPCHGHATKGQAVGGVPLPNTLEGPQFRPQPLYFAVRRIPPVIAEKGKLDHIEERLRAIENVLSEDGGARLTGALSKGGKMRGVATNAYLWKSSEKPKET

SEQ ID NO: 186891 - protein, 101 aa, Glycine max
  Coding DNA Sequence Number=SeqID_70113
MSWMNIKSALPLNPKCHFLQHSYVQVDGIRVKRWQCWWLAVVWSIWQMRNRIIFSNAIFNGNKLIEDAMFLIGTWLRNLEKDFSLHFNHWSSHIRQGFLYQ

SEQ ID NO: 186892 - protein, 91 aa, Glycine max
  Coding DNA Sequence Number=SeqID_70114
MGETEGPPKCLARVHHQLLVPQWRIRGKARRRLDFGEVFHVPPSWVERHVNDQIEVIGSQWTKKWCNSIHLSPQLSQVGYSTAGKCTGSHK

SEQ ID NO: 186893 - protein, 87 aa, Glycine max
  Coding DNA Sequence Number=SeqID_70115
MEMALRASENSLANGDLGFTLCSREREQRRLHKNTAPISGLSETSSDHEDTEPEQDNHGMIDVGIAERLFVTGVLDELKICFSYSYQ

SEQ ID NO: 186894 - protein, 287 aa, Glycine max
  Coding DNA Sequence Number=SeqID_70116
  Gene Ontology: Mol. function=RNA-directed DNA polymerase activity; Cellular component=nucleus; Biological process=RNA-dependent DNA replication
MGAKESDGQAGGATEAVIVERKLRPKEDCLGELGDLGKFNLALLGKWRWNLFNHHGELWAQVLESKFGGWRNLDATRRSIRESLWWRDLGYACNLSEKGSWLKNGTKWKVGCGSKVLFWEDGWMEDGVSLKEKYPRLYQISQQQNRHIQQMGTITDTGWEWKLQWKRFFLEAEIDTAAKFMKHLHRLTIHVQQQDMCRWEGDSSDKYTMGSAYELLNRNFPLESLDEMFKALWEIKVPSKATIFAWILIRERLPTKSNLRRRNVETNDVTCAFCRSHDEDKAHLFFT

SEQ ID NO: 186895 - protein, 325 aa, Glycine max
  Coding DNA Sequence Number=SeqID_70117
  Homolog annotation: Hit_ID=Q6K796; Match level="QueryCoverage=42%, HitCoverage=3%, E-value=2e-25, Identity=44%"; Hit description =Vacuolar protein sorting 13C protein-like
MRMVRGKGEFWECFMNPDILSCSNPGHPFAAGVMLDKLLAVTVDDSGKETFITGGALDRIQKSVELDRLAVYLDSDIIPWHVNKAWEDLLPSEWFQIFKFGTKDGKPADNLLRKHSYLLQPVTGKAKYSKLLPTEVADSKQPLQKAMVNLDDVTISISKDGYGDIMKLADNFAAFNQRLKYAHYRPLVPVKADSRSWWKYAYKAVSDQIKKASLTELVVYVSKRAMYEGAYQKDPTRWVLMQWVALYDRASLDTVVRLLSCDTEVKGSNRRNSLSTCNGEAVYIYPPQIPLDGSSCNGLPFMLCCSQSMMLLYSLRCFFTTKSLI

SEQ ID NO: 186896 - protein, 225 aa, Glycine max
  Coding DNA Sequence Number=SeqID_70118
MQEKKINEKISIDSAIRAYIETLNIGKLVRFQSAEAAGRRECCKISALNQLAGDARLSNKCAMPEAACGCMYKKVKEREDGGWWCKERRRKEKIRVRGAPPPEIAGGSAQQPSVEVEKGGLIEKALRERAESLVELVGSEGNAAHGVDFVDYVQICNVSPPAVARCHGEEECLDVWRVLATEVDACFNDDDVSTIEADSQWLKKEFSLMKLTQLNVSTELTQLDI

SEQ ID NO: 186897 - protein, 301 aa, Glycine max
  Coding DNA Sequence Number=SeqID_70119
  Homolog annotation: Hit_ID=Q6K796; Match level="QueryCoverage=89%, HitCoverage=6%, E-value=4e-21, Identity=28%"; Hit description =Vacuolar protein sorting 13C protein-like
MSWEQVLRYASLRKRYISLYASLLKSDPTQVTISGNKEIEDLDRELDIELILQWRMLSHKLLEKSAESNHNMRKQKAQKSWWSFGWTSQSSKEESEEFNFSEEDWNQLNKIIGYKEGDDGQLAVNSKADVIHTFLEVHMNHNASKLIGETKESVAELSCEDLSCSIILYPETKVFDIKLGSYKLSSPKGLLAESATSYDSLVGVFHYKPFDDKVDWRMVAKASPCYMTFTDLSLEFGQYMKDSIDQIVKFFESNTAVSQTIALETAAAVQNKCSIDSELEEYIMKLTSSLVHPITQMMVDL

SEQ ID NO: 186898 - protein, 215 aa, Glycine max
  Coding DNA Sequence Number=SeqID_70120
  Homolog annotation: Hit_ID=Q6K796; Match level="QueryCoverage=90%, HitCoverage=4%, E-value=5e-25, Identity=32%"; Hit description =Vacuolar protein sorting 13C protein-like
MTIDEVKRTAQQQMNRALKDQARFSLDLDIAAPKITIPTDFCPDNTHATKLLLDLGNLLIRTQDNYQQESAEDNMYLRFDLVLSDVSAFLFDGDYHWSQVSLNKSAHSTNSGFFPIIDKCGVILQLQQVRLETPYYPSTRLALKLPSLAFHFSPARYHRLMHVIKIFEEEDGDSSEFLRPWNQADLEGWFSLLTWKVVVSFRPSRLPIVVHVAPS

SEQ ID NO: 186899 - protein, 126 aa, Glycine max
  Coding DNA Sequence Number=SeqID_70121
MAHKEPNTKSKSDEKTEIEDDSATKMLETMKMVKKIKVKDKAAVIRDFNNLVPAEMMEEEKQKLVMKTEQWEEECVVTTMEIQVVHSELVFLSQLKPSDLGFVWIIMDIERKEIKKKERKIGIDMN

SEQ ID NO: 186900 - protein, 121 aa, Glycine max
  Coding DNA Sequence Number=SeqID_70122
  Subcellular localization annotation: CTP_CleavageSite=15; ConfidenceScore=5.21e-01
MPYPNDVTSSTWRSCCSTRRSCSENPKRSETLFLKSSHVAKMIKSSKQKSPRLWQSWLNNVVEAEVVESNDLVADAGRDIDDAAGVKDDVRECDTPFPIDLLPHTLPSSITFRCSTAALLH

SEQ ID NO: 186901 - protein, 84 aa, Glycine max
  Coding DNA Sequence Number=SeqID_70123
MGGGGGQARWRHRVSLASGYVYEQNIVTVKNRHYSILRRSDHIRRTTTTIAAIKKDENDDDGDKKKNKKEDTKTSQGMSDSELE

SEQ ID NO: 186902 - protein, 122 aa, Glycine max
  Coding DNA Sequence Number=SeqID_70124
  Homolog annotation: Hit_ID=Q9FGQ9; Match level="QueryCoverage=89%, HitCoverage=62%, E-value=5e-27, Identity=63%"; Hit description =Arabidopsis thaliana genomic DNA, chromosome 5, TAC clone:K14A3
  Pfam annotation: Domain name=DUF581; Domain location=47-83; Score =0.3; E_value=0.012; Accession=PF04570.5; Description=Protein of unknown function (DUF581)
MVSCLGLWVMALSTTEVLGAIRFSRRDLGDFMMQDSKITNPTFFKLVLFARSVSGIIVTSSWDTPFCSEECRQEQMERDEAKEKNNNLSSSMKALRKKEQRNSVSPNKTQDYSFRAGTVAAA

SEQ ID NO: 186903 - protein, 79 aa, Glycine max
  Coding DNA Sequence Number=SeqID_70125
MCWWGQRASRLAKRDPFRAWVTLGNWSEKQGSGKKRNRGFRFRSGKKRVAMHVQLDSSLVSHFSLPLKARASQHFCVFS

SEQ ID NO: 186904 - protein, 58 aa, Glycine max
  Coding DNA Sequence Number=SeqID_70126
MKETNLGQAKQKKTTGGVEPMWQTRRNVVPGNNHMKWQFPITSLALAVPQFTQENEGL

SEQ ID NO: 186905 - protein, 63 aa, Glycine max
  Coding DNA Sequence Number=SeqID_70127
  Subcellular localization annotation: CTP_CleavageSite=43; ConfidenceScore=5.03e-01
MEMEQMVFVSVEKEATGTTIILFFVFTNFALRVVGGFCRRNCLCMAHASRVSFAFFTALVLPQ

SEQ ID NO: 186906 - protein, 329 aa, Glycine max
  Coding DNA Sequence Number=SeqID_70128
  Gene Ontology: Mol. function=shikimate kinase activity
  Homolog annotation: Hit_ID=Q9FJQ8; Match level="QueryCoverage=99%, HitCoverage=99%, E-value=5e-47, Identity=39%"; Hit description =Similarity to S-ribonuclease binding protein
  Subcellular localization annotation: CTP_CleavageSite=61; ConfidenceScore=5.05e-01
MGAVQAQYPSNVLFLNSKTGQEAHDYSLQSPPGQQLLDQSHMLFNNGGTNSRKRGRETTTAAATGIAPNVINSFSLQSQSPQAQLIDLTQLHNHNQNVVSTGLRLSFGDQQQQRQQLQHHQQQHGCHSSPFISLLSEEGLSSQIKQQRDEIDQFLQAHGEQLRRTLAEKRQRHYRTLLRAAEESVLRRLREKEAEVEKATRRNAELEARAAQLSVEAQLWQAKAKAQEATAAALQAQLHQAMMSSGGGEDGGGGGLSCAGGEAEDAESAYVDPERVGPTPKCRGCAKRVASVVVLPCRHLCICAECDGHFRACPVCLTVKNSTIQVYLS

SEQ ID NO: 186907 - protein, 109 aa, Glycine max
  Coding DNA Sequence Number=SeqID_70129
  Subcellular localization annotation: CTP_CleavageSite=39; ConfidenceScore=5.01e-01
MSVATYPSMGGRGKKPKVHLPKRKMHGVTTNVYLRENVRETKKRRFAKLEKKGSGVVYAWGREKTGRLCSEDSRPDGEKENNSRQRKTQKDYKRGINETLGLIRILVVD

SEQ ID NO: 186908 - protein, 50 aa, Glycine max
  Coding DNA Sequence Number=SeqID_70130
  Gene Ontology: Mol. function=metal ion binding
  Homolog annotation: Hit_ID=Q5N6Z8; Match level="QueryCoverage=96%, HitCoverage=10%, E-value=2e-15, Identity=85%"; Hit description =Copine III-like
MAMTIVEQSGGQYHVLVIIADGQVTKNVDTKHGKLSSQEQKTVDAIVAAR

SEQ ID NO: 186909 - protein, 213 aa, Glycine max
  Coding DNA Sequence Number=SeqID_70131
MMASRKCCTGPGQPLGGYSTWDSFWFALETTWVRLQGRTIRFNTEALHEFLGTPVIVLEKEHLTSYPQYLHTYPNREAIAVELCTPGAIHVERRGSFMEDSAEGLHHLGLDLERVVLLQLRSDLPHISRAKVGPGLSYSRRTTTIGRPAFCHIYFYLPFFFLLFLVGASLLDDAEPHGQRLIIQNLHQFFLHHSMEPPLMIVRASGKCTGSHK

SEQ ID NO: 186910 - protein, 507 aa, Glycine max
  Coding DNA Sequence Number=SeqID_70132
  Gene Ontology: Mol. function=RNA-directed DNA polymerase activity; Biological process=RNA-dependent DNA replication
  Homolog annotation: Hit_ID=Q1S3H4; Match level="QueryCoverage=71%, HitCoverage=86%, E-value=2e-93, Identity=45%"; Hit description =Integrase, catalytic region
  Pfam annotation: Domain name=rve; Domain location=202-325; Score=4.9; E_value=0.0023; Accession=PF00665.16; Description=Integrase core domain
AWVSPFQVVPKKGGMIVVCNEKNDLIPTRTVTGWRMCIDYRNLNDAMRKDHFPLLFMDQMLAWLAEECRLTYVMLTIVYALEKFRSYLGASRVIIFINHVAIKYHFTKVDSKPRVIRWVLLIQEFDVVIKYKEGSENVIAGHLSKLVNEEVSFQVTSIRISGRSSSMTFVSMFVMIPTYSRLERIICGEDVSPWKKPEDGFFWPSIFKDTHDHVLHYDQWNQYILVTIDYVSKWIEVVVASNIDAKTIIKFFKKNIFSHFGVPEYSSMTETNGKAEISNKELKKILEKTMASSRKDWAAKLNDALWAYETAFKTFIGLSPFQMVYGKACHLLVELEHKAYWALKFLNFDESLSGEKRKLQLLELEEMRLNAYESSKIYKEKMMVYHDQKLIQKTFKPNQQVLLYNSRLRLFPGKLKSKWSRPFIIKEVRPYGVVELLDHASNCGVMIHETLMIFKKKLQTPSVPSRAKRNHEIGTLSPVISLSASCALSAKLAISTRLITVGSWKTT

SEQ ID NO: 186911 - protein, 97 aa, Glycine max
  Coding DNA Sequence Number=SeqID_70133
MEGFAAQVAPPMMGREMITMIVDTLPVFYYEKMVGYMPSSFADLVFTSKRIEMGMRRGKFDYAASMKRKPGENGENKKEGETYVVIVVSTWPNFPLA

SEQ ID NO: 186912 - protein, 298 aa, Glycine max
  Coding DNA Sequence Number=SeqID_70134
  Gene Ontology: Mol. function=DNA binding; Cellular component =mitochondrion; Biological process=DNA integration
  Homolog annotation: Hit_ID=Q1SIP9; Match level="QueryCoverage=85%, HitCoverage=28%, E-value=4e-78, Identity=52%"; Hit description =Integrase, catalytic region
NPDGSIAHHKAQLVAKGFYQRPGIDYKDTFSPVVKPQAIKIVLCIALSKGWSLTQMDVNDALLHGFVDPTFPHHVCKLHKSLYGLKRAPQAWYHELKSFVVAYGFLNSKYDSSLFIYKHDNATTYFLVYVDDLLLTGNNDNFISQFKATIVAKFSLKDLWRPSHFLGVELIPTSSGFFLSQQYYIKDIRQKENMINAKPVGTPMSTTCSLGTNDDTPSHDLSSFRSLIGSLHYLSITRLDVAFSVNKLSKYMQAPSSQYGGILVYRGKRDLHMRDRSLTTNIISHIQMVGMCENEFHT

SEQ ID NO: 186913 - protein, 363 aa, Glycine max
  Coding DNA Sequence Number=SeqID_70135
  Gene Ontology: Mol. function=sugar porter activity; Cellular component=integral to membrane; Biological process=transport
  Homolog annotation: Hit_ID=O52717; Match level="QueryCoverage=90%, HitCoverage=77%, E-value=1e-171, Identity=88%"; Hit description =Ribitol transporter
  Pfam annotation: Domain name=MFS_1; Domain location=1-299; Score= -9.7; E_value=0.00088; Accession=PF07690.6; Description=Major Facilitator Superfamily
MFIGFVLWCVFHVLFLVFGLGRANYALILLFYGIRGLAYPLFLYSFIVAIIHNVRSDSSSSALGWFWAVYSVGIGVFGSYIPSFTIPHIGEMGTLWLALAFCVTGGLIAVAALRNTETPRHMQNLTTREKFSELGRAVTLIYTNRSIMLSSIVRIINTLSLFGFAVVMPMMFVDELGFTTSEWLQVWAAFFFTTIFSNVFWGIVAEKLGWMKVVRWFGCIGMALSSLAFYYLPQHFGHNFAMALVPAIALGIFVAAFVPMAAVFPALEPEHKGAAISVYNLSAGLSNFLAPAIAVVLLPHFSTIGVVVAYTALYLLAFCLCPFIRVDQPGFALTYSPAADGSVAPRRGFPYGKICRSAVRHPG

SEQ ID NO: 186914 - protein, 447 aa, Glycine max
  Coding DNA Sequence Number=SeqID_70136
  Gene Ontology: Mol. function=hydrolase activity; Cellular component =membrane; Biological process=dodecyl sulfate metabolic process
  Homolog annotation: Hit_ID=Q5PHM1; Match level="QueryCoverage=99%, HitCoverage=67%, E-value=0.0, Identity=90%"; Hit description =Putative hydrolase
  Pfam annotation: Domain name=Lactamase_B; Domain location=1-220; Score=32.7; E_value=1.3e-06; Accession=PF00753.17; Description =Metallo-beta-lactamase superfamily
MTIIEGKEGITVVDPLVSAETAKVGMDLYYKNRGKKPVVAVIYTHSHVDHYGGVRGVVDEADVKSGKVKIYAPSGFMEAAVAENIMAGNVMSRRASYMYGNLLKPSATGQVGAGLGTTTSAGTVTLIAPTNIIEKDGQKEVIDGLTYDFMLAPGSEAPSEMLWFIEEKKLIESAEDVTHTLHNTYSLRGAKIREPLPWSKYINEAIVRWGDKAEIIMAQHHWPTWGNENVVNLLKSQRDLYRYINDQTLRMANEGLTRDEIAAKFKLPDSLANTWANRGYYGSVSHDVKATYVLYLGWFDGNPATLDELPPEEAAKKFVDYMGGADAIMKKAKEDYDQGNYRWVAQVVSKIVFADPKNQDARNLEADALEQLGYQAESGPWRNFYLTGAQELRNGVVKGPTPNTASPDTVRAMTPEMFFDYLAVHINGEKAGNAKSIFNIVLGSDGG

SEQ ID NO: 186915 - protein, 169 aa, Glycine max
  Coding DNA Sequence Number=SeqID_70137
  Gene Ontology: Mol. function=zinc ion binding; Cellular component =intracellular; Biological process=regulation of transcription
  Homolog annotation: Hit_ID=Q9SJU5; Match level="QueryCoverage=90%, HitCoverage=73%, E-value=2e-40, Identity=54%"; Hit description =Putative CONSTANS-like B-box zinc finger protein
  Pfam annotation: Domain name=zf-B_box; Domain location=31-76; Score =50.1; E_value=7.2e-12; Accession=PF00643.14; Description=B-box zinc finger
MGRRLIFWSLQVHMCNKLASRHVRVGLASPSDVPRCDICENAPAFFYCETDGSSLCLQCDMIVHVGGKRTHGRYLLFRQRVEFPGDKSSHAENPASQPLEPGEAKRGQNPLPKLKMGEKQQNHKMPMVPTPGPDADGHAKMESKMIDLNMKPNRIHEQASNNQVRVHEK

SEQ ID NO: 186916 - protein, 127 aa, Glycine max
  Coding DNA Sequence Number=SeqID_70138
MATYVSHDDIVPSSSDMIIILEIYAVTMVILCRLCTRSFFNPSLTTLPSSSSLPGFCFLAKPRTTLSNPLTKNHRHNHLRTLFSRNNTFTIPKNNTKTSANCPIQFFLRDRQKQGRVEMANTFACRF

SEQ ID NO: 186917 - protein, 1307 aa, Glycine max
  Coding DNA Sequence Number=SeqID_70139
  Gene Ontology: Mol. function=nucleic acid binding; Cellular component= nucleus
  Homolog annotation: Hit_ID=Q7XCX5; Match level="QueryCoverage=78%, HitCoverage=66%, E-value=1e-113, Identity=32%"; Hit description=Plus- 3 domain containing protein, expressed
  Pfam annotation: Domain name=GYF; Domain location=677-732; Score =28.3; E_value=2.7e-05; Accession=PF02213.6; Description=GYF domain
  Pfam annotation: Domain name=PHD; Domain location=79-127; Score=21.7; E_value=0.00038; Accession=PF00628.19; Description=PHD-finger
  Pfam annotation: Domain name=Plus-3; Domain location=403-510; Score =145.5; E_value=1.4e-40; Accession=PF03126.8; Description=Plus-3 domain
  Pfam annotation: Domain name=SWIB; Domain location=273-348; Score =89.1; E_value=1.3e-23; Accession=PF02201.9; Description=SWIBMDM2 domain
  Pfam annotation: Domain name=zf-CCCH; Domain location=1283-1307; Score=11.2; E_value=0.043; Accession=PF00642.15; Description=Zinc finger C-x8-C-x5-C-x3-H type (and similar)
  Pfam module annotation: Pfam domain module=GYF::PHD::Plus-3::SWIB::zf- CCCH; Domain location=677-732::79-127::403-510::273-348::1283-1307
MEQPLQPQPETAAVGARDLEQSRLVGVPVAERAGNSCAANLQVTVVDGGAVFKRKRGRPAKGAPKVAPPVRQQQDEEDVCFICFDGGSLVLCDRRGCPKAYHLACIKRDEEFFRSKAKWNCAFVRSRHIICAILARTLCVRDAQKMLILFVSERIKCEVDFDDKSSWEYLFKVYWMYLKGKLSLTFDELLQAKNPWKGAAPMSYKIQSPHELYHLRDDKGSGSENSCIDIESNNLKNKKPKRQPKLLDKGDCLDRITSGGDSGVSLPECTKWASKELLEFVAHMKNGDTSLLSQFDVQTLLLEYANKNNLRDPQQKSQIVCDSRLLNLFGKTRVGHIEMLKLLEPHFLLKDNGPAENTFGAGIINAVASEGEAIDNYNKQLMLVDDKRCKTHNPDAYAAIDVHNINLIYMRRSLMENLTEDTEKIHEKVVGSFVRIRISSNDQKQDMYRLVQVVGTSKVAEPYKIGTRTTDIKLEILNLNRKEVISIAEISNQEFSEDECKRLRQSIKYGLSKRLTVGEILNKAVTLQAIRVNDLLNSPEERQRRQHEIPDVHSDPNLDSMFESDEDDGESDERKQDSNIFSKYLGFDRKERGSIFPRISNGASNDMGGKTQDLPATREPVGNTCTVKNNINCDDTAIDDSTNAVVKSEVSSVAPDISSPLLFTGMQQSLNDFLNDRSWHYQDPTGKIQGPFSMLQLYKWNASGCFPPDLRIWRVGEKQDNSILLTDALSGKCSKNVSLPFNSQLLSLGVSVTLDNKDNSQDAGKNGKNEISADGQIIEQSKEQKPQVDNTSTQSDGKDEPVRSNGGHGQLHVYPSLLPTAIPEKLNEDPSDKLRKGHGIVGNSENRNNGSIRTSDGQSNSGHSYQKQSDSEENSGKSSGQTWRHPNVNSSSDCLVTMSAHVSGTKTSPHKLGFDLHNPPSPPAACNTSSGQTWSHPNVNSSSNCLVNTSAHVSDTKSSPHKLGFDLHNPPSPPACNTSSGQTWRHPDINSSSNCLVTTPAHVSATKTSPHKLGFDLHNPPSPPACNTSTWQAIIGEPNDFDESVSDLLAEVEAMESLGGLESPTSIMKCGEDLTEGSKNDCLSFVAELSPMLDAGKGDALSSTGDLNLPSQPTAAEEPLRQADVHHHHHQRISAEHPSRSSKVEVGTKNGVSGNQWDSGSENSPIVPSPGTLGLAIDTTWRLGLENTHLGWSGIDQGNANVGWGVGQTAVQENRSSSSYTSAVTPGFGDSQTKYGSDRFSVSRDRGFQGHSRESGLSRSRIPYNRQPSYGVGNGASYKPLPKGQRVCKFYESGYCKKGASCDYWHP

SEQ ID NO: 186918 - protein, 142 aa, Glycine max
  Coding DNA Sequence Number=SeqID_70140
  Gene Ontology: Mol. function=transferase activity
  Homolog annotation: Hit_ID=Q1T3Y9; Match level="QueryCoverage=98%, HitCoverage=41%, E-value=2e-22, Identity=34%"; Hit description =Transferase
MDEIVDTPLGVQLNVFECGGIAIGACMSHKIADAMSYFMFIQTWAAIARGEAHGLKAKYAEKMALQKPPSRVEALTTFIWTRFISSTQVAVAASDQRSRFYVVAHTVNLRSRMDLPLPALAFGNYYRAVKAFPSLDHKGECL

SEQ ID NO: 186919 - protein, 194 aa, Glycine max
  Coding DNA Sequence Number=SeqID_70141
  Homolog annotation: Hit_ID=Q10SS1; Match level="QueryCoverage=69%, HitCoverage=21%, E-value=6e-17, Identity=38%"; Hit description =Expressed protein
MAAATSYLTGTQRYAAGALFGLALHQAQLHQTHPLGLSTDDFPSDSETSSTLAVSEHPNLWVHHNSGLLRPVLKYLDINSAAWSGLEETAGFSSASRHVGPFLRLLSEDFDDDDDDSSQRLDQELALSEAVDAMVHSLEKNSESLVSRREKLREYENQCREKFSTADVQPNSEKLSEESDSALRASLCLPIRFR

SEQ ID NO: 186920 - protein, 102 aa, Glycine max
  Coding DNA Sequence Number=SeqID_70142
MSFIKEQEASKEETQSKEDKWAKWKRGGIIGAAALTGGTLMAVTGGLAAPAIAAGLGALAPTLGTLIPVIGASGFAAAASAAGTVAGSVAVAASFGVIASMK

SEQ ID NO: 186921 - protein, 51 aa, Glycine max
  Coding DNA Sequence Number=SeqID_70143
MENAVGKNVGVAMASIPATHATQLLPTVWYLTRSLNNNVTIKSVVVLNARI

SEQ ID NO: 186922 - protein, 63 aa, Glycine max
  Coding DNA Sequence Number=SeqID_70144
MTILKLSQTKPMRWKRSRNLLHKTHSKSIQIRQYSILTVGVQCEALNMQEQSLPNVLLIPKIN

SEQ ID NO: 186923 - protein, 357 aa, Glycine max
  Coding DNA Sequence Number=SeqID_70145
  Gene Ontology: Mol. function=sequence-specific DNA binding; Cellular component=nucleus; Biological process=regulation of transcription, DNA-dependent
  Homolog annotation: Hit_ID=Q1S9S7; Match level="QueryCoverage=81%, HitCoverage=98%, E-value=6e-74, Identity=51%"; Hit description=Zinc finger, GATA-type
  Pfam annotation: Domain name=GATA; Domain location=275-310; Score =70.9; E_value=4e-18; Accession=PF00320.17; Description=GATA zinc finger
  Subcellular localization annotation: CTP_CleavageSite=47; ConfidenceScore=5.28e-01
DAFAPYSMLYQTPYPQPFQFHHPLPSSFSPLLAVPTTPPPLYLPFPQAEKEMECVEAALKSNYRKEMTLKLSPQTFTEEVSVQNGTTCDDFFVNDLLDFSHVEEEPEQQEDTPCVSLQHENPSHEPCTFKDDYASVPTSELSVLADDLADLEWLSHFVEDSFSEFSAAFPTVTENPTACLKEAEPEPEIPVFSFKTPVQTKARSKRTRNGLRVWPFGSPSFTDSSSSSTTSSSSSSSPSSPLLIYTQSLDHLCSEPNTKKMKKKPSSDTLAPRRCSHCGVQKTPQWRTGPLGPKTLCNACGVRFKSGRLLPEYRPACSPTFSSELHSNHHRKVLEMRQKKETVSVDETGFAPAHVVP

SEQ ID NO: 186924 - protein, 56 aa, Glycine max
  Coding DNA Sequence Number=SeqID_70146
MADQYATKSKDKGSKIPGTRMYIAKYFTKTYVCLGSKIPHGKKESEQEKNKKEEKK

SEQ ID NO: 186925 - protein, 70 aa, Glycine max
  Coding DNA Sequence Number=SeqID_70147
  Gene Ontology: Mol. function=small conjugating protein ligase activity; Biological process=protein modification process
  Homolog annotation: Hit_ID=Q1S9R2; Match level="QueryCoverage=85%, HitCoverage=37%, E-value=2e-20, Identity=73%"; Hit description =Ubiquitin-conjugating enzyme, E2
  Pfam annotation: Domain name=UQ_con; Domain location=1-67; Score= -41.9; E_value=0.037; Accession=PF00179.16; Description=Ubiquitin -conjugating enzyme
MIDLVLVFGDILYDSWSPAMTVSSICISILSMLSSSTTKQRPEDNDRYVKNCRNGRSPKETRWWFHDDKV

SEQ ID NO: 186926 - protein, 391 aa, Glycine max
  Coding DNA Sequence Number=SeqID_70148
  Gene Ontology: Mol. function=receptor activity; Cellular component =integral to membrane; Biological process=protein amino acid phosphorylation
  Homolog annotation: Hit_ID=Q9FH56; Match level="QueryCoverage=96%, HitCoverage=95%, E-value=2e-99, Identity=49%"; Hit description =Similarity to elicitor-inducible receptor-like protein
  Pfam annotation: Domain name=LRR_1; Domain location=120-142; Score =15.8; E_value=0.15; Accession=PF00560.23; Description=Leucine Rich Repeat
  Pfam annotation: Domain name=LRR_1; Domain location=144-166; Score =19.2; E_value=0.015; Accession=PF00560.23; Description=Leucine Rich Repeat
  Pfam annotation: Domain name=LRR_1; Domain location=168-189; Score =10.9; E_value=2.6; Accession=PF00560.23; Description=Leucine Rich Repeat
  Pfam annotation: Domain name=LRR_1; Domain location=191-210; Score =14.9; E_value=0.3; Accession=PF00560.23; Description=Leucine Rich Repeat
  Pfam annotation: Domain name=LRR_1; Domain location=213-236; Score =10.8; E_value=2.7; Accession=PF00560.23; Description=Leucine Rich Repeat
  Pfam annotation: Domain name=LRR_1; Domain location=238-260; Score =10.0; E_value=3.8; Accession=PF00560.23; Description=Leucine Rich Repeat
  Pfam annotation: Domain name=LRR_1; Domain location=262-283; Score =5.2; E_value=30; Accession=PF00560.23; Description=Leucine Rich Repeat
  Pfam annotation: Domain name=LRR_1; Domain location=288-309; Score =7.8; E_value=9.9; Accession=PF00560.23; Description=Leucine Rich Repeat
  Pfam annotation: Domain name=LRR_1; Domain location=312-334; Score =10.2; E_value=3.5; Accession=PF00560.23; Description=Leucine Rich Repeat
  Pfam annotation: Domain name=LRR_1; Domain location=96-118; Score =18.8; E_value=0.019; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=120 -142::144-166::168-189::191-210::213-236::238-260::262-283::288 -309::312-334::96-118
MAIWGLLLGAESKTHVGDAEVLKELKQGLEPGSVKPGSCVSSWDFTLDPCDNLFGDKFTCGFRCDVVVSGLSRVTELALDQAGYSGSLSFTWNLPYLQTLDLSNNYFSGQIPYSFSNLTRLSRLSLSSNSFSGEIPSSLGTLSNLQELYLDNNNLRGTIPQSFDNLANLKRLELQSNKLNTRLPNLGSLRNLKFLYLSDNSVTGTLPASLPVSLVQISLRNNNLSGVLVGESFKSLTRLQVVDFSSNQLSSAVPSVFFQLPSLQQLTLSFNEFTNLEAPYKGTESQSGLVAVDLSNNRLKGFLPSFMAVMPKLSSLSLENNEFTGRIPTQFGVKTVFPEKGVSSFGRLLLGGNYLLGGIPRPLLALKRDSANGGQQKSLAQCNRFSPASTP

SEQ ID NO: 186927 - protein, 87 aa, Glycine max
  Coding DNA Sequence Number=SeqID_70149
  Subcellular localization annotation: CTP_CleavageSite=25; ConfidenceScore=5.50e-01
MPPLSLNLVSPLLTMPSTFPLALISASASPPPSDLKFLLTETTKKSQGVRGPKPAAVESSQHAHPLFGVQFVSFKVLASSYLSVRVG

SEQ ID NO: 186928 - protein, 63 aa, Glycine max
  Coding DNA Sequence Number=SeqID_70150
MEEKAGLAVMYDSPSGPASYPTLIVCPWKCHILKKRMGQCGILCDSGGCNCKVDWASDPNAKA

SEQ ID NO: 186929 - protein, 113 aa, Glycine max
  Coding DNA Sequence Number=SeqID_70151
  Gene Ontology: Mol. function=small conjugating protein ligase activity; Cellular component=cAMP-dependent protein kinase complex; Biological process=protein modification process
  Homolog annotation: Hit_ID=Q7Y014; Match level="QueryCoverage=87%, HitCoverage=95%, E-value=3e-48, Identity=88%"; Hit description =Putative ubiquitin-conjugating enzyme, 3'-partial
  Pfam annotation: Domain name=UQ_con; Domain location=19-113; Score =63.7; E_value=6e-16; Accession=PF00179.16; Description=Ubiquitin -conjugating enzyme
MTSSSAAARKNLSKIACNRLQKELVEWQVNPPTGFKHKVTDNLQRWVVEVTGAPGTLYANETYQLQVDFPENYPMEAPQVIFLHPAPLHPHIYSNGHICLDSDFCCNLLRTFL

SEQ ID NO: 186930 - protein, 417 aa, Glycine max
  Coding DNA Sequence Number=SeqID_70152
MKVALEQSSKEAPEVDVEAINERKQKRLAKSIADEDLEKVEFLAKENKTKRMHESASSALACPPKVNLVAQRSEDLSENDDDDERLVRVALQKRKIVALDALALEKAKKAQPVAEPRANKKNPASSLLDGESINDIPITPLCKSTPTTQSPPPPFPLQLERFKREATRETIFVETPTWTHYDYEHTPSDAIVHFPPPTWTCPVIPSHAWCNIKKQKDKKSFQGNISQDYLESKEGTLCKKWNFLRHISRRRATDIKMVVDRVCLRLPVWDIAKNKGDNVVHCDVVQVLYFLGSITLMMLALALPEMRTTTPSSNAQQKKKAEDVVAAAIVEKEAIAIAEREAATTIQVEAYAKVVEDTIVHGVIIDFTNTSFMDEIEASKRPMQLWLMKLNHPFQILRPSSVQLQMRPPLQIRVIEA

SEQ ID NO: 186931 - protein, 56 aa, Glycine max
  Coding DNA Sequence Number=SeqID_70153
MGLNIEKLKNIIVSLEMAVVVEVGKVVERTEEVVVVSEPRVVVEVQERQELMKHWA

SEQ ID NO: 186932 - protein, 466 aa, Glycine max
  Coding DNA Sequence Number=SeqID_70154
  Gene Ontology: Mol. function=oxidoreductase activity; Cellular component=endoplasmic reticulum; Biological process=electron transport
  Homolog annotation: Hit_ID=Q9M066; Match level="QueryCoverage=96%, HitCoverage=78%, E-value=1e-140, Identity=56%"; Hit description =Cytochrome P450 90C1
  Pfam annotation: Domain name=p450; Domain location=2-463; Score=24.3; E_value=4.4e-12; Accession=PF00067.12; Description=Cytochrome P450
MWKGMNNVQSLCMYGNVFKTCILGSNVIVSTDPDVNKVVLQNQANNFVPAYPKSIRELMGEQSILKMNGTMHKKVHTLIAGFLRSPQLKARITRDIEHAVKQCFASWTPHQPIYVQDQVKKITFPVLIKVLMSVGPGEDLDFLYREFAEFIKGLICLPLKFPGTRLYKSLKAKDRMVKMVRKIVEERKKQLKDYNADDHGDAAVNDVVDVLLRDKVDSNSSSRLTPEMISQNIIEMMIPGEETLPTAMTMALKFLSDSPLAVSKLQSTHHFFEGAENEPTMKIDSQCFHEENMELKRLKTNCSDDYAWTDYMSLPFTQNVISETLRMANIVNGIWRKSVNDIEIKEKILMQFHYSAYPGYLIPKHWCVMASLTSVHMDGKNYENPFNFDPWRWEKIGIVAGNNCFTPFGGGHRLCPGLELSRLELSIFLHHLVTTYRWIAEKDEIIYFPTVKMKRKLPISVQPIIA

SEQ ID NO: 186933 - protein, 118 aa, Glycine max
  Coding DNA Sequence Number=SeqID_70155
MWVLQYTWSHVRTPARAPLPAVIISSISGLVVQLYCDSTNLNCGKTLCRTTFIPSQHLYVVAAKTTSVLPSLHLLMRTRAKATMATSENESQQEHRQGREQKEAARREEEDENVDIIK

SEQ ID NO: 186934 - protein, 611 aa, Glycine max
  Coding DNA Sequence Number=SeqID_70156
  Gene Ontology: Mol. function=4 iron, 4 sulfur cluster binding; Cellular component=cellular_component; Biological process=regulation of cyclin-dependent protein kinase activity
  Homolog annotation: Hit_ID=Q75WU8; Match level="QueryCoverage=99%, HitCoverage=98%, E-value=0.0, Identity=70%"; Hit description=Similar to CDK5 regulatory subunit-associated protein
  Pfam annotation: Domain name=Radical_SAM; Domain location=264-461; Score=110.0; E_value=6.7e-30; Accession=PF04055.11; Description =Radical SAM superfamily
  Pfam annotation: Domain name=TRAM; Domain location=515-591; Score =51.8; E_value=2.4e-12; Accession=PF01938.10; Description=TRAM domain
  Pfam annotation: Domain name=UPF0004; Domain location=104-216; Score =166.7; E_value=5.7e-47; Accession=PF00919.10; Description =Uncharacterized protein family UPF0004
  Pfam module annotation: Pfam domain module=Radical_SAM::TRAM::UPF0004; Domain location=264-461::515-591::104-216
  Subcellular localization annotation: CTP_CleavageSite=85; ConfidenceScore=5.20e-01
MASSLSSVVNQPHLAQRLKLHRPSSLTTLTIFFHKHKHQHQHNASFPHPYTSSPRSRPLNLIMASRTHSPSYTLRRHFIPQATLTASEAQPRLVPDTEVPPTGRIYHETYGCQMNVNDMEIVLSIMKNAGYGEIVSVPESAEIIFINTCAIRDNAEQKVWQRLNYFWFLKRHWKSNVATGRSQSMRPPKVVVLGCMAERLKEKILDSDKMVDVVCGPDAYRDLPRLLEEVDYGQRGINTLLSLEETYADINPVRISKNSVTAFVSVMRGCNNMCSFCIVPFTRGRERSRPVESIVREVAELWKEGVKEVMLLGQNVNSYNDASGIEREVESGSNWKLSEGFSSMAKVKNMGLRFSDLLDRLSSEFPEMRFRFTSPHPKDFPDDLLYLMRERHNICKLIHLPAQTGSSTVLERMRRGYTREAYLDLVQKIRSIIPDVALSSDFICGFCGETEEEHSETLTLIKAVGYDMAFLFAYSMREKTHAHRNYVDDVPEEIKQRRLAELIETFRESTGQCFDSQIGTTQLVLVEGPNKRAPDTELMGKSDKGHRVLFVNMPIPDREDINTKRNPVVGDYVEVHITRSTRASLFGEALAITKLTSFDNNLDKEAAACSM

SEQ ID NO: 186935 - protein, 490 aa, Glycine max
  Coding DNA Sequence Number=SeqID_70157
  Gene Ontology: Mol. function=oxidoreductase activity; Cellular component=mitochondrial matrix; Biological process=electron transport
  Homolog annotation: Hit_ID=Q7XI14; Match level="QueryCoverage=83%, HitCoverage=86%, E-value=1e-143, Identity=56%"; Hit description =Putative actin interacting protein
  Pfam annotation: Domain name=FAD-oxidase_C; Domain location=274-483; Score=135.1; E_value=2e-37; Accession=PF02913.9; Description=FAD linked oxidases, C-terminal domain
  Pfam annotation: Domain name=FAD_binding_4; Domain location=140-241; Score=75.1; E_value=2.1e-19; Accession=PF01565.13; Description=FAD binding domain
  Pfam module annotation: Pfam domain module=FAD-oxidase_C::FAD_binding_ 4; Domain location=274-483::140-241
  Subcellular localization annotation: CTP_CleavageSite=34; ConfidenceScore=5.44e-01
MANHNSRFLLRSFIPFFHRRMNSPLLPSATSCPRLTSGTAFDEKFTQLPSNIVRGDHRQVLSFFNPSRNFAETKQWGVGIRHKCFGSMAGSVQRNPRFSKLNDDDVRYLEGILGSKNVVQDEDKLVTSNTDWMHKYKGSSKLLLQPRTADQVSQILKYCNSRNLAVVPQGGNTGLVGGSVPVFDEVIVSLSSMNKIISFDKIGGNVSTNAGGLRLVRYGSLHGSVLGVEAVLANGTVLDMLKTLRKDNTGYDLKHLFIGSLGIVTKVSILTPPKLSSVNVAFLACKDYSSCQSELMCYTEKGVALMVRQKLEAFLLGSMENELISDGVLAQDINQASSFWLLREGIPEALMRAGAVYKYDLSIPLEHMYNLVEEMRSRLDEKVADVMDVASNTANVIGYGHLGDGNLHLNISTSHYDDKILSHIEPYVYEWTSKHRGSISAEHGLGLMKANEIFYSKSHETVQVMASIKNLLDPNHILNPYKVLPQSLIS

SEQ ID NO: 186936 - protein, 41 aa, Glycine max
  Coding DNA Sequence Number=SeqID_70158
MIFVLEVEARSTWACLLSSTFDGERNGWRFEFWNPKAVGLF

SEQ ID NO: 186937 - protein, 122 aa, Glycine max
  Coding DNA Sequence Number=SeqID_70159
MESELLLKLQCGIGRWFMYVAHGIDHFIRYMRLIVASLFYFEEAPKFVEYFIWWGHLMPMRNLSMRCQPRSPQHPLRRIQKEIEEDPKILEDDLSKATKEPLDLIMEDGAMAVSGELPYEVG

SEQ ID NO: 186938 - protein, 60 aa, Glycine max
  Coding DNA Sequence Number=SeqID_70160
MISCKVDAPSSWCSNANYMGGIGKDKFGEEMKKNSRLASVNVVYNLVTRVLPICMKGLLR

SEQ ID NO: 186939 - protein, 129 aa, Glycine max
  Coding DNA Sequence Number=SeqID_70161
MLRSYRGIYMKSLMTIDQIWGFSGQIYNFEGEIDGFRGQIRDFSGTKRENEKGYEKRVLTKGGMTKWKGNLWRETMRVQWSFNWHDRAVWWQNESESLRMKTAKLHCESARVIVKKPYTLINDDFKKCC

SEQ ID NO: 186940 - protein, 52 aa, Glycine max
  Coding DNA Sequence Number=SeqID_70162
MPDQLRRKLDDKDVVIDASKSWDWNIETKKGSTRMLIDLNNVMKLKQHKCNY

SEQ ID NO: 186941 - protein, 509 aa, Glycine max
  Coding DNA Sequence Number=SeqID_70163
  Homolog annotation: Hit_ID=Q00SS9; Match level="QueryCoverage=34%, HitCoverage=79%, E-value=5e-18, Identity=33%"; Hit description =Homology to unknown gene
  Pfam annotation: Domain name=FG-GAP; Domain location=231-265; Score =9.1; E_value=0.5; Accession=PF01839.13; Description=FG-GAP repeat
  Pfam annotation: Domain name=FG-GAP; Domain location=435-464; Score =19.3; E_value=0.014; Accession=PF01839.13; Description=FG-GAP repeat
  Pfam module annotation: Pfam domain module=FG-GAP::FG-GAP; Domain location=231-265::435-464
MNQASENSGTVDLRHFAFYAFAGRSGVERWSRKNEVLCSILWSSNIEVHSSDASQLLPQHNYKLDVHALNTRQPGEGIQRINPGSYASPMGTFINLDYPSVLRLNLNYCPFLNKYVYQARREDTLLKLAHFRRHKRKTLKKTPGKAMSYPFHKPEENHPPGKDSTKKISNIIGKAANYAGSAKSKKHLPYVPTITNYTQVWWVPNVVVAHQKEGIEALHLASGRTICKLHLQEGGLHADINGDGVLDHVQAVGGNGAEQTVVSGSMEVLRPCWAIATSGVPIREQLFNVSICHYTHFNLFQHGELYRSYSQGSDIASLEVATPILIPRSDGHRHRKGSHGDVIFLTNRGEITSYSPGLHGHDAIWQWQQSTGVTWSNLPSPSGVMEGGGLVIPTLKPLSLRLHDNQEMILAAGEQEAVIISPGGSLLATIELPGPPTHVLIAEDFSNDGLTDLILVTSNGVYGFVQTRQPGALFFSMLVGCLIVVMGVIFVTQHLNSTKGKPRPSSGSR

SEQ ID NO: 186942 - protein, 81 aa, Glycine max
  Coding DNA Sequence Number=SeqID_70164
MADMQNKKKKKERHGRVIPNQPAEEVLVGPPPLLCHRAETTIPLWCTLGSYTRQVHPMVLLSMLLLKQYENYHLPLFCKKP

SEQ ID NO: 186943 - protein, 206 aa, Glycine max
  Coding DNA Sequence Number=SeqID_70165
  Gene Ontology: Mol. function=nucleic acid binding; Biological process= DNA integration
  Homolog annotation: Hit_ID=Q1T010; Match level="QueryCoverage=78%, HitCoverage=14%, E-value=5e-28, Identity=34%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MLGSSGVFSRNLPVFDGKKFNNWCLKMNAIFDFQEVEEVFKNGFQEIGRNATKEQKAEYKELKKLNSKAGFQIHQGVNVVIFGKMSKATTTKQVRDILNKAYGGADKTKKTCKEELIDQQLVDKVLRTLTPRFDHVVVVIEESKDLDSMKVEELQNSLEAHDVKEGKGKLNNEVNLAHDDGLDSDPVLLMVTSTEIHNSSSWYLDT

SEQ ID NO: 186944 - protein, 158 aa, Glycine max
  Coding DNA Sequence Number=SeqID_70166
  Gene Ontology: Mol. function=zinc ion binding
  Homolog annotation: Hit_ID=Q10QQ7; Match level="QueryCoverage=28%, HitCoverage=22%, E-value=9e-08, Identity=51%"; Hit description =Expressed protein
  Pfam annotation: Domain name=PHD; Domain location=7-54; Score=1.3; E _value=0.042; Accession=PF00628.19; Description=PHD-finger
MVDLQTVCCMCGDVGFPDKLFRCNKCRNRFQHSYCSNYYGELPDIELCDWCHSEEKNLRHIGSNSKKPVSAGNEAGATHRSEYSGEKMIKQHDHHREESGSEKGKSPTPSPRPGTRRYKLLKDRVVSKCFLRASPGAAIKLCLGDLLVMCSNLKTASG

SEQ ID NO: 186945 - protein, 435 aa, Glycine max
  Coding DNA Sequence Number=SeqID_70167
  Gene Ontology: Mol. function=transition metal ion binding; Cellular component=nucleus; Biological process=electron transport
  Pfam annotation: Domain name=Transposase_23; Domain location=319-390; Score=13.6; E_value=3.7e-05; Accession=PF03017.5; Description =TNP1ENSPM transposase
MGDRLDEMSEMICDVGQEYFQQEHTLMYDTLQSDLKKPLYPGCKKCLTLLSIVLSLDMHPEENTLPKSYYQAKKILCPMGIECQKIHARPNDCILYKNEFEEMHNCPRCGVSRYRVKDDDDVAMTKALRKAPHASIPLTGEQVLEWVDGINTVFEKTQKKENNKTSIWKKSVIGMLLDIQGKTKNGLNTRQDLVEMDIRDQLHPSLVQLKDLKLVGIKSHDCHILKQQLKVVDPLKLHELESKAAIILCQLEMYFPPLFFNIMVHLIVHLNLHRPEASIVERYIVKEAIELCSEYMEKEKLAGVLESQHDERVGDKGSKGMHEVKCGLYVDDSPPRLVALGRVYEGSTSVHNVPLGNDQVKVGVEEVLEADARIPIPTQEVQLVGKALNTFLAWSTHLDKQVGEGQAKPIDMSDPDVDPLYLMTLTIPQLFLKPL

SEQ ID NO: 186946 - protein, 85 aa, Glycine max
  Coding DNA Sequence Number=SeqID_70168
MRIKRSFKVVMGPRTRLVVSFKTRKGKQGSKGVSKELIQGKSIWLEAYENKIASIISKYACELGSINKNQAKAIVQAINGAKHTK

SEQ ID NO: 186947 - protein, 96 aa, Glycine max
  Coding DNA Sequence Number=SeqID_70169
FFEDPNNDGLTIDFDRDISQTINEEEEEDVLSPELERLVAQEEREMKPHQEETELVNLGTTEEKKEVKDYMNHMLLKDLLKTKQLELIKMDDQDSL

SEQ ID NO: 186948 - protein, 71 aa, Glycine max
  Coding DNA Sequence Number=SeqID_70170
MALHMIYTRPISDQVTMSGKVVSGRGTLGAIKGMWYQAHDYNSMAQPPIALPTPDDARHSSLYRQWCTQHA

SEQ ID NO: 186949 - protein, 78 aa, Glycine max
  Coding DNA Sequence Number=SeqID_70171
MGDFISRLSFPACLHFSGENTETFSSLTSYPELRRSEFLIGGYVGARASLLSTTPPFVAMTQELVARGDTLRLSAPRV

SEQ ID NO: 186950 - protein, 316 aa, Glycine max
  Coding DNA Sequence Number=SeqID_70172
  Homolog annotation: Hit_ID=Q9XGX0; Match level="QueryCoverage=95%, HitCoverage=94%, E-value=1e-55, Identity=44%"; Hit description =Putative zinc finger protein SHI
  Pfam annotation: Domain name=DUF702; Domain location=99-258; Score =307.6; E_value=2.3e-89; Accession=PF05142.3; Description=Domain of unknown function (DUF702)
MAGLFSLGGGSSSRGNTQQEEIPPPDTLFWYNNKNDDVSSYHRGGGFELWNQQQLMGQGPPSQQRPLFHQDLYSALGVGPSRPISDDQSSSRSGFMLGSTGGGGGISCQDCGNQAKKDCPHMRCRTCCKSRGFDCQTHVKSTWVPASRRRERLQQFSALQQTLEPPSSGGGDLPKRHRERDHHYHSPLACTRFPSNPLSSGLEEVNFPALVRSDAEFRCVRVSSMDEEAEEEYAYSTAVNIAGHVFKGILYDYGPEGNTNYMAGAGESSSTGVGALNLTTGAIVSEPIVDPSSLYTAPLNTFIPGSGTQFFPHPRS

SEQ ID NO: 186951 - protein, 69 aa, Glycine max
  Coding DNA Sequence Number=SeqID_70173
MWLFVRSTNKTSTIAHGWVEQAKTFPFNIYNWTREDEHCKEGSNGRRKFWLVRGCDEDESRGGAMIFLD

SEQ ID NO: 186952 - protein, 259 aa, Glycine max
  Coding DNA Sequence Number=SeqID_70174
MDRSTDVAIIKEFYANLYDPKDNSPKQVRVRGHLIKFDADALNTFLKTPMIIEEGEELSSYSRFCHLRPDPSELPAQLCIPGRGFELNADGLPLKILRKNLTTLAQTWSILSFSNLALTSHTSNITLDRARLIYGIIQKMDMNLGYIISSQISMIAQHDSSSLAINLAYVKKNCWNLDDPSVSFRGPHKARGKRSETLPSFEIPPLAAPSTTVPTSSAPSASAPLPAPIIAPSIGSSSFTLEILFAMLQSLHRGHIIIM

SEQ ID NO: 186953 - protein, 928 aa, Glycine max
  Coding DNA Sequence Number=SeqID_70175
  Gene Ontology: Mol. function=nucleoside-triphosphatase activity; Cellular component=membrane; Biological process=defense response
  Homolog annotation: Hit_ID=Q19PL1; Match level="QueryCoverage=92%, HitCoverage=88%, E-value=1e-108, Identity=30%"; Hit description=NBS -NBS-LRR type disease resistance protein
  Pfam annotation: Domain name=LRR_1; Domain location=579-600; Score =4.7; E_value=38; Accession=PF00560.23; Description=Leucine Rich Repeat
  Pfam annotation: Domain name=LRR_1; Domain location=602-624; Score =10.1; E_value=3.7; Accession=PF00560.23; Description=Leucine Rich Repeat
  Pfam annotation: Domain name=LRR_1; Domain location=626-648; Score =11.4; E_value=2.1; Accession=PF00560.23; Description=Leucine Rich Repeat
  Pfam annotation: Domain name=LRR_1; Domain location=724-745; Score =0.3; E_value=2.4e+02; Accession=PF00560.23; Description=Leucine Rich Repeat
  Pfam annotation: Domain name=LRR_1; Domain location=772-794; Score =7.1; E_value=14; Accession=PF00560.23; Description=Leucine Rich Repeat
  Pfam annotation: Domain name=LRR_1; Domain location=845-867; Score =5.2; E_value=31; Accession=PF00560.23; Description=Leucine Rich Repeat
  Pfam annotation: Domain name=NACHT; Domain location=183-337; Score= -35.9; E_value=0.036; Accession=PF05729.3; Description=NACHT domain
  Pfam annotation: Domain name=NB-ARC; Domain location=145-451; Score =352.1; E_value=9.1e-103; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=579-600::602 -624::626-648::724-745::772-794::845-867::183-337::145-451
MAEVAVSTVVTKLTELLVEQAAVAAVSVSQLAGVREQVENLKNELGWMQSFLRDADAKQEGNDRVRMWVSEIRDVAFEAEELIETYVYKTTMQSSLDKVFRPFHLYKVRTRIDKILSKIKSISDRRETYGVVVMTRDDGNNSNERLRHWRQPSPYSEEEYVIELEDDMRLLFTQLLAVEPTPHVVSIVGMGGLGKTTLAKKLYNHTRITNHFECKAWVYVSKEYRRRDVLQGILRDVDALTRDEMEKIPEEELVNKLRNVLSEKRYLVVLDDIWGMEVWDGLKSAFPRGKMGSKILLTTRNGDVALHADACSNPHQLRTLTEDESFRLLCNKAFPGANGIPLELVQLKSLAKEIVVKCGGLPLAVVVVGGLLSRKLKSSGEWKRVLQNISWHLLEEQEKIARILALSYNDLPPHLKSCFLYLGLFPEGVNIQTKKLIRLWVAEGFLLQEGEETAEGVAQKYLNELIGRCMIQVGTVSSLGRVKTIRIHHLLRDLSLSKGKEEYFLKIFQGDVAGQSTKARRHSMHSCHDRYDSLKHNAGHSRSLLFFNREYNDIVRKLWHPLNFQQEKKLNFIYRKFKLLRVLELDGVRVVSLPSLIGDLIQLRYLGLRKTNLEEELPPSIGNLQNLQTLDLRYCCFLMKIPNVIWKMVNLRHLLLYTPFDSPDSSHLRMDTLTNLQTLPHIEAGNWIVDGGLANMINLRQLGICELSGQMVNSVLSTVQGLHNLHSLSLSLQSEEDEFPIFMQLSQCTHLQKLSLNGKIKKLPDPHEFPPNLLKLTLHNSHLQKESIAKLERLPNLKVLILGKGAYNWPELNFNGEGFPQLHILRLVLLKELEEWTVEENAMPRLENMVIDRCEKLKKIPEGLKAITSLKKLKIIGMPVEFEHKLRTKDLFDFTNTPVIESTTDILAIAMEWKHFQVLALQFSACLL

SEQ ID NO: 186954 - protein, 1621 aa, Glycine max
  Coding DNA Sequence Number=SeqID_70176
  Gene Ontology: Mol. function=RNA-directed DNA polymerase activity; Cellular component=chromatin; Biological process=chromatin assembly or disassembly
  Pfam annotation: Domain name=Chromo; Domain location=1521-1569; Score= 29.8; E_value=9.6e-06; Accession=PF00385.14; Description='chromo' (CHRromatin Organisation MOdifier
  Pfam annotation: Domain name=RVP_2; Domain location=472-606; Score= -45.9; E_value=0.0038; Accession=PF08284.2; Description=Retroviral aspartyl protease
  Pfam annotation: Domain name=RnaseH; Domain location=980-1097; Score=- 22.9; E_value=0.0078; Accession=PF00075.14; Description=RNase H
  Pfam annotation: Domain name=rve; Domain location=1236-1371; Score =52.9; E_value=1.1e-12; Accession=PF00665.16; Description=Integrase core domain
  Pfam annotation: Domain name=zf-H2C2; Domain location=1177-1218; Score=24.6; E_value=0.00019; Accession=PF09337.1; Description=His(2)- Cys(2) zinc finger
  Pfam module annotation: Pfam domain module=Chromo::RVP_2::RVT _1::Retrotrans_gag::RnaseH::rve::zf-H2C2; Domain location=1521 -1569::472-606::719-888::224-314::980-1097::1236-1371::1177-1218
MTYIRHFLLSLLVALTLLVHPSILYHICVGHVHIHKSLHVSNWITCNRVTDNRVKGECMKLPDYRHRGSRNRKNKEKQQDSRNRGTSILRSRRHWPSKPVFPFDSLSVSTFGALVALMPDSEKNPGPSDRLEDALLRLTTQNMYLGESVHALTLQLKELLQRTNTTPQSSPIPIPLSPTSPTPASQHHMKLDIPRFDGSEPQGWIFKINQFFEYHSTPEQDKLTVASFYMEGRALAWYQWMKANNHFTSWSSFIQALRARFAPTPYDDPTGVLFKLTQKGTVAQYLTEFEDLATRVVGISPPLLLSCFISGLSPEIRREVQAHHPLSMVQAAGLARLQAEKVLDQRPSPRSRPPNPTPFPPQLGPPPSLPAPTLPPLLNPPPPPRPPTTPMSTPTLKRVSPDEMALRREKGLCFNCDEKYHRGHKCSSRFFILISDDLEPIPSHIPIPDLTHHPPPDPPDNLDLYPTQISLNSLAGHIAPETLRFVGQLSGQPMLILVDGVSTHNFIQLQMVTKLGLLCHETKPLQVLVGNGQHLTCNYVCEAIPVEIQGLTFPIDLYVLAISGANIVLGVQWLRTLGPVLTDYTKLCMQFFFQDQLVTLQGDTEDTLGMLSSSQFWRLLRRQSPGLYFHITVAPSDTNLISSADFPEDIRSLLTKFDSLFHPLQDMPPARETDHHIHLLPQATPVNVRPYRYPYFQKQEIEAQVASMLQKGLIQPSTSPFSSPVLLVKKHDGSWRFCVDYRALNAITIKDRFPIPTIDELLDELGSAQCFSKLDLLQGYHQIRMHSGDIPKTAFRTHHGHFEFKVMPFGLCNASSSFQATMNLIFRPYLRRFVIVFFDDILIYSPSFSDHLKHLELTFQVLLDNNFILKLSKCSFAQSQVEYLGHLVSSRGVEPVASKVADVVQWPIPQSPRALHSFLGLAGFYRRFIKGYAMIADPLVKATTMEPFQWSSQAQMAFDQLKHALSTAPVLALPDFHLPFTVETDASGIGMGAVLSQQGHPIAYFSKPFTAKLLRSSTYVRELFAITAAVKKWRQYLLGHPFTIVTDHRSLKELLTQVIQTPEQHTYLARLMGYNYTIQYRSGSHNQAADALSRLPEHMPHTATMSLLLSVPCLTFLDELHKKLRQNPQYIQQFQEVANSSESHPDFTIAKDLLLYKGRIWLPRNIPLIHSFLTEYHAIPTGGHMGVAKTVARLSENFQWQGLRQDVAEFVARCMECQQTKCETKRVAGLLCPLPVPARPWEDLSLDFITGLPPCQGKTVILVVVDRFSKGIHLGSLPTTHTAHMVASLFVDIVVKLHGIPRSLVSDRDPLFVSHFWQNLFHLSGTKLRMSSAYHPQSDGQTEGKLLPWVEWSHNTSWNVGTGSTPYEVTFGRKPFNFPDYLAGSSQIAAVDDILTNRDEVFQSIRKKLLKAQESMKRQADAKRRELSFQIGDWVLLKLRPYRQRSARGTQSTSGKLAKRYYGPFQIIDKVGAVAYRLRLPEGTRIHSVFHCSLLKPFRGEPDVVRIADFPEQFLNDQPLITPLAILDYRKAADNQNAPWEVLVQWQGLSPDETSWENWDQLKQEYHLEDKVILQGPREVDSTEEAEITKTKKSNRIAETGVQAVSGKRKISKPAYLDEYV

SEQ ID NO: 186955 - protein, 522 aa, Glycine max
  Coding DNA Sequence Number=SeqID_70177
  Gene Ontology: Mol. function=zinc ion binding
  Homolog annotation: Hit_ID=Q9FMJ2; Match level="QueryCoverage=96%, HitCoverage=61%, E-value=1e-138, Identity=49%"; Hit description =Ankyrin-like protein
  Pfam annotation: Domain name=DUF248; Domain location=285-521; Score =225.3; E_value=1.4e-64; Accession=PF03141.7; Description=Putative methyltransferase
  Pfam annotation: Domain name=Methyltransf_11; Domain location=404 -499; Score=43.1; E_value=9.6e-10; Accession=PF08241.2; Description =Methyltransferase domain
  Pfam module annotation: Pfam domain module=DUF248::Methyltransf_11; Domain location=285-521::404-499
  Subcellular localization annotation: CTP_CleavageSite=68; ConfidenceScore=5.42e-01
MALFQTRKKSSSPSYVSTLTILVFIALCVFGVWMLTSNSVVPPQTQSDEDTSTRTAIDTSATTNDELSSSEDSHETTSKSGEKEKDNPTAVYGDNPGHLPDDAIKADDNNSNNEPQKQQVDISDSQLSEESSLTQKDQVTAVIHEAGSDSDVKISEPEKQDEENQEQQDVQSFGTRGGSKTEEDEANKEQLREDKGVVEVAKKYEKVPADTSQQDSDAASKGTSSQEEETQNPKAEKKGGKSKKPWSTQVDQSQQENKRQTVESNSDEKLEDHTWYLCNVTAGADYIPCLDNEKALKQLRSTKHYEHRERHCPEDPPTCLVPIPKGYKTPIEWPSSRDKIWYHNVPHKLLAEVKGHQNWVKVAGEFLTFPGGGTQFIHGALHYIDFVQQAEPNIAWGKRTRVILDVGCGVGSFGGFLFERDVIAMSFAPKDEHEAQVQFALERGIPAISAVMGSQRLPFPSSVFDLVHCARCRVPWHLDGGMLLLELNRVLRPGGYFVWSATPVYQKLEEDVEIWKGRITYL

SEQ ID NO: 186956 - protein, 257 aa, Glycine max
  Coding DNA Sequence Number=SeqID_70178
  Gene Ontology: Mol. function=nucleic acid binding; Biological process= DNA integration
MATHVDEGKTEKKVEEHKQQLATEPTLELVSDLVELEEVMEDEDDQQERETPIKESEIEIKMKEDKEKEKEKEKEEKVEERKKSKRGYEREKKRELSPAEGKEVAYPLVPSKKDKERHLARFLDIFKKLEITLPFGEALQQMSLYAKFLKDMLMKKNRYIHSDTIIVEGNCSVVIRRILPPKHKDPGSVTIPCSIGEVAVGKALIDLGACINLMPFSMCRRLRELEIMPTRMTLQLVDRSITRPYRVIEDFWLGSNI

SEQ ID NO: 186957 - protein, 341 aa, Glycine max
  Coding DNA Sequence Number=SeqID_70179
  Gene Ontology: Mol. function=nucleoside-triphosphatase activity; Cellular component=membrane; Biological process=cell division
  Homolog annotation: Hit_ID=Q683K1; Match level="QueryCoverage=93%, HitCoverage=64%, E-value=1e-92, Identity=52%"; Hit description=AAA -type ATPase like protein
  Pfam annotation: Domain name=AAA; Domain location=121-317; Score =47.6; E_value=4.3e-11; Accession=PF00004.19; Description=ATPase family associated with various cellular activities (AAA)
  Pfam annotation: Domain name=AAA_5; Domain location=121-262; Score= -9.6; E_value=0.0096; Accession=PF07728.4; Description=ATPase family associated with various
  Pfam module annotation: Pfam domain module=AAA::AAA_5; Domain location=121-317::121-262
VDELKAQITWKLDEGSKEDSNNHNKKYSFELTFNEKHREKALDLYIPHVLKTYEAIKAERRIVRIYSRLDGYWNDSELSHPATFDSLALSPELKKDIIDDLERFQRRKEHYKKVGKPWKRGYLLYGPPGTGKSSLIAAMANYLKFDVYDLELTSIYSNSDLMRSMKEASNRSIVVIEDIDCNKEVQARSSGLSDDQDSVPDNEAAKVKTNRFTLSGLLNYMDGLWSSGGEERIIIFTTNHKEKIDPALLRPGRMDMHIHLSFLKGKAFRVLATNYLNIEGDHPLFEEIDGLLEKLEVTPAVVAEQLMRNEDPDDALETFVTFLKEMDKDSNCHLELRGTSE

SEQ ID NO: 186958 - protein, 59 aa, Glycine max
  Coding DNA Sequence Number=SeqID_70180
MRDRNCWGMRSWNAVLRSIMNVEKAAYTSNHDEAEVKEEKSCAETSSAHSRKVRVVWDN

SEQ ID NO: 186959 - protein, 151 aa, Glycine max
  Coding DNA Sequence Number=SeqID_70181
  Gene Ontology: Mol. function=nucleoside-triphosphatase activity; Cellular component=membrane; Biological process=cell division
  Homolog annotation: Hit_ID=Q9FN77; Match level="QueryCoverage=85%, HitCoverage=24%, E-value=1e-43, Identity=66%"; Hit description=AAA -type ATPase-like protein
MPFLKARPELLTLSGLLNFIDGLWSSCGDERIIIFTTNHKERLDPALLRPGRMDMHIHMSYCSYQGFKILASNYLETPSDHPLFGEVEGLIEDIQITPAQVAEELMKNEDPEATLEGFVKLLKRKKMEGDVCENSTPDKAEPTHQQSKRRK

SEQ ID NO: 186960 - protein, 82 aa, Glycine max
  Coding DNA Sequence Number=SeqID_70182
  Homolog annotation: Hit_ID=P27598; Match level="QueryCoverage=85%, HitCoverage=7%, E-value=5e-28, Identity=85%"; Hit description=Alpha -1,4 glucan phosphorylase L isozyme, chloroplast precursor
MVDILTVIFAIAQSVRDALIINWNPTYDYYEKLNVKQAYYLLMEFLQARALLNAIGNLELIGPYAEALSKLGHKLENVAYQV

SEQ ID NO: 186961 - protein, 116 aa, Glycine max
  Coding DNA Sequence Number=SeqID_70183
  Gene Ontology: Mol. function=metal ion binding; Biological process =metal ion transport
  Homolog annotation: Hit_ID=Q2QSQ7; Match level="QueryCoverage=64%, HitCoverage=31%, E-value=7e-09, Identity=41%"; Hit description=Heavy metal-associated domain containing protein, expressed
  Pfam annotation: Domain name=HMA; Domain location=6-66; Score=30.0; E_ value=8.1e-06; Accession=PF00403.16; Description=Heavy-metal -associated domain
MVKKTVLKVDISCLKCKTKLLKIVSSLQGVDKIEADEGKGTLTVTGDADPYEIIVRIRKAGKHAEVVSVGPPRDPPVWHSLGLILIDESIHQSVSALPKDKKEILLFSGCTSNYAG

SEQ ID NO: 186962 - protein, 155 aa, Glycine max
  Coding DNA Sequence Number=SeqID_70184
  Subcellular localization annotation: CTP_CleavageSite=27; ConfidenceScore=5.08e-01
LLVLLKLPFLFVFELEFAPVPIRVGVRVRVRVGVRVRVRSCSHSSSCSSLSHLVTLDLSSTMPLWVCVYNDPGAHLSVKFPSKLPFLFVFELEFAPVPIRVGVRVRVRVGVRVRVRSCSHSSSCSSLSHLGTWANLLLSVLCGHNSCRHFPHCRV

SEQ ID NO: 186963 - protein, 79 aa, Glycine max
  Coding DNA Sequence Number=SeqID_70185
MRDENSKKSKGNEIQHFECVGVCILQAVDCLSFCCLMKLSWSKKMVRKFFNIKSKTEDSQENGVAYGGWYLGFLQSSFY

SEQ ID NO: 186964 - protein, 136 aa, Glycine max
  Coding DNA Sequence Number=SeqID_70186
MSWTLYPTSWILHCALCSNSSIFGQDVLDIVSDIVDLAASILHLTFYLALIVESRNVKFLENDLISGSDQLRGLGSEIDHIKSQPSILSQRLVVIHTPQVQRDDEQPMTDIPQPVADNPVDQIDHQILENDEQLAK

SEQ ID NO: 186965 - protein, 157 aa, Glycine max
  Coding DNA Sequence Number=SeqID_70187
  Gene Ontology: Mol. function=protein dimerization activity; Cellular component=nucleus; Biological process=regulation of transcription, DNA-dependent
  Homolog annotation: Hit_ID=Q1S6L7; Match level="QueryCoverage=59%, HitCoverage=20%, E-value=4e-12, Identity=44%"; Hit description=CAMP response element binding (CREB) protein
YYIILNDPKYLNSDDNNQVNPPLPSLDEAAKGKSVVATEPTTISKSLFVLPPICKKTMDEIWSQIHKSQPHYNEANNSLARNEPLLKGQQALGEMTLEDFLVKAGVDVTTNDVLEKCPSLGKCTSFTRTNTAAMTRTSTTAMTRTTTTRVAQHPNQT

SEQ ID NO: 186966 - protein, 169 aa, Glycine max
  Coding DNA Sequence Number=SeqID_70188
  Gene Ontology: Mol. function=carbamoyl-phosphate synthase (ammonia) activity; Cellular component=cytoplasm; Biological process =pyrimidine base biosynthetic process
  Homolog annotation: Hit_ID=Q42601; Match level="QueryCoverage=72%, HitCoverage=55%, E-value=2e-45, Identity=66%"; Hit description =Carbamoyl phosphate synthetase large chain
MAPMSSTPYFSRVPLLARAKTRLRGLAAHGGEERVGTLPFEDALDEVRRHGGDVGAVDGFGTGHDSGGVGVDEDNLVPFFAEGLARLGAGVVELARFPDDDGARAEDQDLLYVGPLAQFGGGWFRDGDVGASDTRGVEARGGRRTWAEGGGRNGVVLGERFRGTEREGE

SEQ ID NO: 186967 - protein, 806 aa, Glycine max
  Coding DNA Sequence Number=SeqID_70189
  Gene Ontology: Mol. function=carbamoyl-phosphate synthase activity; Cellular component=cytoplasm; Biological process=pyrimidine nucleotide biosynthetic process
  Homolog annotation: Hit_ID=Q8L6J9; Match level="QueryCoverage=99%, HitCoverage=92%, E-value=0.0, Identity=52%"; Hit description =Putative carbamoyl phosphate synthase large subunit
  Pfam annotation: Domain name=CPSase_L_D2; Domain location=1-196; Score=261.3; E_value=2e-75; Accession=PF02786.7; Description =Carbamoyl-phosphate synthase L chain, ATP binding domain
  Pfam annotation: Domain name=CPSase_L_D2; Domain location=460-654; Score=10.3; E_value=6.3e-12; Accession=PF02786.7; Description =Carbamoyl-phosphate synthase L chain, ATP binding domain
  Pfam annotation: Domain name=CPSase_L_D3; Domain location=226-341; Score=150.0; E_value=6.3e-42; Accession=PF02787.9; Description =Carbamoyl-phosphate synthetase large chain, oligomerisation domain
  Pfam annotation: Domain name=CPSase_L_chain; Domain location=351-480; Score=2.4; E_value=0.0012; Accession=PF00289.12; Description =Carbamoyl-phosphate synthase L chain, N-terminal domain
  Pfam annotation: Domain name=MGS; Domain location=721-794; Score =54.9; E_value=2.6e-13; Accession=PF02142.12; Description=MGS-like domain
  Pfam module annotation: Pfam domain module=CPSase_L_D2::CPSase_L _D2::CPSase_L_D3::CPSase_L_chain::MGS; Domain location=1-196::460 -654::226-341::351-480::721-794
MKNIGIKTPPSGIGTTLDECLSIANDIGEYPLIVRPAFTLGGTGGGISYSIEGLLEICEAGIAASLTNQVLIEKSLMGWKEYELEVMRDLTNNVVIICSIENIDPMGVHTGDSITVAPAQILMDKEYQRLRDYSIAIIREIGVECGGSNVQFAVNPENGEVMVIEMNSWVSRSSALVSKATGFPIAKMTAIPRFAFENFPGSLPILTTQMKSVGEAMAVGIASKFLTQSIYAIYPAMKRGMQIDEIFELSYIDKWFLTQFKELVDVESFLLSNNFSDLTNIDFYEVKKRGFSDKQIVFATKSIEKEVHNKRLSLGVTPAYKRVDTCAAELEANTPYIYSSYDFECESAPTTRKKVLILGGGPNRIGQGIEFDYCCCHASFALLLDSYAEFCAVATLTICNPCHSPQIMTLVDRLYFKPLTVEDVLNIIDLERLHGIIVQLGGQTPLKLSFPLQQYLDEHKPACASGVGHIEHPKGGIARSETDAPATAADIGYPVVVRPSYVLGVEVDPEHPVLIDKYLSDACDIDVDALADSQGNVVIGGIMEHIEQAGIHSGDSACSIPTRTVPSSCLETIRSWTQNLVKQLNVRGLMNCQYAITPSGDVFLLEANPRASRTVPFVSKAIGHPLAKYASLVMSGKILYHLQFTKEVIPNYVSVKEAVLPFSKFPGCDVFLIPEMRSTGEVMGIDPSYNIAFAKAQIAAGQKLPLVGTVFLSLSDLTKPHLEKIAIAFVENGFKIVATSGTAHLHEGRPHAGDIIANGNIQLMVVTSSDDALDRIDGLASRRMALAYKVPIVTTVNGELWQLLKQ

SEQ ID NO: 186968 - protein, 49 aa, Glycine max
  Coding DNA Sequence Number=SeqID_70190
MVIEHISTELMIVDPLVKGMPPFKFKDHWSERFGLGRSSLAKVLHQFWS

SEQ ID NO: 186969 - protein, 199 aa, Glycine max
  Coding DNA Sequence Number=SeqID_70191
  Gene Ontology: Mol. function=transition metal ion binding; Cellular component=cytoplasm; Biological process=proteolysis
  Pfam annotation: Domain name=Transposase_21; Domain location=55-199; Score=131.4; E_value=2.4e-36; Accession=PF02992.5; Description =Transposase family tnp2
MHNCPKFGVSWYKVKDDNECSSDESTMKGPPTKVLWYLLIIPMFKHLFANADYAKYLTWHADRRNCDGMLRHPADSSQWKKINSLYPEVGKEARNLSLSTQHSSWPVFLQKYMVFFMLISGPRQPKNVIDVYLSPLIEELTKLWDEGVTVFDGYRNETFKWRAMLFCTINDFPAYGNLSGYNVKGQHACPICEEDTTYA

SEQ ID NO: 186970 - protein, 49 aa, Glycine max
  Coding DNA Sequence Number=SeqID_70192
  Gene Ontology: Mol. function=protein serine/threonine kinase activity; Cellular component=membrane; Biological process=protein amino acid phosphorylation
  Homolog annotation: Hit_ID=Q1S7U2; Match level="QueryCoverage=94%, HitCoverage=16%, E-value=2e-15, Identity=80%"; Hit description =Protein kinase
HLRPEIPRSCPSALSNIMRKCWDAKPEKRPEMHEVVEMLEAIDTSKGDE

SEQ ID NO: 186971 - protein, 73 aa, Glycine max
  Coding DNA Sequence Number=SeqID_70193
MVKCLVKLQTKFREDPTVNEGWAAFLPRQLHTKFREDPTVNEGWEAFLPRQLHVAFSRSFIKRLPLEASSWLL

SEQ ID NO: 186972 - protein, 90 aa, Glycine max
  Coding DNA Sequence Number=SeqID_70194
MDQHDFFGSGVFGRNSHWRKGFWLLIKKGTASCVIPSFLLPRVRVAIPILGQGLWPMSAQQACRGLGMMYVRDVCLASGSGIRECPTLFP

SEQ ID NO: 186973 - protein, 321 aa, Glycine max
  Coding DNA Sequence Number=SeqID_70195
  Gene Ontology: Mol. function=protein serine/threonine kinase activity; Cellular component=membrane; Biological process=protein amino acid phosphorylation
  Homolog annotation: Hit_ID=Q9LUI6; Match level="QueryCoverage=89%, HitCoverage=76%, E-value=1e-117, Identity=70%"; Hit description =Kinase-like protein
  Pfam annotation: Domain name=Pkinase; Domain location=77-317; Score =121.6; E_value=2.2e-33; Accession=PF00069.15; Description=Protein kinase domain
  Pfam annotation: Domain name=Pkinase_Tyr; Domain location=77-314; Score=86.1; E_value=1e-22; Accession=PF07714.7; Description=Protein tyrosine kinase
  Pfam module annotation: Pfam domain module=Pkinase::Pkinase_Tyr; Domain location=77-317::77-314
MHSEGGVTPKMGLEAVPSNSKMICSENLSSKNMNFRADKIDLMNLDVMLEKHVNRIFSKSIEAKRHKESWEIDLTKLDLQYCVANGAYGTVYRGTYDNQDVAVKVLDWGEDGVATAVEIAALRASFWQEVTVWQKLDHPNVTKFIGASMGTSNLKIPLPSCGQNSVPSKACCVIAEFLPGGTLKQYLFKNRQNKLPYKVVIQLALDLSRSLSYLHSKKIVHRDVKTDNMLLDAKQNLKIADFGVARVEAINQSEMTGETGTYGYMAPEVLNGKPYNRKCDVYSFGICLWEIYYCNRPYSKLSLAAVSRAVINQLQFFPGSV

SEQ ID NO: 186974 - protein, 137 aa, Glycine max
  Coding DNA Sequence Number=SeqID_70196
  Gene Ontology: Mol. function=ribonuclease H activity
  Homolog annotation: Hit_ID=Q1RZZ2; Match level="QueryCoverage=89%, HitCoverage=60%, E-value=5e-10, Identity=33%"; Hit description =Ribonuclease H
  Pfam annotation: Domain name=RnaseH; Domain location=3-129; Score= -26.7; E_value=0.018; Accession=PF00075.14; Description=RNase H
MSLNVDGAWFVHDPKAACGGILRDHVKDNFKELLHADWKYICSVVQSELWVIFHGINLAREHGFSSLEIHSDSKDVIRMVKGLKDLHVRDKCTVDATKACIVPLMNVHFVHVFRVRNKVADHLLSMYLLSELSFKAW

SEQ ID NO: 186975 - protein, 101 aa, Glycine max
  Coding DNA Sequence Number=SeqID_70197
  Gene Ontology: Mol. function=protein-tyrosine kinase activity; Cellular component=integral to membrane; Biological process=protein amino acid phosphorylation
  Homolog annotation: Hit_ID=Q1RTK1; Match level="QueryCoverage=91%, HitCoverage=17%, E-value=4e-20, Identity=46%"; Hit description=Sugar transporter superfamily
MHYLYTVLASSDLPHHYLKSNNVLVGPDNEPMLVDYGKAPEATQQGQVSRSCIVHCLGVVIIEILTARFRSQYVSNGKGGADVVQWVETAISEGHADIFSV

SEQ ID NO: 186976 - protein, 249 aa, Glycine max
  Coding DNA Sequence Number=SeqID_70198
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=99%, HitCoverage=67%, E-value=3e-86, Identity=64%"; Hit description=SAM dependent carboxyl methyltransferase
  Pfam annotation: Domain name=Methyltransf_7; Domain location=36-249; Score=135.9; E_value=1.1e-37; Accession=PF03492.6; Description=SAM dependent carboxyl methyltransferase
MEVTQVLHMNGGSGETSYANNSLVQQKVICLTKGMREEAISSLYRSMLPRSLAVADLGCSSGPNTFFVISEAIKSVEKLCRELNHQSPEYQIYMNDLPGNDFNNIFKSLDSFKEKLCNEIIEAGHGIGSCFFNGVPALCGYPSEYYVNYTIAPDYYYKSYRSDKVPDGVENNKGNIYMASTSSLNVLKAYYEQYQKDFSLFLKCRAEEIVEGGRMVLTFLGRRSDDRSSKECCYIWELLAMALNDMVSK

SEQ ID NO: 186977 - protein, 98 aa, Glycine max
  Coding DNA Sequence Number=SeqID_70199
MASYLVNGNATNEFSMEYRSKLNAYVQFMDDTLITGDIMHQNVCTIKVILQLFKVVLGLKVVLIPFVFFALPIEAYHMKLSILYALSIYFLSLFKAPK

SEQ ID NO: 186978 - protein, 108 aa, Glycine max
  Coding DNA Sequence Number=SeqID_70200
MARNFNMISICGCYYGGGFGFFLTVVVETIQLRYESVSTVSKFNFFFPSRRREGGSLGGGGDVRCTLVTCWSWVRIRKQPLCICKGKAAYNIPPPYLRIAKSLWAMGY

SEQ ID NO: 186979 - protein, 796 aa, Glycine max
  Coding DNA Sequence Number=SeqID_70201
  Gene Ontology: Mol. function=ent-copalyl diphosphate synthase activity; Cellular component=chloroplast; Biological process =metabolic process
  Homolog annotation: Hit_ID=O04408; Match level="QueryCoverage=99%, HitCoverage=96%, E-value=0.0, Identity=68%"; Hit description=Ent -kaurene synthase A, chloroplast precursor
  Pfam annotation: Domain name=Terpene_synth; Domain location=272-491; Score=377.9; E_value=1.5e-110; Accession=PF01397.11; Description =Terpene synthase, N-terminal domain
  Pfam annotation: Domain name=Terpene_synth_C; Domain location=508 -758; Score=161.9; E_value=1.7e-45; Accession=PF03936.6; Description =Terpene synthase family, metal binding domain
  Pfam module annotation: Pfam domain module=Terpene_synth::Terpene _synth_C; Domain location=272-491::508-758
AVSSETNDKQEIRCRAISKPRTQECSDIFQGSLATLKFREINVEDDIEEEQDIGALVANEIKKRVDTIKSILGSMEDGEITVSAYDTAWVALIEDVHGTGVPQFPSSLEWIAKNQHPDGSWGDKELFSAHDRIINTLACVIALKTWNMHPEKCEKVISSILLSKVSSLSFVIEKKGFIKDDKSSSRMAFFRENLGKLQNENVEHMPIGFEVAFPSLLDMARGLDIEVPNNSPILNKIFAMRNVKLTRIPRAMRHKVPTSLLHSLEGMSGLDWKELLKLQSQDGSFLFSPSSTAFALMQTKDQNCHNYLNKVVKRFNGGVPNVYPVDLFEHIWVVDRLERLGISQYFQQEIKDCLSYVYRNSNVQDIDDTAMGFRLLRLHGYQVSADVFKNFERNGEFFCFTGQTTQAVTGMFNLYRATQIMFPGERILEHGKHFSAKFLKEKRAANELVDKWIIMKNLAEEVAYALDVPWYASLPRVETRFYIDQYGGESDVWIGKTLYRMAYVNNNNYLELAKLDYNNCQALHLIEWGRIQKWYSESRLEEFGMNRRTLLLAYFVAAASIFEPEKSRVRLAWAQTSILLETITSYVSDAEMRKAFMKKFSDCLNRRDYSIGWRLNRNRTGHGLAETLVATIDQISWDILVSHGHEIGYDMHRNWEKWLSSWHREGDKCKGQAELLAQTINLCGGHWISEDQVSDPLYQSLLQLTNNLCNKLRCHQKDKELESSNSGTNVNSMITQEEESKMQELVQLVHQKSPTGIDFNIKNTFLTVAKSFYYTAFCDSRTVNFHIAKVLFDEVV

SEQ ID NO: 186980 - protein, 98 aa, Glycine max
  Coding DNA Sequence Number=SeqID_70202
  Homolog annotation: Hit_ID=Q1S326; Match level="QueryCoverage=98%, HitCoverage=38%, E-value=5e-15, Identity=35%"; Hit description =Putative receptor kinase-related
MAKNCCSTFFLAMDAIRHWTPHYWDVKNAFLHGELEEYYMEQPLDFVVHGEFGLWFNQRMESLFNRRKLDVLKESSMLDCRPIDSSKDPNHKFFPYQG

SEQ ID NO: 186981 - protein, 76 aa, Glycine max
  Coding DNA Sequence Number=SeqID_70203
  Gene Ontology: Mol. function=oxidoreductase activity; Cellular component=membrane; Biological process=electron transport
  Homolog annotation: Hit_ID=Q2LAK0; Match level="QueryCoverage=94%, HitCoverage=13%, E-value=8e-27, Identity=89%"; Hit description =Cytochrome P450 monooxygenase CYP701A16
MGPIYSIRTGASTLIVLNSPHLAKELIISDQAMVTRFSSISTRKLSNALKILTSDKCMVPTSDYNEFHKTVKRHSY

SEQ ID NO: 186982 - protein, 896 aa, Glycine max
  Coding DNA Sequence Number=SeqID_70204
  Gene Ontology: Mol. function=nucleic acid binding; Cellular component= intracellular; Biological process=DNA integration
  Homolog annotation: Hit_ID=Q1T010; Match level="QueryCoverage=98%, HitCoverage=88%, E-value=0.0, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=258-384; Score =74.6; E_value=3.1e-19; Accession=PF00665.16; Description=Integrase core domain
  Pfam module annotation: Pfam domain module=RVT_2::rve; Domain location=543-800::258-384
MAAMNAIPGNLPVFDRKGYEDWCAKMDAILGFQELDEIVATLKQAWDILQQVYGNTGRTKKVVTNSMKACDEAMVDSKIVEKVLRTLTPNFDHIVVAIEESKDIENMKVEELQNSLEAHEQRPKPTTSLEVMVAGPKEEEEDKEEAEVVIEMQKHKVQLPESIFLEAIQMSNVIIPILEETTLSKVEMIGNNNAHCKCKKNDQAHLAHEEDGSDSDQVLLMVTMSSKEDCSSWFADNSTILAEGIGKVMITRKNGETTAKQPLGIVHSDVCGSFDTPSLGGNRQSELKLKILRTNEGDEYNSKEFKEFCEAKGIEHEVIAPYTPQHKGLAERTNRTLLDMARCMLKGKGLPNCYWVEAVTKTTYVLNRCPTKRLQSITPEEAWTGDKPIVNHLRIFRSLSYKNIPDERRKKLDDKSEALILVGYHPTGAYKLYCPLKQQVVISRDVVIDETATWKWENDSKIHNSYILEDSPRAKDVNPASSMQPLIRRSQRTRFPSTRLADYELYSNSSISDAGEMVHFAVMIDTEPVHWKQALDIREWNVVMKEELDAIEKNRTWELVDLPHNKHPIDVRWVFKVKLKPDGLIAKHKARLVAKGFLQKQGIDYTKVYAPVARMETIRLVIVIASSRNWTICQLDIKSTFLNGPLEEEVYILQPPGFEIKGKEHKVYKLLKALYGLKQAPRAWNRVIENFLSKQGFVKCTLEFGVYVKETQHKNLLFVCLHVDDLIITRDVDEEIEQFKEKMKSEFDMTDLGILHYFLGFEFMHTQKGIFLHQKKYTSEVLKRFNMENCNTVPVPVMPNLKLTEELDEKPVDATLFKQIIGSLIFLCNSRPDICYGVGLLRRFMGNPRAPHMTATKHILRYLKGTSDFGLLFPIGNDQNKSCIKAYSDLDWCGDK

SEQ ID NO: 186983 - protein, 383 aa, Glycine max
  Coding DNA Sequence Number=SeqID_70205
  Homolog annotation: Hit_ID=Q9FJZ1; Match level="QueryCoverage=98%, HitCoverage=98%, E-value=3e-50, Identity=33%"; Hit description =Arabidopsis thaliana genomic DNA, chromosome 5, TAC clone:K1F13
  Subcellular localization annotation: CTP_CleavageSite=42; ConfidenceScore=5.17e-01
MPTFTAMALDRLIEPGASKPVDKSAPTSMPVPNSQKLERSTSAPAKKSKVPQPPLKPALYTTPEVTPLPDAPSSFPPSPYIINHKRRGPRLLKSSSEASALSEVNIRCDDDNDKSVDAVVTSSAGDLQVTSTKPELVKEEKVNGVYDGQLDRSNDVDHANGHRETGSGSLTNGLLKEKPPALNLDRVSEVEDFFYPLDSMSFSSNTDGEENAGTELSMKLSSPSTEFYDAWEELSSEGMSQNSTYDIEAELREVRLSLLVEIEKRKQAEESINNMRSQWESIRQGLYQAGIILPAYLNATAEDEQLTSDPVEDLCQQVYIARFISNAIGKGIARAELETEMEAQLEAKNFEIARLLDRLHCYETMNREMSQRNQEAVGETYVI

SEQ ID NO: 186984 - protein, 72 aa, Glycine max
  Coding DNA Sequence Number=SeqID_70206
MRDENTDKGSHVLVVQQSKEKVMQLVCLEKWEDFKKLRVMKTNDDKFKANVVQNFEDEDMYLASAEEVAKSK

SEQ ID NO: 186985 - protein, 157 aa, Glycine max
  Coding DNA Sequence Number=SeqID_70207
  Gene Ontology: Mol. function=ion channel activity; Cellular component= spliceosome; Biological process=RNA splicing
  Homolog annotation: Hit_ID=Q6YTU8; Match level="QueryCoverage=86%, HitCoverage=30%, E-value=1e-59, Identity=82%"; Hit description =Putative potassium channel regulatory factor
  Pfam annotation: Domain name=Prp18; Domain location=1-111; Score =181.1; E_value=2.7e-51; Accession=PF02840.6; Description=Prp18 domain
MGSPNMGGSRTAKPTLQAMVLPDDIRQALLLMVECCMRRDYLAAMDHYIKLAIGNAPWPIGVTMVGIHERSAREKIYTNSVAHIMNDETTRKYLQSVKRLMTFCQRRYPTLPSKAVEFNSLANGSDLHSLLAEERFSGGNQAASEERLRIMPAPRDS

SEQ ID NO: 186986 - protein, 565 aa, Glycine max
  Coding DNA Sequence Number=SeqID_70208
  Gene Ontology: Mol. function=protein binding
  Homolog annotation: Hit_ID=Q683B0; Match level="QueryCoverage=92%, HitCoverage=95%, E-value=2e-65, Identity=34%"; Hit description=MRNA, complete cds, clone: RAFL21-63-G01
  Pfam annotation: Domain name=F-box; Domain location=86-133; Score =18.8; E_value=0.02; Accession=PF00646.23; Description=F-box domain
MAAKRPCPSQNPRAENNLGEVERRLEAFLSLSHVASLSLDLSFERLLQSLPSDSDSDLIDRALKMASLLLDAAKHSSRKRASNHNSLSWPLPPDLTIKVFSMLDTQSLCYASATCLLFSKCAKDPMCYANLDLTTLVPKVNNAVVATMIQRAGKGLRSLKLGVVPSAATSLGSCPPFVCTIRNAIVEVPNFSWNDKRSRQGRESSILTRCCLSPLSGDGGAPGALLRKLHLYNIERMDNASLGAALSACPSLLDLEIVGLMNYSQKMGIFGQSMLHAEVLSFLLAVDRPLMKSMEMSLQLWIRIGNGCRRLVSHVELRQTLMSVSANCHLIERLFFESSKTGRDDSLKAQTCFELVNNCPHLTSLSLRGFKLHDCKVRVLVKGFRKLKYVDFSTSYSITGNFLRNLGSCNGGNLLEVLILRDCMHLKEMEVARLLTAILAGDFKLLVHLDISNREGLASEADWYHRCYNSSIMPTKQVLEARPDMCLVAEYPSAEGSYIETFDADMNSEISLPSQLSSHTSDGSIFMSTSESSYNSDQGSGNEDGQDANYVIYEESSDEIDFLSL

SEQ ID NO: 186987 - protein, 125 aa, Glycine max
  Coding DNA Sequence Number=SeqID_70209
MPYTVICTHNSAIVTRGSGSMWRYLMVIHTFHQLEASEPVDTQRPMWSFAPFPEMSASSARDRKKASEPVDMQRPMWSSAPFLEMSTSSDRDREKVSPLRRYLECARSFVPESISYLSISAFAFV

SEQ ID NO: 186988 - protein, 520 aa, Glycine max
  Coding DNA Sequence Number=SeqID_70210
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=31%, E-value=1e-158, Identity=54%"; Hit description =Chromo
IPYGYPHLDTGQQFIKEETVVDDHHLSLNALERAIVLIDGGSSDNFMQPRIAKFLKLPVEPAPSFKVMVGNGNYMETKGLVQNLIIQAQGNVFQLPVYALPISEADLILGANWLKTIGPHIADYALLNLRFLHGNKFITIQGEVDHVPVQAHLHHIRRMVNTYSIVEVYTVKMVDPIAQAIPLSELLDDMEPKLALLLHNYASVFDTPTSLLPHRTQDHYIPLIKGSGPVKVMPYHYPHSQKEEIEKLVADMLIEGIIQPSKSPFLSPIILVKKKDGSWRVCTNYRALNATTIKDSFPKPTVDVLLDELFGASFFSKLDLSSGYPQVLLTPEDIHKTAFRTHHGHFEWLVMPFGLTNAPTMFQGLMNDIFKDVLRKFVLVFFDDILIYSSLWNNHLYHLEVVLKTLQQHQLYARFSKCSFGVTKIEYLGHTFSGRGVAMDTTKLDAIRTWPLPTNLNQLCGFLGLSGYCHCFVKSYAQLAAPLIDLLKKDSFKWTVATTIALYHICEGYKSTRKMGLGCG

SEQ ID NO: 186989 - protein, 183 aa, Glycine max
  Coding DNA Sequence Number=SeqID_70211
  Gene Ontology: Mol. function=N-acetyltransferase activity; Biological process=metabolic process
  Homolog annotation: Hit_ID=Q1S7V2; Match level="QueryCoverage=84%, HitCoverage=98%, E-value=1e-44, Identity=53%"; Hit description=GCN5 -related N-acetyltransferase
MAASNYICIISRPKLKASSQATYSILMEGAAICSTADAREEGVDLTQISLRPISLDDLDDLMLWTTDEKVAKHCTWEPYTSKEGGINFIHNIASKAPWFRAICINNQPGIATHAVKQVVKAAFSEFPHLERLQALVDVENVASQRVLEKAGFQREGVLRKYVVIKGKSRDMITFSVLPNDPLS

SEQ ID NO: 186990 - protein, 1776 aa, Glycine max
  Coding DNA Sequence Number=SeqID_70212
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=91%, HitCoverage=92%, E-value=0.0, Identity=57%"; Hit description =Prefoldin
  Pfam annotation: Domain name=KIP1; Domain location=1-52; Score=87.5; E_value=4.2e-23; Accession=PF07765.3; Description=KIP1-like protein
MDAKVKAMIKLIEEDADSFARRAEMYYKKRPELMKLVEEFYRAYRALAERYDHATGELRQAHKTMAEAFPNLLTDDSPCSSSGTGPEPHTPEMPHGSHPIRALLDSVDLQKDAFGFSSIQNTLKMNGESLEESANGLSRKGLKQLNEIFGFSQLSAEKQNAKAQIHADSEHAQKAESEVQTLKKALEDIQSDKDSIFLQYQKSLEKLCEIERELNEAQKDAGGLDERASKAEIEIKVLKEALAELKYEKDAGLLQYKQCVERIASLETTLSLAQMDAKGNDERAAKAETEAKNLRKELATLEAEKDAAHLQYKQCLEKISVLEAKITHAEENSRKLNEQIERTELEVKSLKKNIAELNGEKESVTVLYKQCLQKISTLESEILLAQEISERLNREIEIGAEKLKTAEKHSDMLETSNRSLQLEADVLLQKISLKDEKLLEKHTELERLQTVMHEEQSRFLQIESTLHTLQKSYSQSQEEQRSLALELKHGLQLLEDLQLSKQGFREEMQQIVEENRTLHELNFSSTRLLKNQQTEISELKMIKEKLEREFAVKVEESNLLQRESHQIKDEIQGLNNRYQAILEELGSVGLNPKSFALSVKDLQKENTTLKEACKMERDEKEALREKSKDIDKLLSENAFMGSSLSNLNNELGGLRDTVKKFQESCGVLQEEKSILVTEKSSLLSQLQIITESMQNLLEKNTLLEKSLSDAKIELEGLRAKSSSLEEFCNLLNNEKHNLLNERSVLVSQLESVEAKLGNLEKRFTKLEEKYSDMEKDKESRVSQVEELHSLLLTQKEKHANQKHSSEARMANLENIVLRLQEERRLGKIEFEEELDKAVNAQVEMFILQKCVEDLEQKNMGLLIECQKHVEASKFSDEVISELESENLMQQMELEFLLDEIRKFKMGIHQVLAALQVDSGGGHGKGIKQEEMPISHILNNIEGLKGSLVKTQEEKLQLLVENSVLLTVLSQQEFEGEELVSEKRILEQEFENTREQHAMLQKVKLELLEMNRQLRSEVTKGEEKESELRSKLEALHVELIDLQRTNLVFEEENCKLVEEKNLLLGSVLELKDAKSAAEQENSVILHEALALKNLSLVYECFFTEKVLEQRALAEHLSGLHSVNNDLKRELGLLREKFEVKEAQNVYWKESVERMDKDLHEAKSENNHLNCQVESSEHLLVKKNAELLEMEERLKAAEMLSAEFCRDIEKLKMGKQQSRLINENLERQILELSEGCMSHKKEIEHLNEANRSLLSEMRSLRQEVEQQRAREETLSSELLDKTNEFELWEAEAATFYFDLQISSISEALLENKVTELTGVCMRLEDESDAKSLEIKQMTERVCLLESEIGGLKGQLSAYNPVISSLKEDFASLEHTALVRINKMPVECNQEQKDAVIETCLHENGYQSSRDNKSTLIPDGVSDLLSVKARIRAVEKSMVEEIKKLVKEDNLTTKANPGALTKATNVEVSPYVENCNRKEDKVPKDESTHDVNSWRTKTENGSLMKDIPLDHISDNSASKSCRRENSGTDDQMLELWETAEQDCFASSMISEAMKQSSVPTEDVIAYHQSDHSGKFQNTSSELDVEKELGVDRLQLSRSIKERTQDGKRRKILERLSSDAQKLTILKTAVQDLKQKMETKRSKKGVETEYETVKRQIDEVEGAVVKLVDTNDQLTKDLEESAPSLNRQTSAELEKSRHIQRKRVTEQARKGSEQIGRLQFEVQNIQYTLLKLADEKSKGKSRFTGKTVVLLKDFIHSGKRSSKKRNKGFCGCSRPSTNED

SEQ ID NO: 186991 - protein, 96 aa, Glycine max
  Coding DNA Sequence Number=SeqID_70213
MEREKKEATDTEKQQTVSDIKRKQRHCTLQNYRNTYEIKNLPSETNLMNYPNSTDHTNETKTQNYANGHPENYKKHRTLIHFTSLTPQKHGIWQWE

SEQ ID NO: 186992 - protein, 48 aa, Glycine max
  Coding DNA Sequence Number=SeqID_70214
MYKGVEGSAAGCGEERSTTGAGGFDVPSRDLSGVAAVSGLSYSSPASG

SEQ ID NO: 186993 - protein, 232 aa, Glycine max
  Coding DNA Sequence Number=SeqID_70215
MASRKRKSIGARPTGLYDTRRFHSLDAWNRYTDNVLGRSILPERKVEIYHTEFDDFKTKFESSKDPSPKLARVRGHLVKIDADSLNTFLETPIVLEEGETLPTYSRLGFPALITALCQARGVVSDSLTFEHLSLAINLAYIRKNCWNDDDLTITFRGARRARAKPADIPFTSIALTPTPTSTSAAPSVLAHVDSQRFEAMLQKSIGGSSFRIHPISVAVLREGSLAWGPTFS

SEQ ID NO: 186994 - protein, 97 aa, Glycine max
  Coding DNA Sequence Number=SeqID_70216
MTKACQKGVRKGKEGEACHPARPGELGCFLQKAPPRRPKWVWFLFAPPYNFTDRATMLFFDFWHVMELHVLCNNGCQVPRSGQAKVACHQTMVPGRN

SEQ ID NO: 186995 - protein, 129 aa, Glycine max
  Coding DNA Sequence Number=SeqID_70217
  Homolog annotation: Hit_ID=Q9FJZ0; Match level="QueryCoverage=36%, HitCoverage=48%, E-value=1e-12, Identity=67%"; Hit description =Arabidopsis thaliana genomic DNA, chromosome 5, TAC clone:K1F13
MQLRGTLTEETKLGSNMFRSTSTRGPAKYERLEKEHADNGTSNEEFKRSTSLPSRAMGSTFGDINLHRNPTKKANSKPKEKKSHPLFSFFDLRRKKKTTARPEFARYLEYVKEGGMWDLNSNKPVMYYK

SEQ ID NO: 186996 - protein, 290 aa, Glycine max
  Coding DNA Sequence Number=SeqID_70218
  Homolog annotation: Hit_ID=Q9LUA7; Match level="QueryCoverage=80%, HitCoverage=73%, E-value=2e-43, Identity=40%"; Hit description =Arabidopsis thaliana genomic DNA, chromosome 5, P1 clone:MIF21
  Pfam annotation: Domain name=DUF868; Domain location=24-282; Score =404.3; E_value=1.7e-118; Accession=PF05910.3; Description=Plant protein of unknown function (DUF868)
MKEFPSCFGENGVRVVDSSYSSTTRGAQNAVTCVYQCKLGGRSCLITVSWTKNLMGQGLSVGIDELGNHCLCKVDIKPWLFSKRKGSKNLEVESNKIDILWDLSCAKFGSGPEPLEGFYLVVVFNQEMVLLLGDLKKEACKKIDSDYACADHSEAVFIAKREHIFGKKFYGAKAQFCDKGQVHDVRIECDTLGLNDPCLVIRIDSKTVMQVKQLKWKFRGNHTILVDGIPVEVFWDVHNWLFGNAMGDAVFMFQTCISTEKLWSSSQSSVSDPSVLTWAYSQQFRDSQLQ

SEQ ID NO: 186997 - protein, 1265 aa, Glycine max
  Coding DNA Sequence Number=SeqID_70219
  Gene Ontology: Mol. function=heat shock protein binding; Cellular component=integral to membrane; Biological process=protein folding
  Homolog annotation: Hit_ID=O23230; Match level="QueryCoverage=99%, HitCoverage=86%, E-value=3e-68, Identity=26%"; Hit description =Trichohyalin like protein
  Pfam annotation: Domain name=TolA; Domain location=875-1201; Score= -145.2; E_value=0.033; Accession=PF06519.2; Description=TolA protein
  Pfam annotation: Domain name=Vicilin_N; Domain location=466-561; Score=-74.6; E_value=0.1; Accession=PF04702.3; Description=Vicilin N terminal region
  Pfam module annotation: Pfam domain module=TolA::Vicilin_N; Domain location=875-1201::466-561
LAETDSFSGESDQSANNQSMSKGDLFHSVDGNAGFDVLYHNKVNGTSNKRKSKGKTHMTQLHAVPGFGRVYDETTQLHQTDPSFQIADDIDLDMEFKADKVEGNHPRKTMAHLRNFAFGDQTFDSDLNIQNGGSRKDSDSREMFITVSDINLRSLPSQVPPPSRPPPALDVKKGSMPGFHSNSRLVASEETPGAGSPPFFDVEDHMNSSATASVDAIKEAMLRAEAKLRSAKELKERKKRDCESHLKSSYDAKINEAKMCKDIKRLSSLNDQTTQGSHDQRHSKTKLSVTDDRQKLKKASPETLDNLEGKRVLNTFEEKDKMESRSSQESDRSSGVGTWKDECEFFELAGMEESRRVTQPTKQSKDLVQGTEAQKHDQMEREASNVQEKHKQVKATAENYQGEEYEKKYKAAKEACEHHENIMKSEASNGKHRQREQMKKEKMAKVFEVEDNEKAIKIAHQHGKTEKKVTEADQSRIVEDVCEMEHREHKQVEIQKPKEVNRQTPNEVQLTMGLRENEKKLKEVEKQQQSMKRHKQYEKIKENGKTEREAFALGQTEHEEKLKGSVEPEDMDERSNVAFEPYYTEEKEVSKRENEMKLKLGEQIQVKKRLKEAHERVEIEKSLKSSSENEESDDGLTRAFRLDGNGKQLKEDFELEVNEIRLKEASKQRENEAYEKDQNRKKFKDVYGEGNRLQEAGDNKGIQKVMNQTPMQQINGMLNEAQRKKVTESTSSQTFAMEGSVAVSNENSHLEQSENMEQDVGEMEKDKGLNKAFDMERNGEGGNIKNAKATNETREIESDEDLAAQSAFVHEEFIGKQNVSKESVADQDIGLMRTECKVGEKKLKEIGVENQQANEKIRAPEMTAGDAEHSGTQTKKEGDTVTKADYRGTEAAGPAAVQETLNVQKAAQWFHVDQSTESKAKSTNETSSIVKDAERMGRERESEKDHLTQTEEEGDREREREKDIEKAMLEAEREREREKDRMAVDRATLEARDRAYAESCERAAFERATVEARYKALAEARERLEKACAEARDKSNIDKETIEARLKAERAAVERATAEAQDRAMEKLKNERTAFESREWLARSVSDNFCGRPDSSSSDMLDPEFQNLSSTTGSRHPYSLYGAASFSERSDKEGESAQRCRARLERYRRTAERAAKALAEKNMRDLLAQKEQAERNRLSETLDAEVRRWSGGKEGNLRALLSTLQYILVPDSGWQAIPLTEVITSAAVKKAYRKATLCVHPDKLQQRGASIQHKYICEKVFDLLK

SEQ ID NO: 186998 - protein, 103 aa, Glycine max
  Coding DNA Sequence Number=SeqID_70220
  Gene Ontology: Cellular component=integral to membrane
  Homolog annotation: Hit_ID=Q9M2D2; Match level="QueryCoverage=95%, HitCoverage=24%, E-value=3e-16, Identity=44%"; Hit description =UPF0187 protein At3g61320, chloroplast precursor
MTLNDELVGEGGGAEEGEEVREEVEEEGLIVGDDGGGKGGEEEDGRDEGEDDAGGEAGEDVAEVAEGAAVVAPVLVGVEGALLLHVALLHGVGPIRDGAEERD

SEQ ID NO: 186999 - protein, 127 aa, Glycine max
  Coding DNA Sequence Number=SeqID_70221
  Homolog annotation: Hit_ID=O23230; Match level="QueryCoverage=73%, HitCoverage=7%, E-value=4e-18, Identity=49%"; Hit description =Trichohyalin like protein
  Subcellular localization annotation: CTP_CleavageSite=67; ConfidenceScore=5.16e-01
MAHSRQQNKAGFTLSSKINNNGSFSSGTGSKSIYDDVYGGPLKFGVSSLSPRFEDYGEIFGSFHTVRASSIPVLDLPAVHHSEAFFDPRNHAFNYTEVFGALDFAVPYENLFHPHTALDGASEEEAW

SEQ ID NO: 187000 - protein, 418 aa, Glycine max
  Coding DNA Sequence Number=SeqID_70222
  Gene Ontology: Mol. function=nucleic acid binding; Cellular component= nucleus; Biological process=response to salicylic acid stimulus
  Homolog annotation: Hit_ID=Q1T242; Match level="QueryCoverage=49%, HitCoverage=44%, E-value=4e-14, Identity=28%"; Hit description =Homeodomain-like
  Pfam annotation: Domain name=Myb_DNA-binding; Domain location=143 -190; Score=21.1; E_value=0.0041; Accession=PF00249.21; Description =Myb-like DNA-binding domain
MSDYYFDEEEILELLKEDDWPVFDDLFNNFATQDSSPPADEILPANEDSSPLADDEILPAHEVLDAPAPLPVPPPAPAPNRVHTSATALDPAPQMVLASQDPTKPSEETLSSSHPHHLLQHNMDPSHVILSGDSSHSVHHKKYEHWTIEEHKSFLFGLEIKKEKGWKQISDKYVPSKTASQVASHAQKYIKRKNTPMKERKRRSIHDTILEDIDIIRIDQHNWVPPTSNFIVQPHTLGSNWVPSTSNLMVQSHTPVTDQHNWIPPCPSNFAVPQCIPHVDQDNWVSPPSNLAAQSCTAHIDQYTWDPPPPNFAVQPPTPHIDQHNWVPSPPNFSPHTSLIDQDNWVPTPPDFAVQPHEMQRAQHMQMQQLNLHSSSPQMDEYRNFNSGHPQNELDLIAQQILEYKNKFNHKNNEGSTR

SEQ ID NO: 187001 - protein, 103 aa, Glycine max
  Coding DNA Sequence Number=SeqID_70223
MAVNGNDYLQICVVAAKHIISAMMIHLSVNSIIYIEQRLCDKMKGRVKEKNRRKKRERKNAQMEICHATKTPVGGTVVNLYLASPMQQPVSKTSGRIPHSLSL

SEQ ID NO: 187002 - protein, 145 aa, Glycine max
  Coding DNA Sequence Number=SeqID_70224
  Gene Ontology: Mol. function=inorganic diphosphatase activity; Cellular component=cytoplasm; Biological process=phosphate metabolic process
  Homolog annotation: Hit_ID=Q6KBB0; Match level="QueryCoverage=82%, HitCoverage=55%, E-value=2e-60, Identity=91%"; Hit description =Putative inorganic pyrophosphatase
  Pfam annotation: Domain name=Pyrophosphatase; Domain location=1-145; Score=228.3; E_value=1.7e-65; Accession=PF00719.9; Description =Inorganic pyrophosphatase
MVVEIGKGSKVKYELDKTSGLIKVDRILYSSVVYPHNYGFIPRTICEDSDPMDVLVLMQEPVLPGSFLRARAIGLMPMIDQGERDDKIIAVCADDPEFRHYTDINELPPHRLAEIRRFFEDCILLFARTNKPHASLFVVIDNYAH

SEQ ID NO: 187003 - protein, 103 aa, Glycine max
  Coding DNA Sequence Number=SeqID_70225
  Gene Ontology: Mol. function=acyltransferase activity; Cellular component=mitochondrial membrane; Biological process=photorespiration
  Homolog annotation: Hit_ID=Q2V987; Match level="QueryCoverage=75%, HitCoverage=29%, E-value=1e-31, Identity=83%"; Hit description =Transcription factor APFI-like
MSVNREVISEIGCESSEKKREDRVFYAVGFWIRETGQAIDRLGSRLQGNYLFQEQLSRHRPLMNLFDKAPSVHRDAFVAPSASLLGDVHVGPASSIWYGCVLR

SEQ ID NO: 187004 - protein, 176 aa, Glycine max
  Coding DNA Sequence Number=SeqID_70226
  Gene Ontology: Mol. function=transcriptional repressor activity; Biological process=regulation of nitrogen utilization
  Homolog annotation: Hit_ID=Q9SDZ1; Match level="QueryCoverage=87%, HitCoverage=77%, E-value=9e-29, Identity=63%"; Hit description =Isoflavone reductase homolog 1
  Pfam annotation: Domain name=NmrA; Domain location=22-175; Score =35.1; E_value=4.1e-10; Accession=PF05368.3; Description=NmrA-like family
MDWLWSLGTYRSHNHEFIAALILKFGSIPWQRKAGHPTFALVRESTIAHPSKSNFIESFKSSGITILYSLVKAIKQVDVVISTLSEHQIDDQAIILGDGNIKGVYVTEEYIGTNTIKAVDDPRTLNKILYLKPPANVLTFNELISLWESKIQKALEKTYVPEDQIIKSIQGQYELL

SEQ ID NO: 187005 - protein, 53 aa, Glycine max
  Coding DNA Sequence Number=SeqID_70227
MNSLCEHAAPSEFINTHCIQALSEELAKHPYRAKQSHAKTSIPEPSTIGCGIR

SEQ ID NO: 187006 - protein, 150 aa, Glycine max
  Coding DNA Sequence Number=SeqID_70228
  Subcellular localization annotation: CTP_CleavageSite=35; ConfidenceScore=5.32e-01
MDMNIGGLISGQMTMMAQSNSSRLGFPALVTTLCRSRGVGSDALTSYENLRPTIYLAYIIRNCWNANDQTVNYPEARKTKLRAIDVPSSFAPIAGIPASSTSAPLPALADLSAQSSQTSDAKLQSLFEGQILIIQSLHELAQQRPIMSVE

SEQ ID NO: 187007 - protein, 698 aa, Glycine max
  Coding DNA Sequence Number=SeqID_70229
  Gene Ontology: Mol. function=nucleoside-triphosphatase activity; Cellular component=integral to membrane; Biological process=transport
  Homolog annotation: Hit_ID=Q9C6W5; Match level="QueryCoverage=90%, HitCoverage=97%, E-value=0.0, Identity=69%"; Hit description=White -brown complex homolog protein 14
  Pfam annotation: Domain name=ABC2_membrane; Domain location=389-595; Score=183.1; E_value=6.8e-52; Accession=PF01061.14; Description=ABC -2 type transporter
  Pfam annotation: Domain name=ABC_tran; Domain location=89-277; Score =152.3; E_value=1.3e-42; Accession=PF00005.17; Description=ABC transporter
  Pfam module annotation: Pfam domain module=ABC2_membrane::ABC_tran; Domain location=389-595::89-277
MPENCIAPKSEHSNTTHPEEGPPEMTQTVLPIQTNKQSFPKLAMYPITLKFEELVYKVKIEQKGVCWGSTRSCKEKTILKGVTGMVCPGEIMAMLGPSGSGKTTLLTALGGRLSGKLSGKVTYNNQPFSGAMKRRTGFVAQDDVLYPHLTVTETLLFTALLRLPNTLTKEEKVQHVEHVISELGLSRCRGSMIGGPFFRGISGGERKRVSIGQEMLINPSLLLLDEPTSGLDSTTAQRIITTIKGLASGGRTVVTTIHQPSSRLYHMFDKVVLLSEGCPIYYGHASSAMDYFSSVGFSTSMIVNPADLMLDLANGIAPDPSKLATEHSESQEAEKKLVREALISAYDKNIATRLKDELCSFEVNNYKVIKDSSTRNHIKPEQWCTSWWHQFKVLLQRGLRERRFEAFNRLRIFQVISVAFLGGLLWWHTPESHIGDRIALLFFFSVFWGFYPLYNAVFTFPQERRMLIKERSSGMYRLSSYFLARTVGDLPIELALPTAFVIIIYWMGGLKPHPVTFLLSLLVVLYSVLVSQSLGLAFGAILMEVKQATTLASVTTLVFLIAGGYYIQQIPPFIEWLKYLSYSYYCYKLLVGVQFNDDDYYECSKGVLCKVGEFPQIKSVGLNHLWVDVTIMAMMLNKIRGRKHWGYISGTKAAPENKKCDEYEAWEDESCLVKSWLLDSMTKEIISLFIRLATAKDI

SEQ ID NO: 187008 - protein, 72 aa, Glycine max
  Coding DNA Sequence Number=SeqID_70230
  Subcellular localization annotation: CTP_CleavageSite=21; ConfidenceScore=5.01e-01
MSPLSYPNFVWGLSFVDLLILASRLTVLNTNYSAKQGTIQCPSSPRPTFGLLGTPNNFKAKGLAHLGELQLP

SEQ ID NO: 187009 - protein, 108 aa, Glycine max
  Coding DNA Sequence Number=SeqID_70231
MGTRGCINYNHVLAIRQVGYPMRGAPLEEDLTPIIARGFNSTNAEALQKVRKAWEMVQKKDKEFRGSSNGPIGGYHRWLKAYMQGLDWLPNLRTTKGVEVEAPEEDEE

SEQ ID NO: 187010 - protein, 355 aa, Glycine max
  Coding DNA Sequence Number=SeqID_70232
  Gene Ontology: Mol. function=nucleic acid binding; Cellular component= nucleus
  Homolog annotation: Hit_ID=Q8S8Z9; Match level="QueryCoverage=26%, HitCoverage=39%, E-value=1e-13, Identity=44%"; Hit description =Syringolide-induced protein 1-3-1B
  Pfam annotation: Domain name=Myb_DNA-binding; Domain location=120 -167; Score=21.1; E_value=0.0041; Accession=PF00249.21; Description =Myb-like DNA-binding domain
MSDHYFDEEEILELLKENDWPVFDDLFNNFATQDSSPPADEIIPGNDDSSPPADDEILAAHEVLDTPAPLPVPPPAPAPNRVHTSATALDPAPQMVLASQDPSHVILSGDSSHSVHHKKYEHWTIEEHKSFLFGLEIKKEKGWKQISDKYVPSKTASQVASHAQKYIKRKNTPMNERKRRSIHDTILEDIDIIRIDQHNWVPPTSNFIVQPHTLGSNWVPSTSNLMVQSHTPVTDQHNWIPPCPPNFAVPPRIPHVDQDTWVPPPPNFAVQPPTPHIDQHNWVPSPPNLAPHTSLIDQDNWVPTPPDFAVQPHEMQRAQHKQMQQLNLHSSSPQMDEYRNFNCGHPQNELDLIAQ

SEQ ID NO: 187011 - protein, 578 aa, Glycine max
  Coding DNA Sequence Number=SeqID_70233
  Homolog annotation: Hit_ID=Q1S4Q9; Match level="QueryCoverage=12%, HitCoverage=15%, E-value=2e-31, Identity=93%"; Hit description =Phosphoribosyltransferase; AAA ATPase; Phosphoribulokinase/uridine kinase
ADADVRLARRIRRDTSEKGRDIGAVLDQYSKFVKPAFDDFILPTKKYADIIIPRGGDNHVAIGLTVQHIRTKLGVRAGVSLSKVSALSEYHPLSEASARLASQRYLEGNLARIHPPSDLVQLDLDIEATCRRNNVERRRKILQDRTTPIPEDHPSSKPSSNFPLTRESDTGEPEANIMADDQPRRITLEDYSSSTVPQFLTSIARPKVQAHNISYPHSLIQLIQGNLFHGLPNEDPYTQLATYIEICNTVKIVGVSENAVRLSLFSFSLSGEAKRWLGMNEALERFRSLLRKTPTHGFSEPIQLNIFIDGDHAILRDQTHIPTKRSLLELSSQDALLAQNKLLSKQLETLTETLSKLPNQFHVNQPSHSAVLQVDIQVFNMIQIITNNKDSGGLTQEINLTRTRVSMSNHKSTESAIRNLEIQVGQLAKQLADNSSSTFGANTEKNLKEEYKSILTHNRKAVMFEDEEKIGDDKQQPVIEQGEEEKEEEEDQLKEKQITDKGKEINMSLYSKFLKDMLTKKSKHIHSDTIIHKDPRNVTIPYSIGAISVGKALIDLGANINLMPLSMSTRIGELEIRS

SEQ ID NO: 187012 - protein, 160 aa, Glycine max
  Coding DNA Sequence Number=SeqID_70234
  Gene Ontology: Mol. function=protein binding; Biological process =protein modification process
  Homolog annotation: Hit_ID=Q9LS53; Match level="QueryCoverage=42%, HitCoverage=8%, E-value=2e-14, Identity=64%"; Hit description =Genomic DNA, chromosome 3, P1 clone: MYF24
MCWEDGARRPQRLLRRLRVSLETRGSTEFSLGSCPPSLALQGMLWSTIGDQLLASPILDGKALLYSFVSTPEVRIGVAFGSDGSQSLPATEWPGVSSWLLVPGDAGELKKMLTEPTGLHVQDRKLIYKKKERDSKSYLDVERVKDGSKLVLLVDIESRER

SEQ ID NO: 187013 - protein, 99 aa, Glycine max
  Coding DNA Sequence Number=SeqID_70235
MNVVGARFARGRGEGGFGNQFGALVHRYLCAVRRRCDTFLRDLAQEGDALGLHGGGLIERLRANRSSIGWRWKRRQNFGDGDLNGGVVLARVGEEVAER

SEQ ID NO: 187014 - protein, 218 aa, Glycine max
  Coding DNA Sequence Number=SeqID_70236
  Homolog annotation: Hit_ID=Q1T493; Match level="QueryCoverage=79%, HitCoverage=38%, E-value=2e-15, Identity=26%"; Hit description =Nucleic acid-binding, OB-fold, subgroup
MVVVDSNGDEIHVVCKQDQLKSRKAVLKENFIYVMHNFKVIKNDGKFRVCDHEYKLCFTGVTVVRQCDMEQLPFRKFIFVSFSSVIAGDFKIGLLVDVIGVVDEVVFRYVSSKNTRWPDERPIVILLTHSRIKETQGSYPASVSNSFKASKLMINDLVLEIQEFRESLLDLGIEVRSILTPIGQGSSQVSGSSQLSSKDVFLSKTEVKNISEINVSSE

SEQ ID NO: 187015 - protein, 83 aa, Glycine max
  Coding DNA Sequence Number=SeqID_70237
MPKSSPNMHVKQEVSTRVKPRLLFNQSMGQNTPNKIDDDGSNSHQGEKQGFQFTKCQETPISKTITHYLYITYNSKRNMQCCT

SEQ ID NO: 187016 - protein, 166 aa, Glycine max
  Coding DNA Sequence Number=SeqID_70238
MGESNKFGLYVDDNPPHLVVLGRVNEGSKTIHNVPLGNDQVKVSVEKVRDANAHVPVPTHEGAREPSKPIDRLEPDDDTLYQMTLTILQLFLKHMLVSWDSTMFWVYNDGVPLYIKNEELSKIAHGSKDLSVLLTQAAIEVLDIVLAPSWWVHELVGSRAGEFVVS

SEQ ID NO: 187017 - protein, 103 aa, Glycine max
  Coding DNA Sequence Number=SeqID_70239
  Homolog annotation: Hit_ID=Q9ZVC6; Match level="QueryCoverage=56%, HitCoverage=26%, E-value=4e-09, Identity=49%"; Hit description =Expressed protein
MAICPRVEAQGKCFRRDQLNVQVTSKLTLRLMGERLITDNRWHRFNLELPLLSDYDTDSVTAKFEGAKISIKFGELSQTKRKETLITPPSQKIEHQKPTQEDV

SEQ ID NO: 187018 - protein, 43 aa, Glycine max
  Coding DNA Sequence Number=SeqID_70240
MKNWMQNSKRGVYLGVYLNGEMVRTYMLVLLRNSVMPIIPVVI

SEQ ID NO: 187019 - protein, 60 aa, Glycine max
  Coding DNA Sequence Number=SeqID_70241
MDENHKMILKSLGVTNATKLVTSKPIVLQMKSGLRKVKRKEKEINLLTKDYESDENISQE

SEQ ID NO: 187020 - protein, 50 aa, Glycine max
  Coding DNA Sequence Number=SeqID_70242
MAEPSKKRKGTSSRSQQYSGSQETPIPSSIPLGIIVFIRGTAYTKSMKAP

SEQ ID NO: 187021 - protein, 59 aa, Glycine max
  Coding DNA Sequence Number=SeqID_70243
MTKARQKGVRKVNEMKIKARETSEDQNLPVEDRRTTKNKRITVENLHEITSRKRYGSAS

SEQ ID NO: 187022 - protein, 77 aa, Glycine max
  Coding DNA Sequence Number=SeqID_70244
MVAITPARFPQPPFFRGYDSNTMCAYHGGAPGHSIEHCMTLKRKDFHVYAIIVNHSYNAKMDEFDILVSLILSQTHL

SEQ ID NO: 187023 - protein, 98 aa, Glycine max
  Coding DNA Sequence Number=SeqID_70245
  Gene Ontology: Mol. function=triose-phosphate isomerase activity; Biological process=metabolic process
  Homolog annotation: Hit_ID=Q8ZK78; Match level="QueryCoverage=85%, HitCoverage=40%, E-value=7e-23, Identity=60%"; Hit description =Putative cell envelope opacity-associated protein A
  Pfam annotation: Domain name=OapA; Domain location=14-98; Score =132.7; E_value=1e-36; Accession=PF04225.3; Description=Opacity -associated protein A
SPQITTPKSDPQGEWHIYAVTSGQTLAQVLRDNNVPVNEVFAMGDEDGDGQPLSALQSGQQVKIRQNAQGVVTGLTVESSNGPVLFTRQPDGSFIRVQ

SEQ ID NO: 187024 - protein, 82 aa, Glycine max
  Coding DNA Sequence Number=SeqID_70246
MWMLKLGEGQAWGFVWDMMLGDYTSAKGDDGSGGGWWMKVLFAADRRRIEVLGSDGRPQANAGVIGNGGEEGRVKFGGKGVQ

SEQ ID NO: 187025 - protein, 501 aa, Glycine max
  Coding DNA Sequence Number=SeqID_70247
  Gene Ontology: Mol. function=oxidoreductase activity; Cellular component=integral to membrane; Biological process=electron transport
  Homolog annotation: Hit_ID=O81974; Match level="QueryCoverage=98%, HitCoverage=98%, E-value=1e-165, Identity=57%"; Hit description =Cytochrome P450 71D8
  Pfam annotation: Domain name=p450; Domain location=32-496; Score =400.2; E_value=2.9e-117; Accession=PF00067.12; Description =Cytochrome P450
MEAQSYLLLIGLFFVLHWLAKCYKSSVSQKLPPGPKKLPIIGNLHQLAEAGSLPHHALRDLAKKYGPLMHLQLGEISAVVASSPKMAKEIVKTHDVSFLQRPHLVFGQMISYGGLGIAFAPYGDHWRQMRKMCATELLSTKRVQSFASIREDEAAKFIDSIRESAGSPINLTSRIFSLICASISRVSFGGIYKEQDEFVVSLIRKIVESGGGFDLADVFPSIPFLYFLTGKMTRLKKLHKQVDKVLENIIREHQEKNKIAKEDGAELEDQDFIDLLLRIQQDDTLDIQMTTNNIKALILDIFAAGTDTSASTLEWAMAEMMRNPRVREKAQAELRQAFREKEIIHESDLEQLTYLKLVIKETFRVHPPTPLLLPRECSQPTIIDGYEIPAKTKVMVNAYAICKDSQYWIDADRFVPERFQGSSIDFKGNNFNYLPFGGGRRICPGMTLGLASIMLPLALLLYHFNWELPNKMKPEEMNMDEHFGLAIGRKNELHLIPNVNL

SEQ ID NO: 187026 - protein, 129 aa, Glycine max
  Coding DNA Sequence Number=SeqID_70248
MKKKFRVPSSLEGATVLDSGINAAEFVCPFWFSADTKSFIQKILDPNPKTAQQSAEFTSSWSGIQRRSTKDPSLSTELTNTTTVTSTSVVNALQRRSRQPDVDTNKLNDGGTYTTSLKMMKTTTAYVNG

SEQ ID NO: 187027 - protein, 201 aa, Glycine max
  Coding DNA Sequence Number=SeqID_70249
PCVYICCSEHYARYIDPIKLLKFDPKFGGQFRYSEASLLQSKMTSRGYISSMGQIRNGKSTSISFNELQGSILPWQDLVTLALVHHYFMHQATFLQEKEATQGGLGIMPISRGRFTLKEKVDLKLGEFPEKQEVFETKGWNRLKDLGVCNEPLVREFYANTILKDGYMERKSWVSYAFLPYPNFVRGPLFGGMQPLLDHLE

SEQ ID NO: 187028 - protein, 97 aa, Glycine max
  Coding DNA Sequence Number=SeqID_70250
MKAKKTRNELKVSDLETYPLKNEERMKNGEERRKTFTDLLTETSRKRYGSTSKNGEQVAAQLAQASWVASSRSNSASKNSLEAQFKISKSLFAPPPF

SEQ ID NO: 187029 - protein, 218 aa, Glycine max
  Coding DNA Sequence Number=SeqID_70251
VAGCTICGGAHESGCCIPVEEHPAREVNYMGNQPRNNFNAGEFSGFQHGQQYNQQQGQWRNHPENQFNRDQGGTSIRPQQLGPSLYDRTTKLEETLAQFMQVSMSNQKSTKSAVKNLEIQVGQLAKQLVDRSSSNFIANTEKNPKEECKAVMTRSRMEIQGDDSEAGKKMEGHKQQLPPKPALEPISNFVELEEINEETEDDKEEETPIKEKEKEKKS

SEQ ID NO: 187030 - protein, 143 aa, Glycine max
  Coding DNA Sequence Number=SeqID_70252
  Gene Ontology: Mol. function=RNA-directed DNA polymerase activity; Biological process=RNA-dependent DNA replication
MGAKLNPAKCTFLVKLGKLLGFVVSQKGIEVDPDKVKAILQMPEPRTKKQDMLCFGVSSPPSKAVHAELHHLVGVQNGPSQVLLSEFDIVYVTRKAVKGSALANYLTQHDVAPCGACRPWILFINGFLFFLRSNCNGMEKEKD

SEQ ID NO: 187031 - protein, 513 aa, Glycine max
  Coding DNA Sequence Number=SeqID_70253
MAQSSLSVFLPIKEKYDVSASTSRYLMDINGIALDDEDPGHHEIHYDDGNNHGVILVDGIDALGVPFFGLAGLSFIGKASIDGVDYTSDVLGRFLLWWRLSLMSLLLVPLSASIFCSSSVCFLPSLVVFGVITNTTVISIVFGLFEPGLGAFVWGSQMEKLALVWLVPFIRLVQVGFSVCFMHVTLLLYTNLLGCKARSIECNATSRQLRSYSETYGGVLHTESFDEGVEAVYRPRFACVKKASRCLSGSIVPSYRSRLSGFHPKGISAFIMGVQARRGRIARHCGEVWHKPLAGHGKPLALSTRPLGVAPSPCCGFGVTRFACVKKASRCLSGSIVPSYRWRLSGFHPKGISAFIMWSTKGCRWIIRAGRCMCMRLRSFAVLLCIGGVQARRGRIARRCGEVWHEPLAGHGQPLALSTLPLGVAPSPCCGFGVTAAGVDVAEWGPKLYTLARKGAFDKREDLQNKGLRRSTFADNSRVVDNSYELIDNVKDKHLLIDKRTDVEGWHVSLSAM

SEQ ID NO: 187032 - protein, 136 aa, Glycine max
  Coding DNA Sequence Number=SeqID_70254
  Gene Ontology: Mol. function=RNA-directed DNA polymerase activity; Cellular component=chromatin; Biological process=RNA-dependent DNA replication
MPYPTVAEGTQVMKRDEGSQIRALTVYQSSLGSEFDTDLQDDTSDKDPKLIEELVQLQPGPKPRKMGEEQLKAVKEEVDQLLHANFIKEVRLSTWLANVVMVKKANDKWRMCTDYTDLNRTCPKDAYHLPSINRLV

SEQ ID NO: 187033 - protein, 148 aa, Glycine max
  Coding DNA Sequence Number=SeqID_70255
MSYPNFVWGPSFANFFILASRIELFNASCRIIYKTPGSPRLASGLPRPPIYFMVKSLARLGEQGVMGLKEWGPKVQRSRIKKKEEKRRRKKRKKKLKCHLIAIAIDLYIVLRSFFVLRLLKGIPWEEEGKEIRREEEEEEEEEEELRK

SEQ ID NO: 187034 - protein, 84 aa, Glycine max
  Coding DNA Sequence Number=SeqID_70256
MTKARQKGVRKGKRGRWLPPSSPMRAGLLPPEGTAFCWNILEGPSGITDCALMLPFDSRHVADLHGLPKATGQAKVASQQIDGP

SEQ ID NO: 187035 - protein, 95 aa, Glycine max
  Coding DNA Sequence Number=SeqID_70257
MRIIFYRPRFKKGLRLCQWGLLLWKPDLDIWGKTNLGVKVSVSGRTSILFHKARATMMIWKQRAKLVMATARTTFLNEKLYTVPKFQQTLLTTTK

SEQ ID NO: 187036 - protein, 227 aa, Glycine max
  Coding DNA Sequence Number=SeqID_70258
MTLKLPYCPIFVQVFYNNLEIHDGVIFSKVHKIPIGVDQSLFYSLTKLSSQGVPFEGTLVDDYSSHDARKIVCVENADKTGRLLAGSFTFECRVMHFILCHVLLHRSTNLSQASEKDLILLWALQTGITGKCPSTISRSGYSILQHFKVPLTNEPFVKDYLASALKERTPSPPPRDPSSTLLNDVLNEIQDLRAFVGERFDSMDSRITPLEDDMGFIRRCFDPPTNH

SEQ ID NO: 187037 - protein, 412 aa, Glycine max
  Coding DNA Sequence Number=SeqID_70259
  Gene Ontology: Mol. function=oxidoreductase activity; Cellular component=integral to membrane; Biological process=electron transport
  Homolog annotation: Hit_ID=O81974; Match level="QueryCoverage=99%, HitCoverage=81%, E-value=1e-139, Identity=58%"; Hit description =Cytochrome P450 71D8
  Pfam annotation: Domain name=p450; Domain location=1-410; Score =246.9; E_value=4.3e-71; Accession=PF00067.12; Description=Cytochrome P450
MAKEIVKTHDVSFLQRPHLVFGQMISYGGLGIAFAPYGDHWRQMRKMCATELLSTKRVQSFASIREDEAAKFIDSIRESAGSPINLTSRIFSLICASISRVAFGGIYKEQDEFVVSLIRKIVESGGGFDLADVFPSIPFLYFLTGKMTRLKKLHKQVDKVLENIIREHQEKNKIAKEDGAELEDQDFIDLLRIQQDDTLDIQMTTNNIKALILDIFAAGTDTSASTLEWAMAEMMRNPRVREKAQAELRQAFREKEIIHESDQEQLTYLKLVIKETFKVHPPTPLLLPRECSQPTIIDGYEIPAKTKVMVNAYAICKDSQYWIDADRFVPERFEGSSIDFKGNKFNYLPFGGGRRICPGMTLGLASIMLPLALLLYHFNWELPNKMKPEEMNMDEHFGLAIGRKNELHLIPN

SEQ ID NO: 187038 - protein, 107 aa, Glycine max
  Coding DNA Sequence Number=SeqID_70260
  Gene Ontology: Mol. function=oxidoreductase activity; Cellular component=integral to membrane; Biological process=electron transport
  Homolog annotation: Hit_ID=O81974; Match level="QueryCoverage=97%, HitCoverage=20%, E-value=4e-30, Identity=57%"; Hit description =Cytochrome P450 71D8
MVNAYAICKDSQYWIDADRFVPERFEVSSIDFKGNNFNYLLFGGGRRICPGMTFGLASIMLPLALLLYHFNWELPNKMKPEEMNMDEHFGLAIGRKNELHLIPNVNL

SEQ ID NO: 187039 - protein, 136 aa, Glycine max
  Coding DNA Sequence Number=SeqID_70261
  Homolog annotation: Hit_ID=Q1T493; Match level="QueryCoverage=99%, HitCoverage=25%, E-value=2e-20, Identity=36%"; Hit description =Nucleic acid-binding, OB-fold, subgroup
  Pfam annotation: Domain name=DUF223; Domain location=40-135; Score= -4.9; E_value=0.0082; Accession=PF02721.5; Description=Domain of unknown function DUF223
MARILDKIKSIDGSREMLKLAVRVTNLWFVGTPNKSEQAEMIIVDSEGDQIHVVCKADQLKSWKADLKENSTYVMHNFKVVKNDSQFRVCEHEYKLVFIRVTVVREADLHELSFKEFKFVEFGNVVAGNFVASLLV

SEQ ID NO: 187040 - protein, 33 aa, Glycine max
  Coding DNA Sequence Number=SeqID_70262
MKDLKYELGGLNDEEQHKREWMAEFWKVSKWYI

SEQ ID NO: 187041 - protein, 711 aa, Glycine max
  Coding DNA Sequence Number=SeqID_70263
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=77%, HitCoverage=58%, E-value=3e-91, Identity=42%"; Hit description =Putative retroelement
MELKGEDNGVLGQVALQSLFGKSFQVVDGLLVCTELQDPRGLPPNRGKEHTITLLEGQGPVNVRLYCYPHHQKNEIEKQVKELVDTGMICPSHSASSSLVILVKKKDATRRMCVDYRTLNKFTVPDKFPIPVIDELLDELHGAQFFSKLDLKLGYHQGHYEYLVMPFGLMNAPSTFQALMNEAFRGMLRKYVLVFFEDILMYSLDWMTHTQHLTAVLDGVAMDPSKIQSLLQWPNPKNVKGVQGFLGLTGYYCKFIKDYGTIAHPLTDLTKKEGFKWGIPEQAAFEALKGQMTTGLVLALPDFSQEFIIESVASGQGLGAILIQIGRPVAHFSKTLKDRNLTKSAYEKELIAATSSAHNNNEPTKLGCQIVGISGKEEIEEVLQDESLKEADWSSQLSHPGFLFYSRNIIQLLKAVIPGSTEAYYSPLTFLAELYGGHGLKLFKLQGTHLKMSTAYHPQTEVINRFLETFLRCFIAVQPKSWVLWLPWAEYWYNTTFHVSTGTLPFEMVYGCKPPVLTGFSIGETMEAAQRELLDHNEDLMGNKQLRPQQIGAIAYKLKLPDSARIRPVFHVSLLKKAIANYRVEEELPADLGSDTPQVCEPAAVLAADNYWCIGKDKSVLEEGDNVRTPVMDTRPIARPTIWRVYSRRKGTKKSICASEGAELWVVGIVIPLSDIAWKDAKYAQIWEYLRDEFELTQRFASLDFKLKFVE

SEQ ID NO: 187042 - protein, 249 aa, Glycine max
  Coding DNA Sequence Number=SeqID_70264
  Gene Ontology: Mol. function=RNA-directed DNA polymerase activity; Cellular component=membrane; Biological process=RNA-dependent DNA replication
  Homolog annotation: Hit_ID=Q1SRI1; Match level="QueryCoverage=69%, HitCoverage=29%, E-value=2e-28, Identity=37%"; Hit description=RNA -directed DNA polymerase
MVVFQYGSIVLFNVPEHEVDAYLKIVKKHASGLLPEMRKDDFFSLVLGKKLSRSSSEVLNSILIFYLSFFKIPKKVIEILVRLQRRFLWGVGVDEFKTAWVKWETVCLPNYHGGLGVRDLELINMALLGKWKWSMLQEDDTIWNRILVSKYGGWRVLDLERVNQPESLWWRDLKKSCGASAVGEWFNKGMKLKIGCWSRVNFWTDKWMGGPELLGCGRSGAKIYTVSGAYAWLYETVVGSSEEEIFKRV

SEQ ID NO: 187043 - protein, 115 aa, Glycine max
  Coding DNA Sequence Number=SeqID_70265
MDKFKPNYNAAMSYNGKTTCGRALRDHCGGTIFTFFVRIGNSSINLAELWAIVFGIKLATSRGYYDPKVVQQRMNMLNLLNLSWRWRPLQILVPEITLPREANQVRTVLPSMALA

SEQ ID NO: 187044 - protein, 94 aa, Glycine max
  Coding DNA Sequence Number=SeqID_70266
  Gene Ontology: Mol. function=DNA binding; Cellular component=nucleus; Biological process=regulation of transcription, DNA-dependent
  Homolog annotation: Hit_ID=Q0PJH7; Match level="QueryCoverage=82%, HitCoverage=17%, E-value=6e-32, Identity=83%"; Hit description=MYB transcription factor MYB177
  Pfam annotation: Domain name=Myb_DNA-binding; Domain location=48-93; Score=29.2; E_value=1.5e-05; Accession=PF00249.21; Description=Myb -like DNA-binding domain
MIVFRSDGCGFVRNFSHITPDIPLHDQFSCANDYALKVRKPYTITKQRKRRTDKEHKKILEALKLYGRAWRRIEEHVGTKIVVQIQSHVQKFFS

SEQ ID NO: 187045 - protein, 497 aa, Glycine max
  Coding DNA Sequence Number=SeqID_70267
  Gene Ontology: Mol. function=protein serine/threonine kinase activity; Cellular component=integral to membrane; Biological process=protein amino acid phosphorylation
  Homolog annotation: Hit_ID=Q1SI44; Match level="QueryCoverage=96%, HitCoverage=66%, E-value=1e-151, Identity=59%"; Hit description =Leucine Rich Repeat, putative
  Pfam annotation: Domain name=LRRNT_2; Domain location=20-61; Score =49.9; E_value=8.7e-12; Accession=PF08263.3; Description=Leucine rich repeat N-terminal domain
  Pfam annotation: Domain name=LRR_1; Domain location=118-140; Score =9.9; E_value=4; Accession=PF00560.23; Description=Leucine Rich Repeat
  Pfam annotation: Domain name=LRR_1; Domain location=142-164; Score =16.7; E_value=0.083; Accession=PF00560.23; Description=Leucine Rich Repeat
  Pfam annotation: Domain name=LRR_1; Domain location=166-189; Score =14.4; E_value=0.42; Accession=PF00560.23; Description=Leucine Rich Repeat
  Pfam annotation: Domain name=LRR_1; Domain location=191-213; Score =15.5; E_value=0.19; Accession=PF00560.23; Description=Leucine Rich Repeat
  Pfam annotation: Domain name=LRR_1; Domain location=216-238; Score =8.0; E_value=9.1; Accession=PF00560.23; Description=Leucine Rich Repeat
  Pfam annotation: Domain name=LRR_1; Domain location=240-261; Score =2.7; E_value=89; Accession=PF00560.23; Description=Leucine Rich Repeat
  Pfam annotation: Domain name=LRR_1; Domain location=94-116; Score =4.7; E_value=38; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=20-61::118-140::142 -164::166-189::191-213::216-238::240-261::94-116
MTVTFFIFLLYFFFHPAVSLSSDGIALLTLKSAVDAPGAAAFSDWNDADATPCRWSGVTCANISGLPEPRVVGLALSGKGLRGYLPSELGTLLYLRRLNLHTNALRGAIPAQLFNATALHSVFLHGNNLSGNLPPSVCTLPRLENLDLSDNALSGAIPDTLRKCSNLQRLILARNKFSGEIPASPWPELKSLVQLDLSSNLLEGSIPDKLGELKTLTGTLNLSFNHLSGKIPKSLGNLPVAVSFDLRNNDLSGEIPQMGSFSNQGPTAFLNNPNLCGFPLQKPCTGSAPSEPGLSPGSRRPAHRSAKGLSPGLIILISVADAAGVALIGLVVVYVYWKRKGKSNGCSCSLKRKFGGESEKLSLCCWCNGVKSDDSEVEEGEKEEGEGGRGEGDLVAIDKGFNFELDELLRASAYVLGKSGLGIVYKVVLGNGVPVAVRRLGEGGEQRYKEFAAEVQAIGKVKHPNIVKLRAYYWAPDEKLLISDFISNGNLATALRG

SEQ ID NO: 187046 - protein, 75 aa, Glycine max
  Coding DNA Sequence Number=SeqID_70268
MAVVRKEVKLLVGINDHTWPQLCWLGQSVYRKGKKWLLLTYQWWCGGSHGRPWQSRSGSSAVGPPPPPPRAAALL

SEQ ID NO: 187047 - protein, 154 aa, Glycine max
  Coding DNA Sequence Number=SeqID_70269
  Gene Ontology: Mol. function=transcription regulator activity; Cellular component=nucleus; Biological process=regulation of transcription
  Homolog annotation: Hit_ID=Q1SHA2; Match level="QueryCoverage=91%, HitCoverage=43%, E-value=1e-37, Identity=59%"; Hit description=Helix- loop-helix DNA-binding
MLDEAIEYLKQLQLQVQMLSMRNGLSLHPMCFPDGLQPLQLSQMGMELSERNRSTPLKMSATLPLHQDNNPLHYASNQPCVPYPPYINNPETSFGLEPRIQPDTKPLQHKEGSSEPIRGEDILQYQQSSAIHSDTNTLGGSQGAHVSSCIINSM

SEQ ID NO: 187048 - protein, 559 aa, Glycine max
  Coding DNA Sequence Number=SeqID_70270
  Gene Ontology: Mol. function=transferase activity, transferring glycosyl groups; Biological process=pyridine nucleotide biosynthetic process
  Homolog annotation: Hit_ID=Q1SHA1; Match level="QueryCoverage=99%, HitCoverage=100%, E-value=0.0, Identity=78%"; Hit description =Nicotinate phosphoribosyltransferase related
  Pfam annotation: Domain name=NAPRTase; Domain location=173-454; Score= 109.2; E_value=1.2e-29; Accession=PF04095.6; Description=Nicotinate phosphoribosyltransferase (NAPRTase) family
MAVNGSKKKKSGQGIPGPTNPMVTPMLTDQYQFTMAYAYWKAGKHQERAVFDLYFRKNPFGGEYTVFAGLEECVRFVANYKLNEEDIDYIKNNLSVSCEDGFLDYLRRIDCSDVEVYAIPEGSVVFPKVPLLRIEGPIAVVQLLETPFVNLINFASLVSTNAARHRFVAGKTKTLLEFGLRRAQGPDGGVGASKYSYIGGFDATSGYPMSLYFVIRQSVYICPGIVVQKFCNVAAGMLFGIPLRGTHSHAFVSSFMNLDEIKDKSLRKKDGSSTCKDFRSNSLHGNFAETNQSELAAFTSYALAFPHNFLALVDTYDVMRSGIPNFCAVALALSDLGYKAIGIRLDSGDLAYLSCEVRKLFCSIEKEFGLPGFGKMSITASNDLNEETLDALNKQGHEIDAYGIGTYLVTCYAQAALGVVFKLVEINNKPRIKISEAVSKVTIPCKKRIYRLYGKDENAMVGERILCRHPFEESKRAYVVPRKVEELLRCYCAGSSDKKEEILPPLKDIRERCIKQLEQMRSDHMRRLNPTPYKVSVSAKLYDFIHFLWLNEAPVGELR

SEQ ID NO: 187049 - protein, 108 aa, Glycine max
  Coding DNA Sequence Number=SeqID_70271
MALRSRTSGHGRRFESLCRRESEASERRKRNADCGCCVSVGMKSQSVTKLPWNKTAAPTNVQNNSNNDWRVATVEMTWESIEEMSKPLRLTLVERVMTGIFSSPFTVA

SEQ ID NO: 187050 - protein, 851 aa, Glycine max
  Coding DNA Sequence Number=SeqID_70272
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=O48653; Match level="QueryCoverage=99%, HitCoverage=54%, E-value=0.0, Identity=66%"; Hit description=DNA polymerase alpha catalytic subunit
  Pfam annotation: Domain name=DNA_pol_B; Domain location=140-624; Score=545.8; E_value=4.5e-161; Accession=PF00136.12; Description=DNA polymerase family B
  Pfam annotation: Domain name=zf-DNA_Pol; Domain location=640-848; Score=241.3; E_value=2e-69; Accession=PF08996.1; Description=DNA Polymerase alpha zinc finger
  Pfam module annotation: Pfam domain module=DNA_pol_B::zf-DNA_Pol; Domain location=140-624::640-848
  Subcellular localization annotation: CTP_CleavageSite=25; ConfidenceScore=5.06e-01
MACKVASSMWSKLGRLNRSTMPKLRRSKVFGSGADPGIMSCIAGRLLCDTYLCSRDLLKEVSYSLTHLAKSHLNKIRTEVAPHEVPKMFQTAESLMKLIEYGETDAWLSMELMFYLSVLPLTRQLTNISGNLWGKTLQGARAQRVEYLLLHTFHAMKFMVPDKFSYHAKETKETKLMKRRLTHDVEDNNFDAYIDDANHDNDASEADNKKSKKGPSYAGGLVLEPKKGLYDKYILLLDFNSLYPSIIQEYNICFTTVERSLDESFPRLPSSKTTGVLPEVLKNLVDRRKMVKSWIKNEKNKNEKTDPIRVQQLDIQQQALKLTANSMYGCLGFSNSRFYAKPLAELITSQGREILQSTVDLVQNNLNLEVIYGDTDSIMIYSGLDEIEEANKIAVRVIQEVNKKYKCLEIDLDGLYKRMLLLKKKKYAAVKLLYKDGTPYEAIERKGLDIVRRDWSILAKELGDFCLTQILSGGSCEDVVESIHNSLMKVQEEMRNGQVALEKYVITKTLTKPPEAYPDAKNQPHVLVAQRLKQQGYSSGCSVGDTIPYIICYEQGGSPGSAAGIAQRARHPDELKRDQGTWLIDIDYYLSQQIHPVVSRLCAPIQGTSPERLADCLGLDSSKFHHKSSEALNDDSASPLSFVADDEERYRGCEPLVLSCPSCSGTFDCPPVFKSICLLGSERQRPTSVAPEEAEYNFWRKLCCPKCPDVKISPVMIANQVKRQAERFILMYYRGLLVCDDETCKHTTRSISLRLVGDSERGTVCPNYPRCNGRLVRKYTEADLYKQLSYFCHVFDTVSCIEKMEAKSRIPIEKELIKIRAVIKSAASTAQEIRDRCAFGWVKLENLVISV

SEQ ID NO: 187051 - protein, 105 aa, Glycine max
  Coding DNA Sequence Number=SeqID_70273
  Gene Ontology: Mol. function=transcription factor activity; Cellular component=nucleus; Biological process=regulation of transcription, DNA-dependent
  Homolog annotation: Hit_ID=O82133; Match level="QueryCoverage=67%, HitCoverage=21%, E-value=3e-19, Identity=62%"; Hit description =Dehydration-responsive element-binding protein 2B
MKTNNNVSGERKSRKRRSGESDSVEDTLEKWKEYNRQQQLGSRENGVEVIHKVPALGSRKGCMIGKGGPHNSDCKFRGVRQRIWVKWVAEILEPINGKLVGEKTK

SEQ ID NO: 187052 - protein, 656 aa, Glycine max
  Coding DNA Sequence Number=SeqID_70274
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=Q1SH99; Match level="QueryCoverage=99%, HitCoverage=65%, E-value=0.0, Identity=56%"; Hit description=DNA -directed DNA polymerase B
  Pfam annotation: Domain name=DNA_pol_B_exo; Domain location=378-650; Score=-94.5; E_value=0.074; Accession=PF03104.9; Description=DNA polymerase family B, exonuclease domain
MADDEPVSGRRRPRGPEATERSKALERLKARIHGGRRSDATGPQIRLENPVYDTVPEDEYNALVAKRREQARSFIVDDEGLGYGDEGEEEDWSQAGFNLSSGESEDESERPKRKKVEKKDPQPKRPSSSLSAAAAMMGGQRLSSMFTSSVFKKSRDDKASESIVDDVIAEFAADETDRLRRKRANVNSSSSSVTNDALRINNTVRDKPSVDLIGASSLPANGNAVSVKVVDSDGSDSGFEQKSEAVSEIEDLACVSSENGQAPVVESDDCKINEGIVEEKEMKKAEIEVISGGKKEVFTLNAKVKEEDEEDPSLSATAGWKEVMSGAGGVDADSKDALQNQQHSELDLEKDGSFFFYILDAYEEFYGENRGTLYLFGKVKTGDLYQSCCIIVKNMQRCIYAVPSLSLHRTEEMMSLERDVQESRISSADFFKKLQDAVSDVKNEIAQHLVNLEVSNFSMAPVKRKYAFERSEIPAGENYVVKINYSFKDPVLPVDLKGESFCALLGTGCSALELFLIKRKIKGPSWLQVSNFSPSSASRRVSWCKFEVTVDSPKQINSAPKITSKIPPVVVAAINLKTIINEKQNINEIVSASVVCCNMVKIDTPMMASEWRRPERLTRFTVVRKLDGSIFPMGFNKEVTDRNLQVGSNILCAESR

SEQ ID NO: 187053 - protein, 326 aa, Glycine max
  Coding DNA Sequence Number=SeqID_70275
  Gene Ontology: Mol. function=endopeptidase inhibitor activity; Cellular component=membrane; Biological process=aromatic compound metabolic process
  Homolog annotation: Hit_ID=UPI00005FA64A; Match level="QueryCoverage =99%, HitCoverage=19%, E-value=1e-116, Identity=63%"; Hit description= COG2373: Large extracellular alpha-helical protein
VQVLLSAVDSGVLSITDYATPDPWNGFFGRKRYNADQYDVFGQLIEGGGKLAALRFGGDGDDADALSRGGKKPVTEAQIVAQQLQPVTLDASGEGTLELPVPAFNGELRLMAQVWSEDSFGAADRKLVVAAPLVSELATPRFLASGDQSTLALDLTNLTDQPQTLNVTVNASGLIALNGQIPARVQLAKGARTTLAIPVKAQDGFGEGDVQVTVSGLSLPNETLAPSVRRWKIGVRPAYPAQTLSFDNVMNSGQRWQVMASAFNGLQAGTLSGQLSLSSQPPLNIASYISQLYAYPYGCLEQTASGIWPSLFTNHAQLSAMGIKTS

SEQ ID NO: 187054 - protein, 257 aa, Glycine max
  Coding DNA Sequence Number=SeqID_70276
  Gene Ontology: Mol. function=protein serine/threonine kinase activity; Cellular component=membrane; Biological process=protein amino acid phosphorylation
  Homolog annotation: Hit_ID=Q1SH98; Match level="QueryCoverage=93%, HitCoverage=48%, E-value=1e-126, Identity=90%"; Hit description =Protein kinase
  Pfam annotation: Domain name=Pkinase; Domain location=1-234; Score =56.7; E_value=7.6e-14; Accession=PF00069.15; Description=Protein kinase domain
  Pfam annotation: Domain name=Pkinase_Tyr; Domain location=1-234; Score=31.5; E_value=2.1e-14; Accession=PF07714.7; Description =Protein tyrosine kinase
  Pfam module annotation: Pfam domain module=Pkinase::Pkinase_Tyr; Domain location=1-234::1-234
EKEFKVEVEAIGRVRHKNLVRLLGYCAEGAHRMLVYEYVDNGNLEQWLHGDVGPCSPLTWEIRMNIILGTAKGLTYLHEGLEPKVVHRDIKSSNILLSKQWNAKVSDFGLAKLLGSDNSYITTRVMGTFGYVAPEYASTGMLNERSDVYSFGILIMELITGRNPVDYSRPPEEVNLVDWLKKMVSNRNPEGVLDPKLPEKPTSRALKRALLVALRCTDPNAQKRPKMGHVIHMLEAEDSPYKEVTIISAEINSTSVR

SEQ ID NO: 187055 - protein, 462 aa, Glycine max
  Coding DNA Sequence Number=SeqID_70277
  Gene Ontology: Mol. function=phospholipase C activity; Cellular component=membrane; Biological process=intracellular signaling cascade
  Homolog annotation: Hit_ID=Q1SH97; Match level="QueryCoverage=92%, HitCoverage=99%, E-value=1e-163, Identity=65%"; Hit description =Phosphatidylinositol-specific phospholipase C, X region
MHIEKCQCTKTYRTEPEKQTLSNRKAQMKPIPCLSIRILLLIAICLFTSSSASKQIGETCGSDNKCDAGLSCQACPANGNTRTRCSRIQPLSPTSRVKGLPFNRYSWLTTHNSYALAGARSATGSVLVAPMNQEDTVAEQLKSLLRTTPLRFILYWIHLQNGVRGFMLDMYDFQKDIWLCHSFQSKCFNFTAFQPAINVLKDMRTFLDGNPSEIITIFIEDYVTAPQGLTKVFKDSGLSKYIFPVSRMPKNGGDWPTVDDMVQKNQRLVVFTSKSAKEASENIAYQWTYVVENQYGDDGMKAGSCPSRAESPAMNTESRSLVLVNYFHSAPNRSQACADNSAPLLDMTKTCHEAAGNRWANFIAVDYYQRSDGGGAPLAVDEANGHLTCGCDNIAYCKENAKFGTCDVPPISPPPPATETLSTGNQQTQNDNHTNNAYIGRTAKLMQSVVGILATTTFLAWL

SEQ ID NO: 187056 - protein, 66 aa, Glycine max
  Coding DNA Sequence Number=SeqID_70278
MDAASSTGEERVPPLSMARSLVTWRVPPLSMARQLTWTLSRWSHWREACCLTAPNGEKPSTLGLKG

SEQ ID NO: 187057 - protein, 735 aa, Glycine max
  Coding DNA Sequence Number=SeqID_70279
  Gene Ontology: Mol. function=binding
  Homolog annotation: Hit_ID=Q10N57; Match level="QueryCoverage=65%, HitCoverage=95%, E-value=1e-27, Identity=25%"; Hit description=HEAT repeat family protein, expressed
  Pfam annotation: Domain name=HEAT; Domain location=100-136; Score =16.0; E_value=0.14; Accession=PF02985.12; Description=HEAT repeat
  Pfam annotation: Domain name=HEAT; Domain location=137-173; Score =17.8; E_value=0.04; Accession=PF02985.12; Description=HEAT repeat
  Pfam annotation: Domain name=HEAT; Domain location=33-69; Score=8.6; E_value=3.8; Accession=PF02985.12; Description=HEAT repeat
  Pfam module annotation: Pfam domain module=HEAT::HEAT::HEAT; Domain location=100-136::137-173::33-69
MIKSDISVCVIRCCVKVASWGLMLAASNSDMKAYWSNDIFAKLCSMARDMNMKVRVEAFSGLRKMEMVSEDLLLQSLSKRVSGHGKQKETLGQRTSEQFVMLATNVAGALVHGLEDEFFEVRKSVCESLCTLTSLSSEFARKALDSLMDVLNDESEVVRFQSLETLHHMAINGRLKLLEKHLHMFLGALVDNSWDVRYTDRKILKVVKLNYLALFKSSVDSLLGSLDSYPQDEADVFSTFSHLGRNHKKFVSLIIKDMFEEVETALEGNVEFNSARIAALLILSISAALLNADVGRIPPVMFSYAVTFLGRIYNAFSDIMDRDALLACLCEKSRSTEYSATNINPGEGEQQFPLFEGDAPNFASNEVIGSKIDSHITREQKEVANDQVEQQQSVYNEVTNLINYILAKLPDMWPRIQSGHTNEVLRSLRCLKELTTMKFDSLGSGDADALAFTLLYLRIIELLAEVWNNLLPAKGLCYQGIGKLEFKLGKLDRRVKELMSRFIGFSAEEELNVLELMLLTYTLRISKEEISCINHTLKRLSSLYLRVESILKESSALPSNFLVELGKVLSSTSINGASCSPLQFEACLKFFSLKQFVFHGPIKHVKAELSVPNIDFEHPLPFVSGLPVGIQCEITLHNILSESRLWLRMTLDDGFIQYFFLDLDCSEGSEEVRKCTFVAPFYRTAEADCLILKVCIGSECLFENVSPVQKFGGPKRELVLLCNEKQVYLSKVSKA

SEQ ID NO: 187058 - protein, 260 aa, Glycine max
  Coding DNA Sequence Number=SeqID_70280
  Homolog annotation: Hit_ID=Q1S657; Match level="QueryCoverage=40%, HitCoverage=27%, E-value=2e-11, Identity=37%"; Hit description =Peptidase S26A, signal peptidase I; Cyclin-like F-box; F-box protein interaction domain; ...
  Homolog annotation: Hit description=Galactose oxidase, central
MEILFEKLMMEVLSWLPVKSLVRFTCASKWFQSLISDSSFVKLHLQRSPKSEDFLLICSVDDTLNRFFILSCPAIPLVSDDPLSLIADDHSLGLELNDTYEIAGACNGLRKTFEDAQCVLALPGIDHAAGTFGFGYEVVVSIVSTLNNDGSLKLCEERDIHTIVAASLDGVYLHDFYSDGDDEDFISDQCFGVLKDCLSLFLHSRKTKHLAIWQMKEFGNQNSWTLSQSIAIQDLEIDCMPCHDLLPLIMYEELRMAVSS

SEQ ID NO: 187059 - protein, 159 aa, Glycine max
  Coding DNA Sequence Number=SeqID_70281
  Gene Ontology: Mol. function=heat shock protein binding; Cellular component=endoplasmic reticulum; Biological process=protein folding
  Homolog annotation: Hit_ID=Q5QMV0; Match level="QueryCoverage=78%, HitCoverage=34%, E-value=6e-39, Identity=62%"; Hit description =Putative Altered Response to Gravity
MGGLFEAITGYGLGGSSMALFGRVGGGIYTKAADVGADLVGKVERKIPEDDPRNPALQSDPFQLFYFEQDANRGYGLALQEDSEKTGKVTSAGMYFLHFQVYRMDSTVNALAMAKDPEGAFFKRLEGLQPCEVSELKPGTHIFAVYGLNNLSYIVLLPV

SEQ ID NO: 187060 - protein, 181 aa, Glycine max
  Coding DNA Sequence Number=SeqID_70282
IYEHFPSVHDCVTDDVYDETSTRACRWLTTKAYIKGLRAAAYQTRLDALTITNVSWMPYGDHQGVRRFELISCFQGQTIPPPPVSASLSYEDIDDKYQQITWSGSSGYLICAPQHKEYIEPGIPEVPVGADVGPSQAPAVDGCEAIAERLEHVLNLRMVTEGTELHEIVEDCLRIARGVTT

SEQ ID NO: 187061 - protein, 49 aa, Glycine max
  Coding DNA Sequence Number=SeqID_70283
MRKRKWKKESAFPKSRHVVGFDSKIPFASLMVSPLEGEQGRVVIDYSIW

SEQ ID NO: 187062 - protein, 76 aa, Glycine max
  Coding DNA Sequence Number=SeqID_70284
MYVLGKPARQCEMAPKKLSTKRSRRDATGEGSSAASEVYSHRFQSAKHQQCFEAIKGWSFHRERRVQLREDEYPDF

SEQ ID NO: 187063 - protein, 78 aa, Glycine max
  Coding DNA Sequence Number=SeqID_70285
MGKDKLELGVEDQKVSFNLFEAMKHPNDKKACFDLDKVKKRLSHEVQKVTVELSSAIGLSVHPPLSATSTHLAQRRNW

SEQ ID NO: 187064 - protein, 54 aa, Glycine max
  Coding DNA Sequence Number=SeqID_70286
MGGLFVEKLPGSHIINRTSKRVKLRHQKETTPENLAFHNFNQKQKMQLKLKAEM

SEQ ID NO: 187065 - protein, 273 aa, Glycine max
  Coding DNA Sequence Number=SeqID_70287
  Gene Ontology: Mol. function=hydrolase activity, acting on ester bonds; Biological process=metabolic process
  Homolog annotation: Hit_ID=Q2XFF3; Match level="QueryCoverage=98%, HitCoverage=73%, E-value=2e-61, Identity=46%"; Hit description=AotO -related protein
  Pfam annotation: Domain name=AstE_AspA; Domain location=5-262; Score=- 38.8; E_value=0.0015; Accession=PF04952.5; Description=Succinylglutama te desuccinylase  Aspar
DFNRRFPALGDTLAAELAGSLTQSEYENKRLIRDAIDRHYRDRIAKSELEAQRFTLMRMASQADLMIDLHCDWDALPHLYTTPHAWPEIEPLARWLGSEVQLLAQISGGEPFDEACCEPWLTLAERFGKDYPMPRGLLPVTLELRGVADVSPEQAEKDADAIINALIEGGYITGETGDSPALLHAPTQLAGCEYIHAPHSGLLLNRRKLGEWIKAGEVVAEVVDPINDYVTPLVAEFGGVLYARNLTKFVTAGMLVVRLAGENAGRKGELLVV

SEQ ID NO: 187066 - protein, 166 aa, Glycine max
  Coding DNA Sequence Number=SeqID_70288
  Homolog annotation: Hit_ID=Q0WS32; Match level="QueryCoverage=33%, HitCoverage=17%, E-value=3e-19, Identity=76%"; Hit description=SRF3
  Subcellular localization annotation: CTP_CleavageSite=59; ConfidenceScore=5.24e-01
MINSQLARGLCQQKSEGVDRPQWSTFSHVNYSGSLSSTFGSKATHCKVDSRRNMLLTVSCNAEDMLLPRGNFTFSVLTESGIQILLSLLGTVHSMAKGFLFMSIAVMGRCRMHSIQMMNSKQDCHGIVGKAYSDRLLVVTVYPLKVDAKKSVGQSPLYIYLRILDF

SEQ ID NO: 187067 - protein, 106 aa, Glycine max
  Coding DNA Sequence Number=SeqID_70289
MTELRPCRHGSGTRPCENRIEPALTLIDKNRVDRVQGRVRVFPDNPKRGQGRLSILTPHIAKPLAGKKLCKRTLKLIRRGLQGEREAAQERTQRQPLEPRPQLPHR

SEQ ID NO: 187068 - protein, 54 aa, Glycine max
  Coding DNA Sequence Number=SeqID_70290
MLKPDLASDMRKKLDGFTIFINGETEDMKEANMGKRDLNSRSRGVVQHFRFMAQ

SEQ ID NO: 187069 - protein, 751 aa, Glycine max
  Coding DNA Sequence Number=SeqID_70291
  Gene Ontology: Mol. function=DNA binding; Cellular component=beta -galactosidase complex; Biological process=DNA integration
  Homolog annotation: Hit_ID=Q1S3I6; Match level="QueryCoverage=99%, HitCoverage=68%, E-value=1e-122, Identity=43%"; Hit description =Integrase, catalytic region
LANRFSQGDIFRVADIQEEVARLQQGTLDISSYFTKLMTPWEEIENFCPIRDCTCAIPCSCGAATDLRKFKEQDKVIKFLKGIGDQYSHVRSQIMLMSPLPTLDNAFNLILQQERQFNLPSTTDSSIENQSSVNHFSQTPSRPSNNFGRGCGRGYSSGGRGNRLCTHCNRTNHTVETCFIKHGYPPGFQHRKSNSSGNASVVNSVQDAGSAHISSSSSASTSTNGSSASLSTIQEQYTQILQLLQQSNLQSTSPSSVNSVFATNFVSHTSPSPSSGKNLSNNTSHWWIVDTGATDHITHIFDSFSSTYHIAPKTMTMPNGDTVTTTIVGSVLLYDSLVLHNVYYFPSFHVNIISVTTLFDSTLYDVKLYPNSCKIVQLLHPKMTGFTARRIGKLYVLDTTSPLVFSPTPGSVNTSISHDPATIWHFRLGHLSSHIHKCISSYFPFVTFNDNHKPCNTCHLAKQRNLPFAHSTTKSVAIFDLIHADIWGPLSTPSISGHKYFLTLVDDYNREGTKGYLLYDPIIHEFYVSRNVIFHEIVFPFASPPLANNPVSVNPDITTLDTSDILLDLPLSLPPPNEPTSPPAPTRKSHRLTKPPAYLFEYHCNLLSSILSASNPEPKTYKQACKFDCWNLAMKSELDALASTNTWSVVDLHEGKQPIGCKWVYKIKHHADGSIERYKARLVAKGYTQLEGVDYFDTFSPVAKLTTIRTLLSVAGIKDWHLEQLDINNAFLHGDLDEEVYMDLPPGFLPP

SEQ ID NO: 187070 - protein, 45 aa, Glycine max
  Coding DNA Sequence Number=SeqID_70292
MVDFQGFGKGYLQKILTGGGMRAAEKLKIRDVTNGIRASISPGMM

SEQ ID NO: 187071 - protein, 205 aa, Glycine max
  Coding DNA Sequence Number=SeqID_70293
  Gene Ontology: Mol. function=DNA binding; Cellular component=beta -galactosidase complex; Biological process=DNA integration
  Homolog annotation: Hit_ID=Q1S3I6; Match level="QueryCoverage=95%, HitCoverage=13%, E-value=4e-89, Identity=77%"; Hit description =Integrase, catalytic region
  Subcellular localization annotation: CTP_CleavageSite=76; ConfidenceScore=5.52e-01
TLQVHHSAAIRVLKYLKSAPAKGLFYSSSSTLKLSGFADSDWASCPATRRSVTGYCVFLGTSMQSWKSKKQSTVARSSSEAEYRALASLTCELQWLQYLFKDLHISLDQPISVYCDNKSAIYLAHNPIFHERTKHIEIDCHVIREKIQTGLIHLLPVSSAAQLADVLTKPLPAPSFNSLISKLDLLDIHSPACGGLLHDVNSNSS

SEQ ID NO: 187072 - protein, 408 aa, Glycine max
  Coding DNA Sequence Number=SeqID_70294
  Gene Ontology: Mol. function=RNA-directed DNA polymerase activity; Cellular component=chromatin; Biological process=chromatin assembly or disassembly
  Pfam annotation: Domain name=Chromo; Domain location=358-408; Score =25.7; E_value=0.00017; Accession=PF00385.14; Description='chromo' (CHRromatin Organisation MOdifier
  Pfam annotation: Domain name=rve; Domain location=150-266; Score =15.5; E_value=0.0003; Accession=PF00665.16; Description=Integrase core domain
  Pfam module annotation: Pfam domain module=Chromo::rve; Domain location=358-408::150-266
MEDNDIHKTAFKTHRGHFEYLVMPFGLTNALAIFQGLMNSIFQGYKRKNSLYAKKSKCYFGVERVEYLGHFITKDGYYRRFVEGFGGIARPLTNMLKKNNFHWFDEAKVAFQSLKDSLIQSPVFALPEFSKVFRVEVDASSYGIGVVLMQNHHPIAFIGLPNYKGKQVIYVVVDILSKTAYFMSLTHPYTATEVAQSFLDNVFKEHAYHPQTDGQSEVVNRCLERFLRCMCCDVPHEWSKWLLLVGWWYNTNHHTSIQCNPYEVMFGQPQFAFHICQERMKQLADNKRSDKSYEIGDFVYVKLHPYKQILVAFKPNAKLAPKNFGPFQIEDKIGLKRHVGEPVSNFLPTDYDGVMRGKEPELILDRAIIKRGNKVVTKVLVKWKHQLIEDATWEFFYDLKRTYPTFNP

SEQ ID NO: 187073 - protein, 1172 aa, Glycine max
  Coding DNA Sequence Number=SeqID_70295
  Gene Ontology: Mol. function=receptor activity; Cellular component =integral to membrane; Biological process=xylan catabolic process
  Homolog annotation: Hit_ID=Q6JN46; Match level="QueryCoverage=98%, HitCoverage=95%, E-value=1e-145, Identity=32%"; Hit description=EIX receptor 2
  Pfam annotation: Domain name=LRRNT_2; Domain location=16-54; Score =60.6; E_value=5.2e-15; Accession=PF08263.3; Description=Leucine rich repeat N-terminal domain
  Pfam annotation: Domain name=LRR_1; Domain location=1000-1022; Score =16.7; E_value=0.081; Accession=PF00560.23; Description=Leucine Rich Repeat
  Pfam annotation: Domain name=LRR_1; Domain location=1024-1046; Score =10.3; E_value=3.4; Accession=PF00560.23; Description=Leucine Rich Repeat
  Pfam annotation: Domain name=LRR_1; Domain location=1048-1069; Score =9.6; E_value=4.6; Accession=PF00560.23; Description=Leucine Rich Repeat
  Pfam annotation: Domain name=LRR_1; Domain location=113-135; Score =14.2; E_value=0.48; Accession=PF00560.23; Description=Leucine Rich Repeat
  Pfam annotation: Domain name=LRR_1; Domain location=137-160; Score =14.6; E_value=0.37; Accession=PF00560.23; Description=Leucine Rich Repeat
  Pfam annotation: Domain name=LRR_1; Domain location=162-184; Score =16.9; E_value=0.073; Accession=PF00560.23; Description=Leucine Rich Repeat
  Pfam annotation: Domain name=LRR_1; Domain location=186-208; Score =18.5; E_value=0.024; Accession=PF00560.23; Description=Leucine Rich Repeat
  Pfam annotation: Domain name=LRR_1; Domain location=309-331; Score =10.0; E_value=3.8; Accession=PF00560.23; Description=Leucine Rich Repeat
  Pfam annotation: Domain name=LRR_1; Domain location=333-355; Score =5.9; E_value=22; Accession=PF00560.23; Description=Leucine Rich Repeat
  Pfam annotation: Domain name=LRR_1; Domain location=363-384; Score =18.5; E_value=0.025; Accession=PF00560.23; Description=Leucine Rich Repeat
  Pfam annotation: Domain name=LRR_1; Domain location=386-409; Score =14.9; E_value=0.29; Accession=PF00560.23; Description=Leucine Rich Repeat
  Pfam annotation: Domain name=LRR_1; Domain location=410-432; Score =12.3; E_value=1.4; Accession=PF00560.23; Description=Leucine Rich Repeat
  Pfam annotation: Domain name=LRR_1; Domain location=434-456; Score =11.4; E_value=2.1; Accession=PF00560.23; Description=Leucine Rich Repeat
  Pfam annotation: Domain name=LRR_1; Domain location=463-484; Score =12.0; E_value=1.6; Accession=PF00560.23; Description=Leucine Rich Repeat
  Pfam annotation: Domain name=LRR_1; Domain location=486-507; Score =14.0; E_value=0.54; Accession=PF00560.23; Description=Leucine Rich Repeat
  Pfam annotation: Domain name=LRR_1; Domain location=510-532; Score =10.2; E_value=3.5; Accession=PF00560.23; Description=Leucine Rich Repeat
  Pfam annotation: Domain name=LRR_1; Domain location=534-556; Score =11.1; E_value=2.4; Accession=PF00560.23; Description=Leucine Rich Repeat
  Pfam annotation: Domain name=LRR_1; Domain location=563-584; Score =7.6; E_value=11; Accession=PF00560.23; Description=Leucine Rich Repeat
  Pfam annotation: Domain name=LRR_1; Domain location=586-608; Score =13.6; E_value=0.73; Accession=PF00560.23; Description=Leucine Rich Repeat
  Pfam annotation: Domain name=LRR_1; Domain location=610-633; Score =10.1; E_value=3.7; Accession=PF00560.23; Description=Leucine Rich Repeat
  Pfam annotation: Domain name=LRR_1; Domain location=635-655; Score =4.0; E_value=51; Accession=PF00560.23; Description=Leucine Rich Repeat
  Pfam annotation: Domain name=LRR_1; Domain location=660-682; Score =3.3; E_value=68; Accession=PF00560.23; Description=Leucine Rich Repeat
  Pfam annotation: Domain name=LRR_1; Domain location=684-707; Score =2.2; E_value=1.1e+02; Accession=PF00560.23; Description=Leucine Rich Repeat
  Pfam annotation: Domain name=LRR_1; Domain location=711-732; Score =1.6; E_value=1.4e+02; Accession=PF00560.23; Description=Leucine Rich Repeat
  Pfam annotation: Domain name=LRR_1; Domain location=755-776; Score =2.4; E_value=1e+02; Accession=PF00560.23; Description=Leucine Rich Repeat
  Pfam annotation: Domain name=LRR_1; Domain location=781-803; Score =14.6; E_value=0.36; Accession=PF00560.23; Description=Leucine Rich Repeat
  Pfam annotation: Domain name=LRR_1; Domain location=805-827; Score =18.5; E_value=0.025; Accession=PF00560.23; Description=Leucine Rich Repeat
  Pfam annotation: Domain name=LRR_1; Domain location=829-851; Score =14.2; E_value=0.49; Accession=PF00560.23; Description=Leucine Rich Repeat
  Pfam annotation: Domain name=LRR_1; Domain location=853-876; Score =10.3; E_value=3.3; Accession=PF00560.23; Description=Leucine Rich Repeat
  Pfam annotation: Domain name=LRR_1; Domain location=878-900; Score =8.3; E_value=8; Accession=PF00560.23; Description=Leucine Rich Repeat
  Pfam annotation: Domain name=LRR_1; Domain location=88-111; Score =11.0; E_value=2.5; Accession=PF00560.23; Description=Leucine Rich Repeat
  Pfam annotation: Domain name=LRR_1; Domain location=902-924; Score =6.7; E_value=16; Accession=PF00560.23; Description=Leucine Rich Repeat
  Pfam annotation: Domain name=LRR_1; Domain location=976-998; Score =13.0; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1; Domain location=16-54::1000 -1022::1024-1046::1048-1069::113-135::137-160::162-184::186-208::309 -331::333-355::...
  Pfam module annotation: Domain location=363-384::386-409::410 -432::434-456::463-484::486-507::510-532::534-556::563-584::586 -608::610-633::635-655::660-682::684-707::711-732::755-776::781 -803::805-827::829-851::853-876::...
  Pfam module annotation: Domain location=878-900::88-111::902-924::976- 998
MMLQVVVSAQDHIMCIQTEREALLQFKAALLDDYGMLSSWTTSDCCQWQGIRCSNLTAHVLMLDLHGDDNEERYIRGEIHKSLMELQQLNYLNLSWNDFQGRGIPEFLGSLTNLRYLDLSHSYFGGKIPTQFGSLSHLKYLNLARNYYLEGSIPRQLGNLSQLQHLDLSINQFEGNIPSQIGNLSQLLHLDLSYNSFEGSIPSQLGNLSNLQKLYLGGSFYDDGALKIDDGDHWVSNLISLTHLSLAFVSNLNTSHSFLQMIAKLPKLRELSLKQLHVINDTPVAVQRHLSYNLLEGSTSNHFGRVMNSLEHLDLSDNILKGEDFKSFANICTLHSLYMPANLLTEDLPSILHNLSSGCVRHSLQDLDLSHNQITGSFPDLSVFSSLKTLILDGNKLSGKIPEGILLPFHLEFLSIGSNSLEGGISKSFGNSCALRSLDMSGNNLNKELSVIIHQLSGCARFSLQELNIRGNQINGTLSDLSIFSSLKTLDLSENQLNGKIPESNKLPSLLESLSIGSNSLEGGIPKSFGDACALRSLDMSNNSLSEEFPMIIHHLSGCARYSLEQLSLSMNQINGTLPDLSIFSSLKKLYLYGNKLNGEIPKDIKFPPQLEQLDLQSNSLKGVFTDYHFANMSKLYFLELSDNSLLALAFSQNWVPPFQLRSIGLRSCKLGPVFPKWLETQNQFQGIDISNAGIADMVPKWFWANLAFREFISMNISYNNLHGIIPNFPTKNIQYSLILGPNQFDGPVPPFLRGSVFLDLSKNQFSDSLSFLCANGTVETLYELDLSNNHFSGKIPDCWSHFKSLTYLDLSHNNFSGRIPTSMGSLLHLQALLLRNNNLTDEIPFSLRSCTNLVMLDIAENRLSGLIPAWIGSELQELQFLILGRNNFHGSLPLQICYLSDIQLLDVSLNNMSGQIPKCIKNFTSMTQKTSSRDYQGHSYLVYTIGISGNYTYDLNALLMWKGSEQMFKNNVLLLLKSIDLSSNHFSGEIPLEIEDLFGLVSLNLSRNHLTGKIPSNIGKLTLLDFLDLSRNHLVGSIPLSLTQIDRLGMLDLSHNNLSGEIPTGTQLQSFNASCYEDNLDLCGPPLEKLCIDGKPAQEPIVKLPEDENLLFTREFYMSMAIGFVISFWGVFGSILMNRSWRHAYFKFISNFSDAIYVMAAVKVFKLHHRG

SEQ ID NO: 187074 - protein, 423 aa, Glycine max
  Coding DNA Sequence Number=SeqID_70296
  Gene Ontology: Mol. function=RNA-directed DNA polymerase activity; Cellular component=chromatin; Biological process=chromatin assembly or disassembly
MAEATRNQAALQEQEECLEHRIMSKLEAHIMEITSSIWQAIDSSIDRRILETSQKNFDSEIIATNQGPHRRDERHANSNYSCGTRLVRIVFPRFSGDVVQQWIYQCETYFGIDGTLANFQVKLVVIHFEGKALQWHTSFVKTLPEDVRKAFQLAKLYESTSNSYIYTKTFPKFQKNQPSTKAILPTPNPTHKPIDSQFTLNPTQRQPNKKLTPTFMAERQSKGLCCFCDEQYSPNHALTHKKLEIHVMEVSDIEEETIDQFDKMQEDGSTSLDPQISVNALTDIASFKTMRVTCCYKKKPLHTLIDSGSTHNFLDEGVAKKLGCLITDIPILSVAVANGARFEDIFQEPTRLPPKRKGHDHKISLVAGANPFNKRLYRYSKQQKDVIDKLVSDSLKFGIIQKNNSHFASPIVLIGKKDDCWIK

SEQ ID NO: 187075 - protein, 227 aa, Glycine max
  Coding DNA Sequence Number=SeqID_70297
  Gene Ontology: Mol. function=catalytic activity; Cellular component =cytosol; Biological process=cellular metabolic process
  Homolog annotation: Hit_ID=Q9CA28; Match level="QueryCoverage=99%, HitCoverage=71%, E-value=7e-94, Identity=68%"; Hit description =Putative reductase; 61412-62628
  Pfam annotation: Domain name=Epimerase; Domain location=1-156; Score=- 57.1; E_value=0.021; Accession=PF01370.11; Description=NAD dependent epimerasedehydratase family
MENLIDPCLKGTINVLNSCIKANVKRVVLTSSCSSIRYRDDVQQVCPLNESHWTDLEYCRRHNLWYAYAKTIAEREAWRIAKENGMDLVVVNPSFVVGPMLAPQPTSTLLLILSIVKGMKGEYPNTAVGFVHINDVIATHLLAMEDPKTSGRLICSSTVAHWSQIIEMLRAKYPSYPYENRCSSQEGDNNPHNMDITKISQLGFPPFRTLEQMFDDCIKSFQEKGFL

SEQ ID NO: 187076 - protein, 391 aa, Glycine max
  Coding DNA Sequence Number=SeqID_70298
  Gene Ontology: Mol. function=nucleoside-triphosphatase activity; Cellular component=membrane; Biological process=cell division
  Homolog annotation: Hit_ID=Q1SK92; Match level="QueryCoverage=93%, HitCoverage=49%, E-value=1e-125, Identity=61%"; Hit description=AAA ATPase, central region; DEAD/DEAH box helicase, N-terminal
  Pfam annotation: Domain name=AAA; Domain location=130-301; Score =170.7; E_value=3.7e-48; Accession=PF00004.19; Description=ATPase family associated with various cellular activities (AAA)
MEVDASFASEGSVMNELKQWNDFLSHGFSLFQEGKSSGNLKTNESYKENSGEDITGAKNEMKCDNQAPENKSETEKSIPVTKKDGENPTLAKVEVPDKKFEKCIRPEVIPANEIGVTFADIGALDEIKESLQEAIANEAGASFINVSMSTITSKWFGEDEKNVRALFTLAAKVAPTIIFVDEVDSMLGQRTRVGEHEAMRKIKNEFMTHWDGLLTGPNEQILVLAATNRLFDLDEAIIRRFERRILVGLPSVENREMILKTLLAKEKHENLYFKELATMTEGYIGSDLKNLCITVAYRPVREIIKQERMKDMEKKKREAEGQSSEDASNNKDKEEQEIALRPLNMEDMRQAKSQEAASFASEGSIMNELKHWNDLYGERGSRKKQQLTYFL

SEQ ID NO: 187077 - protein, 236 aa, Glycine max
  Coding DNA Sequence Number=SeqID_70299
  Homolog annotation: Hit_ID=Q9FMD0; Match level="QueryCoverage=72%, HitCoverage=29%, E-value=2e-14, Identity=32%"; Hit description =Genomic DNA, chromosome 5, P1 clone:MUK11
MGDNKESKAGQLLKKLWTQVNQLEHNTIMDLITRPPLVLFDAIKSGNAEAVKILIDKNCELVTIKDPKNGRNLLHLVVLFRQKRIFISMLWGLEEHIVRAVEVDNEGNNILHLAAHLPVEFEELSSFRASIQMQRELEWFKLVEWRVPGELRRMRNNMGKRPIDVFYEEHKKLSEEIKDAAKGIAESGMLVAALVATVAFAAALSNVPGKCSRIIHFFCVYTFILVKFHFIKIRTK

SEQ ID NO: 187078 - protein, 155 aa, Glycine max
  Coding DNA Sequence Number=SeqID_70300
MDVPRELRTMRNNMGKIPIDVFYDEHKKLSEEIKDAAKGIAESGMLLAALVATVAFAAALTVSAFTAAYFLIFDHSSKWVSLASMGAVILLRHKGIYIVCIRAIRDMYNGVKANVRTRGGSQKNLVSISHVCVEKSYGIRIQEVHEDQMQGSRIS

SEQ ID NO: 187079 - protein, 116 aa, Glycine max
  Coding DNA Sequence Number=SeqID_70301
MRNNKGRKKPKDAFQEEHKKLSEEIKDAAKGIADYGMLVAALVATVAFPTALTVLADNKNNAWFTVFILTNAVALFTSSASLLSFSSNFTSSRLAKNDRKFVKSLHPSLTFGLFPT

SEQ ID NO: 187080 - protein, 124 aa, Glycine max
  Coding DNA Sequence Number=SeqID_70302
MGSHAKCEDDSHVLKQNDNHQSNESMENASEPAEVKQSFPVSKPTEVCIRNFDLNLDPDEDMDSLDTPTSVPASSSAKSVSEEKHEEYPGWPLSDMEKMTIDPIQLANINGRIDEDEEDYDEEM

SEQ ID NO: 187081 - protein, 133 aa, Glycine max
  Coding DNA Sequence Number=SeqID_70303
  Pfam annotation: Domain name=Ank; Domain location=45-79; Score=15.0; E_value=0.21; Accession=PF00023.20; Description=Ankyrin repeat
  Pfam annotation: Domain name=Ank; Domain location=80-110; Score=11.6; E_value=0.67; Accession=PF00023.20; Description=Ankyrin repeat
  Pfam module annotation: Pfam domain module=Ank::Ank; Domain location =45-79::80-110
MTPEELSSLKEDLTRYIRWDDHEGLELKSIIDKCADIVRIPLNDRGDTALHEAVSERSDETVKELVKRMRPEDMLIPNLDGMLPVHLAVLYGRNQIVKILSSQEVLDKMKLEDIKRLFLMTIRVDMFGKCKTN

SEQ ID NO: 187082 - protein, 393 aa, Glycine max
  Coding DNA Sequence Number=SeqID_70304
  Gene Ontology: Mol. function=chromatin binding; Cellular component =chromatin; Biological process=chromatin assembly or disassembly
  Homolog annotation: Hit_ID=Q1SAV4; Match level="QueryCoverage=88%, HitCoverage=88%, E-value=1e-101, Identity=51%"; Hit description =Integrase, catalytic region
  Pfam annotation: Domain name=Chromo; Domain location=297-350; Score =22.9; E_value=0.0012; Accession=PF00385.14; Description='chromo' (CHRromatin Organisation MOdifier
  Pfam annotation: Domain name=rve; Domain location=1-147; Score=68.5; E_value=2.1e-17; Accession=PF00665.16; Description=Integrase core domain
  Pfam module annotation: Pfam domain module=Chromo::rve; Domain location=297-350::1-147
MDFIVGLPVYKGNTVILVVVDRFSKGIHLGMLPTGHTAHMVASLFLNIVVKLHGFPRSIVSDRDPLFISQFWRDLFSLSGTLLRLSSAYHPQSDGQTEVLNRVIEQYLRAFVHEKQGTWGKYLPWVEWSHNSAWSATTGSTPYEITYGRKPLTFPDYLAGTSKNDAVDEFLVDRETTFHSIRKKLLKAQETMKRFADAKRRDVVYQPNDWVLVKLRPRRQLTARGSNARGEKLAKRYYGPFRIVDRIGAAAYRLQLPEGTRVHPVFHCSVLKPFIGTVDSITSPTLPLQFEEGQPVVTPLTILRRRQIPGTLPIAWEVLVQWDGLSPDEATWENWHHLCHEYHLEDKVDFQGAEDVTHELKMPDTQETPASMVQRKEETKRKIVKPVYLADYV

SEQ ID NO: 187083 - protein, 595 aa, Glycine max
  Coding DNA Sequence Number=SeqID_70305
  Gene Ontology: Mol. function=receptor activity; Cellular component =integral to membrane; Biological process=red or far red light signaling pathway
  Homolog annotation: Hit_ID=Q6R8G7; Match level="QueryCoverage=92%, HitCoverage=68%, E-value=0.0, Identity=67%"; Hit description=PHO1 -like protein
  Pfam annotation: Domain name=EXS; Domain location=401-569; Score =284.3; E_value=2.3e-82; Accession=PF03124.5; Description=EXS family
  Pfam annotation: Domain name=SPX; Domain location=3-145; Score=-6.5; E_value=1.1e-05; Accession=PF03105.10; Description=SPX domain
  Pfam module annotation: Pfam domain module=EXS::SPX; Domain location =401-569::3-145
MAMEVIEEGSTHHEQSDDSNDDQEEHVKQTVKPKVEVQKPNNVRGTRPAPLEVLDRVQLNHSFETPRSTIKGVLNFPGNTELNFSRKNLNKVEEQLQRSFIEFYRKLRLLKSYSFLNTLAFSKIMKKYDKITSRDAAKAYMKMVDNSHLGSSDEVTKLMDRVEKTFTKHFYNSNRNKAMNILRPKAKRERHRVTFSMGFLAGCTAALVLALILIVRTRKILDESGSTKYMDTLFPLNSLYGYIVLHMLMYAANIYFWRRYRVNHSFIFGFKQGTELGYNQVLLLGFGLAVLALGGVLVNLDMQIDPQTKDYKTLTELIPLILLLVVIAILLCPINIFYRSSRVFFLICLFHCICTPLYKVTLPDFFMADQFTSQVEALRSFELYICYYGWGDFKQRENTCNSSSVFITFKFIVAVIPYWSRFLQCLRRLFEEKDPMQGYNGLKYFLTIVAVCFRTAYSRNNSMAWMVLAWIFSVFAAVASTYWDLVIDWGLLQRRSKNRWLRDKLAVPHKSVYFLAMVLNVLLRFAWLQTVLNFKFSFLHKQAMTTIVACLEIIRRGMWNFFRLENEHLNNVGKYRAFKSVPLPFNYDEDEDKDE

SEQ ID NO: 187084 - protein, 195 aa, Glycine max
  Coding DNA Sequence Number=SeqID_70306
  Gene Ontology: Cellular component=integral to membrane; Biological process=red or far red light signaling pathway
  Homolog annotation: Hit_ID=Q6R8G7; Match level="QueryCoverage=98%, HitCoverage=25%, E-value=5e-54, Identity=57%"; Hit description=PHO1 -like protein
  Pfam annotation: Domain name=SPX; Domain location=1-178; Score=72.9; E_value=1e-18; Accession=PF03105.10; Description=SPX domain
MKFGKEYTSQMVPEWQEAYMDYNLLKTLLKEIQRFKLRNKPSPTPSGLRRKLTLYRAFSGLTQQRHYQQLTPSEQDIESQPIMVHSVNNHDGSEKYETTFRMTSEEGGEYELVYFKRLDDEFNKVGKFYRSKVEEVLKEAAILNKQMDALIAFRIKVENPTGSFDRSVEMTRLASDVASSSAVLAASTPRGAKLN

SEQ ID NO: 187085 - protein, 216 aa, Glycine max
  Coding DNA Sequence Number=SeqID_70307
  Gene Ontology: Mol. function=DNA-directed RNA polymerase activity; Cellular component=mitochondrion; Biological process=transcription
  Homolog annotation: Hit_ID=O47884; Match level="QueryCoverage=99%, HitCoverage=22%, E-value=2e-50, Identity=56%"; Hit description=RNA polymerase
MYLTATAFLYQSYKYEEDALNDIKNKLIPYLECKENLKTYFKTYLKTLVIESRMAKRPFQYLSNIYLFLLSVSDLMSFVDLYNCVPVTQDASASAYQLMAYFLLDKNFAKLTNLFDTGSGEIFDIYSHMRIELISFIKDSLSEENPELCAILDRVLTRSIVKQIYMPIIYGKTANSTTKDLIVSLCQDLLPKESDQPGRSGMLLPRSTSLVQHRIF

SEQ ID NO: 187086 - protein, 202 aa, Glycine max
  Coding DNA Sequence Number=SeqID_70308
  Gene Ontology: Mol. function=intramolecular transferase activity, phosphotransferases; Biological process=metabolic process
  Homolog annotation: Hit_ID=Q6Z8J0; Match level="QueryCoverage=54%, HitCoverage=31%, E-value=2e-18, Identity=47%"; Hit description =Putative phosphoglycerate mutase
MATLDLNLVPSHSVEKESWDLNTEEKLEAADSSSMAAEVYYQAISTLQSRSYLNNLNHHQKHQNNLVRLVSRDFISNNGLSTRRSNCTGQRNCSVIRSLALQTSVADPVLSSSRSNASDTYKKSSGCNIQATLILIRHGESLWNEKNLFTGCVDVLLSKKGIDEAIEAGKRISSIPSEAGVYAYTRILFVWKAAMALADLYQ

SEQ ID NO: 187087 - protein, 70 aa, Glycine max
  Coding DNA Sequence Number=SeqID_70309
MASLLTISHVARKTPVVMASSYHLQIATPSGESEHRGVATAIGNLRASCNSHQRVREEELASTGSDLRAI

SEQ ID NO: 187088 - protein, 445 aa, Glycine max
  Coding DNA Sequence Number=SeqID_70310
  Gene Ontology: Mol. function=DNA binding; Biological process =regulation of transcription, DNA-dependent
  Homolog annotation: Hit_ID=Q1S9D7; Match level="QueryCoverage=66%, HitCoverage=90%, E-value=4e-26, Identity=28%"; Hit description =Transcriptional factor B3; Cupredoxin
  Pfam annotation: Domain name=B3; Domain location=206-299; Score=51.7; E_value=2.5e-12; Accession=PF02362.12; Description=B3 DNA binding domain
  Pfam annotation: Domain name=B3; Domain location=346-437; Score=13.0; E_value=0.0025; Accession=PF02362.12; Description=B3 DNA binding domain
  Pfam annotation: Domain name=B3; Domain location=9-104; Score=66.5; E_ value=8.5e-17; Accession=PF02362.12; Description=B3 DNA binding domain
  Pfam module annotation: Pfam domain module=B3::B3::B3; Domain location=206-299::346-437::9-104
MSSQGYGVHFFKVILESTLRKGQLKVPSSFTRRHWQGISNPVILSLPNGTKRKVYWLKDGCDVWFSNGWREFAKKLRLDVSHFVVFRYEGNSCFNVIIFGKSALEVEYPSSHDSNVEVEEINDTDFSAKFGEDHTSKSSKKRKIIPKEEDDDDDDEPKHCKKDSGFDYSKQKNGGSSQGDFKRRIKMFHEKVKEMFYAENEHFTCLIQKTYTERDLLILPMEFSKPYLHKEGNATLFVDDGRSWDVGLRVNHYGQLTFSRGWRKFSLENKLKVGDVCGFELHNSEKFSFEVSIYRLEENSSTPIFKGHEQRLSNMPSSSFRTPVTPNASTSKSKDDLCIFIKSSNLPCQTISFKYIRSYVNESCSEIHGRLVTLRVGCRAWQVKLLCYNANSFARFSSGWPEFARECDLKPGDVCILKMIDVKKLVFEVSCLKGKISREENEVYK

SEQ ID NO: 187089 - protein, 105 aa, Glycine max
  Coding DNA Sequence Number=SeqID_70311
MELLNIGFSKTDVNYFMLTSGADVKELILTSGAETVVGAQRSKLSPRGSTDVHVLLGSLHQASLIIEFNIDSLERCRGDPNLILEGEELHDPAFMDGEEECGRGS

SEQ ID NO: 187090 - protein, 104 aa, Glycine max
  Coding DNA Sequence Number=SeqID_70312
MEEFLQKVAWPRVQPSPLGGGEAFAAQEPQPDQEDDIREASKPIPSEPFIVETSPAIPQEDAAAVTPQLESSAPVPDLPLSRDSPSSTPALDLNEHAMDSAQDH

SEQ ID NO: 187091 - protein, 103 aa, Glycine max
  Coding DNA Sequence Number=SeqID_70313
MVLNFGKNIWHPLWGCGTTYLVVSCQSSTFIHAAGVSLNKVHVLSEYHPLSETSARLASKRNLEGNLPHKHALNMSSARLVSRLSLLALSAPGLLSQRSLIRA

SEQ ID NO: 187092 - protein, 62 aa, Glycine max
  Coding DNA Sequence Number=SeqID_70314
TCKARIKGNKEFVNSNLGHSPYLECKKDGLISTLAMDHPSNLKVPNLIDHEGGSWKTDIVTK

SEQ ID NO: 187093 - protein, 148 aa, Glycine max
  Coding DNA Sequence Number=SeqID_70315
  Gene Ontology: Mol. function=RNA-directed DNA polymerase activity; Cellular component=chromatin; Biological process=chromatin assembly or disassembly
MVFVQGVTSYPAKIQGYVAIVEPLTSLICKDQLSWHSEAQQVFDKLKELMTKALVLATPDFTIPFTLETNASGTSMGIVLFQNSHPLAYYRRVFCPRLQRASTYIHKLHVITSAVRKWRQYLLGYPFVIFTYHKSLRDLMPQVIQTPK

SEQ ID NO: 187094 - protein, 85 aa, Glycine max
  Coding DNA Sequence Number=SeqID_70316
MEAMNECLWEELSIPINQIIARSRNVQNDATITCRRRTIDLPIIKWEAPSTRLIACDRCGSRKSMRTFLPIVEEGKTIALLEAIY

SEQ ID NO: 187095 - protein, 164 aa, Glycine max
  Coding DNA Sequence Number=SeqID_70317
MTTPFKTKEVNEEITTKDIRSLMEQANYANKYLQVLQESISEEKVLTKPKDHESSSSTVQMEKPFFNLLFKENTFSRIHTVEEEGVLEQKEAQASKSKKEEVVAMRESVLEIKRLREREGVLGNSERVRGVVGLGRAIGTILVFWKETYARELDRERELHHEGE

SEQ ID NO: 187096 - protein, 196 aa, Glycine max
  Coding DNA Sequence Number=SeqID_70318
  Gene Ontology: Mol. function=transmembrane receptor activity; Cellular component=membrane; Biological process=defense response
  Homolog annotation: Hit_ID=Q1T2S3; Match level="QueryCoverage=70%, HitCoverage=10%, E-value=5e-31, Identity=51%"; Hit description=TIR; Disease resistance protein; KRAB box; Calcium-binding EF-hand; Tumor Necrosis Factor
  Pfam annotation: Domain name=LRR_1; Domain location=29-50; Score =13.3; E_value=0.87; Accession=PF00560.23; Description=Leucine Rich Repeat
  Pfam annotation: Domain name=LRR_1; Domain location=4-27; Score=0.9; E_value=1.9e+02; Accession=PF00560.23; Description=Leucine Rich Repeat
  Pfam annotation: Domain name=LRR_1; Domain location=52-73; Score =10.4; E_value=3.2; Accession=PF00560.23; Description=Leucine Rich Repeat
  Pfam module annotation: Pfam domain module=LRR_1::LRR_1::LRR_1; Domain location=29-50::4-27::52-73
MCPKLETLIFNSAFLSDKDVHAIIYNFPNLKDLNVSSNNFKSLPAHIKECTKLTSLDVRYCYKLRKIPELPSSVQKVEASGCNSFATETSNILWSQVRKDMKRIEMPKRKIPEWFDYVNGGYPVFEARGKFPTVALVFVFGKENLPSFSNITWLMSKSAINCKACSSPSEYPSKTEMHGLDQRDFAATNEPKSSWT

SEQ ID NO: 187097 - protein, 124 aa, Glycine max
  Coding DNA Sequence Number=SeqID_70319
MTSASGDATPPFLDDYMELSQNNLLDAEGPNASSSRMVLTNYAATASDNRDYILSQDFFWVTYFKFIMPRIVSKRNYSFLGFSFVGNTLCPKLLKNLNTTKRKRCQLGKIAVTNRHPKTSRMKS

SEQ ID NO: 187098 - protein, 81 aa, Glycine max
  Coding DNA Sequence Number=SeqID_70320
MACLLMKKTRGVATNIYLRENVRKTKNDEGLRILKIRVRELFTHGEGIRTGKGVALAPTYPQIDFNYEQKSLKVLDLETMF

SEQ ID NO: 187099 - protein, 127 aa, Glycine max
  Coding DNA Sequence Number=SeqID_70321
  Subcellular localization annotation: CTP_CleavageSite=55; ConfidenceScore=5.29e-01
MLLHHLSRSPTNSLPSIVHVSSHIESGTPRIDCLALFANSPFSNFIRRPMNSLPSAVHMSSTIESRASRIDCLALFTNSPFSNLIRRPMNSLPSAVHVSSTIESGAPRIHCLALFANSPFSILFGDP

SEQ ID NO: 187100 - protein, 70 aa, Glycine max
  Coding DNA Sequence Number=SeqID_70322
  Subcellular localization annotation: CTP_CleavageSite=42; ConfidenceScore=5.17e-01
VVLFMLARLWTAQRALVNFGLARAFLAQRMDSRGALSGISPRSANKHSSSFFQILPCAQPREYCVQRMAR

SEQ ID NO: 187101 - protein, 105 aa, Glycine max
  Coding DNA Sequence Number=SeqID_70323
  Gene Ontology: Mol. function=nucleic acid binding; Cellular component= mitochondrion; Biological process=DNA integration
MKEEINFMRHNDVWDLVELSKGCKRVGSHDNLELHQMDVKIDFLNGDLEKNVYMDQPVGFSVEGKKHIMCKLKKSIYSLEQSSRQWHLRLNDIIFSFEFKENTVD

SEQ ID NO: 187102 - protein, 210 aa, Glycine max
  Coding DNA Sequence Number=SeqID_70324
MTTLTQTWMTLLLSNILPSDHNSDLPLPKSQLVYAILTRMSVHVTQLIADAIYLFVGMPPTRHPLDLDKSNRALGFPELITGLCQSFEVPVTPSKAPDAPPPPHQADPAGSFDTERYLRHLVRQQAANHRAHVQTHNCLYQLSLSLQSQGFAPFPCPTPDQFRAEVAWLGDWPEAQAGEAPAEAPGDGKEARMDEEMTDLLDFLGGSGAT

SEQ ID NO: 187103 - protein, 161 aa, Glycine max
  Coding DNA Sequence Number=SeqID_70325
MSLPSTVHVSSTFESGAPRMSLPSAVRQFSILHFYPEPHECHCLALFMCPPLSSLEPHECHCLALFANSPFSTFSEPHECNCLALFMCPTPSSLEPREVMRSAVHQFSILHFYPEPHECHCLALFMCPPPSSLEPRECHCLALFANSPFSTFIRTPMNVIA

SEQ ID NO: 187104 - protein, 59 aa, Glycine max
  Coding DNA Sequence Number=SeqID_70326
MQTASPIGVFAVAMTRGEDTTTTGEFHGVASPIGDFIVQGGVASQTGKFQAQARGRWYF

SEQ ID NO: 187105 - protein, 209 aa, Glycine max
  Coding DNA Sequence Number=SeqID_70327
MHPPPSSLEPREVMRSAVRQCSILHFFRSPMNVIAQHCSCILHLRVWSPAKLCVALFANSPFSTFIRRSMNSLPSTVYVSSVIKRRASGDWEICFFVIFRIGSFAKHKKKEVVETRVIITEKAGRTKSVSYLCFPLISDERFFLQEAVASGGSNLARLGELGGKLLPYFAINRGRSEGRRGSAFWALLILSKLLRKIVSVKKIQAEALP

SEQ ID NO: 187106 - protein, 160 aa, Glycine max
  Coding DNA Sequence Number=SeqID_70328
MVVIASLLRLCNHTILRIKSPLSCKLVLWIMVEWDQSSTLNRIVGDPLRAGRNRKAEQSSTALDALIAKHLSFADVVEPFYGVQIAVFCGLHGDSSICAVARYGTATCAVAGQPLSLDSLCHLPLAASDLPVHLHLCSLSSALCNRELRWHLLFQNSGGT

SEQ ID NO: 187107 - protein, 396 aa, Glycine max
  Coding DNA Sequence Number=SeqID_70329
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=74%, HitCoverage=21%, E-value=1e-36, Identity=31%"; Hit description=Chromo
  Subcellular localization annotation: CTP_CleavageSite=38; ConfidenceScore=5.14e-01
MVMLLSYRGNVKLTFSVNHHQLQRMVQTNGVSTLFHIRLTTPEPPSTQISTLNNHSPEIESILHRYTFLLQTPTTLPPNHETNLTINLLPHLTPVNVQPYSKSFEDHLRHLDCALQVPKDGRFFLKLSKCCLAQQQIEYLGHVVSGAGVQPVLETTIHQGKCCDSSPFGSSLNPKHFEWSLETQDAFQTLKSIVLEWVSCYLSKLTQLHSLVNSFIQGFNKLQLMFVNHAITIAVKKWRQYLLGHSFVILTDHRSLKELMSQIVQTPEQHKYLTKLMGYDFTIQYRSDSSNIVADALSHTLKTPTGMVFLLSIPHFTFLTELKNELAAHQEFVALQKSLQDEPLSHSEYNYNNGLILKKGCIWLPNSLKFIHLLQQEFHSTPTGGHMGITKTLSIL

SEQ ID NO: 187108 - protein, 55 aa, Glycine max
  Coding DNA Sequence Number=SeqID_70330
MVIWREEDALEGKWTLGKFLVSGFEILVGWGRDSCARCQILDVAYLMCRFMWSGD

SEQ ID NO: 187109 - protein, 709 aa, Glycine max
  Coding DNA Sequence Number=SeqID_70331
  Gene Ontology: Mol. function=histone-lysine N-methyltransferase activity; Cellular component=nucleus; Biological process=chromatin modification
  Homolog annotation: Hit_ID=Q9T0G7; Match level="QueryCoverage=87%, HitCoverage=92%, E-value=0.0, Identity=57%"; Hit description =Probable histone-lysine N-methyltransferase, H3 lysine-9 specific SUVH9 (EC 2.1.1.43) ...
  Homolog annotation: Hit description=(Histone H3-K9 methyltransferase 9) (H3-K9-HMTase 9) (Suppressor of variegation 3-9 homolog protein 9) (Su(var)3-9 homolog protein 9)
  Pfam annotation: Domain name=Pre-SET; Domain location=446-544; Score =114.4; E_value=3.3e-31; Accession=PF05033.6; Description=Pre-SET motif
  Pfam annotation: Domain name=SET; Domain location=546-701; Score =139.4; E_value=1e-38; Accession=PF00856.18; Description=SET domain
  Pfam annotation: Domain name=YDG_SRA; Domain location=258-416; Score =271.2; E_value=2e-78; Accession=PF02182.8; Description=YDGSRA domain
  Pfam module annotation: Pfam domain module=Pre-SET::SET::YDG_SRA; Domain location=446-544::546-701::258-416
MNFLFSRENLPPPPGIPIPATIAAANTTPNPILIPKLEPFDELLNTHTPQQQQQSQDPSFSNGSLDLDLDLDLKLVCDETPGAFSGDPSLLSDFNRLSQLFKTAFTNNNAVLDPIAQGLQQLQNDAVSDPLDGTTVVPPQSFQNSDPGMQQQQQYPNGAVSDPDSRAIVPVPEEGRSSSVAVTTPRQRRFKELVRLTDVGGPEQRHFRDVVRRTRMVYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPTCCLSLDVSNRKENVAVRLFNDIDPNYDPLQYEYLVKTNFPQFVFHQSGRGTGCECADGCVEGCFCAMKNGGDFPYNQSGILLRGKPLVFECGPFCRCPPHCRNRVTQKGLKNRLEVFRSRETGWGVRSMDLIQAGAFICEYTGVVLTREQARLLTMNGDSLIYPNRFTDRWAEWGDLSMIDSNFVRPSYPSIPPLDFAMDVSRMRNVACYMSHSSTPNVLVQFVLYDHNNLMFPRLMLFAMESIPPMRELSLDYGVADEWTGKLSICNE

SEQ ID NO: 187110 - protein, 150 aa, Glycine max
  Coding DNA Sequence Number=SeqID_70332
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLSGGQRRPPSGGARAI

SEQ ID NO: 187111 - protein, 76 aa, Glycine max
  Coding DNA Sequence Number=SeqID_70333
  Subcellular localization annotation: CTP_CleavageSite=53; ConfidenceScore=5.23e-01
NGVSLDAKNFLPGKILQLRKKKTSSVESRGRRLPWNLTEDVFRKTPRKKFFSSAAVISSPEENFYRIPAARGIHLF

SEQ ID NO: 187112 - protein, 203 aa, Glycine max
  Coding DNA Sequence Number=SeqID_70334
MEDIWSSMLIQQRLLSNQLEMLSKHLEIMQIVVIHPQPINCDFCGGKYFNDSCHLYSMENSWWEQELHPYNQYKEERLFILENVLMHFMETSQARFKANQSSIQNLEIQLGEERTQQQWKKCSQVEIQQESPLQVNTSPHQLIGKEEMHGECDKSLSVIFSLITNTSLATIWKVFQGYMILMEFLAKKQKCKEDVFYVTFMPP

SEQ ID NO: 187113 - protein, 768 aa, Glycine max
  Coding DNA Sequence Number=SeqID_70335
  Gene Ontology: Mol. function=protein dimerization activity; Cellular component=nucleus; Biological process=transposition, DNA-mediated
  Homolog annotation: Hit_ID=Q9LH75; Match level="QueryCoverage=86%, HitCoverage=99%, E-value=0.0, Identity=60%"; Hit description=Ac transposase-like protein
  Pfam annotation: Domain name=hATC; Domain location=665-747; Score =138.8; E_value=1.5e-38; Accession=PF05699.5; Description=hAT family dimerisation domain
  Pfam annotation: Domain name=zf-BED; Domain location=113-158; Score =42.4; E_value=1.5e-09; Accession=PF02892.5; Description=BED zinc finger
  Pfam module annotation: Pfam domain module=hATC::zf-BED; Domain location=665-747::113-158
MVDPSSSLSNSWKKSKEVISSNLETVCLQGKVVYIYPPQTPLGGSLALESSFIQRRVRLASTSDFILPSQCYHPPYNHTIAPYGCLPSQIAYGAYAMEISNDSGTKKPKRLTSVVWNHFERIRKADICYAVCVHCNKKLSGSSNSGTTHLRNHLMRCLKRSNFDVSQLLAAKRRKKDNTISLANIGFDEGQRKEEYIKPTIIKFEPEHKKDEIINFGSSKFDQERSQLDLARMIILHGYPLSLVEQVGFKVFVKNLQPLFEFTPNSSVEISCIDIYRREKEKVFDMINRLHGRINLSIETWSSTENSLYLCLSAHYIDEEWTLQKKLLNFVTLDSSHTEDLLPEVIIKCLNEWDIDCKLFALTLDDCSINDDITLRIKERVSDKRPFLSTRQLLDIRSAAHLIKSIAQDAMDALHEVIQKIRESIKYIRSSQVVQGKFNEIAQHARINTQNLLFLDFPVQWKSTYLMLETALEYRTAFSLFQEHDPSYSSTLTDEEWEWASSVTGYLKLLVEIMNIFSGNKFPTANIYFPEICDVHIQLIDWCRSSDNFLSSMALKMKDKFDRYWSKCSLPLAVAAVLDPRFKMKLVEYYFSLIYGSTALEHIKEVSDGIKELFNVYSICSTMIDQGSALPGSSLPSTSCSSRDRLKGFDRFLHETSQGQSMISDLDKYLEEPIFPRNSDFNILNWWKVHMPRYPILSMMARDVLGTPMSTMAPELAFSTGGRVLDSSRSSLNPDTREALICTQDWLQNESGDLNPSSIHSALPLLIE

SEQ ID NO: 187114 - protein, 333 aa, Glycine max
  Coding DNA Sequence Number=SeqID_70336
  Homolog annotation: Hit_ID=Q2HSY3; Match level="QueryCoverage=37%, HitCoverage=57%, E-value=1e-12, Identity=29%"; Hit description =Nucleic acid-binding, OB-fold
  Pfam annotation: Domain name=DUF223; Domain location=39-135; Score= -6.1; E_value=0.011; Accession=PF02721.5; Description=Domain of unknown function DUF223
MPRKENATSEIHSKRGTWKIVFRITNLWFVRKAGGKCAVEMVLMDQTGSKIGATLSEDYFAEFRHLLQHGKTYVLENFSVVRSTREWRVSKSDYMLYFGKPTRVTEEECLEIPENVYNFTSFEDVIVGEAKLDTLVDIIDVVVNIIEQHTQSPPYRVTVVLRDKKLDLSKPYHTVEVTQGDAHSQSLFSQGSQGSPLGRFLHNAKVVRLGEIKPLTQDLYYLTVGTVDEILVKDPWSYDSYLYCTCFVEAKCLHKNVQQKCCRDKETIARYCPNQEGMKNMNSFPTCVDELIGKQLALRLKYRLQYRQCSVVDVSENEDIITAIKAKLSPSQN

SEQ ID NO: 187115 - protein, 71 aa, Glycine max
  Coding DNA Sequence Number=SeqID_70337
MEELIDKTQLSPKIIPTSSCQLGGSTKESHLLYSTAVILLPQTKVRDHRSMMHAPDLNSQMQYGTIPKEIA

SEQ ID NO: 187116 - protein, 72 aa, Glycine max
  Coding DNA Sequence Number=SeqID_70338
MENCLVKLKTKFREDPTVNEGWEAFLPRQLHGVTFSVTTTQVDVPSNVLRQSSQAVSPLKLCEGETKDISSG

SEQ ID NO: 187117 - protein, 148 aa, Glycine max
  Coding DNA Sequence Number=SeqID_70339
MSRNSTDFLTIGVKYLEAVKRGSHAIKQWSPDEIRGAEDDVSLRGSTGTYRDSQRVQKTTLVFACQWAHTVIDKGVQKTTLISACQQAHIAIDKGHIPRLTKGAEDDVSLRVSTGTYRDWQRVPPHVTGLLGHGNKGGVVDKSKAFAP

SEQ ID NO: 187118 - protein, 100 aa, Glycine max
  Coding DNA Sequence Number=SeqID_70340
  Gene Ontology: Mol. function=protein kinase activity; Biological process=protein amino acid phosphorylation
  Homolog annotation: Hit_ID=Q1SM20; Match level="QueryCoverage=79%, HitCoverage=19%, E-value=1e-17, Identity=54%"; Hit description =Nucleic acid-binding, OB-fold
  Pfam annotation: Domain name=DUF889; Domain location=1-100; Score= -117.1; E_value=0.0015; Accession=PF05970.5; Description=Eukaryotic protein of unknown function (DUF889)
MEVSERLSCEKHWHWQSDQKFYNNPEYLQSRAILASTIEVIDKVNEYVMSLIPGDEIEYYSADSINKSDALQNPAFETVTPEFLNSLNTSGIPNHEMKLK

SEQ ID NO: 187119 - protein, 199 aa, Glycine max
  Coding DNA Sequence Number=SeqID_70341
MEGGDFGGEGGGASTRYSVVIGGGTVVGGGGVGLLETQQFLKVLLRHTSWSNDGEEGYLTWSTRGVDCCECIFKEGLRLGSEFNQQRFNCIDLGSKMSIFLLHLHQLAVEFVLFPLKFNNHSLSWNPRVLIRRERMLFECKKLCPSSYYSFSHSSFWVLVQVEDKLRAKRGRFLEVYERRRCLGVERFLRERECGEFAE

SEQ ID NO: 187120 - protein, 145 aa, Glycine max
  Coding DNA Sequence Number=SeqID_70342
  Gene Ontology: Mol. function=helicase activity
  Homolog annotation: Hit_ID=Q9LTU4; Match level="QueryCoverage=99%, HitCoverage=32%, E-value=1e-18, Identity=41%"; Hit description =Helicase-like protein
MEQLYFDVMTICGQLGFPDLFLTFTCNPNWPEIERNVKILNLRSDERPDMVTKVFKQKLDDLINDLKSRQVFGQILGSSTGELFFMRMILSIAKGPTSYDEIIKIDGVQYPTFRAACFALGFLGNDQEFIGAIREAKDWGTAHFL

SEQ ID NO: 187121 - protein, 182 aa, Glycine max
  Coding DNA Sequence Number=SeqID_70343
  Gene Ontology: Mol. function=nucleic acid binding; Biological process= DNA integration
  Homolog annotation: Hit_ID=Q1T2A4; Match level="QueryCoverage=71%, HitCoverage=45%, E-value=2e-20, Identity=37%"; Hit description=Zinc finger, CCHC-type
  Pfam annotation: Domain name=zf-CCHC; Domain location=92-109; Score =10.8; E_value=0.017; Accession=PF00098.13; Description=Zinc knuckle
MSVTKIFTELKVLWEELESQRPRPVPTGTSLTLSSCASMRNAHMFQLQDQVIQFLTGISDQSSVLRLVDTRKPQGRGRGANSNNYSGKNSNRICIYCGKTGHTIETCYRKHGFPPNHGKGVQAVANATQQLQKTESKDEVVGLYHLVIDDNQAQVLAVHKNVSVAIPEPRLHCHTSAGTLVS

SEQ ID NO: 187122 - protein, 181 aa, Glycine max
  Coding DNA Sequence Number=SeqID_70344
  Homolog annotation: Hit_ID=Q10N48; Match level="QueryCoverage=69%, HitCoverage=54%, E-value=2e-24, Identity=46%"; Hit description =Expressed protein
MSLVQCLDGKGFAVCNSLRRNTGRWLFSYVELDLLLAQPLTNFSGKKCKRCGIYEEDKFLSDDVFDVWEFCPSDFTTPDGRYVHFKEKEFNASFLCPECLSFSGASVSAPPVENHNPNKKGMNVAVIILLSILGSTILILGMLGAYKYWQKRKREQDQARFLKLFEEGDDIEDELGLGTII

SEQ ID NO: 187123 - protein, 309 aa, Glycine max
  Coding DNA Sequence Number=SeqID_70345
  Gene Ontology: Mol. function=nucleic acid binding; Cellular component= cytoplasm; Biological process=ribosome biogenesis and assembly
  Homolog annotation: Hit_ID=Q12000; Match level="QueryCoverage=73%, HitCoverage=53%, E-value=1e-27, Identity=35%"; Hit description =Translation machinery-associated protein 46
  Pfam annotation: Domain name=zf-CCCH; Domain location=98-123; Score =23.1; E_value=0.001; Accession=PF00642.15; Description=Zinc finger C- x8-C-x5-C-x3-H type (and similar)
MPPKQQSKADLVKKQKIVEDKTFGLKNKNRSKNVQKYVQNLKQYVQPKLDPSKLTAKKKKEEKAKDKELNDLFKIAVSQPKVPLANIVSVSLWACVDPKSILCEFFKVGQCTKGFKCKFSHDLNVQRKGEKLTFIVISVTRVLNYSSRGTFICLLLVLAFMAFCCSNFWLALFLSETMEDWDQDTLEKVVESKKTEYNQNKPTDMVCTFWTQWRRSNMVGSGSAPMARAKVTTTTPMTPELFMQWKKKKMEEREANLGAQQAERAKNVRMRYAILLHNRQREANLCLTVHSSHMNEFYYSKEKVHAAHS

SEQ ID NO: 187124 - protein, 277 aa, Glycine max
  Coding DNA Sequence Number=SeqID_70346
MVDNFPAQKGKVIKYRVGVKVRGLCGDFVILGSSVVTPFSSSSTPHHQHRHPIKPPHKPSLPKLAPFSSNWNISCALQAPLALSHCADSKLVQEFEVVFEDFIDSGVVDAELLAKVVLLGIRGKKVRSVIHALNKVQGRRISLSTHLNGSDIIAKECCRLVTCSHVEEAVELMEVLARFQISIRELVQPSDIIKRCVLSRNPILAVRDLVSALKAYEASKKHLNTPNMYIYRATIDTCGLCRDYMKSRYIYEAALKHKNPVGWEMGRDVKQVGTKMA

SEQ ID NO: 187125 - protein, 380 aa, Glycine max
  Coding DNA Sequence Number=SeqID_70347
  Gene Ontology: Mol. function=protein serine/threonine kinase activity; Cellular component=membrane; Biological process=protein amino acid phosphorylation
  Homolog annotation: Hit_ID=Q6TKQ5; Match level="QueryCoverage=99%, HitCoverage=99%, E-value=1e-167, Identity=79%"; Hit description =Protein kinase-like protein
  Pfam annotation: Domain name=APH; Domain location=76-254; Score= -14.9; E_value=0.067; Accession=PF01636.13; Description =Phosphotransferase enzyme family
  Pfam annotation: Domain name=Pkinase; Domain location=73-347; Score =132.5; E_value=1.2e-36; Accession=PF00069.15; Description=Protein kinase domain
  Pfam annotation: Domain name=Pkinase_Tyr; Domain location=73-347; Score=151.1; E_value=2.9e-42; Accession=PF07714.7; Description =Protein tyrosine kinase
  Pfam module annotation: Pfam domain module=APH::Pkinase::Pkinase_Tyr; Domain location=76-254::73-347::73-347
MGWIPCSGYSGTKNKVEKMEAQDSLVGQIKATTGKLKRNSSTKSKDTSKNGNPDHIAAQTFSFRELATATRNFRAECLLGEGGFGRVYKGRLESINQVVAIKQLDRNGLQGNREFLVEVLMLSLLHHPNLVNLIGYCADGDQRLLVYEYMPLGCLEDHLHDIPPGKKQLDWNTRMKIAAGAAKGLEYLHDKANPPVIYRDLKCSNILLGEGYHPKLSDFGLAKLGPVGENTHVSTRVMGTYGYCAPEYAMTGQLTLKSDVYSFGVVLLEIITGRKAIDNSKSAGEQNLVAWARPLFKDRRKFSQMADPTLQGQYPPRGLYQVIAVAAMCVQEQANMRPVIADVVTALSYLASQRYDPNTQHTGQSSRHAPGTPPRNRRGQ

SEQ ID NO: 187126 - protein, 210 aa, Glycine max
  Coding DNA Sequence Number=SeqID_70348
  Gene Ontology: Mol. function=oxidoreductase activity; Cellular component=chloroplast
  Homolog annotation: Hit_ID=Q9ZUU2; Match level="QueryCoverage=87%, HitCoverage=75%, E-value=5e-76, Identity=73%"; Hit description =UPF0308 protein At2g37240, chloroplast precursor
  Pfam annotation: Domain name=AhpC-TSA; Domain location=31-148; Score=- 9.8; E_value=0.0048; Accession=PF00578.11; Description=AhpCTSA family
MACSPSTTLVSNSLLLNKTTRVESPVLGEDTTSSLDSVKVFDLNGNGIPISDLWKDRKAVVAFARHFGCVLCRKRADYLSSKKDIMDASGVALVLIGPGSIDQHFDMTLLSLLEIYADPTHSSYEALNFVSGVLTTFTPNAGLKIIQLYMEGYRQDWKLSFEKDTVSRGGWKQGGIIVAGPGKNNISYLHRDKEAGDDPEIEDILKACCS

SEQ ID NO: 187127 - protein, 90 aa, Glycine max
  Coding DNA Sequence Number=SeqID_70349
MGWGFATSQLAELVGLSVCKPEYMKFVMGWGFATSQLAELVGLSVCEPQKFLCLSCLYFLAPSFICWLWALANVYWLKFSCGYYLAAIFC

SEQ ID NO: 187128 - protein, 504 aa, Glycine max
  Coding DNA Sequence Number=SeqID_70350
  Gene Ontology: Mol. function=sequence-specific DNA binding; Cellular component=nucleus; Biological process=regulation of transcription
  Homolog annotation: Hit_ID=Q6VR10; Match level="QueryCoverage=56%, HitCoverage=100%, E-value=2e-87, Identity=63%"; Hit description=WRKY 13
  Pfam annotation: Domain name=FLYWCH; Domain location=215-282; Score= -1.1; E_value=0.093; Accession=PF04500.7; Description=FLYWCH zinc finger domain
  Pfam annotation: Domain name=WRKY; Domain location=226-284; Score =146.1; E_value=9.5e-41; Accession=PF03106.6; Description=WRKY DNA -binding domain
  Pfam annotation: Domain name=WRKY; Domain location=422-481; Score =145.6; E_value=1.3e-40; Accession=PF03106.6; Description=WRKY DNA -binding domain
  Pfam module annotation: Pfam domain module=FLYWCH::WRKY::WRKY; Domain location=215-282::226-284::422-481
  Subcellular localization annotation: CTP_CleavageSite=90; ConfidenceScore=5.05e-01
MHIKEAERVVIAKPVASRPTCSTFKSFSELLAGAINASPAIPSSQTTVSAIRPKTVRFKPAMNQPPSGFVFSQADTFGAALDNSSEMSPKLDTKQSLIYKPTAKLVSKTTVSLLANMDMNAFQLQLNYALALVEPKEEEDEEQEEGEEEKGNCSTSRQQTQQPMEANFQHSIHEKFRTNTSSNLDQSITPQTEINYQSSEPSKMVQQNIEEDQKVLTSSVNCDRPSYDGYNWRKYGQKQVKGSEYPRSYYKCTHPNCPVKKKVERSFDGNIAEIVYKGEHNHSKPQLHKRNSAAGTQGSGVVSDGIVQDMWSNSHSERNEGNEVRIENTGLSMHSDYYVKVPRPNDSALNVGATNAGGVSTENSCGLSGECEEGSKGFEAQEDEPRYKRRKNENQSNEAALSEEGLVEPRIVMQSFMDSEILGDGFRWRKYGQKVVKGNPYPRSYYRCTNIKCNVRKHVERAIDDPRSFVTTYEGKHNHEMPLKNTGTVASERDSQASLSKDKA

SEQ ID NO: 187129 - protein, 42 aa, Glycine max
  Coding DNA Sequence Number=SeqID_70351
MATAGVEEIRPPTLGAIFEPPPLFDGTTRVYKTRSNWVLLTL

SEQ ID NO: 187130 - protein, 232 aa, Glycine max
  Coding DNA Sequence Number=SeqID_70352
  Gene Ontology: Mol. function=transcription factor activity; Cellular component=chloroplast; Biological process=regulation of transcription, DNA-dependent
  Homolog annotation: Hit_ID=P03030; Match level="QueryCoverage=99%, HitCoverage=78%, E-value=2e-89, Identity=74%"; Hit description =Transcriptional activator protein lysR
  Pfam annotation: Domain name=HTH_1; Domain location=6-65; Score=81.0; E_value=3.8e-21; Accession=PF00126.17; Description=Bacterial regulatory helix-turn-helix protein, lysR family
  Pfam annotation: Domain name=LysR_substrate; Domain location=89-231; Score=9.7; E_value=0.00019; Accession=PF03466.10; Description=LysR substrate binding domain
  Pfam annotation: Domain name=MarR; Domain location=4-67; Score=-2.4; E_value=0.061; Accession=PF01047.13; Description=MarR family
  Pfam module annotation: Pfam domain module=HTH_1::LysR_substrate::MarR ; Domain location=6-65::89-231::4-67
MAKINWRHIEIFHAVMTSGNLTQAATLLHTSQPTVSRELARLEQQLGLQLFERVRGRLQPTVQGLRLYEEVQRSWYGLDRIMDAAEGLRNFRQGELSIACLPVFSQSLLPPLLQPFLQRYPQVSLNIIPQESPLLEEWLSAQRYDLGLTETQHAPAGTERLALLTCDEVCVLPPQHPLCQRAVLTPQDFHGENYVSLSRSDSYPGGAAAGAGDAQRRVGVRDGARRGGYFDC

SEQ ID NO: 187131 - protein, 56 aa, Glycine max
  Coding DNA Sequence Number=SeqID_70353
  Homolog annotation: Hit_ID=Q1MDQ8; Match level="QueryCoverage=56%, HitCoverage=8%, E-value=1e-07, Identity=71%"; Hit description =Putative MFS family transmembrane transporter precursor
MAGPAEQQREHGDQREAEDQAERHFPVRQFPANNVTHRQASANQEQRPADTAIADA

SEQ ID NO: 187132 - protein, 125 aa, Glycine max
  Coding DNA Sequence Number=SeqID_70354
  Gene Ontology: Mol. function=diaminopimelate decarboxylase activity; Biological process=lysine biosynthetic process via diaminopimelate
  Homolog annotation: Hit_ID=Q7CGZ1; Match level="QueryCoverage=97%, HitCoverage=29%, E-value=1e-33, Identity=61%"; Hit description =Diaminopimelate decarboxylase
MFMPRPLNDSQTALNATNLLPLAQRYSGPFWAYDAEIIQQRIAQLSAFDVVRFAQKACSNIHILRLMRAAGVKVDSVSLGEIERALAAGFQPGGEDIVFTADVPDSPTLARIAEPLIPLNTGSQD

SEQ ID NO: 187133 - protein, 153 aa, Glycine max
  Coding DNA Sequence Number=SeqID_70355
  Gene Ontology: Mol. function=transcription factor activity; Cellular component=integral to membrane; Biological process=regulation of transcription, DNA-dependent
  Homolog annotation: Hit_ID=Q5PEP7; Match level="QueryCoverage=50%, HitCoverage=33%, E-value=3e-17, Identity=70%"; Hit description =Transcriptional activator protein LysR
MATFATVPGLQINVVRHGKDAPNLVSTLNISAFNVGNALGAWVGGAVIDKGYGLTAVPVAAAALAAAGLVVCLLTFRKSGGQRETVVAKVIDQRRCRPMLWPHQAHRERHGNTEAAHHHTAVGVIQRPPAAAPPAAHGTAHPATDDSYRCATG

SEQ ID NO: 187134 - protein, 219 aa, Glycine max
  Coding DNA Sequence Number=SeqID_70356
MEGHNGLNTLECLRGRLLAERHASRVAKEEAESLGNKFVELEKKLKEEIKLRDKAERKLKLLKKKLECFNNVTTPSWQKYHSSEKCEDSCGSSLSSAVSRDSEANETKLVHTVNPALLENEVHNHNVAEECVLVQTQNSPFTTKDCNSDPSNFLPQILGNNPNQSSDNLKNDGNRLSLSSSKSLAEGYNSQGTDDCSSNPSPTEAFPENICHNSNPIPS

SEQ ID NO: 187135 - protein, 370 aa, Glycine max
  Coding DNA Sequence Number=SeqID_70357
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LHJ9; Match level="QueryCoverage=98%, HitCoverage=95%, E-value=1e-129, Identity=62%"; Hit description =Protein phosphatase 2C
  Pfam annotation: Domain name=PP2C; Domain location=35-317; Score =104.5; E_value=3.2e-28; Accession=PF00481.12; Description=Protein phosphatase 2C
MVRFCWRPAAVGDDGDVNGRVEGLLWYKDLGNHLYGDFSMAVIQANSSLEDRSQLESGPLTSDYLGPQGTFIGVYDGHGGTAASQFVSDNLFCNFKNFAGEHQGISENVIQRAFSATEEGFLSVVRKQWLSKPQIASAGTCCLAGIICNGMLYVANAGDSRAVLGRVERATRETTTIQLSAEHNVNIQTERDEVRTKHPYDPQIVVMKHNVWRVKGIIQVSRSIGDAYLKKDEFNREPLPNKFRLSEPFSKPILSYEPAISVHKLRPEDQFIIFASDGLWEQLSNQEVVNIVSNSPRNGIARRLVKAALRVAARKREMRVSDLQKIEQGVRRHFHDDITVIVVFLNHKLIDNSSLLASPLSIKGGGSASF

SEQ ID NO: 187136 - protein, 230 aa, Glycine max
  Coding DNA Sequence Number=SeqID_70358
  Homolog annotation: Hit_ID=Q66G04; Match level="QueryCoverage=29%, HitCoverage=14%, E-value=2e-25, Identity=77%"; Hit description =Putative APC family amino acid permease
VYVALANIRGGMSIYAEIIAQSVPEWHESRERLRCRENATDRFEAVSAERQAVQGKGLEPSRSGVANGTRTHDNWNHNPGLYQLSYSHHYYFLLTRAALYPAELRARSAVAGGDTTDLRQSCLVLFRRNVAFDYALLTPAHKSALRSPFSPFIGAFLPDFQPDDGNARIRVDSHADQHANQKSDGQIVHIREHDRLKAVVFDRFLMGAAEIELAYQHHEPRHHARQHARA

SEQ ID NO: 187137 - protein, 36 aa, Glycine max
  Coding DNA Sequence Number=SeqID_70359
MTATVSSIMATYLSWPPLIFFTKAYQLEKSSQVDST

SEQ ID NO: 187138 - protein, 108 aa, Glycine max
  Coding DNA Sequence Number=SeqID_70360
METSTYNVDKDTYELKVDLWNRGVVLQGDDYKCPFFSQNRESMRFYSTKNSSIPCQPQAPAGPSCVTKQYSYALVASWQDDYVLRVGKEQTVGRGMGSSHVELVEVQE

SEQ ID NO: 187139 - protein, 95 aa, Glycine max
  Coding DNA Sequence Number=SeqID_70361
MPQKIEVALISKSMGIKSPAIDLLCIQENRTTIIQFKRTMNGNPIFRKAHQIVKYLKLKWMNSSIELRELVLDRVKFRNKALLKETLIIDDLEQN

SEQ ID NO: 187140 - protein, 179 aa, Glycine max
  Coding DNA Sequence Number=SeqID_70362
MVVGDKTYQTQHFRGNITRERIETDLGRVRVGRVILFSDQEKNPRGTTVTSMVFLVAVGAGKSGVGEGGRRGEPKVVTVDTGHETSPPGVAPSPRLEPGSKVAAPAPLNGWHPWGRRIMTVQTGLIGVAVGEGGGGRQSRIELFGRPRAMAGFEDQNLQSDKRKKKNKDLLIDMKEEDE

SEQ ID NO: 187141 - protein, 90 aa, Glycine max
  Coding DNA Sequence Number=SeqID_70363
  Gene Ontology: Mol. function=RNA-directed DNA polymerase activity; Biological process=RNA-dependent DNA replication
  Subcellular localization annotation: CTP_CleavageSite=55; ConfidenceScore=5.16e-01
MEMGYVFTSRCFRLRLTQGKLLKSLPQFKFSWFGLRLCSNLLTRCCRPGTRTIISISSLPQHQSMCVYTDIRTFKSMKSSFKSISCFRKA

SEQ ID NO: 187142 - protein, 108 aa, Glycine max
  Coding DNA Sequence Number=SeqID_70364
MASFEGQNLQSDKRKKKNKNLLCLSGEMRQAETKQDSLMLHCPNCPLLQTLLLLSYHSPALAESPCPQGDNPCITGSSLPRRFHLGQPLPLDQHLPRSIRCVRVPAII

SEQ ID NO: 187143 - protein, 134 aa, Glycine max
  Coding DNA Sequence Number=SeqID_70365
ERSYSESWQEYRGGVGERNGDVRSGGFNPKLMRSNSSVSWRNGQGMIGGGGGFGNVSMRKSDVQGNGLGLELGGRKGRDEFVGLERNRRARYSSPNSIDNNGLLRLYLGSRRNGSGKGRSNQAHSIARSVLRLY

SEQ ID NO: 187144 - protein, 324 aa, Glycine max
  Coding DNA Sequence Number=SeqID_70366
  Gene Ontology: Mol. function=RNA-directed DNA polymerase activity; Cellular component=chromatin; Biological process=chromatin assembly or disassembly
MAFRTHHGHYEFKVMPFGLCNASLYFQATMNMIFQPYLRQFVLKLSKCFFAQSQVEYLGHLVSSKGVEPVASKVETIRQWPVPHSTKALRSFLGLARFYRRFIRGYPTIATLLVKATTMEPFQWIAQAQAGFDYLKEALSTAPVLTLPDFTKSFMVETDASGVDMGTVLSQQGHPIAFFSKPFPPKLLRASTYVCELCVITTAVKKWRQYLLGHRFMIITDHHNLKELLSQVIETLEQHMYLAHLMGYDYLIQYCFGTNNQVVDALSRLPEQTPVMAMILLVPSLTFLEELRCQLDNHSGYQHQRRTILDSLTTHPEFSGNTCV

SEQ ID NO: 187145 - protein, 57 aa, Glycine max
  Coding DNA Sequence Number=SeqID_70367
MAEINQGKTMTGHDWPRIVCLLLAGFRPMVYSEAMGHATLPPFSCNLCLNMRPPSAR

SEQ ID NO: 187146 - protein, 86 aa, Glycine max
  Coding DNA Sequence Number=SeqID_70368
MEKTTTRSHWEGWRCENNITWPKSSLKLLCHHGPHVSKANTNGNDADVAPEFSPLKTVQFGNPSQDTVEPRDEGFGGRLWRWKWEK

SEQ ID NO: 187147 - protein, 183 aa, Glycine max
  Coding DNA Sequence Number=SeqID_70369
PKKCVFVQVSSPFEFGAMRSDCLVQFSILNLFRSPKNCVFIHVSYTFEFGAMRSDCLVQFSILNLFRSPMNCVFVHVSSTFEFGAMRSDCLVQFSILNLFRSPMNCVFVHVSSTPKNCVFVHVSSTFEFGAMRSDCLVQFSILNLFRSPKNCVFIHVSYSFEFGAMRSDCLVQFSILNIFGAP

SEQ ID NO: 187148 - protein, 151 aa, Glycine max
  Coding DNA Sequence Number=SeqID_70370
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=99%, HitCoverage=29%, E-value=2e-32, Identity=90%"; Hit description =Digalactosyldiacylglycerol synthase 1, chloroplast precursor
MVWAKGYEELIDLSAKHKADLDGFKLDVFQNGEDANEIQSAARRLDLNLNFQKIRDHADDSLHGNGTELSFNPPYLYKLNKENNGEKTSVDKGKLIAKSASMPNLTELVDGGLAFPHYCLIGNQFQRLCIGAIPGTRDYDNQHCKDLHLLP

SEQ ID NO: 187149 - protein, 41 aa, Glycine max
  Coding DNA Sequence Number=SeqID_70371
MAKHFLLLLFAVYVAAIDEVLMFKDQSNYEWHVMDGVDRVE

SEQ ID NO: 187150 - protein, 91 aa, Glycine max
  Coding DNA Sequence Number=SeqID_70372
  Gene Ontology: Mol. function=protein-tyrosine kinase activity; Biological process=protein amino acid phosphorylation
  Homolog annotation: Hit_ID=Q8LEG7; Match level="QueryCoverage=94%, HitCoverage=17%, E-value=7e-31, Identity=73%"; Hit description =Protein kinase-like protein
MGLQQETASSTKQLSLTPFGEACLRLDLTAIHEILEKTGYKDDEGIANELSFQLWTSQMQETLNLKKHGDTAFRAKDFVTAIDCYTQSCND

SEQ ID NO: 187151 - protein, 43 aa, Glycine max
  Coding DNA Sequence Number=SeqID_70373
MKGRAGSYKEHRLHGVFTDDHSKKLDKDIAGIFPFPIEHCYCS

SEQ ID NO: 187152 - protein, 369 aa, Glycine max
  Coding DNA Sequence Number=SeqID_70374
  Gene Ontology: Mol. function=DNA binding
  Homolog annotation: Hit_ID=Q1SU80; Match level="QueryCoverage=81%, HitCoverage=59%, E-value=2e-80, Identity=46%"; Hit description=Bromo adjacent region
MSHSRPPPSEANVGKMIDFKWGDKRGVGGKNKDIQYYESFVYEGVQYFLYDCVYLYTAGHVETSIGKLVKIFETRNRQKMIKLVWFFRPFDIRNWLGQYKPCWNELFLASGEGKGVSNFNYLVENGSEAIFLSMAKMVILHHDLESIIRKCSVICTSKDKRNPKPSEIELKKADYFFNCTFDVVRGVIIDQFTNEIDGIRVERFFNRNGDEKTSNHLHVGTDIRPKIVIKTRTNPCTISHCQVNDKAKVRTYENVLPKQSSDSYTYKKRKIVEEKPTIGQISKTPKEQEIDEKKAELRQDERVKTNKKVIDVIERPDAFFHAEHSHWAGFCIHYGNWPNMNAQLTGGCLEKRRWFKKMMIHLRQRNLKI

SEQ ID NO: 187153 - protein, 168 aa, Glycine max
  Coding DNA Sequence Number=SeqID_70375
  Gene Ontology: Mol. function=DNA binding
  Homolog annotation: Hit_ID=Q1SU80; Match level="QueryCoverage=99%, HitCoverage=33%, E-value=3e-44, Identity=56%"; Hit description=Bromo adjacent region
MGTLVLLNNLDPSYTSFEVEDLVWCALKARVEARMIEWSPGRALVIFKTKDAAESAIYQLNKRCLVLGEGRIVSAIKGTLREPGKKKRFTGHLVLDRAAHQRQHQEMRNAVSTSHCSQPNTIEYGMATEWILHYEKSNACWNALYEVEHEFVCHAETNEGDTRCEEQA

SEQ ID NO: 187154 - protein, 151 aa, Glycine max
  Coding DNA Sequence Number=SeqID_70376
  Gene Ontology: Mol. function=nucleic acid binding; Biological process= RNA-dependent DNA replication
  Homolog annotation: Hit_ID=Q1T254; Match level="QueryCoverage=62%, HitCoverage=23%, E-value=6e-26, Identity=60%"; Hit description =Peptidase aspartic, catalytic
MLFGEALQQMPLYSKFLKDMLTRKHRYIHQENIIVEGNCSAIIQKILPPKHKDPRSVTIPFSIGEVNVGKALIDLGARINLMPLSMCRRLGELEIMPQRDDSSALMHEVFSGLRGLRTYVGERFDSLDGRIDAIDAHFEGMDTRITQLEED

SEQ ID NO: 187155 - protein, 184 aa, Glycine max
  Coding DNA Sequence Number=SeqID_70377
  Homolog annotation: Hit_ID=Q8TGM5; Match level="QueryCoverage=22%, HitCoverage=61%, E-value=8e-08, Identity=70%"; Hit description =Uncharacterized protein ART3
PRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 187156 - protein, 139 aa, Glycine max
  Coding DNA Sequence Number=SeqID_70378
MKEGIGHILDLTTIGEKMKESLKRLTLTSYTSMGRTIKSTLKPYGSHSYPKKDQGLGILGAAPSKPKDDKGKTIEKQPPKAKDTYYFSMPHQKNHDYEEPKTFIVAKMRLLLHLPLVKVKKQKGKNLVKKFTPKKKDNL

SEQ ID NO: 187157 - protein, 99 aa, Glycine max
  Coding DNA Sequence Number=SeqID_70379
MAKIQGPKEGKTYSNIYKEEWIQPWPMGSKIYPEYHENPRAFFSSSSPILLDPSIQYPWGVFNYLQGPPSCPFNKGYSQFDVRDLRAYLGHVHPDKGQL

SEQ ID NO: 187158 - protein, 89 aa, Glycine max
  Coding DNA Sequence Number=SeqID_70380
MPKSSPNMHVKQEVSTRVKPRLLCKQSMGQNTLNKIDDDDSNSHQGEKTRISIHKMPRNSYFKNNYPLPVHNPKFKEEHARLYTNIKPK

SEQ ID NO: 187159 - protein, 199 aa, Glycine max
  Coding DNA Sequence Number=SeqID_70381
MDIIEVPSFYHRQWAPEYPKFVNYRYDGTIYQIRLRQHRTKVYFAEGMKEFRKDLSIFESVMIKFLACNKKSMFDLYFFPSLECQTCRRPKVMSRQHIWTVEITQSILSAPGPLRLPNCAMTHVNACGQHMTILRRFGPPLQWNVVVVDGGVGRKYVVQPWYQFLADNDFSHGDEVSFYYRTIDKIWEIVICRRKNWDY

SEQ ID NO: 187160 - protein, 302 aa, Glycine max
  Coding DNA Sequence Number=SeqID_70382
  Gene Ontology: Mol. function=binding; Cellular component=ubiquitin ligase complex; Biological process=protein ubiquitination
  Homolog annotation: Hit_ID=Q9ASI0; Match level="QueryCoverage=88%, HitCoverage=74%, E-value=2e-75, Identity=58%"; Hit description =Putative arm repeat-containing protein
  Pfam annotation: Domain name=Arm; Domain location=142-182; Score=5.4; E_value=2.6; Accession=PF00514.13; Description=Armadillobeta-catenin -like repeat
  Pfam annotation: Domain name=Arm; Domain location=15-55; Score=29.2; E_value=1.4e-05; Accession=PF00514.13; Description=Armadillobeta -catenin-like repeat
  Pfam annotation: Domain name=Arm; Domain location=56-96; Score=31.3; E_value=3.4e-06; Accession=PF00514.13; Description=Armadillobeta -catenin-like repeat
  Pfam annotation: Domain name=Arm; Domain location=98-140; Score=8.2; E_value=1.2; Accession=PF00514.13; Description=Armadillobeta-catenin- like repeat
  Pfam module annotation: Pfam domain module=Arm::Arm::Arm::Arm; Domain location=142-182::15-55::56-96::98-140
MTYSKPSSYVCKSGDLMNKISIVEAGALEPIISFLKSPNPNLQEYATASLLTLSASPTNKPIISACGTIPLLVNILRDGSPQAKVDAVMALSNLSTTQPENLSIILETNAMPFIVSLLKTCRKSSKIAEKCSALIESLVGYEKGRISLTSEEGGVLAVVEVLENGTPQSREHAVGALLTMCQSDRCKYREPILREGVIPGLLELTVQGTPKSQPKARTLLQLLRESPYSRPKAEPDILENIVCDIISQIDGDDQSGRAKKMLAEMVQVSMEQSLRHLQQRALVCTPSEMPIASCASEVSSKY

SEQ ID NO: 187161 - protein, 261 aa, Glycine max
  Coding DNA Sequence Number=SeqID_70383
  Gene Ontology: Mol. function=transporter activity; Cellular component= integral to membrane; Biological process=transport
  Homolog annotation: Hit_ID=P49173; Match level="QueryCoverage=85%, HitCoverage=82%, E-value=2e-97, Identity=76%"; Hit description =Probable aquaporin NIP-type
  Pfam annotation: Domain name=MIP; Domain location=36-249; Score =225.5; E_value=1.1e-64; Accession=PF00230.10; Description=Major intrinsic protein
MAAKSEGIQEEEMSSMEEGVSSPSSSRTCSMSHNCCSNVVTLAQKVMAEVIGTYFVVFAGCGSVAVNKIYGSVTFPGVCVTWGLIVMVMIYSLRRISGAHFNPAVTITLAIFRRFSYKEVPLYIFAQLLGSILASGTLALMLDVTPKAYFGTVPVGSNGQSLVAEIIITFLLMFVISAVSTDDRAVGDFAGVAVGMTIMLNVFIAGPVSGASMNPARSIGPALIKHVYKGLWVYVVGPVVGSIAGALAYYFLRSIDKSSSE

SEQ ID NO: 187162 - protein, 113 aa, Glycine max
  Coding DNA Sequence Number=SeqID_70384
  Subcellular localization annotation: CTP_CleavageSite=50; ConfidenceScore=5.33e-01
MAVFTDPALITASLFSLSLSLFSLSLSRSLSLSGGGWHRLHFRIWGNGKRCESVNDDVVEAKNPGGTAYEGRKSRQRHIWRLTECANVARVILSSDREGWSMKAVSEIDKFQI

SEQ ID NO: 187163 - protein, 153 aa, Glycine max
  Coding DNA Sequence Number=SeqID_70385
MDNEEGVQEQMKADLSALKDQMASISEVMLKLQKTIEDKATATASNTAREAEPVLQPALNLGRDRNTAVFGRRYSPQAYPYGLPSDFTPRAALEDLSQAPTFEGQLPPYADYPVQDDEEGDTHLGPLLHLKDPSPHELPQPNKSATSHLHPHP

SEQ ID NO: 187164 - protein, 119 aa, Glycine max
  Coding DNA Sequence Number=SeqID_70386
MLWTTPCKPLYRSQALDRTLTYPKGIVENLLVKVRNFIFPGDYVILGMEEDKEVPITRPHPIVRKKHPLKDSVTPKDLRRGIRDKKKKDGTTIQTPSYRVDYLVEGLLLEKDIILFKGG

SEQ ID NO: 187165 - protein, 83 aa, Glycine max
  Coding DNA Sequence Number=SeqID_70387
MSFDRDYFSLPFTIQRRQVRWHVETNTCPSIETIEVSPINQRQANPLTRKDKYGHLHPSSKTPCLSTETITVSILSTRGKQPR

SEQ ID NO: 187166 - protein, 286 aa, Glycine max
  Coding DNA Sequence Number=SeqID_70388
  Gene Ontology: Mol. function=structural molecule activity; Cellular component=intermediate filament; Biological process=nucleosome assembly
  Homolog annotation: Hit_ID=UPI0000DBF0F4; Match level="QueryCoverage =79%, HitCoverage=92%, E-value=8e-30, Identity=43%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Subcellular localization annotation: CTP_CleavageSite=21; ConfidenceScore=5.07e-01
GLKVLAFRGLKFLVFRGLKVLAFRGLKVLAFRGLKVLAFRGLKVLAFRGLKVLAFRGLKVLAYKGLKVLAFKGLKILAFRGLKVLAFKRLKVLTFRGLKVLAFRGLKVLACRGLKVLSLIGLKILTCRGLKVLTFKRLEVLVFIGLKVLAFIGLKVLDFRGLKVLAFRGLEVFALRGLKVLAFRGFKVLAFKGLKVLAFRGLKVLAFGGLEVLTFIGLKVLAFRGLKVLTIIKSKTIKVFFAIQRQASLIACRDKVWSSATLVIQRQSSSMTRRDQCGHLHPLSKT

SEQ ID NO: 187167 - protein, 179 aa, Glycine max
  Coding DNA Sequence Number=SeqID_70389
MRYLLFPLTKIQRTNRLRILCLNTLEGTSFVVQVEGTSTWIVVTENKRGYISCGSVQVEGTSTWFFKENKGGLKEISRTAGCLRTGCRHGLLPNQYKFFMRKNTCTWGHVTRFGTPLRLRLIHGGRGGVACARQGDLDTYCLVFLSESGVCTRLDYFLGDGTTLHLRVEVSCMHHTEHD

SEQ ID NO: 187168 - protein, 116 aa, Glycine max
  Coding DNA Sequence Number=SeqID_70390
  Homolog annotation: Hit_ID=Q1SWX1; Match level="QueryCoverage=88%, HitCoverage=19%, E-value=1e-09, Identity=34%"; Hit description=IMP dehydrogenase/GMP reductase
MGLIQAPSLKKRFYQVKVKSLGVTSLKELRQLMGKLRRQAFRKAYGKIWDLAMAEVSIEAIASLAQYYDQPLRCFTFGDFQLSPTVEEFEEILGCPLGGRKPYLFSRFYPSLARNF

SEQ ID NO: 187169 - protein, 128 aa, Glycine max
  Coding DNA Sequence Number=SeqID_70391
  Gene Ontology: Mol. function=ATP binding; Cellular component =mitochondrion
  Homolog annotation: Hit_ID=Q2PMM5; Match level="QueryCoverage=98%, HitCoverage=6%, E-value=1e-57, Identity=87%"; Hit description =Protein ycf2
  Subcellular localization annotation: CTP_CleavageSite=17; ConfidenceScore=5.01e-01
MLPPKAKLRISSRESPNCSRATRKRFFNQKEFSSDVGYLSRSFRNSIILEKQREDVYERDIQQQGEGKGLNRRTPEHLAISDVSILIKKISNNYPESHLSDSISHLSDSIVEDTMESDEFAIIYLTHA

SEQ ID NO: 187170 - protein, 105 aa, Glycine max
  Coding DNA Sequence Number=SeqID_70392
  Subcellular localization annotation: CTP_CleavageSite=55; ConfidenceScore=5.30e-01
MGKGWGPGAAGAGYTSRSFRSTTPDPYGWQPTGQPNAACRAPSFACEPRWTLEIVAVVKVAVVSLRPPAAAGPTPAVVPTLAYELCGRNRHPKELAETCDQSWES

SEQ ID NO: 187171 - protein, 84 aa, Glycine max
  Coding DNA Sequence Number=SeqID_70393
MTMLSQTWSVPSFSNIIPTFHTSDVTLDRAKLIYGIIMKMDMNLVMQSYPARALDRKLQVDWARDAREGPRVLMSLRVDFGPMG

SEQ ID NO: 187172 - protein, 136 aa, Glycine max
  Coding DNA Sequence Number=SeqID_70394
FSAFALLLLGCDSLCCLNVVLLGCCGSLGGLMGTRGWWVYARIVDVENLLCTIARPPPSTTCDGVVPGDMSRGSGDLGDVRRAPGSQQIKGTKTTKQGGLWLKNEDRRLRWSLEAKGASGNRLPACVIDYTEGWVT

SEQ ID NO: 187173 - protein, 90 aa, Glycine max
  Coding DNA Sequence Number=SeqID_70395
MEEKVKLKISGGLRSTYLKLLCSDTTCWKLAYEASMEAGSLSFNKVLQWRSFTTKRVAWIRSLKRKLQWRKRIPEREGEEGGRGVGIEGD

SEQ ID NO: 187174 - protein, 76 aa, Glycine max
  Coding DNA Sequence Number=SeqID_70396
MIQCKGLFSKLRYDFEIPNGENVRNWVANMILKFHDDPTVNEFEIVVLLKQVWWAAGRRKGFERRGKTKMRPKGGS

SEQ ID NO: 187175 - protein, 82 aa, Glycine max
  Coding DNA Sequence Number=SeqID_70397
MIIEESIHVVFDGTNPIRPRNEKGNKGKGNGNEEDFQIDENKTNIDLPREWRTSRYHPPDNIIGDISKGNSLKICKMNLKCP

SEQ ID NO: 187176 - protein, 466 aa, Glycine max
  Coding DNA Sequence Number=SeqID_70398
  Gene Ontology: Mol. function=transporter activity; Cellular component= integral to membrane; Biological process=transport
  Homolog annotation: Hit_ID=P30130; Match level="QueryCoverage=91%, HitCoverage=49%, E-value=1e-147, Identity=60%"; Hit description =Outer membrane usher protein fimD precursor
  Pfam annotation: Domain name=Usher; Domain location=44-466; Score =146.3; E_value=8.1e-41; Accession=PF00577.10; Description=Fimbrial Usher protein
MSTCMQTHFYFVNRRGLLKASLRPVAAAVVLGLGAIPAAASPAVWFNPRFLSDDPASVADLSRFSLGEEVPPGTYRVDIFLNGSLMSTRDVTFVAGDGKQTLSPCLTTGMLRGMGVREASTPDRFSLRNGCRPLAALIPGATTHYDVSRQRLDLTVPQAAMQSTARGYIPPGEWDEGIPAGLLNYTFTGNRMSGRYAGENYFLNLQSGLNAGPWRLRDNSSWMQSSQGIYTASRWQHINTWVERDIIPWRSRLIMGDASTPADVFDSVSLRGIQLLSDEAMLPDSQRGFAPVIHGIAQATSTVTVKQNGYQIYQTTVPPGPFNITDLYPAGNSGDLQVTLSGPAGSRSWTVPWSTVPGLQREGFTKYALSAGEYRSGLAQQDNPSFVQGTVLRGLPYGWTAYGGTQLSANYHAYNLGLGKNMGRAGALSVDITHATAVLPDGSQHQGQSLHLLYNKSLTDWGTSIS

SEQ ID NO: 187177 - protein, 312 aa, Glycine max
  Coding DNA Sequence Number=SeqID_70399
  Gene Ontology: Mol. function=nucleoside-triphosphatase activity; Cellular component=membrane; Biological process=cobalt ion transport
  Homolog annotation: Hit_ID=Q56968; Match level="QueryCoverage=66%, HitCoverage=95%, E-value=1e-106, Identity=94%"; Hit description =(EV76) genomic DNA IS100 element transposed into Lcr plasmid
  Pfam annotation: Domain name=AAA; Domain location=104-290; Score= -34.3; E_value=0.083; Accession=PF00004.19; Description=ATPase family associated with various cellular activities (AAA)
  Pfam annotation: Domain name=IstB; Domain location=56-235; Score =351.3; E_value=1.5e-102; Accession=PF01695.8; Description=IstB-like ATP binding protein
  Pfam annotation: Domain name=rve; Domain location=160-296; Score =27.3; E_value=3.1e-05; Accession=PF00665.16; Description=Integrase core domain
  Pfam module annotation: Pfam domain module=AAA::IstB::rve; Domain location=104-290::56-235::160-296
MVELQHQRLMVLAEQLQLDSLIGAAPALSQQAVDQEWSYMDFLEHLLHEEKLARHQRKQAMYTRMAAFPAVKTFEEYDFTFATGAPQKQIQSLRSLSFIERNENIVLLGPSGVGKTHLAIAMGYEAVRAGIKVRFTTAADLLLQLSTSQRQGRYKTTLNRGVMAPKLLIIDEIGYLPFSQEEAKLFFQVIAKRYEKSAMILTSNLPFGQWDQTFAGDAALTSAMLDRILHHSHPGKPTQNGFIESFNGRFRDECLNEHWFSDVSHARKTISEWRQDYNECRPHSTLNYQTPSEFAASWRKGNSESEGSDITN

SEQ ID NO: 187178 - protein, 79 aa, Glycine max
  Coding DNA Sequence Number=SeqID_70400
TLASIATPLGLKFIPQVKELLDEGLVRKSLNPCALLVPKIGVPMDPKRIKVIPDWPTPSTPLIELVRNHVPSWEDVHER

SEQ ID NO: 187179 - protein, 64 aa, Glycine max
  Coding DNA Sequence Number=SeqID_70401
MTTLVSACQWARLPLVDKRCGTIRYPRMSSDSSSLDDNGADDDGQYDNYYGAADKSEALAPTYP

SEQ ID NO: 187180 - protein, 597 aa, Glycine max
  Coding DNA Sequence Number=SeqID_70402
  Homolog annotation: Hit_ID=Q5PD50; Match level="QueryCoverage=37%, HitCoverage=52%, E-value=1e-82, Identity=68%"; Hit description =H(+)/Cl(-) exchange transporter clcA
  Pfam annotation: Domain name=Fe-S_biosyn; Domain location=249-340; Score=105.3; E_value=1.8e-28; Accession=PF01521.11; Description=Iron- sulphur cluster biosynthesis
  Pfam annotation: Domain name=Voltage_CLC; Domain location=2-208; Score=-42.2; E_value=4.1e-09; Accession=PF00654.10; Description =Voltage gated chloride channel
  Pfam module annotation: Pfam domain module=Fe-S_biosyn::Voltage_CLC; Domain location=249-340::2-208
MRPQFRYNLISIKAVFTGVIMSSIVFRILNGEGAIIEVGKLSNAPDMFQRLHGGNIKKWVLIGGLIGGLCGLLGLMQPTAVGGGFSLIPIAAAGNFSVGLLLFIFIARVITTLLCFSSGAPGGIFAPMLALGTLLGTAFGMAAIPLFPSYHLDAGTFAIAGMGALLAASVRAPLTGIVLVLEMTDNYQLILPMIITCLGATLLAQFLGGKPLYSTILQRTLAKQKAEEAAKAQQYQWEQKMSDDVALPLEFTEAAANKVKHLIADEDNPNLKLRVYITGGGCSGFQYGFTFDDQMNDGDMTIEKQGVALVVDPMSLQYLVGGSVDYTEASDAGLAAVLAAMIYHSMVTRRAVSRRIASRFNTLCVTRGCALKCRPQSTDGSVCSLGREISQREKIVSETAIEPVVVAAPIGAATISPMASSSALVMVKSCFAQLLCRQQQARTRPAQPVIVKRNHRHVKLRLPEARDAGGAAGITASDNRLRVPRQHLLPAHLRPAYAAVSKDIATAAQAAAGQTAETAAPAFAADSADAASAAAGVTPVRPLWHAGAVGSSAAAPPARQSSDRVIADRSIPHGCPDAVAAPPGAADCRRARPAPHP

SEQ ID NO: 187181 - protein, 34 aa, Glycine max
  Coding DNA Sequence Number=SeqID_70403
MASIIVAMASMSAFTFSCTSSALPITLALAQERM

SEQ ID NO: 187182 - protein, 231 aa, Glycine max
  Coding DNA Sequence Number=SeqID_70404
  Gene Ontology: Mol. function=peptidyl-prolyl cis-trans isomerase activity; Biological process=protein folding
  Homolog annotation: Hit_ID=Q7EYT3; Match level="QueryCoverage=48%, HitCoverage=51%, E-value=2e-33, Identity=63%"; Hit description =Peptidyl-prolyl cis-trans isomerase-related-like protein
  Pfam annotation: Domain name=Pro_isomerase; Domain location=95-230; Score=-16.8; E_value=1.1e-05; Accession=PF00160.11; Description =Cyclophilin type peptidyl-prolyl cis-
  Subcellular localization annotation: CTP_CleavageSite=73; ConfidenceScore=5.02e-01
MEQWKGLCFMTQLQLHKGRKSSDKLPGVDKEKAPGSNGFSIAFSRAVGKNMNSSFITRVPNKDRSFKVISKFLSMRLSDVSLNICPLTVYASSQAGFLITEYVRREVLQSHVTVNIQKGHFKGMLFHQVIKHYVIQGPGATEDWNLLGKKYASMRHEAFMLGTSKGKYFNKVFDLFITTAPIPDLNEKLIVFGRVIKGQDIVQEIEEVDTDEHYQPKVSIGILDVALKQLE

SEQ ID NO: 187183 - protein, 107 aa, Glycine max
  Coding DNA Sequence Number=SeqID_70405
  Homolog annotation: Hit_ID=Q1SKW6; Match level="QueryCoverage=54%, HitCoverage=12%, E-value=6e-08, Identity=50%"; Hit description =Integrase, catalytic region
MTVIVNLSCPKASTSKVCDYGRGGVSHDHSAPQTNMVHLPLCEHYFYASTTIQKENKKKDDKALFMLHQCVDLANFNNIVGAITAKQTWEILEKSHSGGEKVKKVRL

SEQ ID NO: 187184 - protein, 90 aa, Glycine max
  Coding DNA Sequence Number=SeqID_70406
  Gene Ontology: Mol. function=DNA binding; Biological process=DNA integration
MRATKVLVMVHFDSEELKIFQRFKVMVEKQSEKSLKVLRTDRGGEYTLNEFEEFCVKMAFNMRLLPSILLNIMGWQRKGIKLCLIWQEAC

SEQ ID NO: 187185 - protein, 437 aa, Glycine max
  Coding DNA Sequence Number=SeqID_70407
  Gene Ontology: Mol. function=nucleic acid binding; Cellular component= cytosol; Biological process=positive regulation of transcription
  Homolog annotation: Hit_ID=Q9ZUL5; Match level="QueryCoverage=92%, HitCoverage=54%, E-value=0.0, Identity=79%"; Hit description =Putative helicase (SNF2/RAD54 family (ETL1 subfamily) protein)
  Pfam annotation: Domain name=SNF2_N; Domain location=1-272; Score =200.5; E_value=3.8e-57; Accession=PF00176.13; Description=SNF2 family N-terminal domain
ILADEMGLGKTVQAITYLTLLKHLHNDSGPHLIVCPASVLENWERELKRWCPSFSVLQYHGAGRAAYCKELNSLSKAGLPPPFNVLLKDDRKILKRWRWSCVLMDEAHALKDKNSFRWKNLMSVARNANQRLMLTGTPLQNDLHELWSLLEFMLPDIFATEDVDLKKLLNAEDGDLIGRMKSILGPFILRRLKSDVMQQLVPKIQQVEYVIMEKQQETAYKEAIEEYRAVSQARMEKCSNLNSKSVLEVLPRRQINNYFVQFRKIANHPLLIRRIYNDEDVIRFARKLHPIGAFGFECTLDRVIEELKNYNDFCIHRLLLHYGVNDRKGILPDKHVMLSAKCRALAELLPSLKEGGHRALIFSQWTSMLDILEWTLDVIGLTYKRLDGSTLTNKEKVKSSENDMTKTVSVANVVKIEILLRIEIGGKKHKSCDITGN

SEQ ID NO: 187186 - protein, 145 aa, Glycine max
  Coding DNA Sequence Number=SeqID_70408
  Gene Ontology: Mol. function=nucleic acid binding; Cellular component= nuclear matrix; Biological process=positive regulation of transcription
  Homolog annotation: Hit_ID=Q9ZUL5; Match level="QueryCoverage=83%, HitCoverage=16%, E-value=9e-54, Identity=84%"; Hit description =Putative helicase (SNF2/RAD54 family (ETL1 subfamily) protein)
  Pfam annotation: Domain name=Helicase_C; Domain location=10-84; Score= 61.7; E_value=2.4e-15; Accession=PF00271.21; Description=Helicase conserved C-terminal domain
MEIVLFMNDFKKGMRLIVLFLYVAERQTIVDTFNNDTSIFACLLSTRAGGQGLNLTGADTVVIHDMDFNPQIDRQAEDRCHRIGQTKPVTIYRLVTKGTVDENVYEIAKRKLVLDAAVLESMEEINEGDMPEKTMGEILSAILLS

SEQ ID NO: 187187 - protein, 92 aa, Glycine max
  Coding DNA Sequence Number=SeqID_70409
MKQLVAQQEALAEEEEAAHGTAGRLTGRRRSTSREKEKSVCLSIFSLSIYCNIRKVHIIYFVPGRSLCNRMMVALVKLSLCGYWTWIARKKA

SEQ ID NO: 187188 - protein, 128 aa, Glycine max
  Coding DNA Sequence Number=SeqID_70410
  Gene Ontology: Mol. function=RNA-directed DNA polymerase activity
  Homolog annotation: Hit_ID=Q1SDN9; Match level="QueryCoverage=39%, HitCoverage=43%, E-value=1e-10, Identity=52%"; Hit description =Polynucleotidyl transferase, Ribonuclease H fold
MEACKEAIWLFYSFGGSSVIINNPQQNGKHQQKERSNATLFQEENCFGVRMIVGHHCGNFIKAQTLVHQGVPEPHKAESWGLLQAVIWINSLGMNNVTFELDCKSVVDSTSSSYHGTSEFSYINSINV

SEQ ID NO: 187189 - protein, 60 aa, Glycine max
  Coding DNA Sequence Number=SeqID_70411
MTLRSVNMHSSSFFQILPRAQPRSIVLSGWLAKPTGWLSETIEEISLWVEAISKEVVQEI

SEQ ID NO: 187190 - protein, 73 aa, Glycine max
  Coding DNA Sequence Number=SeqID_70412
MVSERPWVIFDHYLIVSMDFEVHTVRSNNEQNLGIGSFPRPWKECGCYGHVARNYTKAEMKTQRMAMGVMFCH

SEQ ID NO: 187191 - protein, 713 aa, Glycine max
  Coding DNA Sequence Number=SeqID_70413
  Gene Ontology: Mol. function=zinc ion binding
  Homolog annotation: Hit_ID=Q1S296; Match level="QueryCoverage=99%, HitCoverage=100%, E-value=0.0, Identity=66%"; Hit description=Zinc finger, C3HC4 type (RING finger), putative
  Pfam annotation: Domain name=zf-C3HC4; Domain location=666-706; Score= 43.0; E_value=1e-09; Accession=PF00097.15; Description=Zinc finger, C3HC4 type (RING finger)
MQGQRGTIGSLPETIEFDCGSTSSAATVEPHIFWNNMRNPAENQFVLSPSDINPSHMNSINNEWQNLSGWSIGEPSSSNTQNGVANNEQKRELGLLSSLSSGAIAGPRLEERRFESNNAFSLDNVNTSPMHIRSSSSHLVPQNLNLNASLADSGTDNSYHVERPPSLIKSSGPLNEHVAPTVGSGPFLLPSGTANGFLGEETDGRPGCSLDTRRVSCKRKAVERNVGQSSDGGSSSYSQHTDGSTWNTLPTQAYGGISFNRSAPTDQVNARLGLSTGDGSSESIPVSNVARSSGSFHRNFRPRTSPSSQQISVPPTAISSGNVIRSSGVSSPSPILQRFHPVDNSFDLRAVPPVDTMVPQSQPLVIHVPALPRNAQSFRWSGGSSSTNNHSSNSVMCADRNNLPNEEASSRSMPRNIIEYPMFVPATNLRNVVRNPARTSNNANLSIPGNVGSSSRTGSNPAVNPPPASAWVSRPNPQQYPRRLSEYVRRSLFSPGLEAAGSSSNSYTPFRGPPTSSESRGLSSGVNPFERQGDSEFGIPYSLQSLVVAGEGSSRLVSEMIRSYFKENSRLDELRNVLGLMRRGGNLRFEDVMILDPSVFSGIADIHDRHRDMRLDVDNMSYEELLALEERIGNVSTGLSEEIVSKLLKKKKYSAEPDSQHEAEPCCVCQEEYKDGDDLGSLDCGHDYHRDCIKQWLMHKNLCPICKTTGLAT

SEQ ID NO: 187192 - protein, 323 aa, Glycine max
  Coding DNA Sequence Number=SeqID_70414
  Gene Ontology: Mol. function=transcription regulator activity; Cellular component=nucleus; Biological process=regulation of transcription
  Homolog annotation: Hit_ID=Q1S2A1; Match level="QueryCoverage=52%, HitCoverage=65%, E-value=3e-52, Identity=66%"; Hit description=Helix- loop-helix DNA-binding domain, putative
  Pfam annotation: Domain name=HLH; Domain location=152-201; Score =60.6; E_value=5e-15; Accession=PF00010.16; Description=Helix-loop -helix DNA-binding domain
MAGDVGRALPPPDSEEFSTLFSQLLHNSPPLGMDPNHSPPDFTPHNNTIDININNNIINNNNNNNPVPSSPSNFNFSDPHHYIPASDATTFKQHTPDFTSFSVEINMADVNAIAVVETQKNLDVMEKIVVKSVEASKPVPPPRSSSSKRSRAAEFHNLSEKRRRSRINEKMKALQNLIPNSNKTDKASMLDEAIEYLKQLQLQVQMLMMRNGLSLHPMSLPGGLRPMIMSQTGLNLDGSNGFHNSTSAIASSSNDESLVRHAFSFPKQCSISNQSIGVPSVTNIATSDTSSTFHPSIKDALYGNMPQLFMDTTTMGKPSPDVS

SEQ ID NO: 187193 - protein, 109 aa, Glycine max
  Coding DNA Sequence Number=SeqID_70415
MSILTLGSKKEKKGGGKKEIPNQKWEKAKGKEGNSQSKVGESKKKRKEIPNQKWEKAKRKERKFPIKEWEKAERKGKKAPDQGSKENRRNMQKGLWTRQYLNVYRIVTK

SEQ ID NO: 187194 - protein, 306 aa, Glycine max
  Coding DNA Sequence Number=SeqID_70416
  Gene Ontology: Mol. function=zinc ion binding; Cellular component =intracellular; Biological process=regulation of apoptosis
  Homolog annotation: Hit_ID=Q9M5Q3; Match level="QueryCoverage=86%, HitCoverage=79%, E-value=1e-117, Identity=76%"; Hit description=S -ribonuclease binding protein SBP1
  Pfam annotation: Domain name=zf-C3HC4; Domain location=260-294; Score= 6.3; E_value=0.035; Accession=PF00097.15; Description=Zinc finger, C3HC4 type (RING finger)
MTLARFVGGYPFGHFESKLYLLCLHVVGFAPGPVPPADGSDGGVDLQLQWNYGLEPERKRLKEQDFLENNSQISSVDFLQPRSVSTGLGLSLDNTRLTSTGDSALLSLIGDDIERELQQQDAEIDRFLKVQGGRLRQAVLEKVQATQLQSVSLIEDKILQKLREKEAMVESINKRNIELEDQMEQLTVEAGSWQQRARYNENMIAALKFNLQQAYVQSRDSKEGCGDSEVDDTASCCNGRSLDFHLLSRENTDMKEMMTCKACRVNEVTMVLLPCKHLCLCKDCESKLSFCPLCQSSKFIGMEVYM

SEQ ID NO: 187195 - protein, 205 aa, Glycine max
  Coding DNA Sequence Number=SeqID_70417
  Homolog annotation: Hit_ID=O04892; Match level="QueryCoverage=41%, HitCoverage=21%, E-value=2e-14, Identity=43%"; Hit description =Cytochrome P450 like_TBP
PRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRAGHGGPSPEPVGCRWTARAASAARAGRRVPVGGRIGNGPFGASSPGVEQSTQNCALNVKVKKFNQARVNGGSNYDSLK

SEQ ID NO: 187196 - protein, 48 aa, Glycine max
  Coding DNA Sequence Number=SeqID_70418
MDAGYTNAWFDVVVYENQVSHSWMLGNLESLKKLGIDILSILANRHCY

SEQ ID NO: 187197 - protein, 91 aa, Glycine max
  Coding DNA Sequence Number=SeqID_70419
  Gene Ontology: Mol. function=actin binding; Biological process =cytoskeleton organization and biogenesis
  Pfam annotation: Domain name=Transposase_21; Domain location=16-91; Score=-113.4; E_value=6.3e-05; Accession=PF02992.5; Description =Transposase family tnp2
MTSVAAMKAQRKIPNKDGTNCNGMLHHSTDSSQWKKIKHLYPDFEKKTRNLRLGLATDRMNPFDRLSNHHNSCPRQSGNDIGVYLSPLIKD

SEQ ID NO: 187198 - protein, 52 aa, Glycine max
  Coding DNA Sequence Number=SeqID_70420
MERKRCESEEDEMERKRVEKFRFTKHPSREAPLALNNMDAKLQQVMIVQLTV

SEQ ID NO: 187199 - protein, 140 aa, Glycine max
  Coding DNA Sequence Number=SeqID_70421
  Gene Ontology: Mol. function=transporter activity; Cellular component= outer membrane-bounded periplasmic space; Biological process=transport
  Homolog annotation: Hit_ID=UPI0000526E39; Match level="QueryCoverage =96%, HitCoverage=47%, E-value=2e-48, Identity=65%"; Hit description =extracellular solute-binding protein, family 3
  Pfam annotation: Domain name=SBP_bac_3; Domain location=1-128; Score=- 47.7; E_value=6.5e-05; Accession=PF00497.10; Description=Bacterial extracellular solute-binding proteins, family 3
LTRSDSGVKNVETLAHKRLGVIQGTLQENYALQHFKQTDLVRFPDNNTSVSALNNGTLDAMFLDYEAAKDYATRFKLVTAANIPSFDAPAGVAIAKGKPEFKASLDKAIKAAMQDGTWKQLYQKWFPGSPMPQQYLPGGQ

SEQ ID NO: 187200 - protein, 69 aa, Glycine max
  Coding DNA Sequence Number=SeqID_70422
  Gene Ontology: Mol. function=DNA-directed RNA polymerase activity; Cellular component=nucleus; Biological process=transcription
  Homolog annotation: Hit_ID=Q6ATY6; Match level="QueryCoverage=77%, HitCoverage=30%, E-value=3e-15, Identity=75%"; Hit description =Putative RNA polymerase II subunit 5
MEFQSGDMPNYTTSDGSVKIQKDSEVRLKIIGTRVDATEILMITVLAVVFVNIMKIGLHFWNASLCSDC

SEQ ID NO: 187201 - protein, 53 aa, Glycine max
  Coding DNA Sequence Number=SeqID_70423
MVRTLKSVANQRLLDPVLPMSIEILEMPTTACKGKKIQTKVIMWKWELCMKNF

SEQ ID NO: 187202 - protein, 153 aa, Glycine max
  Coding DNA Sequence Number=SeqID_70424
  Homolog annotation: Hit_ID=Q2R9D1; Match level="QueryCoverage=85%, HitCoverage=19%, E-value=4e-12, Identity=41%"; Hit description =Expressed protein
  Pfam annotation: Domain name=DUF616; Domain location=1-141; Score= -99.7; E_value=7.5e-07; Accession=PF04765.4; Description=Protein of unknown function (DUF616)
MEKCESVVVVSAIFNDHDKIRQPRGLGSQTLQNVCFFMFIDDITLKGLEYLGLISTKSREYKIGVWRIVKVSKEDLYQNPAMNGVIPKYLFHRLFPYSPIQYLDRCKVATNECRHGYIKAPIFCSYHGRSHRNSTVEEMVGCECLEDANGDLL

SEQ ID NO: 187203 - protein, 233 aa, Glycine max
  Coding DNA Sequence Number=SeqID_70425
  Subcellular localization annotation: CTP_CleavageSite=67; ConfidenceScore=5.12e-01
MESAICLRYCPIPYGPKGFHGANPSRFHLKINHATPLSLPQISTTRSPVTRSFGHANCMLERFSSVPSENEGSGNKILRGVTLSSLVLTCVLGLFSFGGKNMNPKLTTAYASPYDKIASLFVRETEAQGSVALKPRLDGAQGSVALKSLLEIPSDAELADTQKKRSSNFGERGPSQLEVNNLKWLAIGLSKSPDRSKALKTLTDQYKYCKAHKITGESEQYLELAMVELSMFK

SEQ ID NO: 187204 - protein, 78 aa, Glycine max
  Coding DNA Sequence Number=SeqID_70426
MSSIVCRDHARKTPSAPGEVQQGPGVSSSDYELLSVFTECLSPPNKVIRPRINWAFIKKYCAPRQAQGETPQQHWDGR

SEQ ID NO: 187205 - protein, 92 aa, Glycine max
  Coding DNA Sequence Number=SeqID_70427
MATSTYLDLEEKEAEYIAVGSCCAQSLYMKEQLEDFGVNLDHVSLKYDNTSAIDAILPPRALDRRLQEDWAKEAREGPRILMSLRVDFGPMG

SEQ ID NO: 187206 - protein, 345 aa, Glycine max
  Coding DNA Sequence Number=SeqID_70428
  Gene Ontology: Mol. function=oxidoreductase activity; Cellular component=cytoplasm; Biological process=response to red or far red light
  Homolog annotation: Hit_ID=Q1ET28; Match level="QueryCoverage=97%, HitCoverage=99%, E-value=1e-145, Identity=75%"; Hit description =Putative gibberellin 2-oxidase
  Pfam annotation: Domain name=2OG-FeII_Oxy; Domain location=175-287; Score=119.3; E_value=1.1e-32; Accession=PF03171.10; Description=2OG -Fe(II) oxygenase superfamily
MVVLSHQSALNELFLVKTCKSTFIGVPEVDLTHPEAKTTIVKACQEFGLFKVVNHGVPLELMTHLENEALKFFMQPQSLKDKAGPPDPYGYGSKRIGTNGDLGWVEYLLLNTNPDVISPKTLQLFEQNPEMFRCGVEEYIGAVKKICCEALELMADGLEIVPRNVFSRMIRDERSDSCFRMNRYPECPELKVEALSGRNLTGFGEHTDPQIISVLRSNNTSGLQICLPDGDGDGTTWASIQPDHTSFFINVGDLLQVMTNGSFKSVKHRVLVDSSMSRLSMIYFGGPPLNEKIAPLPSLVSREEESLYRELTWLEYKNAAYKSKLSDNRLSLFDKSADHSDKSPL

SEQ ID NO: 187207 - protein, 173 aa, Glycine max
  Coding DNA Sequence Number=SeqID_70429
  Gene Ontology: Mol. function=nucleoside-triphosphatase activity; Cellular component=membrane; Biological process=interphase of mitotic cell cycle
  Homolog annotation: Hit_ID=Q1SA92; Match level="QueryCoverage=97%, HitCoverage=41%, E-value=8e-60, Identity=69%"; Hit description=AAA ATPase
DFKLCYDAKFGRKKVAENGDDAAGKAVSNGNGNSVTVAIVSNGNKRASEMAVYEQFRSEGQNQIHTNGFVPTLTDERPQKSLLPPFESAEMRALAESLSRDIIRGSPDVKWESIKGLENAKRLLKEAVVMPIKYPKYFTGLLSPWKGILLFGPPGTGKVCIGIPSEIFTTLPP

SEQ ID NO: 187208 - protein, 146 aa, Glycine max
  Coding DNA Sequence Number=SeqID_70430
IYESVIINFLAYDHHSKFDLHFTPPLHQQTWKRRRASRKHIWTYEITQSMLGAPYPLQLPASVTQCLIHCGDHMTILRRFGPPLQWNVVVLDKGIGDKYITLPWYKFLQEGDFSHGDELSFYYRHADKIWKVIIRRAIDWDDSDID

SEQ ID NO: 187209 - protein, 51 aa, Glycine max
  Coding DNA Sequence Number=SeqID_70431
  Gene Ontology: Mol. function=protein serine/threonine kinase activity; Biological process=response to abscisic acid stimulus
  Homolog annotation: Hit_ID=Q940H6; Match level="QueryCoverage=96%, HitCoverage=19%, E-value=1e-14, Identity=62%"; Hit description =Protein kinase-like protein
MTQIADVRSCGVTLYVMLRILNVQYSIPDYVHISSECRHLLSRIFVADPAK

SEQ ID NO: 187210 - protein, 237 aa, Glycine max
  Coding DNA Sequence Number=SeqID_70432
  Homolog annotation: Hit_ID=Q9I747; Match level="QueryCoverage=40%, HitCoverage=59%, E-value=1e-12, Identity=41%"; Hit description =Protein hcp1
  Pfam annotation: Domain name=DUF796; Domain location=1-97; Score= -4.7; E_value=0.00067; Accession=PF05638.2; Description=Protein of unknown function (DUF796)
MSVGGGGGAGKVNFQDLSVQALIDKATPAVLKFCASGKHVAKVELSICKAGGSQIEYSRVVLEDVLVTKTSFSGVGHTDTIMVNYLFQASKVNLHYWEQSSQGTKGAETKSAPAMPDITSEINAVLSDHSRFDAEQLDIIISFVNELDKGTLSQFENAPDRTIMDTYERLLSASKEPARRQRDEEYELESLTGASRRTTTMSNHAAFFDRFRTTPAHMYGYGGNVYRDQTKSYYDVA

SEQ ID NO: 187211 - protein, 180 aa, Glycine max
  Coding DNA Sequence Number=SeqID_70433
  Homolog annotation: Hit_ID=Q7Y0F6; Match level="QueryCoverage=72%, HitCoverage=52%, E-value=6e-36, Identity=60%"; Hit description =Putative SPX domain containing protein
  Pfam annotation: Domain name=SPX; Domain location=1-82; Score=-38.8; E_value=0.0024; Accession=PF03105.10; Description=SPX domain
MEVQQRIKRVVDVWGPSGSQPSEEDYREEMAKIRKTIVDFHGEMVLLVNYSNINYTGLAKILKKYDKRTGGLLRLPFIQKVLEQPFFTTDLISKLVKECESIIDAVFPAEEEAERAKEAKDAITVAGEGIFRNTVAALLTMQEIRKGSSTESPFSLPPLNLLDSDLIQSIQLNAAVPIVK

SEQ ID NO: 187212 - protein, 332 aa, Glycine max
  Coding DNA Sequence Number=SeqID_70434
  Gene Ontology: Mol. function=protein serine/threonine kinase activity; Cellular component=membrane; Biological process=protein amino acid phosphorylation
  Homolog annotation: Hit_ID=Q69SQ5; Match level="QueryCoverage=93%, HitCoverage=70%, E-value=2e-27, Identity=31%"; Hit description =Putative Avr9/Cf-9 rapidly elicited protein
  Pfam annotation: Domain name=Pkinase; Domain location=22-308; Score= -83.5; E_value=0.0014; Accession=PF00069.15; Description=Protein kinase domain
  Pfam annotation: Domain name=Pkinase_Tyr; Domain location=22-308; Score=-145.1; E_value=0.0014; Accession=PF07714.7; Description =Protein tyrosine kinase
  Pfam module annotation: Pfam domain module=Pkinase::Pkinase_Tyr; Domain location=22-308::22-308
MDPTTNLVEFSSQNLEACTNNFSQSNLIGLTKFGRLYRGILEGQHVVVKIWDGERMEQLSSKYDDENLIIKASSLPISCTFEEVKFWTNPTLRGYPNLVKLIGYTWERDAKGLVYDLNPLDTLDNVIMKDNLNWLQRINVIHELAKLLKFIHDQEKQNMVLNISASHILLDKDYKPNFIDLVLLSEVTMLREQLTMSTSYINPYFSLRGGEWDRSCEVFSFGIVLLELITKRVSVIGKREHASINLDGVVHIWAKKEYKPNCSLVHETLQEDWCYCAEDGVSITLLALQCIEFFPANRPTMRDVLHRLDNLLVLQRMADARATKREKQLISS

SEQ ID NO: 187213 - protein, 148 aa, Glycine max
  Coding DNA Sequence Number=SeqID_70435
  Gene Ontology: Mol. function=DNA binding; Biological process=DNA integration
MSPYRVVFGKACHLPREIEHKAYWAVKTCNFSMDQAGEERKLQLSELDEIRLEAYENAKFYKEKTKKFHDSMIIKKDFMVGQKLRSKWIGPFVITNVFPYGTVEIKSNSINKNFKVNGHRLKPFLTNPSLVDVVVEETSLLHPTLPPP

SEQ ID NO: 187214 - protein, 79 aa, Glycine max
  Coding DNA Sequence Number=SeqID_70436
MEKQMKGTEEEGKKKKEEERKLAGRLLGYYWYFIELLGAPTILLGAPSNTLERKDNEDVENKTMSSHSGDFSATRGSLF

SEQ ID NO: 187215 - protein, 487 aa, Glycine max
  Coding DNA Sequence Number=SeqID_70437
  Homolog annotation: Hit_ID=Q2HRX8; Match level="QueryCoverage=31%, HitCoverage=21%, E-value=3e-17, Identity=34%"; Hit description=IMP dehydrogenase/GMP reductase
  Pfam annotation: Domain name=DUF1723; Domain location=162-211; Score =56.7; E_value=7.5e-14; Accession=PF08330.1; Description=Protein of unknown function (DUF1723)
MVRTRGLGRVLGAGRGRGIREDAHQVDVPRRHRPTASARRQRIRVREDDVPQLHEDVPHVSDATPEMTGAADAVHTEGVATDGSLGSPAVDEGFPSGPRDPSVLTGFAEHVTHNIWSGQERPDLKLVSHGRKVDKIGRPAPEIEGMIAATGLSPLIRCSVITTDPGLISAFIERWHCETSTFHLPVGELTITLDDVASLLHVPITSALHKFESLVTSDAIGLLTKLLEGQTMGCSSLHGPGLGRGIRLGSGCIGPHVRASKRRVAGLYTAGGWLHYTSSVHTCVVHDVYDEGSPRACRWLTGKAHMTGIKGAPYRRHMDALTVTDVCWMPYVEHRGVRGFDLISSYTGQLRWDHLVPAGELCVVPGQVAPDYMEWFFWISYPFVTRTEETAEPRHPPPPHDEEFVEPPIPEVSIASDLATHSVVDCEGCQGMAEDLGAIAEDLERVINLRMVTEGTDLYDIMTRCLRRARGDATDGSLRPRQRRRID

SEQ ID NO: 187216 - protein, 119 aa, Glycine max
  Coding DNA Sequence Number=SeqID_70438
MNMIVGKHPSPTLARDRAKLEYISEGQPSPLEPAFGVELDPNSFSKMVSEPILDPFKGPPTIFVHASSQRSTGREGCVGKHSSPTLARDRAKLEYINERQPSPHEIAFGVELGPNPHIF

SEQ ID NO: 187217 - protein, 305 aa, Glycine max
  Coding DNA Sequence Number=SeqID_70439
MPIDIREIEAALCIPGRGFILKAEGHLGKILGKDLTTLARVWSVLSYSNLAPTSHTSDLTVDRARLIFGLVTQLDLNVGALISGQTISMAQPNSFRLGFPALITALCRSRGVVSDNLVFERLSPTINLAYIRKNCWNPDDPTFIIRGAKRPRARPAKALSTSVAPHPGSTSTALMTTAPSMLPPADFKCFEAMLQSIHQGQIILLQSLQLVAPLDSIPTVEQFNEWVAWPRTQPPLHREDEDPAAQLPHQPEDESSESSTPEPLIRKRRVVVTQEAAAISEKSLEATPVPPTLVVDITSNVNPFA

SEQ ID NO: 187218 - protein, 194 aa, Glycine max
  Coding DNA Sequence Number=SeqID_70440
  Gene Ontology: Mol. function=nucleoside-triphosphatase activity; Cellular component=membrane; Biological process=protein catabolic process
  Homolog annotation: Hit_ID=Q6A167; Match level="QueryCoverage=84%, HitCoverage=24%, E-value=5e-64, Identity=69%"; Hit description=Ftsh -like protease
  Pfam annotation: Domain name=Peptidase_M41; Domain location=26-169; Score=165.1; E_value=1.8e-46; Accession=PF01434.8; Description =Peptidase family M41
MSPLSSRYWTIFRCPILLTSCSRCPILGVRRLTAYHESGHAIVALNTDGAHPIHKATIMPRGSALGMVTQLPSSDETSISKKQLLARLDVCMGGRVAEELIFGQDYVTTGASSDLHTATELAQYMVVKLLREAYDRVKALLKKHEKALHVLANALLEYETLSAEEIRRILLPYREARLPEQQEQEAAEGDLVLV

SEQ ID NO: 187219 - protein, 126 aa, Glycine max
  Coding DNA Sequence Number=SeqID_70441
MEKEHNGEFASWRCWCEGAVARGVAGVLWCWKTEGGGFVEGGDADGSAASEWVSPERWSRANLRLNSGGSWTEKGMPEGGGSALRVALETNWHSDNQNGCAVGRGTVCSQKEASTARRKERGRIEP

SEQ ID NO: 187220 - protein, 474 aa, Glycine max
  Coding DNA Sequence Number=SeqID_70442
  Gene Ontology: Mol. function=nucleic acid binding; Biological process= DNA integration
  Homolog annotation: Hit_ID=Q6A167; Match level="QueryCoverage=18%, HitCoverage=11%, E-value=9e-44, Identity=100%"; Hit description=Ftsh- like protease
  Pfam annotation: Domain name=AAA; Domain location=1-167; Score=39.3; E_value=1.4e-08; Accession=PF00004.19; Description=ATPase family associated with various cellular activities (AAA)
  Pfam module annotation: Pfam domain module=AAA::RVT_2; Domain location=1-167::256-395
FVGVGARRVRSLFQAAKKKAPCIIFIDEIDAVGSTRKQWEGHTKKTLHQLLVEMDGFEQNEGIILMAATNLPDILDPALTRPGRFDRHERGTGGLICVGHESRGFYYLETSSSMLCVAASSPKLFHDRLGHPNLSKLKKMGPQKHYFSTWWADLRAITQHQSMFAAANQICWKLGRGDQFLFWEDPWGDEGIPLKDQFPELFRVSSQRDLRVAEMGSWSENGWVWNLSWRRNLFDNELQLASKFIDQIHASSLNINLKDTWTWRAEANGEFTTKSTYQVLQSELDDQDRLPTKDNLVKRQIQVENDLCPFCHNQPETASHLFFKCDKIMPMWWEFFSWIKEDKTNDLGCLKYFLGIEVAQSKEGIVFSQRKYALYILEERCMGNCKRIDSPMDPNQKLMADQGQGFLYEDKGNTQIFGYCDANWVGCPIDRRSTTRYCVSIGGNVIPWKSKKQNTVAWSSAEGEHRAMATATLS

SEQ ID NO: 187221 - protein, 356 aa, Glycine max
  Coding DNA Sequence Number=SeqID_70443
MDIIPKYLGDDLVLLPGLSEVGAERVMNGGTYGNASVFYSMERWNPSIRTGNKMIWVQCWGIPLQAWDKKHIRQIIAIMGEVVDVNDDVEAKRRLDRARVLIKTPWTPLIKHTVDVHISGETFKVHVVEECRAAFCENHNNGCSYRDSSEEIDFDESLQGDLPSAMTSLTIVDHDHKRATATDHHPKSPHKPSMPTVSDGKNWSIGLHSDQHEYDYLLDKTNDPRILTGCKGKAMVNSSFKEPQDRDFHENSKRDKGKSSGVQKEPFLPSRDFAGDKIPSRAVDAYQEHKGADVAIEIVKNREQETDMVQDSETHASSRGKVHTSEINANSNDMDVERRGLTEESHNKNQVYGGQR

SEQ ID NO: 187222 - protein, 353 aa, Glycine max
  Coding DNA Sequence Number=SeqID_70444
  Gene Ontology: Mol. function=RNA-directed DNA polymerase activity; Cellular component=nucleus; Biological process=RNA-dependent DNA replication
EWIKEAQQVSIVTIYSPCDIHIKIILWDTLRQLKDSSQEGLWCVLGDFNSIRDPAERFGTCERISGDNNIKQFNDWIDDLEVLEIPCLGRQFTWFRPNGAPRSRLDRFLVSPEWLDRWPGSLQLTLPRKFLDHCPILLRAKTVDWGWGAYVLKEKIKRLKQRLKIWNQEQFGNILKKVKNQEAELNKLEEDTTQRQLTDQEMMERKQLQESLWVAAQAHESLLRQKSRSRWINEGDCNTHYFHLMMNANQNRYSIKGVLIDDIWTDDPHKVKEEVRSFFSQRFQEPDDQRPKIDGISFKTIDQHQNNLLVAPIQEVEVQNAVWECGSDKSPGPDGMNFKFIKQFWNTLKPDIL

SEQ ID NO: 187223 - protein, 81 aa, Glycine max
  Coding DNA Sequence Number=SeqID_70445
  Homolog annotation: Hit_ID=Q2QP62; Match level="QueryCoverage=43%, HitCoverage=8%, E-value=3e-11, Identity=83%"; Hit description =Tryptophanyl-tRNA synthetase, putative, expressed
MEILDAYERGDRFYLYTGHGPCSEALHLGHLIPFMFTNEFPGLDGSGGPLYAGTGCFHKRESLCEMKFNDQYSNDWNSEDD

SEQ ID NO: 187224 - protein, 232 aa, Glycine max
  Coding DNA Sequence Number=SeqID_70446
APDFKPRKAFLFLFFLLAAGIPNLLVSEDWAAYRTVIALSLITTSAFIAGLFVIFNKLKITTSASIVCLVIAVLSCMLNIQKGFSTPQQREYQLLSSAITGNVPAEYSGQLYYRIDSDNLPAVAKSKKYDEFGSLSLGMPWTFAGMADAIKKEHAMKYSLPKAPRRHYFANRATALLTVAWFSGYGATSDRLVAATFCWRLNTTLSHFLNATRRDNMRAAQGLAPLVYACID

SEQ ID NO: 187225 - protein, 201 aa, Glycine max
  Coding DNA Sequence Number=SeqID_70447
  Gene Ontology: Mol. function=phosphopantetheinyltransferase activity; Biological process=macromolecule biosynthetic process
  Homolog annotation: Hit_ID=Q6D222; Match level="QueryCoverage=61%, HitCoverage=99%, E-value=7e-51, Identity=80%"; Hit description=Holo -[acyl-carrier-protein] synthase
  Pfam annotation: Domain name=ACPS; Domain location=14-81; Score=90.7; E_value=4.4e-24; Accession=PF01648.10; Description=4'-phosphopantethei nyl transferase superfamily
ADAGSAPLMAILGLGSDIVEIERIAGVIERSGDRLARRVLSEAEWQQYQAHQQPVRFLAKRFAVKEAAAKAFGTGIRGGLAFNQFEVYNDALGKPGLRFFEQAKVIASQLGVQHVHVTLADERHYACATVIIEDALTGRLIIMTHAFSAAVSVDLIDRFTHANRLVRALRLAHVAVNAALSNYQCHCISSSVACFHCMFHG

SEQ ID NO: 187226 - protein, 92 aa, Glycine max
  Coding DNA Sequence Number=SeqID_70448
SKSPAFVDHPTFCYRDPRVRWHVETPDGNPHTTFAIQRPESPVTCGDTLRLSAPRHSETPSRIDKQRPMWSSAPFLEMPASSGRDYFSLTLL

SEQ ID NO: 187227 - protein, 142 aa, Glycine max
  Coding DNA Sequence Number=SeqID_70449
  Gene Ontology: Mol. function=protein binding; Biological process =defense response
  Homolog annotation: Hit_ID=Q1SW19; Match level="QueryCoverage=68%, HitCoverage=10%, E-value=3e-14, Identity=44%"; Hit description =Disease resistance protein
MATYEWQHVSQLVPPIRMAIPAQSAFVPLLAMAVHMDIADGSGDTCLPPFPNRGFQNLKQILLESLLRLKSIVIEDGALPSLEKLQLVFIPRLKKVPSSLNKLPKLEVFHVTDMSDEFEENFHLNRGQRQWIIGVLLFLCRI

SEQ ID NO: 187228 - protein, 77 aa, Glycine max
  Coding DNA Sequence Number=SeqID_70450
MGIGKGNQWRIELGRDAYLVIFIFEIVREKTKANDIGGMVCIIGGMMLICSKKSDGDDEGSKRWQDMNVMCQRSEWG

SEQ ID NO: 187229 - protein, 227 aa, Glycine max
  Coding DNA Sequence Number=SeqID_70451
  Gene Ontology: Mol. function=transferase activity, transferring glycosyl groups; Cellular component=integral to membrane; Biological process=metabolic process
  Homolog annotation: Hit_ID=Q9ZU72; Match level="QueryCoverage=93%, HitCoverage=45%, E-value=2e-47, Identity=46%"; Hit description =Putative flavonol 3-O-glucosyltransferase
MANYTPNNEGKIGDVFEWLDKQEEEFVVYVSLGSGYTMSFVEMKEMALGLELSGNKFVWSVRPPVTKAGTGNYLTAGAPLGETGTTLGSNNEPSNSFPDEFYRIQTNGIVITDWAPQLDILKHPSIGGFVSHCGWNSLIESVSCGVPIIGLPLFAEQMMNATMLMEEVGNAIRELSKAIRKIMDKDDKEGCVMRERAKELKQLAERAWSHDGPSYLALSKITHSNGM

SEQ ID NO: 187230 - protein, 50 aa, Glycine max
  Coding DNA Sequence Number=SeqID_70452
MGCSQFCITKPASLFRKNTPSIQSSKGLEEQNCLQVRVFAMVGVEKLWLD

SEQ ID NO: 187231 - protein, 126 aa, Glycine max
  Coding DNA Sequence Number=SeqID_70453
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1S9H0; Match level="QueryCoverage=92%, HitCoverage=55%, E-value=5e-35, Identity=66%"; Hit description=X8 domain, putative
  Pfam annotation: Domain name=X8; Domain location=93-126; Score=-38.5; E_value=0.1; Accession=PF07983.3; Description=X8 domain
MALSWGQQVLKMPGLLTGTSLHTLDHWCTPLMPGKSVDTFIFALYDEDLKQGPASERPFGLFKTDLTMAYDVGLDMSSFSYTNPTTTPVTGAQWCIPKVEVAEAQLQANIDYICGSQVVDCGPIQQ

SEQ ID NO: 187232 - protein, 721 aa, Glycine max
  Coding DNA Sequence Number=SeqID_70454
  Gene Ontology: Mol. function=structural molecule activity; Cellular component=coated pit; Biological process=ER to Golgi vesicle -mediated transport
  Homolog annotation: Hit_ID=Q1S9H2; Match level="QueryCoverage=99%, HitCoverage=79%, E-value=0.0, Identity=81%"; Hit description=Adaptin N terminal region, putative
  Pfam annotation: Domain name=Adaptin_N; Domain location=2-378; Score =107.4; E_value=4.3e-29; Accession=PF01602.10; Description=Adaptin N terminal region
  Pfam annotation: Domain name=Gamma-COP; Domain location=453-719; Score=393.2; E_value=3.8e-115; Accession=PF08752.1; Description =Coatomer gamma subunit appendage doma
  Pfam annotation: Domain name=HEAT; Domain location=106-142; Score =6.7; E_value=6.5; Accession=PF02985.12; Description=HEAT repeat
  Pfam annotation: Domain name=HEAT; Domain location=178-214; Score =1.7; E_value=27; Accession=PF02985.12; Description=HEAT repeat
  Pfam annotation: Domain name=HEAT; Domain location=342-378; Score =8.2; E_value=4.3; Accession=PF02985.12; Description=HEAT repeat
  Pfam annotation: Domain name=HEAT; Domain location=70-105; Score=3.0; E_value=18; Accession=PF02985.12; Description=HEAT repeat
  Pfam module annotation: Pfam domain module=Adaptin_N::Gamma -COP::HEAT::HEAT::HEAT::HEAT; Domain location=2-378::453-719::106 -142::178-214::342-378::70-105
MKINELLNCAVHIGDTEACQFIHIRQNDRLAVSKLVTSLTRGNVRSPLAQCLLIRYTSQVIRESGNNTQSGDRPFYDYLESCLRHKSEMVIFEAARAITELNGVTSRELTPAITVLQLFLSSSKPVLRFAAVRTLNKVAMTHPMAVTNCNIDMESLLSDQNRSIATLAITTLLKTGNESSVDRLMKQITNFMSDIADEFKIVVVEAIRSLCLKFPLKYRSLMNFLSNILREEGGFDYKKAVVDSIVILIRDIPDAKESGLLHLCEFIEDCEFTYLSTQILHFLGVEGPKTSDPSKYIRYIYNRVHLENATVRAGAVSTLAKFGAAVDELKGDISTNVKSPNYTLQPRIFILLRRCLFDSDDEVRDRATLYLNTLGGDGSVVETDKDVKDFLFGSFDIPLVNLETSLKNYEPSEEAFDIDSVPREVKSQPLAEKKAPGKKPTGLGAPPSGPPSTADAYERLLLSIPEFANFGKLFKSSEPVELTEAETEYAVNVVKHIFDRHVVFQYNCTNTIPEQLLEDVIVIVDASEAEEFSEVFSKPLRSLPYDSPGQTFVGFEKPEGLSIAGKFSNVLKFIVKEVDPTTGETEDDGVEDEYQLEDLEVVTADYMLKVGVSNFRSAWESIGPDCERVDEYGLGPRESLAEAVNTVINLLGMQPCEGTEVVPPNSRSHTCLLSGVFIGNVKVLVRLSFGLDGPKDVAMKLSVRSEDETVSDTIHEIVASG

SEQ ID NO: 187233 - protein, 421 aa, Glycine max
  Coding DNA Sequence Number=SeqID_70455
  Gene Ontology: Mol. function=signal transducer activity; Cellular component=heterotrimeric G-protein complex; Biological process =signal transduction
  Homolog annotation: Hit_ID=Q8LJQ7; Match level="QueryCoverage=94%, HitCoverage=98%, E-value=0.0, Identity=82%"; Hit description=G protein beta subunit
  Pfam annotation: Domain name=WD40; Domain location=115-153; Score =20.0; E_value=0.0085; Accession=PF00400.22; Description=WD domain, G- beta repeat
  Pfam annotation: Domain name=WD40; Domain location=164-203; Score =35.2; E_value=2.2e-07; Accession=PF00400.22; Description=WD domain, G-beta repeat
  Pfam annotation: Domain name=WD40; Domain location=211-251; Score =32.8; E_value=1.2e-06; Accession=PF00400.22; Description=WD domain, G-beta repeat
  Pfam annotation: Domain name=WD40; Domain location=256-294; Score =46.9; E_value=6.8e-11; Accession=PF00400.22; Description=WD domain, G-beta repeat
  Pfam annotation: Domain name=WD40; Domain location=303-341; Score =15.9; E_value=0.14; Accession=PF00400.22; Description=WD domain, G -beta repeat
  Pfam annotation: Domain name=WD40; Domain location=372-410; Score =9.2; E_value=3.1; Accession=PF00400.22; Description=WD domain, G -beta repeat
  Pfam annotation: Domain name=WD40; Domain location=73-111; Score =38.1; E_value=3e-08; Accession=PF00400.22; Description=WD domain, G -beta repeat
  Pfam module annotation: Pfam domain module=WD40::WD40::WD40::WD40::WD4 0::WD40::WD40; Domain location=115-153::164-203::211-251::256 -294::303-341::372-410::73-111
MEKSGAVCRRVGIRIWQRQKERHSAATDTVNNLRHRLKQKRLSLLDTDIVVVSVSGYARSQGRTPVTFGPTDLVCCRTLQGHTGKVYSLDWTSEKSQIVSASQDGRLIVWNALTRQKIHAIKLPCAWVMTCAFSPTGQSVACGGLDSVCSIFNLNSPTDKDGNLPVSRMLSGHKGYVSSCQYVPDEDTHLITGSGDQTCVLWDITTGLKTSVFGGEFQSGHTADVLSISINGSNSRMFVSGSCDATARLWDTRVASRAVRTFHGHEGDVNAVKFFPDGNRFGTGSDDGTCRLFDIRTGHQLQVYYQQHSDNEIPPVTSIAFSASGRLLFAGYTNGDCYVWDTLLAKVLGALAKHTTTSGSIFSGCTMIEVVLNIGSLQDSHEDRISCLGLSADGSALCTGSWDTNLKGIGGQLKAIEGKAK

SEQ ID NO: 187234 - protein, 167 aa, Glycine max
  Coding DNA Sequence Number=SeqID_70456
MGSRFGKGRSVAVFCGSIAKGSTGGDKFVLGLGWWETTIGSGADMGTSEDGIELKVHGGLGCGQAELSGSEFDNDNLETVQVDGGRGRDPARSCNLVVALHEVSKELGLLLYPFGLVPHRDREDGWFGKKIMWVNIMYIQHTELFRGIAWSNKMLRSLSHYGRLIFH

SEQ ID NO: 187235 - protein, 158 aa, Glycine max
  Coding DNA Sequence Number=SeqID_70457
  Gene Ontology: Mol. function=RNA-directed DNA polymerase activity; Biological process=RNA-dependent DNA replication
MAEDVHRPWIMMGDFNAYLVPSEKEVREKLDMVVGDPSWNQSFPEASVIHLPALKSNHKAILLRTSLGLRDKGRTRMFRVMASWMADDSLNSMLKKTWDSTGEWKYLVTSFQLAFDDWNNNCYGNLFHRKIRILARLHGINEKLTMEENCVGSVASIT

SEQ ID NO: 187236 - protein, 409 aa, Glycine max
  Coding DNA Sequence Number=SeqID_70458
  Gene Ontology: Mol. function=actin binding; Cellular component =membrane; Biological process=mesodermal cell migration
  Homolog annotation: Hit_ID=Q1S9G7; Match level="QueryCoverage=94%, HitCoverage=83%, E-value=1e-161, Identity=72%"; Hit description=CAP protein
  Pfam annotation: Domain name=AT_hook; Domain location=7-19; Score =14.9; E_value=0.061; Accession=PF02178.9; Description=AT hook motif
  Pfam annotation: Domain name=CAP_C; Domain location=247-407; Score =257.3; E_value=3.1e-74; Accession=PF08603.1; Description=DE Adenylate cyclase associated (CAP) C te
  Pfam annotation: Domain name=CAP_N; Domain location=1-242; Score =28.8; E_value=4.5e-13; Accession=PF01213.9; Description=Adenylate cyclase associated (CAP) N termina
  Pfam module annotation: Pfam domain module=AT_hook::CAP_C::CAP_N; Domain location=7-19::247-407::1-242
MERRQTIRGRGRPKKTIREVIKKDLELNDLDRSMKPNLAGLSEFLKPLNEVITKATKLTEGRRSDFFNHLKAAADSLSALAWIAYTGKDCGMSMPIAHVEESWQMAEFYSNKVLVEYRNKDPNHVEWAKALKELYLPGLRDYVKSFHPLGPVWSPTGKIFAPSKASAPAAPPPPSASLFSSESSQASSSKPKEGMSAVFQQISSGNVTSGLKKVTNDMKTKNRTDRTGVVGAIEKETPASSRVFSKAGPPKFELQMGRKWVVENQIEKKDLVIEDCDSKQSVYIYGCKNSVLQISGKVNNITIDKCTKMGVVFKDVVAACEIVNSNGVEVQCQGAAPTISVDNTSGCQLYLSKDSLEASITTAKSSEINVMVPGADPDGDWVEHSLPQQYIHLFKNGHFETTPAAHSGG

SEQ ID NO: 187237 - protein, 342 aa, Glycine max
  Coding DNA Sequence Number=SeqID_70459
MTLKELVGILKVHEQDLAQDEGTKKGKLLSLVDQRPKRNFVFKETSSKAFVVKYASEKESNDDDSNKEDNELSLITRKIKKIGKIRTPLGSIDHPKDPCTRKRKVQSSAISARNEGTSSQNLNDSLSDKDSEEEANLCLMADASTSKAELALDDTINSNDEEAMFESKEDLIKGYNQLLSASACVSKAYRKLNKHFQHLEGEHEDLKKAHRVHLVDFILETTSLGSVQDACACEEVKALLGEKVSSGCKTLLKDFQDLDDSSLNKDREEESNLCLMADASTNDEEPQPDDTINSDGEEALVEEKVSSERKIILKDFQDLEERVKSLTITLEDSEEEHKEMLK

SEQ ID NO: 187238 - protein, 305 aa, Glycine max
  Coding DNA Sequence Number=SeqID_70460
  Gene Ontology: Mol. function=protein serine/threonine kinase activity; Cellular component=cellular_component; Biological process =protein amino acid phosphorylation
  Homolog annotation: Hit_ID=Q84VT0; Match level="QueryCoverage=75%, HitCoverage=74%, E-value=1e-52, Identity=49%"; Hit description =Putative cyclin dependent kinase A
  Pfam annotation: Domain name=Pkinase; Domain location=44-296; Score =125.7; E_value=1.3e-34; Accession=PF00069.15; Description=Protein kinase domain
  Pfam annotation: Domain name=Pkinase_Tyr; Domain location=37-293; Score=-77.8; E_value=1.1e-07; Accession=PF07714.7; Description =Protein tyrosine kinase
  Pfam module annotation: Pfam domain module=Pkinase::Pkinase_Tyr; Domain location=44-296::37-293
MEEVRAVHLVGFNGRTRKSNVRVARVQWKNKEEPRMLTLREKYYDFDQISSKVFKCRRDDQFFTMKIVSILNEENQANNGVPYWIIREISILKELDHINIVRLIDVMTDGPDLFLVFEYLDNEFQADFLKNPKMFMYPQMKKEFLYQILNTVAYLHARKILLRDLRPENILVNVRTQVLKIALFGAARTFEAPLEAYSSSVGCLSYRSPEVLFQFGCEKYSTPNDVWAVGCIFGEMLLHRPLFSGPSDVELLDEIFTLLGTPTEETWPGVTSICGTCALMGPPQQPKDLAKEFPMLNPDGLDLLS

SEQ ID NO: 187239 - protein, 135 aa, Glycine max
  Coding DNA Sequence Number=SeqID_70461
MKDKSIRKDINQSVVLTKVFEAHGVIRKFLYETPVDKLGLNTRRYDYLDEVWEKVAEEDERVDATEVTEQINKKKMDTPSSKPAPTQQHPPPTLIAPKAIDVMAHVSKNPVLKKQNPLSTTKFLRALSETESDDD

SEQ ID NO: 187240 - protein, 72 aa, Glycine max
  Coding DNA Sequence Number=SeqID_70462
  Subcellular localization annotation: CTP_CleavageSite=53; ConfidenceScore=5.07e-01
MAVLSFAENKFPKFLSLSNTAIPSAPVAKSQLLITVHHCAQQNTKLNQSLKTVAKQGMQLKCQIERYTKFDN

SEQ ID NO: 187241 - protein, 51 aa, Glycine max
  Coding DNA Sequence Number=SeqID_70463
  Gene Ontology: Mol. function=nucleoside-triphosphatase activity; Cellular component=protein complex; Biological process=proteolysis
  Homolog annotation: Hit_ID=Q9FJC9; Match level="QueryCoverage=98%, HitCoverage=12%, E-value=5e-10, Identity=66%"; Hit description=26S proteasome regulatory particle chain RPT6-like protein
MTILIEIWLRMLKLWSLQQLIVLQNLMKQYFSIFLKPLKLEFQTKGRGLKY

SEQ ID NO: 187242 - protein, 95 aa, Glycine max
  Coding DNA Sequence Number=SeqID_70464
MAKSIDNSGRRMSFIEALSKSQLAKCTVFTFRLSEVFGCGETKRELSLKRKPSKGALDEIVRFLEVEETSPLLVFLLSFIFSSHCCKGSFPAMES

SEQ ID NO: 187243 - protein, 149 aa, Glycine max
  Coding DNA Sequence Number=SeqID_70465
MTTLTQIWMTLLLSNIPPDDHNADLPPAKVSVGLCHRDIGITPTRHPVDPKKSNRALGFPALVTGLCQSYRAPAPPASSCHRDIGITPARHSVDPEKSNRVLGFSALIMGLCQFYGVSVAPNKAIRPPTNRAFIKKYCAPRQAQGETPQ

SEQ ID NO: 187244 - protein, 203 aa, Glycine max
  Coding DNA Sequence Number=SeqID_70466
METIHLQKKKRTLSTADLNDKVQHEAPPSSIHLDCFHHQGSPSIDPNPIDENIARMHFEVAFLSENAYNIQRRLDVEFQPSIHWTQFTLEVEEEVVSFPSPIHKADQAASSSTTLDPPTRIEVLPPSTWKRLQPKVSKPSSTMAKHKSWPSYSPGIHIKPTTTIKSMSDCIALRLPPLDLRKKKGKVHPHNKPMPHPSPKDNT

SEQ ID NO: 187245 - protein, 43 aa, Glycine max
  Coding DNA Sequence Number=SeqID_70467
MGLKSKMDEDGGIVGGDCGGEGGGIGTRFIEVVSAGIVVSGGR

SEQ ID NO: 187246 - protein, 443 aa, Glycine max
  Coding DNA Sequence Number=SeqID_70468
  Gene Ontology: Mol. function=transmembrane receptor activity; Cellular component=membrane; Biological process=signal transduction
  Homolog annotation: Hit_ID=Q1CF97; Match level="QueryCoverage=99%, HitCoverage=79%, E-value=8e-39, Identity=26%"; Hit description =Methyl-accepting chemotaxis protein
  Pfam annotation: Domain name=HAMP; Domain location=120-190; Score =38.6; E_value=2.1e-08; Accession=PF00672.15; Description=HAMP domain
  Pfam annotation: Domain name=MCPsignal; Domain location=207-443; Score=82.4; E_value=1.4e-21; Accession=PF00015.11; Description =Methyl-accepting chemotaxis protein (MCP) signaling domain
  Pfam annotation: Domain name=TarH; Domain location=1-101; Score=-6.3; E_value=0.076; Accession=PF02203.6; Description=Tar ligand binding domain homologue
  Pfam module annotation: Pfam domain module=HAMP::MCPsignal::TarH; Domain location=120-190::207-443::1-101
HRAGIYLMQDQQSGSVDSWKSLAAAATTSLQQAQQLFAAYQAKSDSPLAQGFVLLAGGLQEQLKGLAANDINAFFMVPMQAFQQQFNDAWFSEIEQANQQLGSVNQHSLSTLKQSRNLALAIAALLMALLLLAAALLMRGVLLPLRHANAQLAQIATGDLVASPAPTRRQSLETRQLLQSIDTMRQGLQQIVSDITTVATRVAAGADEMQQHNQQVMQQHQAQNASFHHLSQRLHRVSEEVEKGAHFSQQATHDAQSADALMRHCAHEVDNMEHQMQQIVAAAGDIAGIIGMLDSLSMQTRLLSLNAAIESAHAGAYGRSFSVVAKEMGLLSQQSGASTRQIDGLIQHTQQHVQDGFAKVQALEVLFARIGQAVSGVVSQLNELQDNSTAQSHRVSKIAREVVEMSLQLQQNEALTDQQVQAAAQLSELSARLTQRAQQFRVS

SEQ ID NO: 187247 - protein, 63 aa, Glycine max
  Coding DNA Sequence Number=SeqID_70469
MDLSLIVDEDFLEEVWAIALVARPYSPKQCCRPEFSSSMFSHRSHQIQIGNSIVILILPRFKD

SEQ ID NO: 187248 - protein, 492 aa, Glycine max
  Coding DNA Sequence Number=SeqID_70470
  Homolog annotation: Hit_ID=Q1SWR7; Match level="QueryCoverage=99%, HitCoverage=98%, E-value=1e-140, Identity=54%"; Hit description =Mitochodrial transcription termination factor-related
  Pfam annotation: Domain name=mTERF; Domain location=144-470; Score= -33.5; E_value=6.2e-06; Accession=PF02536.5; Description=mTERF
MFISCQKYNLYLLCSSVPLRNSTTCSIFNCQNPNEHHSILRQPNSKSTAYLLHHLSHKDDGAPIPIPIPKPSELQDPMPHEEKVKVLELSLVRKRSPQFPGSIYAQSPSDSDVGSSLPPLRTLFQSSDGKDNEEEEEEMIMRALEIRRKVTEEVFKEAVRKGKFGITYTTNLVTRLSGFIDYIMIEAANLKRLPEFSNSTFNLRAKIVIDDSKVVPLIRWLKHNAISFPRIAKLILMSRGNLEAVRSFVEWLKSVYVKGEFLGVVMVNAGDNIFQRSHAELDEIVLYLESNGVRRDWMEYVISRCPQLLSYSLDEVKTRAQIYHDMGLNEKDFGTMVFDFPKVLGYYSMEEMNAKMTIVPKVIFLMTKAGVSEKDIAKVVALGPELLGCNIAHKLDVNVKYFLCLGIRLRQLGEMIADFPMLLRYNPDVLRPNYSLEGRIIPRHKVLVENQINIKLRYIMLTSTDEEFNKMVKGIIRKRLRFESAVTNEDTT

SEQ ID NO: 187249 - protein, 277 aa, Glycine max
  Coding DNA Sequence Number=SeqID_70471
  Gene Ontology: Mol. function=phenylalanine-tRNA ligase activity; Cellular component=cytoplasm; Biological process=tRNA aminoacylation for protein translation
  Homolog annotation: Hit_ID=Q1SWR9; Match level="QueryCoverage=99%, HitCoverage=47%, E-value=1e-147, Identity=90%"; Hit description =Phenylalanyl-tRNA synthetase, class IIc; Aminoacyl-transfer RNA synthetase, class II
  Pfam annotation: Domain name=tRNA-synt_2; Domain location=83-262; Score=-191.2; E_value=0.0049; Accession=PF00152.11; Description=tRNA synthetases class II (D, K and N)
  Pfam annotation: Domain name=tRNA-synt_2d; Domain location=1-269; Score=462.4; E_value=5.7e-136; Accession=PF01409.10; Description =tRNA synthetases class II core domain (F)
  Pfam module annotation: Pfam domain module=tRNA-synt_2::tRNA-synt_2d; Domain location=83-262::1-269
MVRAQLKQIFLCMGFEEMPTNNFVESSFWNFDALFQPQQHPARDSHDTFFLETPSTTKILPEDYVQRVKHVHESGGYGSRGYAYDWKREEANKNLLRTHTTAVSSRMLYQLAQKPFAPKKYFSIDRVFRNEAVDRTHLAEFHQIEGLVCDRGLTLCDLIGILHDFFSRLEMISLPSSGMTKLKFKPAYNPYTEPSMEIFSYHEGFKKWVEIGNSGMFRPEMLQPMGLPEDVQVIAWGLSLERPTMILYGIDNIRDLFGHKVDLGLIKKNPVCRLGID

SEQ ID NO: 187250 - protein, 104 aa, Glycine max
  Coding DNA Sequence Number=SeqID_70472
  Gene Ontology: Mol. function=DNA binding; Cellular component=nucleus; Biological process=regulation of transcription, DNA-dependent
  Homolog annotation: Hit_ID=Q0PJH6; Match level="QueryCoverage=74%, HitCoverage=80%, E-value=2e-24, Identity=65%"; Hit description=MYB transcription factor MYB142
  Pfam annotation: Domain name=Myb_DNA-binding; Domain location=13-62; Score=32.7; E_value=1.3e-06; Accession=PF00249.21; Description=Myb -like DNA-binding domain
MASSSLSKQKASDSSWTPKQNKLFEKALAKYDKDTPERWQNVAKAVGGKSADEVKRHYEILLEDLRHIESGRVPLPKYKSTGSSTNVDEEESLAKAKFGITAFT

SEQ ID NO: 187251 - protein, 136 aa, Glycine max
  Coding DNA Sequence Number=SeqID_70473
  Gene Ontology: Mol. function=RNA-directed DNA polymerase activity; Biological process=RNA-dependent DNA replication
  Homolog annotation: Hit_ID=Q1SDI2; Match level="QueryCoverage=71%, HitCoverage=14%, E-value=4e-18, Identity=50%"; Hit description=RNA -directed DNA polymerase
MVGDPVSNLPLLRYEVREACRNSPEDTKEIVKSILGVSECLGTGKYLGMPSMVGRRKRAVFNYLKDRVWSKINHCNRSSGKWINWLGWDRLAVQKENGNLFLIKMLWCLESSKPNIYPKGLILLMIGPNIGIWSLL

SEQ ID NO: 187252 - protein, 420 aa, Glycine max
  Coding DNA Sequence Number=SeqID_70474
  Gene Ontology: Mol. function=transcription regulator activity; Cellular component=nucleus; Biological process=regulation of transcription
  Homolog annotation: Hit_ID=Q1S089; Match level="QueryCoverage=99%, HitCoverage=100%, E-value=1e-109, Identity=56%"; Hit description =Helix-loop-helix DNA-binding
  Pfam annotation: Domain name=HLH; Domain location=218-268; Score =34.2; E_value=4.5e-07; Accession=PF00010.16; Description=Helix-loop -helix DNA-binding domain
MLHCLNTSGNLGATCSDMTVLERQREATIKWQQHLQNNQPPYLTDFNVNVNAVFSSSSSSSQSQGLVMNICADSALGEVLTHSVKPDPGVWPEFDAGFGSSSGFLPTISPTCSRGGDLVSPKENMASAKENTKKRKPQNSKVVAASDNKQDKRVKASGEEGESKVTEQTSNKNGKSNANKNNNRETTSAETSKDNSKGSEVQNQKPEYIHVRARRGQATDSHSLAERVRREKISERMKYLQDLVPGCNKVAGKAGMLDEIINYVQSLQRQVEFLSMKLAAVNPRLDFNLDELFTKEVFPSCAQSFPNIGMPLDMSMSNNPSYLPFNSAQQLVSCCGGLINNMGISPPNMGLRRNISTSPVPLPETFLDSSCFTQILPSSNWEGGDFQSLYNVAFDQGRTASFPSQPFTGLVEASNLKMEM

SEQ ID NO: 187253 - protein, 281 aa, Glycine max
  Coding DNA Sequence Number=SeqID_70475
  Subcellular localization annotation: CTP_CleavageSite=56; ConfidenceScore=5.46e-01
LPSLGTGVWGANTFPARKYNSRTFHLKVRRSRLFRFFRRFPQINVGGDSARIPFVEHASRESRVALPPKDRVDGGAHYLLTSNHKVNEKNARNGAVTGHVAPLSPKKPSKSVISSFLRASSASPGDPEGASPTWASSLSLGHATSAPNCSGVVHLAPVGLILSVLIYILPTFKNGPRRVQRNARNWNQRGDMQTEAGFQHPKGQIFFSFVAEYEVKSKEKAQIFSLFIQKISETSPSFHVAFLFFFSTIEASIEAPKIPLHFYSKLQGEVIFGVLEHTSTS

SEQ ID NO: 187254 - protein, 178 aa, Glycine max
  Coding DNA Sequence Number=SeqID_70476
  Gene Ontology: Mol. function=transcriptional repressor activity; Biological process=regulation of nitrogen utilization
  Homolog annotation: Hit_ID=Q1S084; Match level="QueryCoverage=99%, HitCoverage=66%, E-value=8e-81, Identity=74%"; Hit description=NmrA -like
  Pfam annotation: Domain name=NmrA; Domain location=1-169; Score=56.0; E_value=1.2e-13; Accession=PF05368.3; Description=NmrA-like family
RFIPSEFGSDPTKVRVSELGDGYNFYAPKVEIRRLVEAEGIPYTFISCNFFMRVLLPSLAQPGSDAPPRDNVNIFGDGNTKVDDPRTLNKVLYLRPPGNVCSLNELKLEKLHVSEGELLQKIKGTSFPANFEMLFIYSAFVKGDHTYFDIESSSGVNGTQLYPHLKYTTISEFLDTLV

SEQ ID NO: 187255 - protein, 121 aa, Glycine max
  Coding DNA Sequence Number=SeqID_70477
  Gene Ontology: Mol. function=transcriptional repressor activity; Biological process=regulation of nitrogen utilization
  Homolog annotation: Hit_ID=Q1S084; Match level="QueryCoverage=86%, HitCoverage=33%, E-value=9e-41, Identity=80%"; Hit description=NmrA -like
  Pfam annotation: Domain name=NmrA; Domain location=6-121; Score= -49.2; E_value=2.6e-05; Accession=PF05368.3; Description=NmrA-like family
MEKSKILVIGATGNLGYNLAEASLMFCHPTFALVRDSSFSDPIKAQKLHSLSQAGATILKGSLEDEASIAEAVRLVDVVICAVSAKQTLHQKLLIRVIKQAGSIKVIHAILFLYFFLVFLR

SEQ ID NO: 187256 - protein, 55 aa, Glycine max
  Coding DNA Sequence Number=SeqID_70478
MTPLMKKIQGLQAPHGAYITILGAPLDLKQPKPHQILSEHLRKTKRCRCGSYVVA

SEQ ID NO: 187257 - protein, 71 aa, Glycine max
  Coding DNA Sequence Number=SeqID_70479
MEELATQLAQASSARPGEPVCFLQRQPPSGGRIWKAQVLKKLRKLTDCVTILPFGFRHIMEFHGLRNHASF

SEQ ID NO: 187258 - protein, 422 aa, Glycine max
  Coding DNA Sequence Number=SeqID_70480
  Homolog annotation: Hit_ID=Q66BN0; Match level="QueryCoverage=48%, HitCoverage=25%, E-value=4e-47, Identity=49%"; Hit description =Putative bacteriophage P2 tail protein gpT
LKNLFSAWEDVRIEVFDGQNSALRKLTVSATEWLTKAGAWVKANPELVGTLVKVTAGVTALIGGLAALGLIAWPVMAGVNMLIAGAGLLGTVFTTVGAGIAAAFSVITLPVVAAAAVIVGVALTIRKYWEPISAFLRGIGEGFSAAFAPMRAVLVPLAGAFTPLLNMVRNVWQWFGKLIEPVKSSQAELQTAARYGRMFGEWIAAGLSLPLQLLGGLPGLLTGIWGVASGIAERAAAVWDTIGERVNAAWLALSAATVQAWDRLTGWLNGKWEGLVNGAKALPGQFKEAGMNMINGVIDGISERWQALKDKFSSLTDMLPDWMKFGDDEAEVNPAISYNRPAPELMPGPGYAGAFDKGGIIPRGQFGIVGERGPEIVNGPANVTGRRKTAALSAAMLSLSTPVMASAPAAAPATAPAPITIQ

SEQ ID NO: 187259 - protein, 131 aa, Glycine max
  Coding DNA Sequence Number=SeqID_70481
  Gene Ontology: Mol. function=transcription factor activity; Biological process=regulation of transcription, DNA-dependent
  Homolog annotation: Hit_ID=Q1LM50; Match level="QueryCoverage=96%, HitCoverage=42%, E-value=6e-35, Identity=61%"; Hit description =Transcriptional regulator, LysR family
  Pfam annotation: Domain name=HTH_1; Domain location=6-65; Score=74.0; E_value=4.9e-19; Accession=PF00126.17; Description=Bacterial regulatory helix-turn-helix protein, lysR family
MNRTGLTELEIVLAVARRGTFKAAASELEMSPSAVTNAVAALEKRLGVRLFNRTTRSVALTDAGRRFSEKIVPALAMIRSAAEEAGSDPGDPAGMLRLNVPPESSALWYASILLPFLQRYPRIRVDIYGIL

SEQ ID NO: 187260 - protein, 156 aa, Glycine max
  Coding DNA Sequence Number=SeqID_70482
  Gene Ontology: Mol. function=oxidoreductase activity; Biological process=metabolic process
  Homolog annotation: Hit_ID=Q1LM49; Match level="QueryCoverage=82%, HitCoverage=27%, E-value=5e-22, Identity=42%"; Hit description =Aldehyde dehydrogenase
MVRATLPPRNMQRSIAMHMIEHIYINGQFVTPDGDEWLDIIKPADGSVIGKARLANAQDAERAIAAAAAAFPAFAATTVAQRITLLEQMYHAVNRAESELRAAILEEYGAPTARSEWMSRYPADVILQVIEELKRYPFVQQAGRAQCRCCRSALPA

SEQ ID NO: 187261 - protein, 140 aa, Glycine max
  Coding DNA Sequence Number=SeqID_70483
SSVEFIPGSSVLAEPASCSGSEGLRLGSEGQKVQHNGVERTRRMGGKERENGEWFGERNGNGNGREGLERREGFGGEGGGGGCKKSYLIQGLLKLAPALEMLCVSTDFIAIFANIVLFGRIITLGLKNVRFLPLHIVDIS

SEQ ID NO: 187262 - protein, 117 aa, Glycine max
  Coding DNA Sequence Number=SeqID_70484
MARTKKTGQMMSEPTKEITDKIRLALPPEPEVDSLAARVSTKERFIDPSGNDLDTGDSENYGLHVEENPPRLVALGRLYEGSITIHNIPLCHDQVRVGVKEVSYADAPIHVPIEEVQ

SEQ ID NO: 187263 - protein, 88 aa, Glycine max
  Coding DNA Sequence Number=SeqID_70485
  Homolog annotation: Hit_ID=Q6A167; Match level="QueryCoverage=69%, HitCoverage=7%, E-value=5e-18, Identity=74%"; Hit description=Ftsh -like protease
WCILFVELVLEQFLHQYGDTSPESVIKWFEQRDRAVDSKGVAEYLRALVVTNAISEYLPDEDSGKASSLPTLVFILRHRVLGILLFNF

SEQ ID NO: 187264 - protein, 120 aa, Glycine max
  Coding DNA Sequence Number=SeqID_70486
MATSLWIMDRAFELMQRRVCSHMIHHHLLLLRSGHATINIGFGIDAQRKTLDKKKKGKKLCGINNILVLSCLLDAICELNLCSNIRRLMFKKEFDTSYVGFNSGSELLSRQNLCNAYLDF

SEQ ID NO: 187265 - protein, 237 aa, Glycine max
  Coding DNA Sequence Number=SeqID_70487
  Gene Ontology: Mol. function=nucleoside-triphosphatase activity; Cellular component=membrane; Biological process=protein catabolic process
  Homolog annotation: Hit_ID=Q6A167; Match level="QueryCoverage=70%, HitCoverage=22%, E-value=4e-59, Identity=70%"; Hit description=Ftsh -like protease
  Pfam annotation: Domain name=AAA; Domain location=130-234; Score= -34.2; E_value=0.081; Accession=PF00004.19; Description=ATPase family associated with various cellular activities (AAA)
LQDLKQRALGNSDETFLSPGISDKLPLHVVMLFSESHEAVSSFRLIQKFMGAAALQKYIGSLGGIGPSGVGSSSSYAPKELNKEVMPEKNVKTFKDVKGCDDAKQELEEVVEYLKNPSKFTRLGGKLPKGILLTGAPGTGKTLLAKAIAGEAGVPFFYRAGSEFEEMNMMYNKLFSQNFFPNKNDIYLHMLRSGLENRIISNGHNQGYQTREFTQTRESFIDLISDSTRRLVRVYFI

SEQ ID NO: 187266 - protein, 287 aa, Glycine max
  Coding DNA Sequence Number=SeqID_70488
  Gene Ontology: Mol. function=sugar porter activity; Cellular component=cytoplasm; Biological process=phosphoenolpyruvate -dependent sugar phosphotransferase system
  Homolog annotation: Hit_ID=P69811; Match level="QueryCoverage=85%, HitCoverage=65%, E-value=3e-81, Identity=64%"; Hit description =Multiphosphoryl transfer protein (MTP) (Phosphotransferase FPr protein) (Pseudo-HPr) ...
  Homolog annotation: Hit description=[Includes: Phosphocarrier protein HPr (Protein H); Fructose-specific phosphotransferase enzyme IIA component (EC 2.7.1.-) (PTS system fructose-specific EIIA component)]
  Pfam annotation: Domain name=PTS_EIIA_2; Domain location=44-183; Score=240.7; E_value=3e-69; Accession=PF00359.12; Description =Phosphoenolpyruvate-dependent sugar phosphotransferase system, EIIA 2
MPDGKPANTRCVQLDEQQRCKIFGSPLRPAAETIHFQQARRNMFQLEVQAIHTGASASDKEQAIRQVAAALTAAGNVAEGYVDGMLAREQQTTTFLGNGIAIPHGTTDTRDLVLKTGVQVYQFPQGVDWGDGQTAYVAIGIAAKSDEHLALLRQLTHVLSDDSIAEQLKSASAEELRALLMGEKQAAEFQFDTSLIATDVAASDLMTLQALNAGRLQAAGAVDASFVADVVSHAPLGLGQGIWLSDSTHGNLNSAVAVSRSATPLTHQGEPVALLLTVAATDQRPLE

SEQ ID NO: 187267 - protein, 182 aa, Glycine max
  Coding DNA Sequence Number=SeqID_70489
  Subcellular localization annotation: CTP_CleavageSite=46; ConfidenceScore=5.47e-01
MAKPSTTALSELSARLTLSSNSLTRAKLKFTYSLMSRSTSNRLDPLEAMDKSLKVGQEPNPNNQAKLDFKNNPPSASFEEGEVVQIVRSTRMSIVTVEVSLKDKEPKVHIQHFFDIESLETIGCIIKAHLMLCNIHRFFENLKVVVPKFIREFWRTAKVYHYELSVKTIAQPLVVSVKAPSS

SEQ ID NO: 187268 - protein, 287 aa, Glycine max
  Coding DNA Sequence Number=SeqID_70490
  Gene Ontology: Mol. function=methyltransferase activity; Cellular component=spindle pole body; Biological process=rRNA processing
  Homolog annotation: Hit_ID=Q1RY42; Match level="QueryCoverage=96%, HitCoverage=33%, E-value=1e-132, Identity=78%"; Hit description =Ribosomal RNA methyltransferase RrmJ/FtsJ
  Pfam annotation: Domain name=FtsJ; Domain location=22-187; Score =218.9; E_value=1.1e-62; Accession=PF01728.9; Description=FtsJ-like methyltransferase
MGKAKGKHRLDKYYHLAKEHGYRSRASWKLVQLNNKFHFLESARAVLDLCAAPGGWMQVAVKSMPVNHLVIGVDLSPIAPVRGAIAIQEDITRPECKSRIKKLMNDHGCRAFDVILHDGSPNVGGAWAQEATSQNALVIDAVKLATQFLAPKGIFVTKLFEKVEVDKPAASRSESAEIYVLGLKYKAPAKIDPRLLDVKHLFQGSVEPQPKVVDVLRDSKQKRHRDGYEDGDTTLRKLSSAANFIWSNSPLEILGSVTSITFTDPADSPIKDHDLTTEEWGFEQQSM

SEQ ID NO: 187269 - protein, 85 aa, Glycine max
  Coding DNA Sequence Number=SeqID_70491
  Subcellular localization annotation: CTP_CleavageSite=45; ConfidenceScore=5.31e-01
MSHPPLEPHNHSQTHLMLSGWLPLLAQFSASGLVGAFALSATLARLAHISEFRLSARLFAQRMDSSGALNGISPRSANMHNSSFF

SEQ ID NO: 187270 - protein, 432 aa, Glycine max
  Coding DNA Sequence Number=SeqID_70492
MDHEVLHQAPPSPIHLDRFHHQRPPTKDPNLSKEDMARIQFPVDFLFENAYNIQRRLDMEFQPSIDWTQMQLDVEEEVITCPSSIHKVDEVVPSSSALYQPIEVEILPPSTWKRIHSKVSKPASLVTLCKNVYKIPFRACKELVSYDKDIIGWSQKIDTQTDSNVDMDHEVLHQAPPSPIHLDRFHHQGPPTKDPNLSKEDMARIQFPVDFLFENAYKIQRRLDVEFQPSIDWTQMPLDIEEEVITCPSSIHKVDEVVPLSSALYQPIGVEILSPSTWKQIHFKVSKPVSLVTLCKNVYKIPFRACKELVNYDKEIIGWSQKIDAQHIDPSSYDLLPPFLHPKHVQLFTPMSQFVPLVYGHQVIPLTKDHIFNVGMIMMQCSLTDQWPSYPPVIHIFPIIAIKFMPDRIALRLPPLDLKKKREGSSPQQTHA

SEQ ID NO: 187271 - protein, 763 aa, Glycine max
  Coding DNA Sequence Number=SeqID_70493
  Homolog annotation: Hit_ID=Q9SIW6; Match level="QueryCoverage=61%, HitCoverage=95%, E-value=2e-33, Identity=28%"; Hit description =Expressed protein
MKAERVSSRRKSISLSIMMPDDVAAQAFHDGDRVEAQAMHRNQSAWMAHWKQTSYKSATPACKNLGVDSEVRKEKEDSGAEQHDLLGGLDSSMRAGAVGEAARATSVTFSNEADDEKSKKAGCDPKPFPTFKFSRKLDGRLSLQREQHDGEGGKSETEPCSGDGNVSLNRAGTSGVGLSLASAHAPPKIEALAKECQVLSQEVLPTALVMKSPWDVEQKNLAVSTSPWNDFAKSASDIVPNGRDKGKTVMPQFTHEPFEICQSSYHLASRGQFTSTKYHTFSSLLISEKKMSSLLDPQKSSFSRWMQGGIAHLPHDSMAGSDDRLYFIRGQHHEIEKYVANPNITCQTESSKSAKPQNLYGLSSLVAQVPCSIRDVGSMKIYTSIDSVEESSRGHPKISQTTHHFLMSKKTDVNFSDRGQFFREPIAPIKSKGSAFNEILDFSPPTSGHALKGLKLEDLGSPIKSEGKENVQDFKYPTCLKNESSAETDTMDMDALHKNNPPGDVPFQTNKCSKDSQNSLTSQGATISAREKTIAKSVNTTIPDINQEPQELLTEESPVVDRETSTSRTHSLDLDHFLSHADEHARSSSGNSSLRTDPSSRWVKRLKLCTLGSANGTESTKIGETSSHEKVNNILGKILKDSKTSLEPKMVHHAEGQMVPDLSTTVSTNGKSSLTAAKKTVEITLSHPWIQRWSHDRSASSQKRHEIGELHEPKSSTAVLKELKKKQFPSIAAMALMGKAMNNLNPSELIKKGPVIVWNMKGF

SEQ ID NO: 187272 - protein, 70 aa, Glycine max
  Coding DNA Sequence Number=SeqID_70494
  Subcellular localization annotation: CTP_CleavageSite=61; ConfidenceScore=5.03e-01
MCCLVDLVGPMKVQVTSGLLNGGPQSSPPDFGHRAQPAAFTVLDFSYVGPFGPPSNSVYVVVDHLASNRA

SEQ ID NO: 187273 - protein, 48 aa, Glycine max
  Coding DNA Sequence Number=SeqID_70495
MSLINNGRRDEGQILQQCHIVYALAQLLLQNANEIEQVKLIHVIVKNV

SEQ ID NO: 187274 - protein, 49 aa, Glycine max
  Coding DNA Sequence Number=SeqID_70496
MERGRKERPKEVKSYFFPRSRKLKYTGEKPSYGERKPLKDLHVISEHVL

SEQ ID NO: 187275 - protein, 300 aa, Glycine max
  Coding DNA Sequence Number=SeqID_70497
  Gene Ontology: Mol. function=endopeptidase Clp activity; Cellular component=membrane fraction; Biological process=proteolysis
  Homolog annotation: Hit_ID=Q9FY07; Match level="QueryCoverage=90%, HitCoverage=99%, E-value=1e-90, Identity=64%"; Hit description =Putative ATP-dependent clp serine protease proteolytic subunit
  Pfam annotation: Domain name=CLP_protease; Domain location=93-299; Score=250.2; E_value=4.4e-72; Accession=PF00574.13; Description=Clp protease
  Subcellular localization annotation: CTP_CleavageSite=51; ConfidenceScore=5.69e-01
MVPQALSVPASASFTIASRTRSPSHLVFSHRNPCSIASSLPNPYGHSSGVGLSSKSRGFPLKLDEKNIHGASTSYGAIEAKGNPPITPAVMTPGGPLDLSSVLFRNRIIFIGQPVNSQVAQRVISQLVTLATIDENADILVYINCPGGSTYSVLAIYDCMSWIKPKVGTVCFGVAASQGALLLAGGEKGMRYAMPNARIMIHQPQSGCGGHVEDVRRQVNEAVQSRHVSVSSFELYNSNNLYNFNAPMILIMLEIDAILKSLLILNPLEKVQQYTERDRFLSVSEALEFGLIDGVLETEY

SEQ ID NO: 187276 - protein, 187 aa, Glycine max
  Coding DNA Sequence Number=SeqID_70498
  Homolog annotation: Hit_ID=Q45NM4; Match level="QueryCoverage=34%, HitCoverage=34%, E-value=5e-16, Identity=62%"; Hit description=BURP domain-containing protein
  Pfam annotation: Domain name=BURP; Domain location=26-181; Score= -35.8; E_value=1.7e-06; Accession=PF03181.6; Description=BURP domain
MAPTLALQFLSLFLLFLMNGQGIGARDMKKVEAVELQDQKEVEWFEATDPEYVASYTAHIHKHHHEKLHQPNYITKYGGTVPKDSSNIMDHTEAFKTGYFALDDRHVGNVMTLQLETAIKVFKVSLGAENGDSKIETLGVCHLDTSDWNPNHIIFTRLGIKPGKAPVCHFFPVKHLMWVPQPSQATK

SEQ ID NO: 187277 - protein, 69 aa, Glycine max
  Coding DNA Sequence Number=SeqID_70499
MEKVTNPLVHNSRWHPSEFYLFQQATESIIPRAKELKLPKGSLGFLNAHLGPQGTQRFFKLRSFLKVFG

SEQ ID NO: 187278 - protein, 273 aa, Glycine max
  Coding DNA Sequence Number=SeqID_70500
  Homolog annotation: Hit_ID=Q1S060; Match level="QueryCoverage=99%, HitCoverage=93%, E-value=3e-73, Identity=56%"; Hit description =Arabidopsis conserved protein
  Pfam annotation: Domain name=DUF241; Domain location=48-273; Score =140.8; E_value=3.8e-39; Accession=PF03087.5; Description=Arabidopsis protein of unknown function
MEASQSHFHVRSNSLPSRPHPLILQCNEHLDRLRSSNETSSSSSSLSHKLGGLQDLHECVEKLFHLSLSQEALHHECQENRVDELLNGSLRLLDVCTAAKDSLLHTKECMRELQSVMRRRKGGEVELKAEVKKFLISRKVVKKAISKALANLKGTRKNCNISSANKDNQLVSLLESVEVITLSTFQSLLQLISGTTQSKSNSWSLVSKLMQTKKVGCSQLADESEFAQLDEELQSCMFAQTSKFENTNNLQTQLEKVESLSQDLEEGLEFLFR

SEQ ID NO: 187279 - protein, 284 aa, Glycine max
  Coding DNA Sequence Number=SeqID_70501
  Homolog annotation: Hit_ID=Q1S065; Match level="QueryCoverage=99%, HitCoverage=100%, E-value=2e-98, Identity=65%"; Hit description =Arabidopsis conserved protein
  Pfam annotation: Domain name=DUF241; Domain location=53-281; Score =143.7; E_value=4.9e-40; Accession=PF03087.5; Description=Arabidopsis protein of unknown function
MVAIEKKTQSSLHLRRNSFPAAAHPLVSQFEEQLQRLRGSEATSSLSSSSVCHKLNDMLDLHDYTDKLLQLPIEQQVLARECNDKCVDDLLEQSLRLLDICNTAKECLLQSKESMCDLVSVIRRKKNNEIGFTIEGAKYLVVRKKMKKQIRKALENLKQKDKNTSPMLSFLNEAEAITLSSLEQMLLFISGPKGHSKHSRWSAISKLMQPKRVMCDSQESNTNEFEKVDAALQSLISLKPSSIENFESHMENLELCIQDLEIGVDQLSRKLIRNRVSLLNIFNH

SEQ ID NO: 187280 - protein, 89 aa, Glycine max
  Coding DNA Sequence Number=SeqID_70502
MRGYNQEGKLLERAWKWAFGFKEEVGIFPQKKRTLEMNVRIEYVDLTSFHCQLLCICKGKAAYNIPPPYLRIAKSLWAMGYEVLYISKK

SEQ ID NO: 187281 - protein, 499 aa, Glycine max
  Coding DNA Sequence Number=SeqID_70503
  Homolog annotation: Hit_ID=Q1S062; Match level="QueryCoverage=97%, HitCoverage=94%, E-value=1e-101, Identity=55%"; Hit description =Arabidopsis conserved protein
  Pfam annotation: Domain name=DUF241; Domain location=255-496; Score =196.2; E_value=7.8e-56; Accession=PF03087.5; Description=Arabidopsis protein of unknown function
METSSKNSLHIRCNSLPSAPHPLVSQFEENLRRLKDSEATSTSLSSSLISQKLIGLQDLHDYADKLLQLPTTQQAFAHKCSDKWVDVLLEGKGADTEFAVEGGKYLAFRKKMKKAIQKALGNLKGMKNELMVSSSSNNTESLFILGILKEVEAATVRLLESLLVFVSDTKGQSKQRRWSIISKLMQSDRMNCDPQESDTNEFVKVDTALQSLISHKTLSVENFHSHMENLETWIEDLEASPSDNSTSSSSSLFRHKLTGLQTLHDCIEKLVRLPLTQEVLVQERQEKWVDELLDGSLRLLDVCTVAKDSLLHMKECARELQSIMRRKRGGEMEVAAEVRKFLASRKVIKKAILKALENLQATVKKAKFPPSNKDNPTVTLASLFKDVQVITLSILESLLNFISGPAQSKPSKWSLVSKLMHNKKVTTTTQESDPNEFSNVDAALQSFVFHMTRKADSISHLQNQLEDLESVIQGFVEGLETLFKRFIKIRVSLLNILNH

SEQ ID NO: 187282 - protein, 53 aa, Glycine max
  Coding DNA Sequence Number=SeqID_70504
MDLKDASHTYHKEGAGTKQYLMKRSLLGREVCNAVVDLPLQLHGWSLKTLVNS

SEQ ID NO: 187283 - protein, 54 aa, Glycine max
  Coding DNA Sequence Number=SeqID_70505
MEQRHVKFSYSIIYISKVQNLMCMTALKWIDELLEGSLKLLDFYSIAIYSQERC

SEQ ID NO: 187284 - protein, 292 aa, Glycine max
  Coding DNA Sequence Number=SeqID_70506
  Homolog annotation: Hit_ID=Q1S065; Match level="QueryCoverage=98%, HitCoverage=98%, E-value=2e-68, Identity=51%"; Hit description =Arabidopsis conserved protein
  Pfam annotation: Domain name=DUF241; Domain location=49-289; Score =150.8; E_value=3.7e-42; Accession=PF03087.5; Description=Arabidopsis protein of unknown function
MATNMKTSLHNRSNSVPSAPHHFISQYDEHLLRLKASEATSSSSSSISSKLDGLHALYECTDKILQLSTIQQALAQESCKTRVDELLEGSLRLLDICSATKDVLLQSTESINGLQLSVRRKGGEAAFKVEGAKYLSSRKKAKKTIQNALEKFKGLKNGLILTSSNTDNETLSMISNFKEAEAVTLVQLESLLSFISGSRGKPKERRWLIVSKLMQPNRVYCDSDQSNTNEFEELDNVLQSLFHKPCSNMSVETFRNHMENLELRIQDLEGGIERLERQLIRTRVSLLNIYNH

SEQ ID NO: 187285 - protein, 131 aa, Glycine max
  Coding DNA Sequence Number=SeqID_70507
  Homolog annotation: Hit_ID=Q1S065; Match level="QueryCoverage=93%, HitCoverage=59%, E-value=4e-23, Identity=41%"; Hit description =Arabidopsis conserved protein
MAAIETNTKSSLHIRSNSLPSAPHPFTSQFEEHLHRLKDSEAALSSTSPSINYKLNALQDLHESMHELESAIRRRRDDTEAGLTIASGKYLASRKQVKKAIRKALGNLKGFKIVGSSNKEHDSCDKLIPYL

SEQ ID NO: 187286 - protein, 90 aa, Glycine max
  Coding DNA Sequence Number=SeqID_70508
  Subcellular localization annotation: CTP_CleavageSite=17; ConfidenceScore=5.10e-01
MHFVLGIWGFSWGWFFGGSEVGSSRSTRRCLSRTRIWLRIITNPWKLAGVHLSTLIPSRSDDAISLVMSCFYILSSLRTRALTKTPLSGL

SEQ ID NO: 187287 - protein, 70 aa, Glycine max
  Coding DNA Sequence Number=SeqID_70509
MPQRGFYAYPAINVGIKGRFRSNFIPTSPTDHRHQMKDRAKELKVLLKKGVKIVGDSCKKGWNKVKHIKR

SEQ ID NO: 187288 - protein, 93 aa, Glycine max
  Coding DNA Sequence Number=SeqID_70510
MEKAEAIMQKMQKIKEYTFMEALMLEIMENFNIDRMENLQTQRKPIARAIGEWLTHHVEANGYFKAGHLEKSLTVLKKSGQLIEAKKRREEYL

SEQ ID NO: 187289 - protein, 391 aa, Glycine max
  Coding DNA Sequence Number=SeqID_70511
MRRKWDEELTSFAKGSIDVAIVKEFYANVYDLEDNSPKQVRVRGHLIKFDEATLNTFLRTPVIIEEGETLSAYSRFALLRPDPQELATKLCILGRGFELNADGQPLKILRKNMITLAQTWSVLSYANLVPTSHTSDITMDRAKLIYGIIMKMDMNLGYLISRQISIIAQHDSSRLGFPALITTLSKARGVTSDSRSLESLIPAIKLAYIKKNYWNLDDPTVTFRGGPRKARGKRSKAPPISAAPDASTPSSSTLPDPSAPSTVSSSAPSFFYSCIRFLVYSRDASLHDTEPPQRTSYSYAEFLESRPAFYYAYGGFPCTAQELDSAKPVEEQAVEEPIFVEDELTPLEPFSFAADTSMAQEEETSPDPMPEPFPAPISEGTMPLALAMEPE

SEQ ID NO: 187290 - protein, 92 aa, Glycine max
  Coding DNA Sequence Number=SeqID_70512
MAPDRMQLQIMCKREHRSFKEYTQSWRDLIAQVVPPMMEREMIIMIVDTLPVFYYEKIDVAPCEACRPWIFFINGVLCFLKFNGSRMKKEER

SEQ ID NO: 187291 - protein, 82 aa, Glycine max
  Coding DNA Sequence Number=SeqID_70513
MAPKKLLTKRTRKTTARGDPVQPRKRRLKRRVQLREGEYTEFQEEVARRQWTQLIEPMAKYDPKIVMEFYANAWPTEEGVMD

SEQ ID NO: 187292 - protein, 89 aa, Glycine max
  Coding DNA Sequence Number=SeqID_70514
MAPGYVKTDLGLDSVGQLAFRQREIRIMVAGRDVVEEKHHPDLCQVVMLVWSTVAGLWPPHQILRPSFFSRCTHNTAPPLGLTDAPGIG

SEQ ID NO: 187293 - protein, 438 aa, Glycine max
  Coding DNA Sequence Number=SeqID_70515
  Gene Ontology: Mol. function=transporter activity; Cellular component= 1-2nm peptidoglycan-based cell wall; Biological process=transport
  Homolog annotation: Hit_ID=Q6D1F5; Match level="QueryCoverage=46%, HitCoverage=99%, E-value=2e-64, Identity=66%"; Hit description =Putative amino acid ABC transporter, permease protein
  Pfam annotation: Domain name=ABC_tran; Domain location=334-438; Score= -20.7; E_value=1.2e-05; Accession=PF00005.17; Description=ABC transporter
  Pfam annotation: Domain name=BPD_transp_1; Domain location=118-311; Score=32.4; E_value=1.6e-06; Accession=PF00528.12; Description =Binding-protein-dependent transport s
  Pfam module annotation: Pfam domain module=ABC_tran::BPD_transp_1; Domain location=334-438::118-311
MLINLGAYSTEIIRAGIQVTPRGQWEAGRVLGLSRTQTFIRVVLPPSLQRIYPALVSQCIIVMLGSSVVSQVSLSGDHADLSGVVDCHASAAAGAGSQMVWSAAGMTTFTDWDILRNLLLAARWTILLSLVAFFGGTLVTLPLLFLRLLQRRWLTRLIRCYTELFQGTPLLMQLFLAFFGVGLFGIDVAPWTAASLALTLYTSAFLLDIWYGSIRALPKGQWEASRCLGLNFGQTLYRVVAPQAIRIAIAPTVGFAVQVIKGTALASIIGFVELTKAGTILNNVTYQPFKVFGLVALASTWRKNSMPLITINQVQKYYGDNHVLKGVDLDIDNGEVISIIGRSGSGKSTLLRCMNGLEGYQEGSIKLGGMTITDRESQAREISRSVGMVFQNFNLFPHMTALENVMLAPRRVLKKSEAECRTLATQMLEKVGLGERLN

SEQ ID NO: 187294 - protein, 383 aa, Glycine max
  Coding DNA Sequence Number=SeqID_70516
  Gene Ontology: Mol. function=DNA binding; Cellular component=nucleus; Biological process=DNA integration
  Homolog annotation: Hit_ID=Q0BXC8; Match level="QueryCoverage=99%, HitCoverage=97%, E-value=3e-67, Identity=39%"; Hit description =ISHne2, transposase
  Pfam annotation: Domain name=rve; Domain location=138-303; Score =99.4; E_value=1.1e-26; Accession=PF00665.16; Description=Integrase core domain
MPWTETVTMQRLEFILACQAGGESMTQLCHRHGISRKTGYKWLSRFNPGELSSLENLSRARHLQPDKIAPDIAARLVQFRQQHPDWGPKKIRHWFLSNGADFIVPAASTIGDLLKAAGMVQPRTPRKRTPGNLRSLTTPVRNNHVWSADFKGRFRLKDGSWCRPFTLTDNHSRYLLSCEPGTSETTVFVRGCMEKAFLEGGLPDVIRTDNGSPFVAPGILALTQLSVWLIKLGIQPERTAPGCPGQNARHERMHRSLKVAMSHHDVFGSLPEQQAWCSGWRNEFNQEKPHEAHGQQPPAKIWTPSPRKWNGKVPEVGYPEGAKLYKVGEKGDLRLNGRTFLSAALRGEYVRFLEVDDGIDVILFDRLILAYYDRAEKRIIRID

SEQ ID NO: 187295 - protein, 204 aa, Glycine max
  Coding DNA Sequence Number=SeqID_70517
  Gene Ontology: Mol. function=hydrolase activity; Cellular component =membrane fraction; Biological process=metabolic process
  Homolog annotation: Hit_ID=Q4KDV0; Match level="QueryCoverage=100%, HitCoverage=95%, E-value=1e-87, Identity=77%"; Hit description =Hydrolase, isochorismatase family
  Pfam annotation: Domain name=Isochorismatase; Domain location=7-169; Score=22.8; E_value=7.9e-08; Accession=PF00857.11; Description =Isochorismatase family
MSKLDLLDSQNSTLIFIDHQPQMAFGVANIDRQQLKNNTVALAKAGKIFDVPVIYTSVETESFSGYIWPELLAVHPESKPIERTSMNSWEDAKFVEAVEKTGRKKLIISALWTEVCLTFPALMALKAGYEVYVVTDTSGGTSVDAHERSVQRMVQAGAVPVTWQQVLLEYQRDWSRKETYDAVMDLVREHSGAYGMGVDYAYTM

SEQ ID NO: 187296 - protein, 174 aa, Glycine max
  Coding DNA Sequence Number=SeqID_70518
  Gene Ontology: Mol. function=DNA binding; Cellular component =chromosome; Biological process=chromosome organization and biogenesis (sensu Eukaryota)
  Homolog annotation: Hit_ID=O65759; Match level="QueryCoverage=67%, HitCoverage=84%, E-value=4e-40, Identity=73%"; Hit description =Histone H2AX
  Pfam annotation: Domain name=CBFD_NFYB_HMF; Domain location=32-96; Score=12.4; E_value=0.011; Accession=PF00808.13; Description=Histone- like transcription factor (CBFNF-Y) and archaeal histone
  Pfam annotation: Domain name=Histone; Domain location=26-99; Score =109.5; E_value=9.5e-30; Accession=PF00125.14; Description=Core histone H2AH2BH3H4
  Pfam module annotation: Pfam domain module=CBFD_NFYB_HMF::Histone; Domain location=32-96::26-99
  Subcellular localization annotation: CTP_CleavageSite=44; ConfidenceScore=5.58e-01
MSSTEVAATTKKGGRGKPKTTKSVSRSSKAGLQFPVGRVARYLKAGRYAQRVGSGSPVYLSAVLEYLAAEVLELAGNAARDNKKTRIVPRHIQLAVRNDEELSKLMGSVTIANGGVLPNIHQNLLPKKAAGKGKPEIGSAIDSTLIVFLVLKVVNAGADNLVVVVVWDGENSEQ

SEQ ID NO: 187297 - protein, 90 aa, Glycine max
  Coding DNA Sequence Number=SeqID_70519
MKTGEVNIGLKKDYRRCETEILSEKPHRVLRRCETENGRKSIEPATIQEVAQISCPEDGMSNEEFRQTVEAFIARQQRMRREEEEDYYLM

SEQ ID NO: 187298 - protein, 71 aa, Glycine max
  Coding DNA Sequence Number=SeqID_70520
MVKEKEVAETESERENGPECRAFDPFVGRKNNGNKERERKEREENPKPQLTRNAAKERMRGLFPSVHYRIV

SEQ ID NO: 187299 - protein, 524 aa, Glycine max
  Coding DNA Sequence Number=SeqID_70521
  Gene Ontology: Mol. function=dihydrofolate reductase activity; Cellular component=nucleus; Biological process=one-carbon compound metabolic process
  Homolog annotation: Hit_ID=Q1T5S8; Match level="QueryCoverage=99%, HitCoverage=100%, E-value=0.0, Identity=82%"; Hit description =Bifunctional dihydrofolate reductase/thymidylate synthase
  Pfam annotation: Domain name=DHFR_1; Domain location=24-201; Score =236.5; E_value=5.9e-68; Accession=PF00186.9; Description =Dihydrofolate reductase
  Pfam annotation: Domain name=Thymidylat_synt; Domain location=243 -524; Score=711.5; E_value=5.9e-211; Accession=PF00303.9; Description= Thymidylate synthase
  Pfam module annotation: Pfam domain module=DHFR_1::Thymidylat_synt; Domain location=24-201::243-524
MASDSLVISNGNGNSKSEPHPQRTYQAVVVATRDMGISKDEKLPWTLPTDLNFFEEITTTTSDPGKKNAVVMGRKTWESIPPENRPLPGRLNVVLTRSGSFDIATAENVLICGSVSSAMELLASSPYCLSIEKVFLTGGGEIFREALNAPGCEAAHITEIEASIECDTFMPRVNTSVFQTWYSSFPLVEDNLRYSFTTYVRVRSFPPESPDQNADPFFDNNSDALKFEVKKFSFLPKMVYERHEEFKYLRLVQEIISEGTTKDDRTGTGTLSKFGCQMRFNLRRNFPLLTTKKVFWRGVIEELLWFISGSTSAKVLQEKGIHIWDGNASRDIGLTDREEGDLGPVYGFQWRHFGAKYTDMHADYSGQGFDQLLDVINKIKHNPDDRRIILSAWNPSDLKLMALPPCHMFAQFYVANGELSCQMYQRSADMGLGVPFNIASYALLTCMIAHVCDLVPGDFIHVIGDAHVYRNHVRPLQEQLQNQPKPFPILKINPKKKDIDSFVASDFKLIGYVPHQKIEMKMAV

SEQ ID NO: 187300 - protein, 571 aa, Glycine max
  Coding DNA Sequence Number=SeqID_70522
  Gene Ontology: Mol. function=transporter activity; Cellular component= intracellular; Biological process=transport
  Homolog annotation: Hit_ID=Q1T5S4; Match level="QueryCoverage=95%, HitCoverage=97%, E-value=0.0, Identity=73%"; Hit description =Cellular retinaldehyde-binding/triple function, N-terminal
  Pfam annotation: Domain name=CRAL_TRIO; Domain location=149-335; Score=158.5; E_value=1.8e-44; Accession=PF00650.10; Description =CRALTRIO domain
  Pfam annotation: Domain name=CRAL_TRIO_N; Domain location=63-132; Score=46.2; E_value=1.1e-10; Accession=PF03765.5; Description =CRALTRIO, N-terminus
  Pfam module annotation: Pfam domain module=CRAL_TRIO::CRAL_TRIO_N; Domain location=149-335::63-132
MSMSSAPITDHRPVKGGLEMEYVEDDKKKKLGSLKKVAISASSKFRHSLQMKGRRHSRVVSVAIEDNVDAQELQVVDAFRQALILEELLPAKYDDHHTMLRFLRARKFDIEKTKQMWADMLQWRREFGADTIMEDFEFKERDEVQKYYPQGHHGVDKEGRPVYIEKLGQVDSNKLMQVTTMDRYLKYHVREFEKTFVVKFPACSISAKKHIDQSTTILDVQGVGLKSLNKAARDLIQRLQKIDGDNYPESLNSMFIINAGSGFRMLWNSIKSFLDPKTTSKIHVLGNKYQSKLLEIIDASELPEFLGGTCTCADKGGCMLSDKGPWNDIEILKVMVQNGEGKCKRKTLSGIEEKTIIQDEIACQKEHDPFNKESVQLGAVPEVAFVPVIDKQVNASWEKAVQNNQLAASKDCFPSDASNTFNGFRIPFTGGIITILMGVITMLRMTRNMPRKVTEATALYANPLYCDGNMMKAPAISMNDQMALMKRMAELEEKVNVLSMKPTMPPEMEELLNNALNRVNTLEQELDSTKKSLDDALARQVELQAHLDKKKKKKKFVGRLNFDTYLILFRW

SEQ ID NO: 187301 - protein, 63 aa, Glycine max
  Coding DNA Sequence Number=SeqID_70523
MARVVRIWSRARGAGNKKRMFGNHEEEEENGCTVTGIAGESQGQLTRGGGKAINWERPNDLVR

SEQ ID NO: 187302 - protein, 83 aa, Glycine max
  Coding DNA Sequence Number=SeqID_70524
MSLPEKAKRNGRKQHGIVFGQRTWGYGFMKISINSPSMISSYQLICANMLHSNIYVLYVLSPSIPPFNFAGHPKNLLAPHHHG

SEQ ID NO: 187303 - protein, 75 aa, Glycine max
  Coding DNA Sequence Number=SeqID_70525
DYMQPDIPQVPVTFDPPQHVVVIAERLKRVLYLRMVTAGTELHDIIQDCLRIARGVPAQMEVLGLNKDDAQSIDD

SEQ ID NO: 187304 - protein, 77 aa, Glycine max
  Coding DNA Sequence Number=SeqID_70526
MYVRYSRVYNEVGSLFVAEEEGRTTTNNGPRATKKMKGPRVAIQWQQRRTTNQAKHPQRKEEKEQANKKKKATQENE

SEQ ID NO: 187305 - protein, 86 aa, Glycine max
  Coding DNA Sequence Number=SeqID_70527
  Subcellular localization annotation: CTP_CleavageSite=24; ConfidenceScore=5.07e-01
MAKSNRSDATGRTSSEEPCFGRTICSTGRTLFQRSYRKKLFRQLFRKMVLLVEQNILSEKLLKEGSSEKSTGTSSSGSFSERTFFW

SEQ ID NO: 187306 - protein, 118 aa, Glycine max
  Coding DNA Sequence Number=SeqID_70528
MMTIQKDQDAIDGVMEDKGEPKDDGNTEGNGYTEEEFVEDNYYMNDDSDSEDNGGIVDGFKVLYKNKRECVKMEIVFTVDSHSLYTSVVVAPDVRDMLSAPSNVVGAPSNFLKWKNCP

SEQ ID NO: 187307 - protein, 163 aa, Glycine max
  Coding DNA Sequence Number=SeqID_70529
MKNIVWDDQLKSNNTIIDENKKGSSLELGATLKEVTCVYDVGGRKKINGLKNGLDRCEKIAKCTIVIKVSNQDSCAVNLSIQETQMCQMEIATNSSLFDPKRSLMTKSNPKSQTCTKKASFSIIGQASMAPIHIKHRGQKSSTKRIKCNVMNKNKDLNNQKYK

SEQ ID NO: 187308 - protein, 133 aa, Glycine max
  Coding DNA Sequence Number=SeqID_70530
  Gene Ontology: Mol. function=ribonuclease H activity; Cellular component=nucleus; Biological process=RNA-dependent DNA replication
  Homolog annotation: Hit_ID=Q1RYI2; Match level="QueryCoverage=93%, HitCoverage=19%, E-value=1e-15, Identity=36%"; Hit description =Ribonuclease H
  Pfam annotation: Domain name=RnaseH; Domain location=1-127; Score =12.1; E_value=4.3e-06; Accession=PF00075.14; Description=RNase H
MSEVCDGAVMEGGSKGACGSLVRDHTGAFLCGVSINIGKGSVLEEELKGILFGLKLAWSRGYRRIRVDSDSLVAIKLMSKGCCMRHPFYNLVQEIHAVHGYQGNIYWNHVLREANQVADALAKKAITTLSLYQ

SEQ ID NO: 187309 - protein, 113 aa, Glycine max
  Coding DNA Sequence Number=SeqID_70531
MRLFRSLGRKTLTSPGKSRMEDADISGESADDDSRPKDADISGEGADDNPEDTKIFGEGADYDCRNLPFGGRVTRDSRVRVPRKEYVRSLHQRLFQENVGKTGKDVIYELKVK

SEQ ID NO: 187310 - protein, 394 aa, Glycine max
  Coding DNA Sequence Number=SeqID_70532
  Gene Ontology: Mol. function=calpain activity; Cellular component =intracellular; Biological process=proteolysis
  Homolog annotation: Hit_ID=Q1SMB6; Match level="QueryCoverage=98%, HitCoverage=94%, E-value=6e-65, Identity=42%"; Hit description =Cyclin-like F-box; F-box protein interaction domain
  Pfam annotation: Domain name=F-box; Domain location=38-85; Score =39.5; E_value=1.1e-08; Accession=PF00646.23; Description=F-box domain
MMSKNTHCHSVSTQTMPETTAKIPKLVSPTGDEYPSCHSLAVLPYDLIWEILLRVPVRSLILFKCVCKSWKTLISDPQFAKDHLCISTADPNMTHQRIVARHHRDILSFSVQSLLQNPSNPAKPHSWRMSHKYCIVGSCNGLLCLSRFKHGYCRLRLWNPCTGLKSKRLSIGFYPVDITFHGLGYDHVNHRYKLLAGVVDYFETQTKIYSFGSDSSTLIQNQNLPREPIRMQGKFVSGTLNWIIEKGTSDDHQWVILSLDMVTETFGEVFLPKCVEDSEKICHPILGVSRDCLFVCFLDSKKAHWSVLMMKEYGVRDSWTKLLMTPHISIFRTQYLYPLFETLRISENGVVLLRTRTNLLLYNSNDGWLVYPRIRRKLGFDMHIYHESLVSPKS

SEQ ID NO: 187311 - protein, 974 aa, Glycine max
  Coding DNA Sequence Number=SeqID_70533
  Gene Ontology: Mol. function=protein serine/threonine kinase activity; Cellular component=integral to membrane; Biological process=protein amino acid phosphorylation
  Homolog annotation: Hit_ID=Q69X93; Match level="QueryCoverage=99%, HitCoverage=91%, E-value=0.0, Identity=53%"; Hit description =Putative receptor-like protein kinase 2
  Pfam annotation: Domain name=LRR_1; Domain location=1-23; Score=14.3; E_value=0.43; Accession=PF00560.23; Description=Leucine Rich Repeat
  Pfam annotation: Domain name=LRR_1; Domain location=122-144; Score =4.0; E_value=50; Accession=PF00560.23; Description=Leucine Rich Repeat
  Pfam annotation: Domain name=LRR_1; Domain location=146-168; Score =12.1; E_value=1.6; Accession=PF00560.23; Description=Leucine Rich Repeat
  Pfam annotation: Domain name=LRR_1; Domain location=170-192; Score =12.3; E_value=1.4; Accession=PF00560.23; Description=Leucine Rich Repeat
  Pfam annotation: Domain name=LRR_1; Domain location=194-216; Score =11.7; E_value=1.8; Accession=PF00560.23; Description=Leucine Rich Repeat
  Pfam annotation: Domain name=LRR_1; Domain location=218-240; Score =13.1; E_value=0.99; Accession=PF00560.23; Description=Leucine Rich Repeat
  Pfam annotation: Domain name=LRR_1; Domain location=242-264; Score =14.4; E_value=0.43; Accession=PF00560.23; Description=Leucine Rich Repeat
  Pfam annotation: Domain name=LRR_1; Domain location=25-47; Score =19.6; E_value=0.011; Accession=PF00560.23; Description=Leucine Rich Repeat
  Pfam annotation: Domain name=LRR_1; Domain location=266-288; Score =12.0; E_value=1.6; Accession=PF00560.23; Description=Leucine Rich Repeat
  Pfam annotation: Domain name=LRR_1; Domain location=290-312; Score =7.6; E_value=11; Accession=PF00560.23; Description=Leucine Rich Repeat
  Pfam annotation: Domain name=LRR_1; Domain location=314-336; Score =12.6; E_value=1.2; Accession=PF00560.23; Description=Leucine Rich Repeat
  Pfam annotation: Domain name=LRR_1; Domain location=338-360; Score =8.3; E_value=8; Accession=PF00560.23; Description=Leucine Rich Repeat
  Pfam annotation: Domain name=LRR_1; Domain location=362-384; Score =11.2; E_value=2.3; Accession=PF00560.23; Description=Leucine Rich Repeat
  Pfam annotation: Domain name=LRR_1; Domain location=386-408; Score =9.3; E_value=5.1; Accession=PF00560.23; Description=Leucine Rich Repeat
  Pfam annotation: Domain name=LRR_1; Domain location=410-432; Score =10.2; E_value=3.5; Accession=PF00560.23; Description=Leucine Rich Repeat
  Pfam annotation: Domain name=LRR_1; Domain location=434-456; Score =21.7; E_value=0.0026; Accession=PF00560.23; Description=Leucine Rich Repeat
  Pfam annotation: Domain name=LRR_1; Domain location=458-480; Score =13.8; E_value=0.61; Accession=PF00560.23; Description=Leucine Rich Repeat
  Pfam annotation: Domain name=LRR_1; Domain location=482-504; Score =16.5; E_value=0.098; Accession=PF00560.23; Description=Leucine Rich Repeat
  Pfam annotation: Domain name=LRR_1; Domain location=49-71; Score =19.3; E_value=0.014; Accession=PF00560.23; Description=Leucine Rich Repeat
  Pfam annotation: Domain name=LRR_1; Domain location=507-529; Score =7.9; E_value=9.5; Accession=PF00560.23; Description=Leucine Rich Repeat
  Pfam annotation: Domain name=LRR_1; Domain location=531-552; Score =13.2; E_value=0.93; Accession=PF00560.23; Description=Leucine Rich Repeat
  Pfam annotation: Domain name=LRR_1; Domain location=554-577; Score =15.0; E_value=0.28; Accession=PF00560.23; Description=Leucine Rich Repeat
  Pfam annotation: Domain name=LRR_1; Domain location=73-95; Score =13.7; E_value=0.66; Accession=PF00560.23; Description=Leucine Rich Repeat
  Pfam annotation: Domain name=LRR_1; Domain location=97-120; Score =8.8; E_value=6.4; Accession=PF00560.23; Description=Leucine Rich Repeat
  Pfam annotation: Domain name=Pkinase; Domain location=682-949; Score =110.9; E_value=3.6e-30; Accession=PF00069.15; Description=Protein kinase domain
  Pfam annotation: Domain name=Pkinase_Tyr; Domain location=682-949; Score=91.4; E_value=2.7e-24; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::Pkinase::...
  Pfam module annotation: Pfam domain module=Pkinase_Tyr; Domain location=1-23::122-144::146-168::170-192::194-216::218-240::242 -264::25-47::266-288::290-312::314-336::338-360::362-384::386 -408::410-432::434-456::458-480::...
  Pfam module annotation: Domain location=482-504::49-71::507-529::531 -552::554-577::73-95::97-120::682-949::682-949
  Subcellular localization annotation: CTP_CleavageSite=56; ConfidenceScore=5.49e-01
MLQLLNLSSTNVSGSIPPSFGQLSHLQLLDLSSNSLTGSIPAELGRLSSLQFLYLNSNRLTGSIPQHLSNLTSLEVLCLQDNLLNGSIPSQLGSLTSLQQFRIGGNPYLNGEIPSQLGLLTNLTTFGAAATGLSGAIPSTFGNLINLQTLALYDTEISGSIPPELGSCLELRNLYLYMNKLTGSIPPQLSKLQKLTSLLLWGNALTGPIPAEVSNCSSLVIFDVSSNDLSGEIPGDFGKLVVLEQLHLSDNSLTGKIPWQLGNCTSLSTVQLDKNQLSGTIPWELGKLKVLQSFFLWGNLVSGTIPSSFGNCTELYALDLSRNKLTGFIPEEIFSLKKLSKLLLLGNSLTGRLPSSVANCQSLVRLRVGENQLSGQIPKEIGQLQNLVFLDLYMNRFSGSIPVEIANITVLELLDVHNNYLTGEIPSVVGELENLEQLDLSRNSLTGKIPWSFGNFSYLNKLILNNNLLTGSIPKSIRNLQKLTLLDLSYNSLSGGIPPEIGHVTSLTISLDLSSNAFTGEIPDSVSALTQLQSLDLSHNMLYGEIKVLGSLTSLTSLNISYNNFSGPIPVTPFFRTLSSNSYLQNPQLCQSVDGTTCSSSMIRKNGLKSAKTIALVTVILASVTIILISSWILVTRNHGYRVEKTLGASTSTSGAEDFSYPWTFIPFQKINFSIDNILDCLRDENVIGKGCSGVVYKAEMPNGELIAVKKLWKASKADEAVDSFAAEIQILGYIRHRNIVRFIGYCSNRSINLLLYNYIPNGNLRQLLQGNRNLDWETRYKIAVGSAQGLAYLHHDCVPAILHRDVKCNNILLDSKFEAYLADFGLAKLMHSPNYHHAMSRVAGSYEYGYSMNITEKSDVYSYGVVLLEILSGRSAVESHVGDGQHIVEWVKRKMGSFEPAVSILDTKLQGLPDQMVQEMLQTLGIAMFCVNSSPAERPTMKEVVALLMEVKSQPEEMGKTSQPLIKQSSNQS

SEQ ID NO: 187312 - protein, 234 aa, Glycine max
  Coding DNA Sequence Number=SeqID_70534
  Gene Ontology: Mol. function=transferase activity, transferring glycosyl groups; Cellular component=cytoplasm; Biological process =purine ribonucleoside salvage
  Homolog annotation: Hit_ID=Q8L8L7; Match level="QueryCoverage=79%, HitCoverage=99%, E-value=1e-61, Identity=60%"; Hit description =Hypoxanthine ribosyl transferase, putative
  Pfam annotation: Domain name=Pribosyltran; Domain location=53-192; Score=88.7; E_value=1.8e-23; Accession=PF00156.17; Description =Phosphoribosyl transferase domain
MEGEGPKKGEGGWGGRGGGRKKGKGKGQKNRLERGWLQRNASHKPFLLAMHSHIERILWSEDQISRRVSELAAEISADFGGQSPAPVVVGVATGAFLFLADLVRKIDLSIAVDFVRVESYGFGTVSNGAPTISFDLKVDVNARHVIVVEDIVDTGHTLSKVIGHLKSKGVSSVSVCTFLDKPARRKVHFQLLGEGKYYRGFECPDYFVVGYGLDFAELYRNLPYIGVLKPELYK

SEQ ID NO: 187313 - protein, 158 aa, Glycine max
  Coding DNA Sequence Number=SeqID_70535
MLQPYEISIGLKEHSNPVAPKAYTLKSPSGPLPPDSAIATSLAVPGNSFNYSSDCSDRIPKRKRDGEEIETSTCTVFHTIPFSPSTNIISQIPTVEASGFLRERKRLQCEGFFSQFRHDIEIPNGENARNCVVNMILKFHDDPTVNGFEIVIFLRLVW

SEQ ID NO: 187314 - protein, 50 aa, Glycine max
  Coding DNA Sequence Number=SeqID_70536
MSERWYWREEFLEPLRRDRERGVSAGMERGVSAGMERGERGEHRDEINTN

SEQ ID NO: 187315 - protein, 113 aa, Glycine max
  Coding DNA Sequence Number=SeqID_70537
MNLNIFCVVHTFSGSFCRSLVYLLPQILPKTSALVQLPAVVSGDCIGKEEEKEGDCVRISIGSLSLLHSCKVSHSSLSLGTISPSALFRKRCRSQASVDELPEAVQKQSALET

SEQ ID NO: 187316 - protein, 141 aa, Glycine max
  Coding DNA Sequence Number=SeqID_70538
  Gene Ontology: Mol. function=nucleotide binding; Cellular component =membrane; Biological process=small GTPase mediated signal transduction
  Homolog annotation: Hit_ID=Q43463; Match level="QueryCoverage=88%, HitCoverage=60%, E-value=3e-61, Identity=88%"; Hit description=Ras -related protein Rab7
  Pfam annotation: Domain name=Ras; Domain location=8-134; Score=111.5; E_value=2.4e-30; Accession=PF00071.12; Description=Ras family
MTDLSLYKWVSFPVSTIWDTAGQERFQSLGVAFYRGADCCVLVYDVNVMKSFDTLENWHEEFLKQANPPDPRAFPFILLGNKIDIDGGNSRVVSEKKAKDWCASKGNIPYFETSAKEDYNVDAAFLCIAKAALANEHEQDM

SEQ ID NO: 187317 - protein, 207 aa, Glycine max
  Coding DNA Sequence Number=SeqID_70539
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=99%, HitCoverage=100%, E-value=3e-92, Identity=67%"; Hit description =Probable F-actin capping protein subunit beta
  Pfam annotation: Domain name=F_actin_cap_B; Domain location=1-207; Score=230.0; E_value=5e-66; Accession=PF01115.8; Description=F-actin capping protein, beta subunit
MEAVMGLMRRIPPKHTETALSALLSLMPHHSSDLLSQVDQPLQVLCDVECGKEFILCEYNRDADSYRSPWSNKYHPPLEDGSLPSSELRKLEIEANDIFAIYRDQYYEGGISSVYMWEDDNEDGSKTGQGRRGYLEEGAWDAIHVIEMSMKLSVADGHLCNMGRMIEEMESKLRNSLDQVYFGKTREMVCTLRPPSEVAQMRMPDSA

SEQ ID NO: 187318 - protein, 323 aa, Glycine max
  Coding DNA Sequence Number=SeqID_70540
  Gene Ontology: Mol. function=oxidoreductase activity; Cellular component=vacuole; Biological process=hydrogen peroxide catabolic process
  Homolog annotation: Hit_ID=Q02200; Match level="QueryCoverage=92%, HitCoverage=92%, E-value=1e-111, Identity=68%"; Hit description =Lignin-forming anionic peroxidase precursor
  Pfam annotation: Domain name=peroxidase; Domain location=43-287; Score=457.4; E_value=1.8e-134; Accession=PF00141.13; Description =Peroxidase
MAYRTSSITSSLVTLVLLGTILCDAELSSTFYDSACPIALSTIRTVIRSAVSAERRMAASLIRLHFHDCFVQGCDASILLDDSSSIESEKSALQNANSIRGYNIIDQAKSEVEKLCPGVVSCADIVAVAARDASFAVGGPSWTVKLGRRDSTTASKSSATSDLPRFTDDLDTLISRFNNKGLTARDMVTLSGAHTIGQAQCFTFRGRIYNNASDIDAGFASTRQRGCPSVSNDDNDKKLASLDLVTPNSFDNNYFKNLIQKKGLLQSDQVLFSGGSTDSIVSEYSNKPTTFKSDFAAAMIKMGDIQPLTASAGIIRKICSSIN

SEQ ID NO: 187319 - protein, 56 aa, Glycine max
  Coding DNA Sequence Number=SeqID_70541
MKITDIRGFLVRQHSNGVHEPKACKTVNGVICSCKCESGLPIRLDLAFTSFDSCRK

SEQ ID NO: 187320 - protein, 205 aa, Glycine max
  Coding DNA Sequence Number=SeqID_70542
  Homolog annotation: Hit_ID=Q1SMB6; Match level="QueryCoverage=36%, HitCoverage=19%, E-value=7e-12, Identity=49%"; Hit description =Cyclin-like F-box; F-box protein interaction domain
IPPTHKLPWLPGGMTREILNHLATITICTKAKAIVSETTPRRNHDLEFFGLRSDGRVAQYDMGIEEFCSSECTEYDTSLEEVNCWWAMFGWAIEVRRRCMANWGWEIRVFHDLQTHLNCRRDLTGTLKRISEMSSSVYVVKLKILPRIGREVKTLNLGIITRKPKGGTIGSAIEGVGGNRPGVVWWSSSCNMEDLQRDKEKVTNG

SEQ ID NO: 187321 - protein, 340 aa, Glycine max
  Coding DNA Sequence Number=SeqID_70543
  Gene Ontology: Mol. function=pseudouridylate synthase activity; Biological process=tRNA processing
  Homolog annotation: Hit_ID=Q75M65; Match level="QueryCoverage=41%, HitCoverage=34%, E-value=2e-26, Identity=46%"; Hit description =Putative pseudouridine synthase
  Pfam annotation: Domain name=PseudoU_synth_1; Domain location=86-178; Score=9.4; E_value=0.001; Accession=PF01416.10; Description=tRNA pseudouridine synthase
MATQLSDAELITSLQARVKELETENAKLLSQLADCRSHEMEKKVYVPDERGGKSKKGNRKSEEKIEKMPGYNTRFMSHHSRRYVALKVMYFGKRFYGFASEAQMEPTVESELFKAFEKTRLLVGNKKESQYSRCGRTDKGVSSVGQSIDLYGKCYGRKDEVLLLSASIEIERTIEEISKQTSNWIGTSVIVAKLSALVFFKWSNEFGSLILLVIALFLRSNLKISETNNGNSGVVLDEQHEGEIDYVRVLNRVLPNDIRIMGWCPAPVDFHASPKGLGMRGCIGKNPSPTLAGDKDKIEYISEVHPSPHELAFGIELGPNPHSKSNAGQGNYFPLWPHWT

SEQ ID NO: 187322 - protein, 194 aa, Glycine max
  Coding DNA Sequence Number=SeqID_70544
  Subcellular localization annotation: CTP_CleavageSite=49; ConfidenceScore=5.35e-01
MEEKRRDAAPSAADSPASEPATSRRRAGANKRKSGALSASGSSSAPSKRASRDKASPLHPPPLHNGPLTRARQTPNNLASASSSAGASAPAAVKRSERAHPSAAESAALAEQLKKESEWETLEAAIEAEFEAIRSRGANAHVVPTHSGETLCLFSNPNLLLFRFRASIAVDSVRKHHVFDFMSFLFTFCSGMNE

SEQ ID NO: 187323 - protein, 881 aa, Glycine max
  Coding DNA Sequence Number=SeqID_70545
  Gene Ontology: Mol. function=metal ion binding; Cellular component =nucleus; Biological process=regulation of transcription, DNA -dependent
  Homolog annotation: Hit_ID=Q53K34; Match level="QueryCoverage=86%, HitCoverage=79%, E-value=1e-107, Identity=33%"; Hit description=Myb -like DNA-binding domain, putative
  Pfam annotation: Domain name=Myb_DNA-binding; Domain location=227 -272; Score=51.5; E_value=2.7e-12; Accession=PF00249.21; Description =Myb-like DNA-binding domain
  Pfam annotation: Domain name=SWIRM; Domain location=3-94; Score=53.0; E_value=9.7e-13; Accession=PF04433.7; Description=SWIRM domain
  Pfam annotation: Domain name=ZZ; Domain location=167-211; Score=28.6; E_value=2.2e-05; Accession=PF00569.8; Description=Zinc finger, ZZ type
  Pfam module annotation: Pfam domain module=Myb_DNA-binding::SWIRM::ZZ; Domain location=227-272::3-94::167-211
MTLRIARSLLAPGWFSWSCIHPIEKQMLPSFFNSKTDNRTPDVYMEIRNWIMKKFHSNPNVQIELKDMSQLNVGDSDARQEVMEFLDYWGLINFHPFPSMDSAMATGSDDGEAEKNSLLEKLYHFETLQLCPPVQRSSQMTPATTSGLFPESTIAEELVKQEGPAVEMLEYHCNSCSADCSRKRYHCQKQADFDLCTDCFSNRRFGSGMSSLDFILMEPAEVAGVNGGKWTDQETLLLLEALELYKENWNEIAEHVGTKTKAQCILHFVQMPIEDTFVDCDDDVVAVCKETVDPVATNNDSSMDKDASECIENDTSDGIKDNDKTSKAEDLEVKVNQEETTKLQEGSDEKSTEGTSKSEDAVKVKIDQEAGNDCAINALKEAFAAVGYSPGPEGPSSFAEVGNPVMALATFLAHLVGSDVAVASAHSSIKSMSRNSPGTELAARCCFLLKDPPDNEKEPTNSERDSKSEGDQDEVNVKQDKPTLEDKDLPNDHSNTKIETNALEVKGQPASTDDGALEKPISSKEQAVSNHEGGLDNGNDPNNAKLPNDQAPATLHNSGGSTSKAEIPLCSDKAQEETLIEESCPSVKDKHVSDSLLSDTSKDAEMVSNSIPSTKSKPQNPEPTNPACESLETTDSVMDVDGVSNSLPSEKIDSQPLITSKSSQCNGTEKDVDMMSPSNPVVSNSGAENGPNTGKDHADNGAKVEDDGTETKQDSSFEKVKRAAVSTLAAAAAKAKLLANQEEDQIRQLTSLLIEKQLHKLETKLAFFNDVENVVMRAREHVERSRHKLYHERALIIASRLGIPPSSSRGVPPSITTNRIPTNIANSLPRPQMMMNPPRPLISRPAGTVATTLQNPLVSSTAAGNSVRPSNQEKLSSVGTK

SEQ ID NO: 187324 - protein, 57 aa, Glycine max
  Coding DNA Sequence Number=SeqID_70546
MAGLKFFRDLEFDWTPLALHRVVIKAGNPSLDVSCCAVTSNVWEVAIRLEKEITPHV

SEQ ID NO: 187325 - protein, 207 aa, Glycine max
  Coding DNA Sequence Number=SeqID_70547
  Gene Ontology: Mol. function=nucleotide binding; Cellular component =membrane; Biological process=small GTPase mediated signal transduction
  Homolog annotation: Hit_ID=P31022; Match level="QueryCoverage=99%, HitCoverage=100%, E-value=5e-87, Identity=73%"; Hit description=Ras -related protein Rab7
  Pfam annotation: Domain name=Arf; Domain location=3-153; Score=-93.5; E_value=0.015; Accession=PF00025.11; Description=ADP-ribosylation factor family
  Pfam annotation: Domain name=MMR_HSR1; Domain location=9-105; Score= -3.8; E_value=0.0022; Accession=PF01926.13; Description=GTPase of unknown function
  Pfam annotation: Domain name=Miro; Domain location=10-105; Score =28.6; E_value=9e-06; Accession=PF08477.3; Description=Miro-like protein
  Pfam annotation: Domain name=Ras; Domain location=10-155; Score =203.3; E_value=5.5e-58; Accession=PF00071.12; Description=Ras family
  Pfam module annotation: Pfam domain module=Arf::MMR_HSR1::Miro::Ras; Domain location=3-153::9-105::10-105::10-155
MPSRRRTLLKVIILGDSGVGKTSLMNQYPSVSVYKLRIWDTAGQERFQSLGVAFYRGADCCVLVYDVNSMKSFDNLNNWREEFLIQASPSDPENFPFVVIGNKIDIDGGNSRVVSEKKARAWCASKGNIPYFETSAKEGLNVEEAFQCIAKNALKSGEEEELVLKLKWDIFVNNLERAPVKLHMQGYLPDTIDVGNSSQPRATGCEC

SEQ ID NO: 187326 - protein, 61 aa, Glycine max
  Coding DNA Sequence Number=SeqID_70548
  Homolog annotation: Hit_ID=Q1SR77; Match level="QueryCoverage=85%, HitCoverage=6%, E-value=6e-14, Identity=75%"; Hit description=AMP -dependent synthetase and ligase
MEFNSNLGDLMELSPLFSDDSRVVDAASIAQKLWSFAKEDIRRHETPVPLAIGVEARFIAS

SEQ ID NO: 187327 - protein, 105 aa, Glycine max
  Coding DNA Sequence Number=SeqID_70549
  Gene Ontology: Mol. function=protein serine/threonine kinase activity; Cellular component=nucleus; Biological process=protein amino acid phosphorylation
  Homolog annotation: Hit_ID=Q8GZR5; Match level="QueryCoverage=84%, HitCoverage=21%, E-value=5e-39, Identity=86%"; Hit description =Mitogen-activated protein kinase
MTTKGSSSSAASSASGDAKIKRVLTHGGKYAQYNVYGNLFEVSSKYVPPIRPIGRGVNGIVCAAVNSETHEQVAIKKIGNAFDNIIDAKRTLREIKLLRHMDHDN

SEQ ID NO: 187328 - protein, 138 aa, Glycine max
  Coding DNA Sequence Number=SeqID_70550
  Gene Ontology: Mol. function=phosphoprotein phosphatase activity
  Homolog annotation: Hit_ID=P55798; Match level="QueryCoverage=99%, HitCoverage=62%, E-value=1e-33, Identity=53%"; Hit description =Serine/threonine-protein phosphatase 1
MALDALQGDDPMLWMMNGGDWFWQLSGARLIAARHALKRCADLPLILHLQFEERVIVIAHADYPASAYALGQDVDWHQVVWSRDRLARHQRGRSQPIAGASAFYFGHTPLEQPLKAANQHYIDTGAVFGNRLTLVQLQ

SEQ ID NO: 187329 - protein, 40 aa, Glycine max
  Coding DNA Sequence Number=SeqID_70551
MAKLKSHHYMCCGQRRKLIAVVANLPSRWDSVPLSKEVRV

SEQ ID NO: 187330 - protein, 226 aa, Glycine max
  Coding DNA Sequence Number=SeqID_70552
  Gene Ontology: Mol. function=DNA binding; Cellular component=nucleus; Biological process=regulation of transcription
  Homolog annotation: Hit_ID=Q8LRL8; Match level="QueryCoverage=90%, HitCoverage=28%, E-value=2e-80, Identity=69%"; Hit description=Nam -like protein 7
  Pfam annotation: Domain name=NAM; Domain location=19-179; Score =221.5; E_value=1.8e-63; Accession=PF02365.6; Description=No apical meristem (NAM) protein
MGEASGAGSADCFSQMMSSMPGFRFHPTDEELVMYYLKRKICGKRLKLDVIRETDVYKWDPEDLPEVVGFEMRVEIFMLLILVMFDAHMVRVPIVDLGQSILKTGDRQWFFFCHRDRKYPNGGRSNRATRRGYWKATGKDRNVICNSRSVGVKKTLVFYAGRAPSGERTDWVMHEYTLDEEELKRCLGVKDYYALYKVYKKSGPGPKNGEQYGAPFNEEQWADDDI

SEQ ID NO: 187331 - protein, 241 aa, Glycine max
  Coding DNA Sequence Number=SeqID_70553
  Gene Ontology: Mol. function=oxidoreductase activity; Cellular component=intracellular; Biological process=lignin catabolic process
  Homolog annotation: Hit_ID=Q84J37; Match level="QueryCoverage=99%, HitCoverage=42%, E-value=7e-76, Identity=55%"; Hit description =Putative laccase (Diphenol oxidase) family protein
  Pfam annotation: Domain name=Cu-oxidase_2; Domain location=89-225; Score=161.6; E_value=2e-45; Accession=PF07731.4; Description =Multicopper oxidase
FNDTRAVLDFITSLRGLPERYPRQVPTNITTQIVTTISVNTLPCPNGRTCQGPNGTIFAASMNNISFDTPNIDILKAYYYHINGVFKPGFPRFPPFIFNFTGDFLPITLNIPKQGTRVNVLNYGATVEIVFQGTNVIAGIDHPMHLHGFSFHVVGYGLGNFNQSKDPKNFNLVDPPYLNTVIVPVNGWAAVRFVATNPGVWFMHCHLERHQVWGMETVFIVKNGKASNETLPPPPPDMPLC

SEQ ID NO: 187332 - protein, 563 aa, Glycine max
  Coding DNA Sequence Number=SeqID_70554
  Gene Ontology: Mol. function=oxidoreductase activity; Cellular component=intracellular; Biological process=lignin catabolic process
  Homolog annotation: Hit_ID=Q84J37; Match level="QueryCoverage=97%, HitCoverage=96%, E-value=1e-178, Identity=55%"; Hit description =Putative laccase (Diphenol oxidase) family protein
  Pfam annotation: Domain name=Cu-oxidase; Domain location=156-308; Score=184.1; E_value=3.5e-52; Accession=PF00394.12; Description =Multicopper oxidase
  Pfam annotation: Domain name=Cu-oxidase_2; Domain location=411-547; Score=159.4; E_value=9.1e-45; Accession=PF07731.4; Description =Multicopper oxidase
  Pfam annotation: Domain name=Cu-oxidase_3; Domain location=30-146; Score=199.0; E_value=1.1e-56; Accession=PF07732.5; Description =Multicopper oxidase
  Pfam module annotation: Pfam domain module=Cu-oxidase::Cu-oxidase _2::Cu-oxidase_3; Domain location=156-308::411-547::30-146
MTCGKNLFLQILWCFSLIGLSSQAQNYTFVVTEVKYTRLCSTKNILTVNGEFPGPTIRATRGDTIFVDVYNKGNFNITLHWHGVKQPRNPWTDGPSYITQCPIQPGRKFTQRLIFTFEEGTIWWHAHSEWLRATVYGAIYIYPNKNTPYPFPQPDAEIPIIFGEWWTSDVNEVFRQSMESGAAPSVSDALTINGQPGDLLPCSSPETFKLNVEQGKTYHLRVINAAVNLILFFSVSQHNLTVVAADAVYSRPFTRDYICISPGQAMDVLLHANQEPGHYYLAARAYSSGVGVAFDNTTTTARIEYSGNYTPPSSPSLPNLPDFNDTRAALDFITNLRGLPERAPSQVPKNITTQIVTTISVNTLPCPNGRTCQGPNGTIFAASMNNISFDTPNIDILKAYYYHINGVFKPGFPRFPPFIFNFTGDFLPITLNTPKQGTRVNVLNYGATVEIVFQGTNLVGGIDHPIHLHGYSFHVVGYGLGNFNQSVDPMNFNLVDPPYLNTVVVPINGWAAIRFEAVNPGVWFMHCHLERHQSWGMETVFIVKDGESENLRLPPPPPDMPPC

SEQ ID NO: 187333 - protein, 200 aa, Glycine max
  Coding DNA Sequence Number=SeqID_70555
  Gene Ontology: Mol. function=oxidoreductase activity; Biological process=electron transport
  Homolog annotation: Hit_ID=Q9SZ83; Match level="QueryCoverage=74%, HitCoverage=45%, E-value=8e-39, Identity=54%"; Hit description =Probable oxidoreductase At4g09670
MKLLMIHRVKGYEAFISYSFKRRGGYVCFPRLMSSLVFWVVQDGIVLGQSCWLPTTYELPKTVVASYEPVLNKDVVILDCGASLYWEDGKVATFHCSFLANLTMDITAIGTRGTLHVHDFVIPYHEKEASFLAGTETGFNDLVTGWDKQPSKNTVTTDLPQEALLVKEFAGWSEKSNSKTPSLTRSVQLLLGKRNWYWML

SEQ ID NO: 187334 - protein, 44 aa, Glycine max
  Coding DNA Sequence Number=SeqID_70556
MATQSYLLNLNTFHVHAGIRGRQCKPLIFKPTNFGFGVWNFEMG

SEQ ID NO: 187335 - protein, 193 aa, Glycine max
  Coding DNA Sequence Number=SeqID_70557
  Homolog annotation: Hit_ID=Q9SZ83; Match level="QueryCoverage=38%, HitCoverage=21%, E-value=7e-15, Identity=51%"; Hit description =Probable oxidoreductase At4g09670
  Subcellular localization annotation: CTP_CleavageSite=77; ConfidenceScore=5.80e-01
MPPLSRRSSATALRSNLRRVAAPPPPSWPSPSLWSLEVTANLRRVRSPPPPSLSREVPSLLLHRRQASPLTSRAFFVATNLVAKVHGLTDYESVMTLRIDNPYRLYLRVFLVFHPGLQNAVELYHVERHGLFQEQVVFVLGRKHGPVKMEAGGEWDVDSVHVEDLVGAVHFGGEREAIGGGKCDGPFWWERLA

SEQ ID NO: 187336 - protein, 67 aa, Glycine max
  Coding DNA Sequence Number=SeqID_70558
MSGGGHGNQQKQNQNVVGGRTSWIDRDRSRGGNIGGATGAPPKPPRLLDFGDEGGSRVGEETISDNA

SEQ ID NO: 187337 - protein, 516 aa, Glycine max
  Coding DNA Sequence Number=SeqID_70559
  Gene Ontology: Mol. function=nucleic acid binding; Cellular component= oxygen evolving complex; Biological process=DNA integration
MWGECVKTVVFLMNRTPSPILQHKSAYEILHQQLPNYSDFRTFGTLCYASTLLSTRHKFSPRATATVFIGYPHGYKGYKLLDLTTLETFISRDVKFFEHMFPFKDKDSTTRSTNPLNPHITPNLITPSTCDDFDPTHTQHHPDNQPSIQNNIQPNPPSENQLRRSTRQCGQPKYLTDYHCYNTYKQDIKFPHWKQVIQAELTTMDLNNTWTITQLPPNKKPITSKWLLKLKLNSDETVAKHKARLVVRGFTQQYGLDFKETFSPVAKITTLRLLWLNKSIYGLKQASRSWFNKFCTTLTSQKYIQSKHDYTLFTKGTGSSFIAILVYVDDIVIASLDKTSIHSTKIMLQQYFKLKDLGNLKFFLGLELSRSQVGIFMCQRHYTMSILEDTGMLACKPSTVHMEADLKLNAESGSQLPDPETYRRLIGRLLYLTISRPDICYTVHKLIQLVFDPCSGHMNAANILLRYLKHTARQGVLFKIHAYVDADWGSCLDSRKLTTGYCVFLGNSLISWKAKK

SEQ ID NO: 187338 - protein, 139 aa, Glycine max
  Coding DNA Sequence Number=SeqID_70560
  Gene Ontology: Mol. function=nucleic acid binding; Biological process= DNA integration
MSLQQGTNDINTYYTKLKSIWEELASYKQTFSCTCEGQSNVFSLILQEEAQREIVVTHSPTNALNSIAFSVNSASKNQYDNNKGKYIKKERPKCAHCDMLGHTKDKCYKLMGYPPNYFKDCTSNSVNQVQHTPESSPPV

SEQ ID NO: 187339 - protein, 295 aa, Glycine max
  Coding DNA Sequence Number=SeqID_70561
  Gene Ontology: Mol. function=oxidoreductase activity; Cellular component=intracellular; Biological process=lignin catabolic process
  Homolog annotation: Hit_ID=Q84J37; Match level="QueryCoverage=94%, HitCoverage=49%, E-value=1e-105, Identity=61%"; Hit description =Putative laccase (Diphenol oxidase) family protein
  Pfam annotation: Domain name=Cu-oxidase; Domain location=157-294; Score=135.6; E_value=1.4e-37; Accession=PF00394.12; Description =Multicopper oxidase
  Pfam annotation: Domain name=Cu-oxidase_3; Domain location=31-147; Score=192.5; E_value=1e-54; Accession=PF07732.5; Description =Multicopper oxidase
  Pfam module annotation: Pfam domain module=Cu-oxidase::Cu-oxidase_3; Domain location=157-294::31-147
  Subcellular localization annotation: CTP_CleavageSite=33; ConfidenceScore=5.03e-01
MSFGKKLFLQILWWFSLIGLSSQIRSHYSFVVREANYTRLCSTKSILTVNGNFPGPTIKVHRGETIFVNVYNKGNYNITLHWHGVKQPRNPWTDGPAYITQCPIQPGRRFRQKLIFSTEEGTIWWHAHSDWSRATIHGAIYVYPTKNTPYPFPKAHAEIPIIFSEWWKSDINEVFTQFIESGGGPNISDALTINGQPGDLYPCSMTETFEFHVEQGRTYLLRVVNAAMNLILFFSVSKHNLTVVGADGMLTKPLTREYICISPGQTMDVLLHANQEPDHYYLAARAYSSGVGVAL

SEQ ID NO: 187340 - protein, 162 aa, Glycine max
  Coding DNA Sequence Number=SeqID_70562
  Gene Ontology: Mol. function=transcription factor activity; Cellular component=nucleus; Biological process=regulation of transcription, DNA-dependent
  Homolog annotation: Hit_ID=Q6Z4V0; Match level="QueryCoverage=75%, HitCoverage=74%, E-value=2e-24, Identity=51%"; Hit description =Putative AP2/EREBP transcription factor LEAFY PETIOLE
  Pfam annotation: Domain name=AP2; Domain location=33-97; Score=96.9; E_value=6e-26; Accession=PF00847.10; Description=AP2 domain
  Subcellular localization annotation: CTP_CleavageSite=27; ConfidenceScore=5.15e-01
MSQTTAQVSKTKPMENLSPLIYKNPIRRTSRRSTMYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQIFGSNEAMACLLSNQ

SEQ ID NO: 187341 - protein, 103 aa, Glycine max
  Coding DNA Sequence Number=SeqID_70563
MEGSSPSIEEERTATFYVYHPCYFLQQALRALLKCVGIDESENTMCSQANKQEKSSLPQTPSADDPITNSPTHKSSPDAADPPSTTNQTIVRGIVGTYFDALM

SEQ ID NO: 187342 - protein, 102 aa, Glycine max
  Coding DNA Sequence Number=SeqID_70564
NLQDSGTLKRVAWGLDVGTRVKVRCGGWRRQTRYAKGGGYVADMDEDEWMYEIMSERADMDYENEEACGANEPHVDCLDAFNTSQDALWWARSVVHENGFVA

SEQ ID NO: 187343 - protein, 67 aa, Glycine max
  Coding DNA Sequence Number=SeqID_70565
MKELIWCGVDLNTKGFICENAATVQTLRQRHDFSISGFIQVRIQRLILKLQIMTRNEDKERIPEGRG

SEQ ID NO: 187344 - protein, 81 aa, Glycine max
  Coding DNA Sequence Number=SeqID_70566
MVTSILQLDSMNLFVKARTWFNPITQGMTILIANTSSTIHRDERLGNMHAMHGKCNYEIEMPEETSFLSQPCIRGKHKGHT

SEQ ID NO: 187345 - protein, 197 aa, Glycine max
  Coding DNA Sequence Number=SeqID_70567
  Gene Ontology: Cellular component=integral to membrane; Biological process=cell division
  Homolog annotation: Hit_ID=Q6CZR0; Match level="QueryCoverage=100%, HitCoverage=59%, E-value=2e-30, Identity=40%"; Hit description=DamX protein
MDEFKPEDELKPDASDRRPTRPRKSSSAPKAKVPVSRQHMMMGIGILVLLILVLGIGSALTGPDEKKPASNSASTGSAAPAGGGSEKNIDLSGSTTMSGQQNATPSAEGTAGNAAPAGSDGQSISMPSVSSTPTQAAPVDTPANQQRVTLPGDLNTALNNQQGSVDAAAQGAQGNSSLPTAPATVSGSAGKAVTPPA

SEQ ID NO: 187346 - protein, 148 aa, Glycine max
  Coding DNA Sequence Number=SeqID_70568
  Gene Ontology: Mol. function=3-dehydroquinate synthase activity; Biological process=aromatic amino acid family biosynthetic process, shikimate pathway
  Homolog annotation: Hit_ID=P07639; Match level="QueryCoverage=97%, HitCoverage=40%, E-value=4e-57, Identity=73%"; Hit description=3 -dehydroquinate synthase
  Pfam annotation: Domain name=DHQ_synthase; Domain location=1-112; Score=-16.9; E_value=1.3e-08; Accession=PF01761.10; Description=3 -dehydroquinate synthase
MAYCIRRCCELKADVVAADERETGLRALLNLGHTFGHAIEAHMGYGNWLHGEAVAAGMVMAARTAERLGQFSAADTDRIIALLQRAGLPVNGPASMTAEAYLPHMMRDKKVLGGELRLVLPLAIGRSEVRGGVAHDMVLAAINDCKVS

SEQ ID NO: 187347 - protein, 39 aa, Glycine max
  Coding DNA Sequence Number=SeqID_70569
MVHASYDMGNSINCGSMYFVLGGYFLGIGYGTYHIASES

SEQ ID NO: 187348 - protein, 329 aa, Glycine max
  Coding DNA Sequence Number=SeqID_70570
  Gene Ontology: Mol. function=oxidoreductase activity; Biological process=electron transport
  Homolog annotation: Hit_ID=UPI00005F80AF; Match level="QueryCoverage =88%, HitCoverage=86%, E-value=1e-126, Identity=75%"; Hit description= COG0673: Predicted dehydrogenases and related proteins
  Pfam annotation: Domain name=GFO_IDH_MocA; Domain location=42-164; Score=132.1; E_value=1.5e-36; Accession=PF01408.12; Description =Oxidoreductase family, NAD-binding Rossmann fold
  Pfam annotation: Domain name=GFO_IDH_MocA_C; Domain location=176-279; Score=41.9; E_value=2.2e-09; Accession=PF02894.8; Description =Oxidoreductase family, C-terminal alphabeta domain
  Pfam annotation: Domain name=Semialdhyde_dh; Domain location=43-151; Score=-14.5; E_value=0.0098; Accession=PF01118.15; Description =Semialdehyde dehydrogenase, NAD binding domain
  Pfam module annotation: Pfam domain module=GFO_IDH_MocA::GFO_IDH_MocA_ C::Semialdhyde_dh; Domain location=42-164::176-279::43-151
MVHKYFSWWHVGLAQASTSERTQQVADKLNQHSQQARVIMTLKLGVIGTGAIGQEHIRRCNNVLQGAKVVAVSDINVEGARAALQRLNIQAEVYQDGHQVINSPEVDAVLVTSWDPTHEEFTLAAIAAGKPVFCEKPLALSAEGCRRIVDAEIAHGKRLVQVGFMRPYDAGYRALKKVITDGDIGEPLMLHCAHRNQSVGENYTTDMAITNTLIHELDVLRWLTEDDYKSVQVVFPRTTSKSHAKLKDPQIVLFETQKGIRIDVEIFVNCAYGYDIQCEVVGEEGIARLPEPSAIQMRKDARLGNALLTDWKDRFIDAYDVELQAFIND

SEQ ID NO: 187349 - protein, 198 aa, Glycine max
  Coding DNA Sequence Number=SeqID_70571
  Gene Ontology: Mol. function=transcription factor activity; Cellular component=intracellular; Biological process=regulation of transcription, DNA-dependent
  Homolog annotation: Hit_ID=UPI00005F80AC; Match level="QueryCoverage =97%, HitCoverage=69%, E-value=1e-83, Identity=83%"; Hit description =COG1737: Transcriptional regulators
  Pfam annotation: Domain name=SIS; Domain location=62-189; Score =120.1; E_value=6.2e-33; Accession=PF01380.12; Description=SIS domain
MEETVNYTERARLFRQTATDDCASSAESPVDILNVFTMVNSQALQQLAMLVNPDQLNKAVKMLNEAENIYIIGLRRSFSVASYLVYALRHLERRAFLIDGLGGMFTEQLNMVNPKDVVIAISYSPYAREAVELVELGAKRGAHQIAITDSQVSPLAAFSDVCFVVREAQVDGFRSQVASLCLAQTLAVSLALNNSSNE

SEQ ID NO: 187350 - protein, 45 aa, Glycine max
  Coding DNA Sequence Number=SeqID_70572
MAANFTSACAVVSLIVPICFFLYMWYPLRGYDAVRVGGENAPDAK

SEQ ID NO: 187351 - protein, 557 aa, Glycine max
  Coding DNA Sequence Number=SeqID_70573
  Gene Ontology: Mol. function=methylmalonate-semialdehyde dehydrogenase (acylating) activity; Cellular component=integral to membrane; Biological process=valine metabolic process
  Homolog annotation: Hit_ID=Q8ZK61; Match level="QueryCoverage=52%, HitCoverage=58%, E-value=1e-127, Identity=77%"; Hit description =Putative NAD-dependent aldehyde dehydrogenase
  Pfam annotation: Domain name=Aldedh; Domain location=1-273; Score =29.5; E_value=5.8e-17; Accession=PF00171.12; Description=Aldehyde dehydrogenase family
  Pfam annotation: Domain name=IolB; Domain location=305-551; Score =572.3; E_value=4.8e-169; Accession=PF06845.2; Description=Myo -inositol catabolism protein IolB
  Pfam module annotation: Pfam domain module=Aldedh::IolB; Domain location=1-273::305-551
AEQLYKDPRIAAVSFVGSSGVAEHIYKTASAHGKRVQAFGAAKNHAIVMPDADLDATVNAIMGGAFGSAGERCMALPVVVAVGDDTADKLISRLTPLIKALRVGPGMQQGAEENEMGPVVSAAHQKKVLGYIDKGEQEGATLVVDGRGVKVAGHEEGYYVGGTLFDNVTPKMVIWREEIFGPVLSIMRASDFDSALQLVNSHEFGNGSAIFTSNGHTAREFVHNVEAGMVGVNVPVPVPMAFHSFGGWKRSVFGALNVHGPDGVRFYTRMKTATVRWPSGQQTVSEFSMPTLVQQPDSHGRIQHVTPESAGWEYVGFDAYLLKKGQTLRLSSGERELCLVLVAGLASVKTRDAEFPGIGKRLSPFERTPPYSVYVPHHDEVEVTADSDLELAVCSAPGSGNLPARLIAPQDVGVEHRGKGRNQRLVHNILPDNQPADSLLVVEVYTDEGATSSYPSHKHDEKDSPDETYLEETYYHRFDPEPGFAMQRVYTDDRSLDECMAPYNRDVVTVPRGYHPVATLAGYDNYYLNVMAGPVRLWKFTWEKDHAWVNSEQYPRR

SEQ ID NO: 187352 - protein, 692 aa, Glycine max
  Coding DNA Sequence Number=SeqID_70574
  Gene Ontology: Mol. function=kinase activity; Biological process=D -ribose metabolic process
  Homolog annotation: Hit_ID=UPI00005F80AD; Match level="QueryCoverage =85%, HitCoverage=92%, E-value=0.0, Identity=76%"; Hit description =COG0524: Sugar kinases, ribokinase family
  Pfam annotation: Domain name=PfkB; Domain location=100-418; Score =146.2; E_value=8.8e-41; Accession=PF00294.14; Description=pfkB family carbohydrate kinase
MKIKFGAETRVMTGRDDSKGFLSSVIISCELAHKPEHPRNGQAVKGGKGSGTRVLPGSQNRDPVRHPETPEALRLIVGGSARRVCLSQKETISMSTQQKRLDVICIGRIAVDLYGQQIGSRLEDMTSFNKYLGGSSGNVAYGTAIQGLKSAMLARVGDEHNGRFLREELQRVGCNTDGLITDKQRLTGLVILGIKDEETFPLIFYRDNCADMGLVPEDIREEFITSSRAVAITGTHLSHPDTRAAVLKALDIARRNGLRTALDIDYRPVLWGLTSLGDGETRFIESGQVTQQLQEVVHYFDLIVGTEEEFHIAGGSTDTLTALKNVRKASSATLVCKRGPLGCVVFEGEIPDSWEQTRLHSGVRVEVLNVLGAGDAFMSGLLRGWLNDESWEQACRYANACGALVVSRHGCAPAMPTKEELDDFLSRDNAVKRPDLDARLNHLHRVTTRKQQWPELNVFAFDHRKQLADMAREAGVSEERIPQLKLLLLQAAQEAANEAGLNEKSGILADTTYGQKALNAITGKHWWIGRPIELPSSRPLRLEHGNIGSQLVDWPAEHVVKCLVFYHPHDSAELRKEQDELVLDVWRSCNKSGHELLLEVILPESNPDRNESYYYDMLSHFYSLGVQPDWWKLPPLTAESWQAIGELIEQQDPHCRGILLLGLDAPEEKLKAGFAAAAQATWVKAVTPVAER

SEQ ID NO: 187353 - protein, 95 aa, Glycine max
  Coding DNA Sequence Number=SeqID_70575
MRKLIKERMENKGVNLVGLNKVVSGIKWMNGMKYRNGNNGSYRAPNEVIPKREVDFLKLWFERTRVEMIGRKESLFPARATHKGCESPLIQPGCS

SEQ ID NO: 187354 - protein, 360 aa, Glycine max
  Coding DNA Sequence Number=SeqID_70576
  Gene Ontology: Mol. function=two-component response regulator activity; Cellular component=integral to membrane; Biological process=two-component signal transduction system (phosphorelay)
  Homolog annotation: Hit_ID=Q6DB55; Match level="QueryCoverage=99%, HitCoverage=66%, E-value=5e-88, Identity=44%"; Hit description =Putative signaling membrane protein
  Pfam annotation: Domain name=EAL; Domain location=209-359; Score=9.5; E_value=3.2e-11; Accession=PF00563.11; Description=EAL domain
MSDSAWDMVTRLRQYQNRRCADIDEDLQRAGTLNAYFRSIGTLQGSEITCSSAYGLQHDTLAGMMMQPPPVTGKAWWSLSIRGTSGVPDRPAVIFVRHLPDSSGFWAVIDGQYLMDFMRAIGESNRYQMSLRFNGGSPIASGPDDQPELLYLSSANYQAESSRYPISVSVTVPAAELIKAWRQALLIFLPMAAIFSILLMVLTANWLRRRLSWADEIRRAIRNREFTVHYQPVYSTGIQRCTGAEALMRWQRPNGEMIRPDIFISHAEAEGMIVPLTQHLLAMMAEDIQSWQVEPGFHIGFNLAAEHLQHLDFVQDMMRFARNIRDKQMLITLELTERSLIEDGDAVSRKLRYLQSHGMK

SEQ ID NO: 187355 - protein, 559 aa, Glycine max
  Coding DNA Sequence Number=SeqID_70577
  Homolog annotation: Hit_ID=P02918; Match level="QueryCoverage=38%, HitCoverage=25%, E-value=5e-94, Identity=80%"; Hit description =Penicillin-binding protein 1A (PBP-1a) (PBP1a) [Includes: Penicillin- insensitive ...
  Homolog annotation: Hit description=transglycosylase (EC 2.4.2.-) (Peptidoglycan TGase); Penicillin-sensitive transpeptidase (EC 3.4. -.-) (DD-transpeptidase)]
  Pfam annotation: Domain name=Transgly; Domain location=342-509; Score= 317.1; E_value=3.2e-92; Accession=PF00912.12; Description =Transglycosylase
  Subcellular localization annotation: CTP_CleavageSite=48; ConfidenceScore=5.75e-01
MVISVCCRTACWSRCSARHHSSSVSNSVTSSTTTSNATLCWRRSSNCCARHGSKLTASISNPPDAAPGLAQSPARPPLPVVAVADSAAAPVVCSAALPPPATPAMGERQGFGCCAAGAIFAGQRPQPVVAERMDQQLMRAQRNAHGDLRQCQTAQLKHVGAQSGLLQRRQPLGDDVAARGGDVQLAGTAAQPVIQRQRGGFDREQASLATAAYAAAPAAAAGQRAVSSAWVNDAASAPTSPVTLARFATRRCVTYRAAAAAATSVAAAIRDGVVQCQGRRVARSGCPVQFASAEKPCARSPYRYRKKDDYPHCMKNDGYIKASGLPLYYRAIVYKLPKRQQMGILSADGELIAQYGEKRRIPLTLQQMPPELIKAFIATEDSRFYEHHGVDPVGIFRAASIALVSGHASQGASTITQQLARNFFLSPERTLMRKIKEAFLAIRIEQLLSKDEILELYLNKIYLGYRAYGVGAAAQVYFGKPVDQLSLSEMAMIAGLPKAPSTFNPLYSHARALARRNVVLARMLDQNYITQQQYNDARNTPLTASYHGPEIAFSAPYLT

SEQ ID NO: 187356 - protein, 233 aa, Glycine max
  Coding DNA Sequence Number=SeqID_70578
MAQRDDLLRRQQAQQQRLQQHQRWQQFWQQLPALMPETLWLSRVERRQGQLVLDGLAQSLADVSAFRHQLQTQPLFAAVKQGSVQPGTDVANSQPAFAGAAATRAGVATAAASATAAIQHAATAAVTTGAAAPATSAAAGRATGHRTASGGDRNVAASGNGGVRIVRAAGGGARQSARGLASGQPATAAGAAPELAAISAAVQRAGCDGVSGATAFSAAGGAGRVTQRVLAGE

SEQ ID NO: 187357 - protein, 287 aa, Glycine max
  Coding DNA Sequence Number=SeqID_70579
  Homolog annotation: Hit_ID=P0ACG8; Match level="QueryCoverage=38%, HitCoverage=83%, E-value=1e-44, Identity=81%"; Hit description=Heat shock protein 15
MRHGQGIHFARQRVLFALFDAGGRLRVHLLRFAGRTPLVADGGDDHRALIVALTQRQLGLQFDHFARFAALAVVMHFAAFNHVASQRAGFIEARGPQPFIKADAFTGFLFHCGSCCYAASRRVAIGRTRSHDAGKMDRAGAGYPKVWVQRDKSRARCRCGLPIHRQSLKRRQGSTEGGGSEQRAHALHSAEVVVKALVVILLNLRHTQAVAVDAAHRPQAVADGADNQHQHQQRGAQIAPLRHGVGLVVQGDVARAVGIGGNAGNDTAGGKRRVQQHAGQALQFVPL

SEQ ID NO: 187358 - protein, 485 aa, Glycine max
  Coding DNA Sequence Number=SeqID_70580
  Gene Ontology: Mol. function=unfolded protein binding; Cellular component=cytoplasm; Biological process=protein folding
  Homolog annotation: Hit_ID=P0A6Y5; Match level="QueryCoverage=55%, HitCoverage=92%, E-value=1e-104, Identity=67%"; Hit description=33 kDa chaperonin
  Pfam annotation: Domain name=HSP33; Domain location=15-283; Score =423.0; E_value=4e-124; Accession=PF01430.10; Description=Hsp33 protein
  Pfam annotation: Domain name=PEPCK_ATP; Domain location=299-485; Score=-28.8; E_value=8e-19; Accession=PF01293.11; Description =Phosphoenolpyruvate carboxykinase
  Pfam module annotation: Pfam domain module=HSP33::PEPCK_ATP; Domain location=15-283::299-485
MNNSRPHERNLMSVQDQLHRYLFENVAVRGELVNASQTWRDIVQNHDYAEPVKTLLGELLVATSLLTATLKFDGDITVQLQGDGPLSMAVINGNNRQELRGVARLKEDAEIAAGSSLKQMVGNGYLVITISPEKGERYQGVVGLEADTLAGCLEDYFMRSEQLPTRLFIRTSEKGAAGILLQVLPAQEPNLDDFNHLATLTETVKSEELIELPATDVLWRLYHQEEATVYDPAPVSFKCTCSRERCGEVLKTLPPEEVDEILAEDGKIDMHCDYCGTHYVHMRVNGLTSQDLETLGISGTTEVVYNPDYATLFQEETRPELEGYARGTLTQSGAIAVDTGIFTGRSPKDKYIVRDDTTRDTLWWNDVGNGKNDNQPLSQETWQALKDRCTQQLSGKRLFVIDAFCGANPDTRLSVRFVMEVAWQAHFVKNMFIRPTEAELADFTPDFVVMNAAQCTNPDWQAQGLHSENFVAFNLTERMQLIGGT

SEQ ID NO: 187359 - protein, 424 aa, Glycine max
  Coding DNA Sequence Number=SeqID_70581
  Homolog annotation: Hit_ID=Q6CZN3; Match level="QueryCoverage=32%, HitCoverage=86%, E-value=4e-65, Identity=86%"; Hit description =Transcription elongation factor
  Pfam annotation: Domain name=GreA_GreB; Domain location=366-424; Score=60.3; E_value=6.3e-15; Accession=PF01272.10; Description =Prokaryotic transcription elongation factor, GreAGreB, C-terminal domain
  Pfam annotation: Domain name=GreA_GreB_N; Domain location=287-360; Score=133.2; E_value=7.1e-37; Accession=PF03449.6; Description =Prokaryotic transcription elongation factor, GreAGreB, N-terminal domain
  Pfam module annotation: Pfam domain module=GreA_GreB::GreA_GreB_N; Domain location=366-424::287-360
MVLSVVLFFNDNLHTCLLLGSWLVLLLLSFSLTVWRVWRQWQRLPAGQSVTLLPWFCRGHRHIARLRPWQQARFPPVAAAFPLCVHVWQAQSEASQQPKRYVIDRYIGVINGEGHFCTGHAALSFGECGYISLYPQQEIDPQPHELPHLLLAGQINDRPGRFLPSLAAEIADWRSPDLTFSFQHYNGQALASYWQANRGDSLYNLTAKNCSTTVVDALDVAFEGYYGQRLQQVFALLLQPAFWGACVLRERAEIMTWTPGLVADYVRLMKKTLGACPGRAVTTSEAMKTQLITREGYNKLRAEHDHLWNEKRPEITRIVSWAASLGDRSENADYTYNKRLLRQIDRRVRYLRKCLAELKIVDYAPQQEGKVFFGAWVEVENEQGDVKRFRIVGPDEIYGDTVKEYISIDSPMARALIKKEVDDE

SEQ ID NO: 187360 - protein, 106 aa, Glycine max
  Coding DNA Sequence Number=SeqID_70582
MPHPALALNQRRAQAAKQAVKQQADFHHRQQQFLQLPFVTVPQRAGQQRTDQNQGKQQIEPALQRHLAAQQHVRHDHAGQQHAAQRQAINQQTITHQQLASGQQQQ

SEQ ID NO: 187361 - protein, 63 aa, Glycine max
  Coding DNA Sequence Number=SeqID_70583
MVKNLHGHTTSYILSPIEIGRVQKIKQNRPFLPYLVSSSQMGHARWPLTLYLLKFPYVGKSFM

SEQ ID NO: 187362 - protein, 389 aa, Glycine max
  Coding DNA Sequence Number=SeqID_70584
  Homolog annotation: Hit_ID=Q3LHL2; Match level="QueryCoverage=55%, HitCoverage=40%, E-value=3e-83, Identity=68%"; Hit description =Hypothetical protein PPS5
  Pfam annotation: Domain name=DUF292; Domain location=23-144; Score =215.5; E_value=1.2e-61; Accession=PF03398.5; Description=Eukaryotic protein of unknown function, DUF292
MPMLRCFFNKAFKASKCATLLQLTIPRIKLLRNRREVHLKQMRRDVAKLLEAGQEAKASLKVEHVMREENIMAAQDIIQLFCELIAARIAFVQSQRKCPLDLKEAISSVCFAAPRCADLPELLQVQSLFASKYGKDFVSAATDLTPDCSVNGQLIELLSVQAPSQEKKLKLLKEIAVEHKLDWDPTASETKSFKKHEDLLNDPIQFCSQCVSKLPLPEEKHTEVDLQSSSQSGSLGSDKHKPNTSFDKKDSEQSMSFISTPLDNKLTKKNGAHVSDSSFENPFFVSVGNKSETEREHFTEQNAANDYDDGGINNVEFEPAFSFSHSSSFPSFDIPKEDFGSSLHNHSVLDDKSSHHQLKRLPSLDDYSGFSYPNLFTPKNSNNWSHTFR

SEQ ID NO: 187363 - protein, 72 aa, Glycine max
  Coding DNA Sequence Number=SeqID_70585
MRIKEEERYQFNVNGLLLTEVKLHALPNFASDTPHYNIEWPIRQGTAGSKPFLKFVNAPDNSYKLVTFCTAK

SEQ ID NO: 187364 - protein, 88 aa, Glycine max
  Coding DNA Sequence Number=SeqID_70586
MSSHFTGHVAIQNIPHQTIQEALNFDAQNPTEIKRITVLDETEREREVPDGNATLRRDVTVAEDVDGGVRRHNAAVCCGGEMVCLGIG

SEQ ID NO: 187365 - protein, 183 aa, Glycine max
  Coding DNA Sequence Number=SeqID_70587
  Gene Ontology: Mol. function=transferase activity; Cellular component= membrane
  Homolog annotation: Hit_ID=Q2MGQ8; Match level="QueryCoverage=83%, HitCoverage=30%, E-value=1e-28, Identity=42%"; Hit description =Exostosin-like
  Pfam annotation: Domain name=Exostosin; Domain location=1-101; Score=- 61.9; E_value=3.1e-05; Accession=PF03016.6; Description=Exostosin family
MEEGFPNATGREQSIKGMRTSEFCLHPAGDTPTSCRLFDAIQSLCIPVIVSDIIELPFEGMVDYAEFSVFPAVNDARKPSWLGNHLQSFSKEQKDRFRQNMAQVQPIFVYDNGHPGGIGPIPVDGAVNHIWKKVHQKLSMIKEAIIRERRKPPDKLVFKMQLYIGQGVLIIDYRPFFLSLAQS

SEQ ID NO: 187366 - protein, 90 aa, Glycine max
  Coding DNA Sequence Number=SeqID_70588
MGSNQVHAFKKRKECALWCPYRMRAKARVMSEIKEVQEQMKADIEAMKKQITTMMEAMMSMRKMMEVNTTIVIAASTTTEVDPTHQSCLN

SEQ ID NO: 187367 - protein, 97 aa, Glycine max
  Coding DNA Sequence Number=SeqID_70589
  Gene Ontology: Mol. function=transferase activity, transferring glycosyl groups; Biological process=nucleoside metabolic process
  Homolog annotation: Hit_ID=Q8GHL2; Match level="QueryCoverage=65%, HitCoverage=54%, E-value=1e-18, Identity=63%"; Hit description =Competence protein F
MRAESRNNVLPHFGVQSPAVQQHKIAIACACGVPQSRPCVGYAVCRCGSPGTACAAYVCVSYRRCRRSVPAADCRPVAISRADAVCAGRRRGTLSLA

SEQ ID NO: 187368 - protein, 387 aa, Glycine max
  Coding DNA Sequence Number=SeqID_70590
  Homolog annotation: Hit_ID=P09391; Match level="QueryCoverage=34%, HitCoverage=56%, E-value=3e-33, Identity=59%"; Hit description =Protein glpG
  Pfam annotation: Domain name=Rhodanese; Domain location=152-239; Score=44.4; E_value=3.9e-10; Accession=PF00581.10; Description =Rhodanese-like domain
PCGSSTPDADAGGVADGNASGRRCAAPFSAALHVRPALRPPDGIRNVPDSAGHRESAWNWQRSIHCNAGTVDAAADHDQVFGFHVISSDVRNSSKMFVFERNNNRKPTLTPALNSIKTFLRDIANISAGKKSHIHRICQVIAAAYQGKLTPNDDEANEHLAQGAQLVDIRDPQSFAMGHATGAQHLTNDNLATFIAGARHDQPVLVMCYHGNSSKGAAQFLLSQGFSDVYSIDGGRHRQPLIDRLKEGEHRMMRITQFNQPRMAQAFVDYMATRGVTLRIERESHYVIVLDDDSKLEMVENELAQFVRDPNHPRYQAASWHSGTTDSGLRYERGNIWANIRERAGPLTLTIMIACVAVFILMQIVGDDVPRAAALLAAAHSVQPDVV

SEQ ID NO: 187369 - protein, 47 aa, Glycine max
  Coding DNA Sequence Number=SeqID_70591
MSYDAAIEVRNHVSPEPEVEDAGVASLANPKRLVTNSECKMILKVQR

SEQ ID NO: 187370 - protein, 308 aa, Glycine max
  Coding DNA Sequence Number=SeqID_70592
  Gene Ontology: Mol. function=endonuclease activity
  Homolog annotation: Hit_ID=UPI00005F80B0; Match level="QueryCoverage =96%, HitCoverage=100%, E-value=1e-136, Identity=77%"; Hit description=COG1082: Sugar phosphate isomerases/epimerases
  Pfam annotation: Domain name=AP_endonuc_2; Domain location=33-250; Score=151.8; E_value=1.7e-42; Accession=PF01261.14; Description=AP endonuclease family 2
MNQENVKLAIAPIGWTNDDMPELGSENTFQQTVSEMALAGFTGSEVGSKYPRDPAVLKPMLDIRGMQICNAWFSTFFANGDKAKTIDQFINHMNFLHAMGARVIGCSEQSKSIQGTSLPVLEQKPVFTDEEWRLTAEGYNELAAIAAQKGMRVTLHHHMGTGIQTPAEIDRFMAMTNNNVGLLYDTGHIYYSEGSQQVMLDVLTQHLPRIFHVHLKDVRDSVVAEVRANSLSFLDGVKKGTFTVPGDGVIDFKPVFKILDDYGYKGWMVVEAEQDPAIANPFEYAVKARKYIRDNAGLENITPPSCVR

SEQ ID NO: 187371 - protein, 561 aa, Glycine max
  Coding DNA Sequence Number=SeqID_70593
  Gene Ontology: Mol. function=thiamin pyrophosphate binding; Cellular component=acetolactate synthase complex; Biological process=branched chain family amino acid biosynthetic process
  Homolog annotation: Hit_ID=UPI00005F80AE; Match level="QueryCoverage =65%, HitCoverage=56%, E-value=1e-149, Identity=71%"; Hit description= COG3962: Acetolactate synthase
  Pfam annotation: Domain name=GFO_IDH_MocA; Domain location=371-493; Score=132.1; E_value=1.5e-36; Accession=PF01408.12; Description =Oxidoreductase family, NAD-binding Rossmann fold
  Pfam annotation: Domain name=Semialdhyde_dh; Domain location=372-480; Score=-14.5; E_value=0.0098; Accession=PF01118.15; Description =Semialdehyde dehydrogenase, NAD binding domain
  Pfam annotation: Domain name=TPP_enzyme_C; Domain location=163-323; Score=171.3; E_value=2.4e-48; Accession=PF02775.11; Description =Thiamine pyrophosphate enzyme, C-term
  Pfam module annotation: Pfam domain module=GFO_IDH_MocA::Semialdhyde _dh::TPP_enzyme_C; Domain location=371-493::372-480::163-323
NVGGVGETGCLAANLLAKEADLVIGIGTRYTDFTTASKWIFQHPEISYLNINVNNFDSYKLDGVQLLADAREGLTALEAGLNGFENHWGGQIEQAQSKLLKETQRVYAATFNTDDFIPEIADHIDRTALFAEFERLTKSVLTQSSVLGTLNEQLPKDAVIVAAAGSLPGDLQRVWRTKDYNAYHVEYGYSCMGYEVNAALGVKLAQPQREVYAMVGDGSFMMLHSELVTSIQEGAKINVILLDNMTNGCINNLQMEHGMDSFNTEFRFRNPQGGKLDGGFVPVDFAAIAAGYGCKTYRVTTLEQLKAALEDAQQQTVSTLIDIKVLPKTMVHKYFSWWHVGVAQASTSERTQQVADKLNQHIQQARVIMTLKLGVIGTGAIGQEHIRRCNNVLQGAKVVAVSDINVEGARAALQRLNIQAEVYQDGHQVINSPEVDAVLVTSWDPTHEEFTLAAIAAGKPVFCEKPLALSAEGCRRIVDAEIAHGKRLVQVGFMRPYDAGYRALKKVITDGDIGEPLMLHCAHRNQSVGENYTTDMAITNTLIHELDVLRWLTEDDYKSVQ

SEQ ID NO: 187372 - protein, 307 aa, Glycine max
  Coding DNA Sequence Number=SeqID_70594
  Gene Ontology: Mol. function=oxidoreductase activity; Cellular component=periplasmic space; Biological process=cell division
  Homolog annotation: Hit_ID=Q7CGI0; Match level="QueryCoverage=77%, HitCoverage=50%, E-value=1e-99, Identity=73%"; Hit description =Suppressor of ftsI
  Pfam annotation: Domain name=Cu-oxidase_2; Domain location=105-243; Score=55.8; E_value=1.4e-13; Accession=PF07731.4; Description =Multicopper oxidase
MRLHMLNAANARRFDLSCSDNRQFTVIASDQGFLPAPVAVQTLSLAPGERREVLVDMSQGDEVSITAGTAAGIMDRLRGLFEPSSIVTNTLVLTVRPTGLLPMVTDNPPMRLLADQILDGVAVRTREFRLGDGTPGINGVLWDMNRIDTTVQQGTFERWIIHADRPQSLHIQGVMFLIKSVNGAQSMGEDRGWKDTVWVDGDVELLVSFPQSSSEHFPFVYYSQTLELADRGTAGQMVVNPVGHSIVSDSPGQIPLPRAGEGRGEGAWLRSITHLHTVSDLRGHLPLPRAGEGRGEGANRTLHPSHP

SEQ ID NO: 187373 - protein, 318 aa, Glycine max
  Coding DNA Sequence Number=SeqID_70595
  Gene Ontology: Mol. function=sequence-specific DNA binding; Cellular component=intracellular; Biological process=regulation of transcription, DNA-dependent
  Homolog annotation: Hit_ID=Q83Q58; Match level="QueryCoverage=92%, HitCoverage=78%, E-value=1e-106, Identity=64%"; Hit description =Putative ARAC-type regulatory protein
  Pfam annotation: Domain name=AraC_N; Domain location=39-193; Score =225.3; E_value=1.4e-64; Accession=PF06719.3; Description=AraC-type transcriptional regulator N
  Pfam annotation: Domain name=HTH_AraC; Domain location=208-254; Score= 44.7; E_value=3.1e-10; Accession=PF00165.13; Description=Bacterial regulatory helix-turn-helix proteins, araC family
  Pfam annotation: Domain name=HTH_AraC; Domain location=260-304; Score= 33.4; E_value=8e-07; Accession=PF00165.13; Description=Bacterial regulatory helix-turn-helix proteins, araC family
  Pfam module annotation: Pfam domain module=AraC_N::HTH_AraC::HTH _AraC; Domain location=39-193::208-254::260-304
MRHTAFFAARESAMPNDALCRQLAQRVITLMREPQKPLCAVENVRLIYAEEPLPRTPMLYSAGIVILFQGHKTGYLGSTVFRYDATKYLMLTVTLPVECETDATPQQPLAGMSLTVDPASLQDLLLSIGDDEQFQPQPQTSGIHSAFLSEEMLCAAERLLDVMDKPRDARVLGPQLVREIIYYVLTGPIGGALLSLVNRQTQFSQVARALRRIENHFAESLSVEMLAAEVNMSVSAFHHNFKAVTQTSPLQYLKRYRLHQARLMMLQDGLKASAAAVRVGYESPSQFSREFKRYFGVTPGEEASRARQTGALQPFDAA

SEQ ID NO: 187374 - protein, 382 aa, Glycine max
  Coding DNA Sequence Number=SeqID_70596
  Gene Ontology: Mol. function=cystathionine beta-lyase activity; Cellular component=cytoplasm; Biological process=methionine biosynthetic process
  Homolog annotation: Hit_ID=P06721; Match level="QueryCoverage=99%, HitCoverage=99%, E-value=1e-153, Identity=68%"; Hit description =Cystathionine beta-lyase
  Pfam annotation: Domain name=Cys_Met_Meta_PP; Domain location=7-378; Score=488.3; E_value=9.2e-144; Accession=PF01053.10; Description =CysMet metabolism PLP-dependent enzyme
  Subcellular localization annotation: CTP_CleavageSite=44; ConfidenceScore=5.21e-01
MATKKIDTRLVTAGRSKRYTQGSVNSVIQRASSLVFDSVADKQRATAGRASGELFYGRRGTLTHFSFQDAMTELEGGAGCVLYPCGAAAVANAILAFVTSGDHILVSGAVYEPTQDFCTKILAKLNVTHHLPNTRVVFLESPASITMEVQDIPAIVAAVRAKAPDAVIMIDNTWAAGVLFNALEHGIDISIQAGTKYIIGHSDAMIGTAVANERCWAQLRENSYLMGQMVDADTAYMASRGLRTLATRLRQHEESGLRVAEWLAAQPEVARVNHPALAQCKGHEFWRRDFSGSSGLFSFILHEKLTPAQLANYLDRFHHFSMAYSWGGFESLILANQPEELAAIRPAGGVDFDGTLVRLHIGLEHVDDLLDDLKAGFARLKA

SEQ ID NO: 187375 - protein, 402 aa, Glycine max
  Coding DNA Sequence Number=SeqID_70597
  Gene Ontology: Mol. function=protein transporter activity; Cellular component=integral to membrane; Biological process=protein transport
  Homolog annotation: Hit_ID=Q6DA97; Match level="QueryCoverage=68%, HitCoverage=90%, E-value=4e-93, Identity=67%"; Hit description =Biopolymer transport protein
  Pfam annotation: Domain name=MotA_ExbB; Domain location=233-371; Score=175.0; E_value=1.9e-49; Accession=PF01618.7; Description =MotATolQExbB proton channel family
MDAGDSRNTTRVFGCTKILSGFVHRAADQNMIAAGDKREDGIGDCGRTARIEHAAGAAFQFGHRILEGKMGEGAAPAIKQFTAGASGGGALFVRDGVKNQVTPAQSRKEAGCGFYYVAEKQSAINCAATTRAGCSSAPVAPVRKPHPTVAASRRRSVVASDLMQTDLSVWGMYQHADIVVKIVMIGLLLASVVTWAIFFGKYAELSGAKRRLKREQLALGEARSLNDAYRAAENFKANSHSAVLLADTRNELELSAGSEDLDGIKERTSFRLERRVAGFSRHAGRGNGFLATIGSVAPFIGLFGTVWGIMNSFIGIAKTQTTNLAVVAPGIAEALLATAIGLVAAIPAVVIYNVFARMIASYKASLGDVAAQVLLLQSRDLDLGNVDTAKEVNRPAAAQKLR

SEQ ID NO: 187376 - protein, 69 aa, Glycine max
  Coding DNA Sequence Number=SeqID_70598
MGTNQNGKRFYQVKVKGLDVTSLKELGRLMGPLQRQAFRKVYGKIQDLTVVEVFTKAVVSLAQNTTTSR

SEQ ID NO: 187377 - protein, 154 aa, Glycine max
  Coding DNA Sequence Number=SeqID_70599
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=Q6DAB5; Match level="QueryCoverage=100%, HitCoverage=42%, E-value=4e-70, Identity=84%"; Hit description=PTS system, IIbc component
MQGGSKFVMGAILGAMATFDFGGPINKTMSLFADGMLVDGIYGPEAVKFVGSIIPPFGITLSYLLTRHKYTKAEKEALKAAFPMGICMITEGVIPIAARDLLRVVASCVVASALAGGLIMVWGVEAPVPHGGMFVVPLFTKPWLFCLALGIGTV

SEQ ID NO: 187378 - protein, 457 aa, Glycine max
  Coding DNA Sequence Number=SeqID_70600
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=Q6DAB2; Match level="QueryCoverage=94%, HitCoverage=99%, E-value=7e-88, Identity=42%"; Hit description =Probable PTS system regulatory protein
  Pfam annotation: Domain name=HTH_11; Domain location=112-171; Score =10.2; E_value=0.0069; Accession=PF08279.2; Description=HTH domain
  Pfam annotation: Domain name=HTH_11; Domain location=24-82; Score =50.7; E_value=4.8e-12; Accession=PF08279.2; Description=HTH domain
  Pfam annotation: Domain name=HTH_DeoR; Domain location=24-76; Score =0.7; E_value=0.05; Accession=PF08220.3; Description=DeoR-like helix -turn-helix domain
  Pfam annotation: Domain name=Mga; Domain location=87-186; Score=17.1; E_value=0.00047; Accession=PF05043.4; Description=M protein trans -acting positive regulator (MGA)
  Pfam annotation: Domain name=PRD; Domain location=224-312; Score =51.0; E_value=4.1e-12; Accession=PF00874.10; Description=PRD domain
  Pfam annotation: Domain name=PTS_IIB; Domain location=360-439; Score =2.3; E_value=0.011; Accession=PF02302.8; Description=PTS system, LactoseCellobiose specific IIB subunit
  Pfam annotation: Domain name=PuR_N; Domain location=109-169; Score= -28.1; E_value=0.1; Accession=PF09182.1; Description=Bacterial purine repressor, N-terminal
  Pfam module annotation: Pfam domain module=HTH_11::HTH_11::HTH _DeoR::Mga::PRD::PTS_IIB::PuR_N; Domain location=112-171::24-82::24 -76::87-186::224-312::360-439::109-169
MPQGKIPLGFTKIKGDRMQILTSRQHRLVKLLLQQAAPQPIGQLALQLGVSGKTIQRDLQWLESWLSNWALTLEKTPGRGVRLRVEDMQQRLQLEQQLNGDEAGDALSHNSRRIKIASQLLSDAPRATSISKLSERYFISHASIVNDLKVIEEWLQPLGLTLQRGPGGTHIEGHEQALRQAMVSLINDVMQQQVAGTPLLPRLDPGSQQALVHYFGEEDVAFVQALLQQMEQQLSYPLGDAWYLNLCTHILIMMHRMAQGNALALDILTTAHDLDQSILTIARQMVARIEQRIGCALPADEVGFIYQYIVSSGIVVEERGDQAMQLTARTFALSPVAEDEIGYLCVHFQAALERQIAHKRILVVCSSGVGTSHLLKSRILRAFPDWEIAGVVSASNQAAFCQHHAVDLVITTIHLDAGAIPAVYVSAFFNDDDIRRVTDAMIGSQLPNGTPCALAAH

SEQ ID NO: 187379 - protein, 146 aa, Glycine max
  Coding DNA Sequence Number=SeqID_70601
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=Q6DAB5; Match level="QueryCoverage=100%, HitCoverage=40%, E-value=5e-60, Identity=80%"; Hit description=PTS system, IIbc component
MNQRLLQPDDGLADKGHHQQPGDDGAEQRQHHDWHQPLHRLRQPDHPAQQQHGIADEETAQNAADEAGADLTADEADDQAGRKAGTIGNRVGDGAADQRHNQPHAPAADLVQHPRNAAGLLADVGPANHLAERDADAGGDDQRDHP

SEQ ID NO: 187380 - protein, 89 aa, Glycine max
  Coding DNA Sequence Number=SeqID_70602
  Homolog annotation: Hit_ID=Q1SPB9; Match level="QueryCoverage=94%, HitCoverage=14%, E-value=6e-08, Identity=37%"; Hit description =Transposase
MDVKADDNCGYRAIVTLLGMGEDSWSLVCNHLLKELGKWSDDYIKLFGGTNTFEELRRSLLVDGLSMVTMDNWMDITKMGYVIASSDYP

SEQ ID NO: 187381 - protein, 87 aa, Glycine max
  Coding DNA Sequence Number=SeqID_70603
MDIRAFLFCIRALSAICDNDFPFEAIRIWSFSRSKLGSALSALIKTTYSLHDKHFNKFTRAGIVWRRHQWQHGGCGDIGGSGSIASF

SEQ ID NO: 187382 - protein, 410 aa, Glycine max
  Coding DNA Sequence Number=SeqID_70604
  Gene Ontology: Mol. function=receptor activity; Cellular component =mitochondrion
  Homolog annotation: Hit_ID=Q1S1U3; Match level="QueryCoverage=89%, HitCoverage=52%, E-value=3e-84, Identity=48%"; Hit description=Trp repressor/replication initiator
  Pfam annotation: Domain name=DUF668; Domain location=144-225; Score =188.5; E_value=1.7e-53; Accession=PF05003.3; Description=Protein of unknown function (DUF668)
MKNCRNYEHSTPNFTLTPTLTFILLAPSKPYKLYSSIRDSLAILRAELKSQKKHVRNLKKKSLWSKILEEFCLWSKILEEVMEKLVDIVHFLYLEIHEAFGSSVPHSLIAAPFFLPTKCRPSFAVVKIPDTDKQAKDSQGNHKKLGSAGLALHYANIITQIDTLVSRSSSVPPNTRDALYQGLPPNVKSALRSRLQSFQLTVPQIKAEMEKILQWLVPIAANTTKAHHGFGWVGEWANTGSEFNRKPAGQTDLLKIETLHHADKDKTEAYILELVIWLHHLVSQVRVGNGGIRSPVKSPIRSPTQKTGQLFTQKACSSPMLTVEDQQMLRDVSKRKLTPGISKSQEFDTAKTRLSKHHRLSKSSSHSPISESKNDIFSTRRLPSVPVIDFDIDRMKALDVIDRVDTIGSS

SEQ ID NO: 187383 - protein, 53 aa, Glycine max
  Coding DNA Sequence Number=SeqID_70605
MVINNDVILDIIQGQDNTEIPPQAPPIVQTQQLQEVHFEDSLEKGQILKGFKG

SEQ ID NO: 187384 - protein, 89 aa, Glycine max
  Coding DNA Sequence Number=SeqID_70606
  Homolog annotation: Hit_ID=Q9LVH1; Match level="QueryCoverage=64%, HitCoverage=19%, E-value=2e-10, Identity=53%"; Hit description =Arabidopsis thaliana genomic DNA, chromosome 5, P1 clone:MGO3
FDISSKLLDICNAFSSELSRLNQQNLPLKKMKTISGHCVLVKDISVSKAAKILTKFVSADNGTSHVINAYLHRPSASFNELKQLHKELG

SEQ ID NO: 187385 - protein, 209 aa, Glycine max
  Coding DNA Sequence Number=SeqID_70607
  Gene Ontology: Mol. function=DNA-directed DNA polymerase activity; Cellular component=mitochondrion; Biological process=DNA replication
  Homolog annotation: Hit_ID=Q6QZN8; Match level="QueryCoverage=76%, HitCoverage=20%, E-value=2e-37, Identity=53%"; Hit description=DNA -directed DNA polymerase
MTLFRSFCNIPVVAARNDVVAPAEGSTLLSRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPNWKELSVKNKESTTTLGKKVTYTF

SEQ ID NO: 187386 - protein, 108 aa, Glycine max
  Coding DNA Sequence Number=SeqID_70608
MEATLPSNWKNLTIEKYDGTNDPDEHLDVYISQANLYTTDDVVLCRVFPTSLKVRNQLASSPDVAGFGQYTPEEERIALDTHGLFWKDNFGYLKPRLNSCHARLDNNT

SEQ ID NO: 187387 - protein, 49 aa, Glycine max
  Coding DNA Sequence Number=SeqID_70609
MPKVEREHCRAIGKVLQHSRGVHLAKGVNLSRSSKFCWKTAFGAFVILP

SEQ ID NO: 187388 - protein, 77 aa, Glycine max
  Coding DNA Sequence Number=SeqID_70610
MGVKYLEAVKQRLQAIKQWSPDEIRGNPVCQKAHRIVKYLKLKRMNLSIELRELVLDMVKFRNKALLKETLIIDDLE

SEQ ID NO: 187389 - protein, 74 aa, Glycine max; identical to SEQ ID NO: 118597
  Coding DNA Sequence Number=SeqID_70611
  Homolog annotation: Hit_ID=Q2PMM5; Match level="QueryCoverage=45%, HitCoverage=1%, E-value=5e-09, Identity=85%"; Hit description =Protein ycf2

SEQ ID NO: 187390 - protein, 298 aa, Glycine max
  Coding DNA Sequence Number=SeqID_70612
  Gene Ontology: Mol. function=nucleoside-triphosphatase activity; Cellular component=chloroplast
  Homolog annotation: Hit_ID=Q2PMM5; Match level="QueryCoverage=97%, HitCoverage=12%, E-value=1e-159, Identity=94%"; Hit description =Protein ycf2
MCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFYEENESFYRRIIKKWVQTSCGNNLEDPKPKIVVFTSNNIMEAVNQYRLIRNLIQIQYSTHGYIRNVLNRFNCNFEYGFKVSNRNIL

SEQ ID NO: 187391 - protein, 68 aa, Glycine max
  Coding DNA Sequence Number=SeqID_70613
MVNLNNEVKRLREEVNVIKRCIKVVGLRLLGLELQHKKRKRGRARVLKEHRWPTSTMSSSDLEKKSKS

SEQ ID NO: 187392 - protein, 129 aa, Glycine max
  Coding DNA Sequence Number=SeqID_70614
MKLQCTQPHKEAKIGKLHRDPRSPCRTPSFSSATADDGGSGNPTTQWIMEKWEKRRKTYLGAAKLEINKMDQHCYTPCSQNVAGEGAVATLGFVVAVASAAPPRSDVAIHGTGKRVVGELLKNESGNTL

SEQ ID NO: 187393 - protein, 118 aa, Glycine max
  Coding DNA Sequence Number=SeqID_70615
MVLKEHALRFVDCGGVGSTVSSVSGGVCLGESVVEFSYGLKRARSQVRGLWWCWKYLSSFTTASISLFMHLGFKPVRHPDATNVDDHEEKCDTVSNLQNCSYGLKMLTIIGLKANLYH

SEQ ID NO: 187394 - protein, 303 aa, Glycine max
  Coding DNA Sequence Number=SeqID_70616
  Gene Ontology: Mol. function=metal ion binding
  Homolog annotation: Hit_ID=Q7F1K9; Match level="QueryCoverage=82%, HitCoverage=83%, E-value=1e-106, Identity=70%"; Hit description =Putative glyoxylate induced protein
  Pfam annotation: Domain name=Cupin_2; Domain location=132-200; Score =22.5; E_value=0.0015; Accession=PF07883.2; Description=Cupin domain
  Pfam annotation: Domain name=Cupin_3; Domain location=125-203; Score =9.0; E_value=0.0022; Accession=PF05899.3; Description=Protein of unknown function (DUF861)
  Pfam module annotation: Pfam domain module=Cupin_2::Cupin_3; Domain location=132-200::125-203
MRSIFVLLLVLGTLFFLCFVLCSVWPPQRKKKAETNTLIYLLVCLFKYAFAEEGFCSAPSESKSKPLYWKVDNPTLSPIHLQDLPGFTRSVYKSNHALVSPESHVYGPLPDWIDTSGAYLISPEMGSHFVMYLAKLKEKSKSGLPLPGVERFIFVLQGAVTLTNAAGVSQLLKVDSYAYFPPNFEHSIECDTPATIVVFERRYSPLPNHIPEPLVGSTDKQPLLETPGEIFELRKLIPTSLAYDFNIHIMDFQPGEFLNVKEVHYNQHGLLLLEGQGIYRLGDSWYPVQAGDVIWMAPFVPQW

SEQ ID NO: 187395 - protein, 297 aa, Glycine max
  Coding DNA Sequence Number=SeqID_70617
  Gene Ontology: Mol. function=RNA methyltransferase activity; Biological process=RNA processing
  Homolog annotation: Hit_ID=Q10T58; Match level="QueryCoverage=84%, HitCoverage=12%, E-value=6e-12, Identity=27%"; Hit description=RNA methyltransferase, TrmH family protein, expressed
  Subcellular localization annotation: CTP_CleavageSite=24; ConfidenceScore=5.14e-01
MSGSRSRFHGFRGASLSASFYQVPPSAVPAMLDCILVSTGLSPPSLFASLLHDFPRILLKDITNEGDDDLDADKRLHLVSMVGAFCHLLKKMGADCDAVRSFVWRCFLPLVKVLQPLQHDLLNQITELFMGVVIETCAWEVLEATSVPIFLRSVGLSMGMLHNDDLDFYEWSSNSSHQDSYDVMIDPLMDKELLLSLSNSFKLLTSCNLLSVILEAALQYMQTDTLPKSAERKGCIVDKFVNILIWELSNMIERMLLHSPEHRSCAVGLLLPIILKALPANGSFEISIRGQKHGFSR

SEQ ID NO: 187396 - protein, 86 aa, Glycine max
  Coding DNA Sequence Number=SeqID_70618
MYLIKFPYAGKSLKVSQPTLQREGDARAYGCVFHGRKMHGVATNVYSRKTSEKLDRCGLRTLSVKGSGVVFTHGEGISTPRVCHKG

SEQ ID NO: 187397 - protein, 45 aa, Glycine max
  Coding DNA Sequence Number=SeqID_70619
MAPKKLSTKRSRREATGEGSSAALEFDSHRFRSAKHQQCFEAIRG

SEQ ID NO: 187398 - protein, 50 aa, Glycine max
  Coding DNA Sequence Number=SeqID_70620
MGKEKYRPGPQLKGSPSGPPAGSQTGEIELPMAGNSQSIERLATESPEVA

SEQ ID NO: 187399 - protein, 56 aa, Glycine max
  Coding DNA Sequence Number=SeqID_70621
MAGVGRYMAPTDIFQPTLRNFFYKRWPIMTARFFRASSIEGSFRPTLACCSSHLGG

SEQ ID NO: 187400 - protein, 489 aa, Glycine max
  Coding DNA Sequence Number=SeqID_70622
DIKWLEDAWVERLKNPAMFDRVEDDLQWELGMDITPKYLGDDLVLLHGLSEIGAERVMNGGTYGNASLFYSMERWNPSIRTGNRMIWVQCWGIPLQTWDKKHIRVLIKTPWTPLIKHTVDIHIIGETFKGCSYRGSSEEIDSDESLLGDLPPAMTRLTVVDHDHKHATATDHHPKSPHKPSMPTAGDGKSWSIGLHSGRRGYDYPWDKTNDPQVLTGCKGKAMVNSSFEVSVANDLCMGRRLTNQEPQDREFHDNSKRDKGESSGVQKEPFPPSHDFAGDKIPSRAVDAYQEHEGVDVAIEIAKNREQEADMYILVGVGPKGNNVWVQYSRLLTKSKTVRHMQIAEARYSNSQEAANMWTMIKQLGVTLGNTGGDQQSRVIARIRCMEDRDRTEAERILIKKENVDMICIQETKKEAIDKSLCQALWGNADVTWEMQPANNSVGGILWEWIREAQQISIVTIYSPCDIHNKRILWDKVRQSKDSSQGGL

SEQ ID NO: 187401 - protein, 423 aa, Glycine max
  Coding DNA Sequence Number=SeqID_70623
  Gene Ontology: Mol. function=RNA methyltransferase activity; Biological process=RNA processing
  Homolog annotation: Hit_ID=O23602; Match level="QueryCoverage=95%, HitCoverage=27%, E-value=1e-102, Identity=52%"; Hit description=TRP -185 like protein
  Subcellular localization annotation: CTP_CleavageSite=65; ConfidenceScore=5.02e-01
MSVKAISLILLWRYQIKRDAPHNSAFTFMWQFFWRTTRSSLSCSEMGAEISLAAYEALVSVLRVLASTYFPHSFYLVEENEQLFSEIEGRPRLDYMCVSFIQNINDLLGSGVLARTRRAVLLEIKWVCLESLLSIPSCAFKNGFNLEENPTFFSDDTLKCIFGDLVESLENAAESCVLPMLRSLRMLFELVAKVMSNAAASHCHLINAQMMWNLVHSSWILHISCNKRRVASIAALLSSVLHPLVFNDENMHQTDNAPGPLKWFIENLLEEGIKSPRTIRLAALHLTGLWLLNPRIIKFYLKELKLLSLYGSVAFDEDFEAELADNNDARLEVSILARSPDPELTEAFINTEVYARVSVAVLFYKLADLARMVGSPNEDANCIAAQESGKSFLLELLDSVCLENGLVHKQPTWAPGLLSVLGF

SEQ ID NO: 187402 - protein, 445 aa, Glycine max
  Coding DNA Sequence Number=SeqID_70624
  Gene Ontology: Mol. function=RNA methyltransferase activity; Biological process=RNA processing
  Homolog annotation: Hit_ID=Q10T58; Match level="QueryCoverage=93%, HitCoverage=23%, E-value=1e-120, Identity=55%"; Hit description=RNA methyltransferase, TrmH family protein, expressed
  Pfam annotation: Domain name=SpoU_methylase; Domain location=293-436; Score=108.1; E_value=2.5e-29; Accession=PF00588.9; Description=SpoU rRNA Methylase family
  Subcellular localization annotation: CTP_CleavageSite=50; ConfidenceScore=5.06e-01
MVSAGACVDNLAICQHSVTVTVRVNYNRMALSSYVFIAANVILNSSKDVQSSHLNELFPPLVPLLTSHHHSLRGFTQLLAYQILHKLFPLLNYGSSEMLPLEKRCFVDLKTYLARNSDCARLRTSMEGYLDAYDPNSSVTPAGIFINRVEEDGFECVPTSLMEQVLKFLNDAREDLRCSMAKDVVTIRNETLNFNGDKNCIENLSGGIEGTMLKDMSSDFQKKVTFTKHDKGGNEAGFLYGNDETYKKLAVLYLPLFNFKINMTEIERDDLLLDQLLQSRRSSLDQQKASRQNFILVASLLDRIPNLAGLARTCEVFRASGLAIADTKIINDKQFQLISVTAEKWVPIIEVPVDSIKIYLQKKKKEGFSILGLEQTANSVPLDQYIFPKKMVLVLGREKEGIPVDIIHILDACIEIPQFGVVRSLNVHVSGAIALWEYTRQQRSQ

SEQ ID NO: 187403 - protein, 159 aa, Glycine max
  Coding DNA Sequence Number=SeqID_70625
  Homolog annotation: Hit_ID=O23602; Match level="QueryCoverage=50%, HitCoverage=5%, E-value=4e-08, Identity=36%"; Hit description=TRP -185 like protein
MTVQRWLSGCGYKDRCANCCNNEIKWWKSLYDFPQNFVSNNLSIDVSLTYDDEDLSAWESEANRWAKMLFLAIKKDHPLELIFVEDTSPELEAHRQRHCHASENNDAWVLFGLSKKERVERRMGKWFWEHVDWRSKLEDIRSTKRNEVSERAHWGEWVV

SEQ ID NO: 187404 - protein, 110 aa, Glycine max
  Coding DNA Sequence Number=SeqID_70626
MSLHICIYGFKSCFCLTGLDELHSITIWGLRAILTDQNKLVVAVCGVTALAAGRGLHCKVMTQNLILVVILISLSLHAKSSWFMMKSVGSWLDNYAQCMTERGSDTTVGS

SEQ ID NO: 187405 - protein, 399 aa, Glycine max
  Coding DNA Sequence Number=SeqID_70627
  Homolog annotation: Hit_ID=Q8LB10; Match level="QueryCoverage=42%, HitCoverage=58%, E-value=1e-57, Identity=64%"; Hit description=ATP -dependent Clp protease proteolytic subunit ClpR4, putative
  Pfam annotation: Domain name=CLP_protease; Domain location=215-381; Score=137.2; E_value=4.4e-38; Accession=PF00574.13; Description=Clp protease
MEEEVDPSIKREKHKENRVMNVGCEDDFFDNPITNLIKKEVKAVVGTSMVLESWNVNLLGEPLALNFVMSMDDNSTMEPRQKGGTKIVMMIQVIRIPPSSPPPPKPPDLSLHEVANGFTVVLKDMKEEGGVLEFSKGGPTFYIVGHAQMGCRNEIHKRGAETWNSNWVVGFILLKLDVCVPDDMLKEQRWKEIEASHMELQGMQMSSNNQRKLEEVSMCNSGFQIPTLRKRLIFRMSVLLGYKENEELVEIGGEKLGYETEAFAIYDVMRYVKPPIFTLCVGNAWGEAALLLAAGAKGNRSALPSSTIMIRQPIARFQGQATDVNLARREVNNVKTELVKLYAKHMEKTPEQIEADIQRPKYFSPSEAVEYGIIDKVIYNDRGTEDRGVVSDLKKARLI

SEQ ID NO: 187406 - protein, 601 aa, Glycine max
  Coding DNA Sequence Number=SeqID_70628
  Gene Ontology: Mol. function=RNA-directed DNA polymerase activity; Cellular component=chromatin; Biological process=chromatin assembly or disassembly
  Pfam annotation: Domain name=Ribosomal_S24e; Domain location=514-594; Score=9.9; E_value=0.0019; Accession=PF01282.9; Description=Ribosomal protein S24e
MAACGGVVKLSENSGDDLETLRKPYTTILKDEVVAYGAVRVFGRIGLNSLTKFEEGGVVEELLFKFLQEMIIGNRWKKELVVRENGEGIVQQVLPPFFNGGGDGGEFSDIRGCTKKPRAERTAPMPTPEASVSTLNRMEKSGKLSTGALHRACFRLRKACSASAFQKPRRARVDRGTGQFWTASILADTGSTPRQDAMTEGAVHCRLKSGRSVAEAERHYKELVMAGWRYPVPPEVRQFWVLEIGACAWSDDARLKHIGHLSLNFMFLEVGVTVWFNIDRNCVRLKKDKVIGGSGRGKGVFGGGISFKFNDIATVDKFHGQADGHKWWHSIVAVANKDTKAGLVGLGPRDTGQALITVEAEAVLPAACDLGGGNKGGVAEGKGGGGVGNEDGVGGTTLLRELVLLETFQPDGLDKGQRLENLDLAANIEGPRMVNAQNGSRWPAKILPKWGTGGCTSSTGNTLRVGAIKFRDIKFHFGSVDEGGFWYRLGEEEGEAEELVVFSRLAMRRRRSSNFANVSKAELKEKLRRMYDGKGTNLVFVFKFRTHFGGGKSTGVSLSTGLSGMEEKSRKQMKERKNRAKKICGVKKTKASDAAKTGKKK

SEQ ID NO: 187407 - protein, 506 aa, Glycine max
  Coding DNA Sequence Number=SeqID_70629
  Gene Ontology: Mol. function=RNA-directed DNA polymerase activity; Cellular component=chromatin; Biological process=chromatin assembly or disassembly
MLQSGIIRPSTSPFSSSVLLVKKRDDSWRFCVDYRALNALMIKDRFPIPKIDELLEELGSATWFSKLDLMQGYHQILMAESDIAKTAFRTHPGHYEFLVEYLGHIASCRGVEPVSAKIEAVQNWPVPRSTRALRGFLGLSGFYRRFIKGYSSLAAPLTALLTKDSFHWNADAEQAFLNLKQALCNAPVLSLPDFSILFSVETDASGFFVHPRMSENSPPSPPPLKNGGSTCWTIPSPFSRTTAWANSSRHQNNNIIWHAYWVISRRTEAPSTQLFLPTVPNYHFLQELKQELLHNSAFLEFRQRIQADPSKYPDCSICDDFILQNGRIWLPKGLQVIPTILTEFHHTPTGGHMGNAKTLGRINENFVWPSMKQDVKLFISSCIEYVNRPRTITATARGYSVHFPCRREKLGDIYGDCRQNPWHATKPHLLPRSPVRESLLARTIQAKRYQTQDEHGVSPLNEWPDRGDESHNRALPPSFSPPKTDMGTFPPVGGVVVQHIHPLCYR

SEQ ID NO: 187408 - protein, 422 aa, Glycine max
  Coding DNA Sequence Number=SeqID_70630
  Gene Ontology: Mol. function=protein dimerization activity; Cellular component=chromatin; Biological process=DNA integration
  Homolog annotation: Hit_ID=Q2R1C3; Match level="QueryCoverage=94%, HitCoverage=56%, E-value=1e-107, Identity=48%"; Hit description=HAT family dimerisation domain containing protein
MFDLLKDVIKEVGPQNVVITDNAPVCKAAGLLIEAEFPHIFWTPCVVHTLNLGVKNICAAKNVDGNENVFNEYGWIAKVIGDASFIKVFIMTHSMGLAIFNEFSSLKLLSIAETRFASMIVMLKRFKLLKRCLQNMVISDQWNSYREDDVRKAAHVKELILNDIWWDKVDYILYFMDPIYSMIRICDTDASNLHLVYEMWDSMIEKVKTTIYRHDEVLENEVSSFFEVIHEILNSRWSKSCNPLHCLAHSLNPRYYSDNWLNEVPNRVPPHRDDELSSQRNKCLKRYFPHVNVRTKVYEEFSKFSSCAGDFGSFDSIEDRWALDPKTWWVMHGSSTPILQKVCFKASSAAMFFLMLLLSRKEEGYKKGETRLWDINGDVHDSLDDSAGILEMADLSLDEPDLEAMLFLDDGNGGEENETIRV

SEQ ID NO: 187409 - protein, 460 aa, Glycine max
  Coding DNA Sequence Number=SeqID_70631
  Gene Ontology: Mol. function=sequence-specific DNA binding; Cellular component=nucleus; Biological process=regulation of transcription, DNA-dependent
  Homolog annotation: Hit_ID=Q8W4H1; Match level="QueryCoverage=84%, HitCoverage=72%, E-value=4e-78, Identity=46%"; Hit description=GATA transcription factor 28
MQFKTDSFVSLIEAYNSKTDSLVNLGPAQSVVWDAMVPSKKRTCAGRPKPSSVEKLTRDLCTILHEQQSYFSASSEEDLLFESDTPMVSVEIGHGSILIRHPSSIARDEESEASSLSVDNKQCLMNEAYSFSSTIPIYSDRSSMNFSSHGVEKIKNSAGQIMQQEKLERHVFPHQDKSQLEKLQVHGNHDSPLCSIDLNDVVNYEEFMRNLTNEQQQQLLKYLPVVDTAKFPDSLRNMFNSFQFKENLIYFQQLLGEGVFNISLLGAKPEEWKTLERLALSNLSKSKWVEHYNFLKKCENKSGKSIGLGSTAMESSNVTTGKRMREHDSRNQNIPELKTTMRSPKRVIIKPPSCEVKEVVEEGSSFSPKSLFALPHGVGGLHMLDSFNFVGESSEDLLLEVPSNSSFPQAELLHPSLSYGARQGPHVLHLKHQSSCTRDMMMIVFLFPCNLELGLPKDGS

SEQ ID NO: 187410 - protein, 168 aa, Glycine max
  Coding DNA Sequence Number=SeqID_70632
  Gene Ontology: Biological process=protein folding
  Homolog annotation: Hit_ID=Q10T60; Match level="QueryCoverage=67%, HitCoverage=33%, E-value=6e-38, Identity=58%"; Hit description =Expressed protein
MGRKKNEPKRTVCSIPLIFLSAFLVSCGLIYALVVLRAPLSESELLPLVEDSKACCRGVENLELWGDVVKWGSDFKLNTSQECCNACKSTCTVNDNGPCLCDTWVFCANPHNCGSKFGECWLKKQKDSLAPEQINAEGEVVSWTSGLIFGKGEGIIGLETEFGTLRVK

SEQ ID NO: 187411 - protein, 132 aa, Glycine max
  Coding DNA Sequence Number=SeqID_70633
  Gene Ontology: Biological process=protein folding
  Homolog annotation: Hit_ID=Q10T60; Match level="QueryCoverage=81%, HitCoverage=31%, E-value=3e-31, Identity=61%"; Hit description =Expressed protein
MANESSYFQAAFGPPFALIQGTLEAQGGEGTIFKKIPIEDCPTIRRGSVAWVGSGPEFFISLANHWEWKKEFTVFGSVLPEDMHIAEKISTLPTKSDVWKNVNVTLLKKPVPLMLRRIDKGHENFNTKANSA

SEQ ID NO: 187412 - protein, 573 aa, Glycine max
  Coding DNA Sequence Number=SeqID_70634
  Gene Ontology: Mol. function=amino acid transporter activity; Cellular component=membrane; Biological process=amino acid transport
  Homolog annotation: Hit_ID=Q9LZ20; Match level="QueryCoverage=94%, HitCoverage=94%, E-value=1e-145, Identity=49%"; Hit description =Amino acid transport-like protein
  Pfam annotation: Domain name=AA_permease; Domain location=61-505; Score=6.8; E_value=6.5e-06; Accession=PF00324.11; Description=Amino acid permease
  Pfam annotation: Domain name=Aa_trans; Domain location=55-459; Score=- 163.5; E_value=0.097; Accession=PF01490.8; Description=Transmembrane amino acid transporter protein
  Pfam annotation: Domain name=Spore_permease; Domain location=56-408; Score=-154.7; E_value=0.012; Accession=PF03845.4; Description=Spore germination protein
  Pfam module annotation: Pfam domain module=AA_permease::Aa _trans::Spore_permease; Domain location=61-505::55-459::56-408
  Subcellular localization annotation: CTP_CleavageSite=50; ConfidenceScore=5.15e-01
MSNIHTATSSMKRLSSYLHSLSQTPHRLRKRMLATWTPEQEFNQVRHRSGADMKRKLKWHDLVALGVGGMLGVGVFVTTGSVALHHSGPSVFISYIIAGISALLSSLCYTEFAVQVPVAGGAFSYLRLTFGEFLGYFAGANILMEYVFSNAAVARSFTEYLSIAFGENDPNVWRVEVPGLPKDYNMLDFPAVALILILTLFLCHSTKESSMLNLIMTAFHIIFFGFIIIAGYCNGSAKNLVSPKGLAPFGARGVLDGAAIVYFSYIGYDSASTMAEEVTDPFKSLPIGIVGSVLITTLLYCLMALSLCMMVPYNKISEKASFSIAFLKIGWNWASNLVGAGASLGIVASLLVAMLGQARYLCVIGRARLVPSWLAKVHPSTGTPLNATVFLGLCTATITLFTELDIIIELISIGTLLVFYMVANALIYRRYVITSHAPPTHTLVFLFLLSLSALCFSLAWKFKQQWWVLLLFGGFMIAITAFFQHVVLTTTTTIHWSVPFMPWPPAMSIFLNVFLMTTLKILSFQRFAIWACLITIFYVLYGVHNTYEAEETENEVDSSVNNLHTKVEIIQVH

SEQ ID NO: 187413 - protein, 248 aa, Glycine max
  Coding DNA Sequence Number=SeqID_70635
  Gene Ontology: Mol. function=metalloendopeptidase activity; Cellular component=cytoplasm; Biological process=proteolysis
  Homolog annotation: Hit_ID=Q1T0S6; Match level="QueryCoverage=100%, HitCoverage=31%, E-value=2e-86, Identity=68%"; Hit description =Peptidase M, neutral zinc metallopeptidases, zinc-binding site
  Subcellular localization annotation: CTP_CleavageSite=3; ConfidenceScore=5.37e-01
MRRSSLVGALLIANMLMATRLTLTLPFSSSIPPLLNRTYRSLSHLKQFPKSHPCPLWSSSFSFCLHTLRKSTSPLRASSSLSTPSMAASSLDEGNPLLQNFVFPPFDVVEPKHVRPGIRALLGKLEHELEELERSVEPSWPKLVEPLEKIIDQLSVVWGMVNHLKAVKDSSELRSAIEDVQAEKVKFQLRLGQSKPIYNAFKAIQESPNWQTLSDARKRIVESQIKEAVLNGVSLEDDKRESFNKIEQ

SEQ ID NO: 187414 - protein, 294 aa, Glycine max
  Coding DNA Sequence Number=SeqID_70636
  Gene Ontology: Mol. function=nucleic acid binding; Cellular component= beta-galactosidase complex; Biological process=DNA integration
  Homolog annotation: Hit_ID=Q1T010; Match level="QueryCoverage=97%, HitCoverage=21%, E-value=1e-107, Identity=63%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTNLGKLSYFLGLEFLWTEYGIVMHQRKYAGEILQRFGMEDCNVAITPAETNQKLEDKPEEEGVDPTGYKQLVGSLRYLCNSRPDICYAVGVLSKFMNRPKKSHFLAAKRVLRYVKGTMQYGVMFPSSVDGAEMKLIGYSDADWCGDKTDRRSTSGYLFKFGGAAVSWSSKKQPVTALSSCEAEYISGSFAACQAIWLKSLLDELKCEVQMPLSLLIDNKSAISLAKNPVSHGRSKHIETRFHFIREQVNNGVLKLIYCPTEDQLADLLIKAVKPDRFIKLREEIGVICFEDLN

SEQ ID NO: 187415 - protein, 509 aa, Glycine max
  Coding DNA Sequence Number=SeqID_70637
  Gene Ontology: Mol. function=nucleoside-triphosphatase activity; Cellular component=integral to membrane; Biological process=transport
  Homolog annotation: Hit_ID=Q1T0S3; Match level="QueryCoverage=99%, HitCoverage=70%, E-value=0.0, Identity=75%"; Hit description=AAA ATPase
  Pfam annotation: Domain name=ABC2_membrane; Domain location=293-500; Score=162.1; E_value=1.4e-45; Accession=PF01061.14; Description=ABC -2 type transporter
  Pfam annotation: Domain name=ABC_tran; Domain location=1-92; Score= -44.4; E_value=0.0015; Accession=PF00005.17; Description=ABC transporter
  Pfam module annotation: Pfam domain module=ABC2_membrane::ABC_tran; Domain location=293-500::1-92
QSSRNTYIGDEGTRGISGGERRRVSIGVDIIHGPSLLFLDEPTSGLDSTSAHSVIEKVHDIARGGSTVILTIHQPSSRIQLLLDHLIILARGQLMFQGSPQDVALHLSRMPRKIPKGESPIELLIDVIQEYDQSEVGVEALAEFARTGVKPPPLSGQQQHSVSSVAPSSHLSHRYEENSQDLSYSSQVSRRVVDGFDHSLRSSHNNNTSMSWSTGNSAAFLKFTPSRLKNDHKLQNTARTNASPGYYAHWSEILEATPTPRSSDYTVNEKDYLAPSNATQEHLGAKFANSYLGEIWILMRRNFINIRRTPELFLSRLMVLTFMGIMMATMFFKPKETLQGITNRLSFFIFTVCLFFFSSNDAVPAFIQERFIFIRETSHNAYRASTYTIAGLITHMPFILLQATAYAVIVWFALKLRGPFLYFLLVLFVSLLSTNSFVVFVSSVVPNYILGYAVVIAFTALFFLFCGYFLNSNDIPHYWRWMNKISTMTYPYEGLLMNQYQTNDTFGFG

SEQ ID NO: 187416 - protein, 553 aa, Glycine max
  Coding DNA Sequence Number=SeqID_70638
  Gene Ontology: Mol. function=protein serine/threonine kinase activity; Cellular component=integral to membrane; Biological process=protein amino acid phosphorylation
  Homolog annotation: Hit_ID=Q5MKK9; Match level="QueryCoverage=99%, HitCoverage=61%, E-value=0.0, Identity=69%"; Hit description =Nodulation receptor kinase
  Pfam annotation: Domain name=LRRNT_2; Domain location=351-393; Score =24.3; E_value=0.00045; Accession=PF08263.3; Description=Leucine rich repeat N-terminal domain
  Pfam annotation: Domain name=LRR_1; Domain location=400-421; Score =8.1; E_value=8.6; Accession=PF00560.23; Description=Leucine Rich Repeat
  Pfam annotation: Domain name=LRR_1; Domain location=423-445; Score =7.8; E_value=9.9; Accession=PF00560.23; Description=Leucine Rich Repeat
  Pfam annotation: Domain name=LRR_1; Domain location=447-467; Score =1.9; E_value=1.3e+02; Accession=PF00560.23; Description=Leucine Rich Repeat
  Pfam module annotation: Pfam domain module=LRRNT_2::LRR_1::LRR_1::LRR_ 1; Domain location=351-393::400-421::423-445::447-467
MELPDIWILRLVVACVFCLLIFIRSASGSATEGFENIACCADSNYTDPQTTLNYTTDYRWFPDKGSCRRTKDVLNEKVRLFFVDEGKRCYNLPTIKNKVYLIRGTFPFNGVNSSFNVSIGVTQLGAVRSSGLQDLEIEGIFRATKDYIDFCLVKGEVDPFISQLELRPLPEEYLHDLPASVLKLISRNSFWGTKDEIRFPTDPSDRIWKATSSSLSALLLSSNVSNFDLKSNVTPPLQVLQTAVTHPDRLQFVLSGLDIEDNEYRVFLYFLELNSTVKAGKRVFDIYVNGEIKKERFDILAGGSNYTYTVLNVSANGLLNLTLVKASGAEFGPLLNAYEVLQMRSWIEETNQKDVEGIQKIREELLLQNQDNKALESWTGDPCFFPWQGITCDGSNGSSVITKLNLSHNDFNGYIPSFPLSSLLISIDLSYNDLMGSLPESIVSLPHLKSLYFGCNKRMSKEDPANLNSSPINTEYDTLSEMKQQNYGRCKGKEPRFGQVFVIGAITCGSLLITLAVGIIFVCRYRQKLIPWEGFGGKNYLMETSRHFVFSSP

SEQ ID NO: 187417 - protein, 540 aa, Glycine max
  Coding DNA Sequence Number=SeqID_70639
  Pfam annotation: Domain name=LRR_1; Domain location=27-50; Score=8.3; E_value=7.8; Accession=PF00560.23; Description=Leucine Rich Repeat
  Pfam annotation: Domain name=LRR_1; Domain location=52-71; Score=6.0; E_value=21; Accession=PF00560.23; Description=Leucine Rich Repeat
  Pfam annotation: Domain name=LRR_1; Domain location=6-25; Score=11.2; E_value=2.2; Accession=PF00560.23; Description=Leucine Rich Repeat
  Pfam annotation: Domain name=Transposase_24; Domain location=319-449; Score=17.5; E_value=1.3e-05; Accession=PF03004.5; Description=Plant transposase (PttaEnSpm family)
  Pfam module annotation: Pfam domain module=LRR_1::LRR_1::LRR _1::Transposase_24; Domain location=27-50::52-71::6-25::319-449
MNSLTTLRRLNLSFNKLTDSIPKLPPNLLELTMKANSLSGPLQKQSFEGMNQLEVVKLSENVLTGTVNPRLRARESRHISHAVLPVDFVQHAAWRNPAGVWADQVHEEAVPRRRLKGEEDRCSPSFYTNILVAEKDTNKGKASKSHPTKQHTAYHAQTTSQNPPCASQPTNSMEGAHSPARTSDVSPPPSMKGVRSPCTSQPTNSDAGRADRSFASLETQRNEAKPILYLDGQGFLPSRSAANGIGDILKKNFTDPWPSWKKIPISTRNSLFEEFLEKFSVSPPDYNWAKKNFEMRGSVLLKNNLNKARTTMDKPHWITDGVWERLCNHWRSEGFKKKSTQAKTNRASNCGASHTGGSISASQHRANMMKETGTIPTPLELFRRMHQRKDNTWVDRRSQHEVFTRTLKQLTKRASAQGKPPPSELDVWCDVARSKKGKVYGFGMESTVMATSPCYRCSSSSSMEWVKKQEFDELAKEMEEVKNERDKLQARVANTERLVEHNNALIRELIESMKFTVNDSQDEGEESDREYEDEESPSEP

SEQ ID NO: 187418 - protein, 287 aa, Glycine max
  Coding DNA Sequence Number=SeqID_70640
  Gene Ontology: Mol. function=chromatin binding; Cellular component =chromatin; Biological process=chromatin assembly or disassembly
  Homolog annotation: Hit_ID=Q1SAV4; Match level="QueryCoverage=53%, HitCoverage=58%, E-value=1e-20, Identity=32%"; Hit description =Integrase, catalytic region
IPALSKIIIAVVDFDISLKDVFVFHLHTLNIEVEDLGISSYYSARVKAKKKMKIQEELVEDKESTMEEKYIERGGRGGDRALELPLSWGKFIIWAEWSYNTSIHAATGITPYKTTFGKKPPSIPQYLIGTSNIDVVDDFLTSREIVFAMGLGAEKIGPIAYHLELPPHSRIHPVFHCSLLKPFHQNSSTHTPVGNLPSKFVDNDPVITPLVILNTKWAPSANGLEPLENYHLEDKVLPDEQGDVMKQPSIGELQVDKEETSTNLRAKRKTSKPHYLDDFVINSDPKR

SEQ ID NO: 187419 - protein, 82 aa, Glycine max
  Coding DNA Sequence Number=SeqID_70641
  Subcellular localization annotation: CTP_CleavageSite=74; ConfidenceScore=5.83e-01
MKGYKVWTSTFNSSTTTTFIPFNNNLSPNYPLTPPSYTASNCFPSFQSQRPKLIAQNFKPHILLCTSLPMLRVSLELGSSII

SEQ ID NO: 187420 - protein, 163 aa, Glycine max
  Coding DNA Sequence Number=SeqID_70642
  Gene Ontology: Mol. function=nucleoside-triphosphatase activity; Cellular component=integral to membrane; Biological process=transport
  Homolog annotation: Hit_ID=Q1T0S3; Match level="QueryCoverage=93%, HitCoverage=20%, E-value=4e-63, Identity=80%"; Hit description=AAA ATPase
  Pfam annotation: Domain name=ABC_tran; Domain location=65-161; Score=- 54.6; E_value=0.012; Accession=PF00005.17; Description=ABC transporter
MTQANGHRRVDQTVIDIKKPPVSFTGGLVFECLTYTVTKKKKVEEKWSNQEVDLLHEITSYAPKGCITAVMGPSGAGKSTLLDGLAGRIASGSLKGRVSLDGATVSASLIKRTSAYIMQEDRLFPMLTVYETLMFAADFRLGPLSLADKKQRVEKLIDQLGLT

SEQ ID NO: 187421 - protein, 710 aa, Glycine max
  Coding DNA Sequence Number=SeqID_70643
  Homolog annotation: Hit_ID=Q2R124; Match level="QueryCoverage=91%, HitCoverage=69%, E-value=1e-156, Identity=43%"; Hit description=Pg1, putative, expressed
  Pfam annotation: Domain name=DUF1399; Domain location=93-238; Score =267.9; E_value=2e-77; Accession=PF07173.3; Description=Protein of unknown function (DUF1399)
MEPQQEMEWNEAQKIPISVDLEVVAKKQLQFLATVDKNRHLYDGPALDRAIYRYNACWIPLLAKHSESPIFEGPLVVPLDCEWIWHCHRLNPVRYKTDCEELYGRVLDNFGVATTVEGICGWQTEEIWNKLYPDEPYNADLVNLLPEDISKRISKLEKYTKYDLISAAKRQSPFFYQVSRTHMKNDLFIKEAVARYKGFLHLIKRNKEKGIKRFCVPTYDIDLIWHSHQLHPVAYCKDLNEALGKVLEHDDTDSDRTKGKKLDLGFSGTTRQWEVTFGTRYWKAGAMYRGNAPSPITSNPFPSSITCKKVVSSNEYPQEISLPDRKVMEVLLEFIGVKNLPEGQEGDLCVLFSKSQPDAFFDAKRRLSILSVSREKQVASFRCEPTGELLFELMSSSSSKLSIRKSTKTLGSASFSMKDYLDPVSKLYVEKWLELVPGSGTMSSKPILLRVAISFTVPVLAPYTLEMTQSRPFSKNTCLFNLPVRPQHAKSWTHVTDENGTRIISLQMRDLKNAKNIGNPGKEVVGLMKSGETRTLAEFMENGWSILENLWLFHLPNKSTNDGHLFELTGANKRVRIFPGRKLDYELRHNGKRGNEMNFLTAVEFSIEEPYGKAVALLDLRSRHVTAKEKWMVLPGIILTFIASNIMKKEGYEGIIAKSKDLKVNGPNEENEKTVLNGTGLSSTNMCNDDEGITYKSEISIGGCGNAVES

SEQ ID NO: 187422 - protein, 146 aa, Glycine max
  Coding DNA Sequence Number=SeqID_70644
  Gene Ontology: Mol. function=monooxygenase activity; Cellular component=membrane; Biological process=electron transport
  Homolog annotation: Hit_ID=Q1SS95; Match level="QueryCoverage=74%, HitCoverage=26%, E-value=6e-29, Identity=50%"; Hit description=E -class P450, group I
MSEFNIFNDTGLQRCMITDVESLFSSKTIKLHPPTPLLLPRESKEKCQINGYEILARTRVFINAWLLEETLSIGLMLRHLSQRGGPGIAFAIADIELPLAHLLYHFDWKLPNGIKLEELDMSESFGLSARRKNGLCLIHIIHHLLL

SEQ ID NO: 187423 - protein, 474 aa, Glycine max
  Coding DNA Sequence Number=SeqID_70645
  Gene Ontology: Mol. function=monooxygenase activity; Cellular component=membrane; Biological process=electron transport
  Homolog annotation: Hit_ID=Q1SDS7; Match level="QueryCoverage=99%, HitCoverage=94%, E-value=0.0, Identity=70%"; Hit description=E-class P450, group I
  Pfam annotation: Domain name=p450; Domain location=12-467; Score =353.5; E_value=3.5e-103; Accession=PF00067.12; Description =Cytochrome P450
MKKKSASTPNLPPGPWKLPIIGNILNIVGSLPHCRLRDLSAKYGPLMHLKLGEVSTIVVSSPEYAKEVLNTHDLIFSSRPPILASKIMSYDSKGMSFAPYGDYWRWLRKICTSELLSSKCVQSFQPIRGEELTNFIKRIASKEGSAINLTKEVLTTVSTIVSRTALGNKCRDHQKFISSVREGTEAAGGFDLGDLYPSAEWLQHISGLKPKLEKYHQQADRIMQSIINEHREAKSSATQGQGEEVADDLVDVLMKEEFGLSDNSIKAVILDMFGGGTQTSSTTITWAMAEMIKNPRVTKKIHAELRDVFGGKVGHPNESDMENLKYLKSVVKETLRLYPPGPLLLPRQCGQDCEINGYHIPIKSKVIVNAWAIGRDPNHWSEAERFYPERFIGSSVDYKGNSFEYIPFGAGRRICPGLTFGLTNVELPLAFLMYHFDWKLPNGMKNEDLDMTEALGVSARRKDDLCLIPITFHP

SEQ ID NO: 187424 - protein, 166 aa, Glycine max
  Coding DNA Sequence Number=SeqID_70646
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=53%, HitCoverage=73%, E-value=9e-41, Identity=94%"; Hit description =Chloroplast 50S ribosomal protein L14
  Pfam annotation: Domain name=Ribosomal_L14; Domain location=62-165; Score=137.0; E_value=5.1e-38; Accession=PF00238.10; Description =Ribosomal protein L14pL23e
  Pfam annotation: Domain name=Ribosomal_L16; Domain location=1-113; Score=108.1; E_value=2.5e-29; Accession=PF00252.8; Description =Ribosomal protein L16
  Pfam module annotation: Pfam domain module=Ribosomal_L14::Ribosomal _L16; Domain location=62-165::1-113
MKGISYRGNHICFGRYALQALEPAWITSRQIEAGRRAMSRNVRRGGQIWVRIFPDKPVTVRPTETRMGSGKADNSGARELMCIRILGASNRRYAYIGDIVVAVIKQAVPNTNLERSEVIRAVIVRTRKELKRSNGIIIQYDDNAAVVIDQEGNPKGTRIFCQSPGN

SEQ ID NO: 187425 - protein, 54 aa, Glycine max
  Coding DNA Sequence Number=SeqID_70647
MDKSLKVGEDEWKEKEKRSTRKGARNFMPQIRVRSDNPFPGHLPMREHSSSPTQ

SEQ ID NO: 187426 - protein, 51 aa, Glycine max
  Coding DNA Sequence Number=SeqID_70648
MVNDIRFFDLNTGAKIPLVCLGTWQSNPGLVSEVVAAAIKKAFFKLFDVCC

SEQ ID NO: 187427 - protein, 152 aa, Glycine max
  Coding DNA Sequence Number=SeqID_70649
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=9e-15, Identity=29%"; Hit description= UPI00006A17C9 related cluster
MRALHVLPVRGLHAPAIKGLHVLTFRGLHAFTFRGLYVLSFRVLHAVTFRGLHVLTFRGLHVLTIRGIDVLAFRGLHALTFRGLHIITFKGLHILTFRRLHVLTFRGLDVLAYKGLHVLTFRELHVLAFRGLHALTLKGLHVFTLRTLWPHL

SEQ ID NO: 187428 - protein, 159 aa, Glycine max
  Coding DNA Sequence Number=SeqID_70650
  Homolog annotation: Hit_ID=Q1SF96; Match level="QueryCoverage=45%, HitCoverage=13%, E-value=8e-20, Identity=66%"; Hit description =Membrane attack complex component/perforin/complement C9
  Pfam annotation: Domain name=Di19; Domain location=41-159; Score= -4.6; E_value=1e-08; Accession=PF05605.3; Description=Drought induced 19 protein (Di19)
MAAEKGVEMVALECLGKRFNLASNFRLRFAKGIQKERLVVLDEQNKRDILIPGTRGVTIKGVSKNIHCDKGDYDVVSLCFHIDDHHPVQAKIGRKRRVRKVGSGSTMSILRKELREGALQSLLGSSSYLASSNSEPDPLLSSFMFNPAVTDDSFVEDTL

SEQ ID NO: 187429 - protein, 99 aa, Glycine max
  Coding DNA Sequence Number=SeqID_70651
MVCQKGLLIGICNLENTKHILRSTPKRRVGRRPMKNNKNVMVDAPGNDDFLRDTMIGGFTIFNFFLQTIIITIFVLFKCNQSMVYSIILHPLNSNGVRV

SEQ ID NO: 187430 - protein, 75 aa, Glycine max
  Coding DNA Sequence Number=SeqID_70652
  Homolog annotation: Hit_ID=Q153F8; Match level="QueryCoverage=78%, HitCoverage=17%, E-value=2e-21, Identity=78%"; Hit description =Pectin acetylesterase
MAKERKDSTVKMVNGFRNQMLNAIKGFSRSPQNGLFINSCFAHCQSERQDTWFADNSPVIGNKNIHLEKNSRTFM

SEQ ID NO: 187431 - protein, 306 aa, Glycine max
  Coding DNA Sequence Number=SeqID_70653
  Gene Ontology: Mol. function=protein binding; Cellular component =cytoskeleton; Biological process=signal transduction
  Homolog annotation: Hit_ID=Q1RVU7; Match level="QueryCoverage=99%, HitCoverage=71%, E-value=1e-94, Identity=58%"; Hit description=IMP dehydrogenase/GMP reductase
  Pfam annotation: Domain name=Ank; Domain location=107-137; Score =12.3; E_value=0.52; Accession=PF00023.20; Description=Ankyrin repeat
  Pfam annotation: Domain name=Ank; Domain location=141-180; Score=6.7; E_value=3.4; Accession=PF00023.20; Description=Ankyrin repeat
  Pfam annotation: Domain name=Ank; Domain location=187-219; Score =27.9; E_value=3.5e-05; Accession=PF00023.20; Description=Ankyrin repeat
  Pfam annotation: Domain name=Ank; Domain location=39-71; Score=4.1; E_ value=8.1; Accession=PF00023.20; Description=Ankyrin repeat
  Pfam annotation: Domain name=Ank; Domain location=73-103; Score=5.8; E_value=4.6; Accession=PF00023.20; Description=Ankyrin repeat
  Pfam module annotation: Pfam domain module=Ank::Ank::Ank::Ank::Ank; Domain location=107-137::141-180::187-219::39-71::73-103
MNTSDDKLKVAAQEGDISLLYTLIQEDLHVLDHMDLTPFAETPLHIVACVGHLQFATEIMRLKPSFASKLNQQGFTPIHLDMQHGQKRMVLRFVDINKDLVRVKGREGLTPFHFASQKGEIDLLANFLLACPDSIEDVTVRCETALHIALRSQQYEAFRVLVGWLQRTRQRGATTLEKTILNWRNEEGNTILHVSALMNDSKAIRLLVKTKVDLNAKNWENLTALDIAANAEVKIVLAKAGAKHGSSITNAPTFPDKLRSNITLMEKIIIFILRIRRDITEDQRNAFLIVAALVATATYQSALSPP

SEQ ID NO: 187432 - protein, 71 aa, Glycine max
  Coding DNA Sequence Number=SeqID_70654
MYMEAGNMFDEFQCNLNAQKRTTLTILCILIDAILPRKGPVTRAMSKRLQEDWARATEEGLKVLMNLGVDF

SEQ ID NO: 187433 - protein, 112 aa, Glycine max
  Coding DNA Sequence Number=SeqID_70655
  Gene Ontology: Mol. function=DNA binding; Biological process=DNA integration
  Homolog annotation: Hit_ID=Q1SKC8; Match level="QueryCoverage=91%, HitCoverage=56%, E-value=2e-12, Identity=59%"; Hit description =Integrase, catalytic region
MVGPTSTMCSCGKSWDITMSDIKLLLHTILRQMAMPRLKLFPRRLRSKWSSPFTIKDVKLYGAMELMDPSSADLKHSCIVNGQRVKVYNGGDIKRLTTIIELHEPCESFASS

SEQ ID NO: 187434 - protein, 54 aa, Glycine max
  Coding DNA Sequence Number=SeqID_70656
MVISSHGVAAKDKGEEPSTWEVSLRRKEGSFLGKLEEESFVEKLEGGYSHPSNS

SEQ ID NO: 187435 - protein, 207 aa, Glycine max
  Coding DNA Sequence Number=SeqID_70657
  Gene Ontology: Mol. function=RNA-directed DNA polymerase activity; Cellular component=intracellular; Biological process=RNA-dependent DNA replication
MTVIHNEKNDLVPTRTVTRWNMHIDYRKLNDATRKDHFPLPFMDQMLERLCDALATFQRCMLAIFADLVEKYIERFVKDFSKIAKPLSNLSNKDVVFKFDEECMLAFHTLKGRLVSAPVIVAPNWSQEFEIMCGASDYVVGAVLGQRQIRCFTQFTMPDNPHLFKLGADNLLRRCATREEVRSILWHYHNSPYGGHYNGDQTTAKVL

SEQ ID NO: 187436 - protein, 215 aa, Glycine max
  Coding DNA Sequence Number=SeqID_70658
MYHKKRAKLETKDDKGNGTKVVPIHALIKKVVRKRSSYIKANANSYGKSLAGLRRLLEEDLKLDKFTLDPYKRFASQQLDEVLASSEVPEPSNNVKKIVKKKPNTKVTKKVSNEENSDTSDKETDEEESEEDEHWSIYKTKVERKDIELVDEEEAQIGVDRSSATSNKCEIYKEEARNAAQKHKTKRVESVNADAEAFGDHWKIQIALCILKLKH

SEQ ID NO: 187437 - protein, 81 aa, Glycine max
  Coding DNA Sequence Number=SeqID_70659
MMQENFFQPVAWLEDRPSSTEGNELAATAKVETVVATTAEVEPVADIATETEARPSIAVDPLYLLFSFCDITYTTILWFTA

SEQ ID NO: 187438 - protein, 132 aa, Glycine max
  Coding DNA Sequence Number=SeqID_70660
MGESKEFLDCVVLNSLTREKGDTKEFRRLVLCSFGKRRRETQKEFRRLVLGEFFLAKGEENEKMNSTSFQGLENPKTSENFWYNEEEVQRDSRLVKDCKRLIGKVFKIIEMQNKALLLYTLHVWSRQPLEEL

SEQ ID NO: 187439 - protein, 182 aa, Glycine max
  Coding DNA Sequence Number=SeqID_70661
  Gene Ontology: Mol. function=nucleoside-triphosphatase activity; Cellular component=excinuclease ABC complex; Biological process =nucleotide-excision repair
  Homolog annotation: Hit_ID=Q2KVT5; Match level="QueryCoverage=68%, HitCoverage=72%, E-value=8e-42, Identity=48%"; Hit description =Putative excinuclease ABC subunit
MAFKLSSELVDAAKGSGDAIRKKEETHRMAEANRAFAHFRALGRLERGDAGQPAFLVLGQQLLEVLAGPAGVDLGYVLGRAHRHDLAAAVAALGTQVQQPVGFGDDVEIMLDHHHRIAGFHQAVQHVDQLFHVGHRQAHGRLVQHVQRVRDARGAAGLDQAVGQARLGQLGHELDALRLAAG

SEQ ID NO: 187440 - protein, 90 aa, Glycine max
  Coding DNA Sequence Number=SeqID_70662
MATARWALKHPVYGIVILRLGICTNRPNVSKKKWKHKHKNGCDLYPELIRSRAWKRSKTQALQAEAQLVKTIMGLYMRPVVGRLLANQMP

SEQ ID NO: 187441 - protein, 406 aa, Glycine max
  Coding DNA Sequence Number=SeqID_70663
FISLSFELSVVVSDNGIGEVIPINEVFPGPRGAQTVKIFRRSVWHVCKLLALHASPGGHLVWFLLFFDHNFLSIYGGSLERLLDDGLELPNLLGASQLGEHVFLSIAFTKDVIHFETFKIFDERLHNVIVLEQHCFLGLACVGNLPLDKLQVYVASKLLSSDFSAWLFEALKLSLRACTRVTLLGPSRMIPASLPFTLDAPSTLSLNLLDGVVRLDYHLMTLKVGPKSSGRGACRICGVPRRLLSSPPHVGISVVGVHSSFAIDLFDHDDIGELGRKPDFSNEHIGDAPMLVTSEVPTEPRALPGFRFKLQLDKLFDGFRASIGGVISRIYVKFTAQDGLVDNQGSDLRPFLHGHDSSDFSHCVYVSLSEAPARSTRYKNLAENLPCKHTLSALSLAKRVIRHLPG

SEQ ID NO: 187442 - protein, 150 aa, Glycine max
  Coding DNA Sequence Number=SeqID_70664
  Gene Ontology: Mol. function=catalytic activity; Biological process =metabolic process
  Homolog annotation: Hit_ID=Q01CB8; Match level="QueryCoverage=70%, HitCoverage=34%, E-value=4e-17, Identity=43%"; Hit description =Homology to unknown gene
MNVKRREYMVGVLPKRRILMRHGKSQGNQDTAAYTTTPDHNIQLTVQGMAQALHTGEHLHRVMGSDGCSPDWRVQFYVFPYVHTQSMFHELRKCFLKKRVIGVREELRVRERDFRNFQVKERMKVWSSKAKAYRKRVSEENSFQEIAKYK

SEQ ID NO: 187443 - protein, 170 aa, Glycine max
  Coding DNA Sequence Number=SeqID_70665
  Homolog annotation: Hit_ID=Q56XU5; Match level="QueryCoverage=25%, HitCoverage=11%, E-value=3e-10, Identity=70%"; Hit description=3 -hydroxyisobutyryl-coenzyme A hydrolase
  Subcellular localization annotation: CTP_CleavageSite=36; ConfidenceScore=5.18e-01
MMLLSATHRKNKKSHSNTAKNRKNKKSLQFGHNKTYSIKKREEIASWPCKRRNQTLPEWLKTEFRLTMNLLQTTISEDMYKGIKALTIDKDNAPKCSKEYFTQGSNVFLEGFEDISFHASKTFKFTEVKKDIVASVNTPAQAHGNEIHKVGQTGTTTTGTGTKRNRNRLF

SEQ ID NO: 187444 - protein, 58 aa, Glycine max
  Coding DNA Sequence Number=SeqID_70666
MLWVKHPRHYMKELRAFRVFIKEAQNMQWWFQSQKRCKEKLKLTRNKRRTMVTLKEIE

SEQ ID NO: 187445 - protein, 198 aa, Glycine max
  Coding DNA Sequence Number=SeqID_70667
PEKKDLGGKVDSMATKRDGLARLEESELWAAQEKRLVGSLRKSCFCTRRIMEKHEKCFQKAVRQAGFFENDLVSKDHGGLVKSKVWRSHLRFDFNLVKGLVTPLVGLPSGLANQFGGRSLDLLPYLMVMRSKCELYLIEGLVMQSGVHFVEVRPWTMVVIVAASKLTKGGSSRVNLGFLEPWTGDVFALGFVKPTKLY

SEQ ID NO: 187446 - protein, 80 aa, Glycine max
  Coding DNA Sequence Number=SeqID_70668
MELKAETNQGKMVTRPQFAEGHATVVKCHFLLSVNIGYLIYPKGGSSKRTPTRRERILVSSLKKNCRLARLGEHPQHEIV

SEQ ID NO: 187447 - protein, 84 aa, Glycine max
  Coding DNA Sequence Number=SeqID_70669
MASIKIAFAVVFLALIACNGHGFKNIRRMKALGENHETDECWKTGCYHKGKPQCNVNRDCWFACTDYCDIAYCDMSTRKCVCPC

SEQ ID NO: 187448 - protein, 142 aa, Glycine max
  Coding DNA Sequence Number=SeqID_70670
MDAKHLTRTKERSHDIKQRSPDEIRCGPSRQSSILHLFQSPMNVIAKRCSCVLHLRVWNYVSRLPNALHVSSTFEFGAMFHDCLSADPQGNPPFSPFFGAPRMLLSSAVHVSSTFEFGAMFHDSLSADPQGNPPFSPFFGDP

SEQ ID NO: 187449 - protein, 130 aa, Glycine max
  Coding DNA Sequence Number=SeqID_70671
DGDVDLNASPQSLDKLLGHELAFKIKVQPKFRNSAVLKCSADSSLINVVMDMLADAETYSKMDIPVSDSNHSAQHEYQSLSVTADHDPLLGLPLTPTKRKTFQDCDDEAGTSQISHAQLSSNKLKKHVGI

SEQ ID NO: 187450 - protein, 253 aa, Glycine max
  Coding DNA Sequence Number=SeqID_70672
RDSNVSMTDLVSAEDDVNLRVSTGLSAAIDEGRRRRRQSSHAIRLFVLQTAKKNVYTDNHSGISARQRDSNVSMTDLVSAEDDVNLRVSTGLSAAIDEGRRRRCQSSHAIRLFVLQTAKKNVYTDNHSGISARQRDSNVSMTDLVSAEDDVNLRVSMGLSAAIDEGRRRRCQSSRAIRLFVLQTAKKNVYTDNHSGISARQRDSNVSMTDLVSAENDINLRVSTGLLFVLQIAKKNVYTDNHSGISARQRDSN

SEQ ID NO: 187451 - protein, 287 aa, Glycine max
  Coding DNA Sequence Number=SeqID_70673
  Gene Ontology: Mol. function=signal transducer activity; Cellular component=signal recognition particle, endoplasmic reticulum targeting; Biological process=signal transduction
  Homolog annotation: Hit_ID=Q8U728; Match level="QueryCoverage=69%, HitCoverage=25%, E-value=1e-106, Identity=96%"; Hit description =GGDEF family protein
  Pfam annotation: Domain name=EAL; Domain location=1-198; Score=255.5; E_value=1.1e-73; Accession=PF00563.11; Description=EAL domain
CWQHPTRGVVPPDVFIPIAEESGIIISLGEWVLREACRQANTWAPHLKIAVNVSPLQFSLANLGHVVCTILMQTGLSPNRLELEITEAALLKDRKATLTILTQLKALGVAIVMDDFGTGYSSLSNLQSFPFDKIKIDRSFIAAMSDDDNARAIVRAVIGLGRSLDLPVTAEGIETDAQYRMVVDEGCAQAQGYLFGKPDVAPAQAAGAAARGARCRPSPCRPSTLGHSSSQPDFMEREPAQIVRIACGAPCCPCPFRRRTTARTKLSDQLFPGRARRMDTFYWESPQ

SEQ ID NO: 187452 - protein, 201 aa, Glycine max
  Coding DNA Sequence Number=SeqID_70674
  Gene Ontology: Mol. function=nucleic acid binding; Cellular component= nucleus; Biological process=DNA integration
  Homolog annotation: Hit_ID=Q1S9T9; Match level="QueryCoverage=82%, HitCoverage=12%, E-value=5e-41, Identity=48%"; Hit description =Peptidase S8 and S53, subtilisin, kexin, sedolisin; Integrase, catalytic region; Zinc finger, CCHC-type
  Pfam annotation: Domain name=rve; Domain location=80-201; Score=48.2; E_value=2.8e-11; Accession=PF00665.16; Description=Integrase core domain
MAEEEEEEERQRHWFVTYEKKSGGNILMGNDVPCHMSEKGLDIMSKRGLLGNHKVKPLQFYEHCVYRKQHWMNFPKVVHTTKAMLDYIHFDCWGSSRFSSLGGEMYFLSIIDGYFGMTWLFIMKQKSKAFKIFKHWMILMKNRIGNIVKCLRSGNGLEFCSTKFNEFYKDKDITRQHIVRYTPKQNGVVERMNKTLLEMVK

SEQ ID NO: 187453 - protein, 47 aa, Glycine max
  Coding DNA Sequence Number=SeqID_70675
MAFPRGAVKEGISLRGCVVKGDVVARGVRVERKEKGDAAVEKWLVKI

SEQ ID NO: 187454 - protein, 67 aa, Glycine max
  Coding DNA Sequence Number=SeqID_70676
MIPMTIVVVMTTVEAKAIVVVTTMAMVVDGDDNDDSDNNNDNGVNNNDDCDSEKEKSHGIRCTSYSS

SEQ ID NO: 187455 - protein, 113 aa, Glycine max
  Coding DNA Sequence Number=SeqID_70677
  Homolog annotation: Hit_ID=Q19PK5; Match level="QueryCoverage=50%, HitCoverage=4%, E-value=2e-10, Identity=55%"; Hit description=TIR -NBS type disease resistance protein
MGCKWIFKKKYGLSTKEVILYKASTVAKGYSQKEGMDCIEIFSLVARQISIHVLLALVKKRLSHEVLKVTFELSSLQLSSSRLNAGLALSSNPLTRAKRKGGTKCNVANSEPI

SEQ ID NO: 187456 - protein, 106 aa, Glycine max
  Coding DNA Sequence Number=SeqID_70678
  Gene Ontology: Mol. function=sugar porter activity; Cellular component=integral to membrane; Biological process=carbohydrate transport
  Homolog annotation: Hit_ID=Q07A14; Match level="QueryCoverage=64%, HitCoverage=12%, E-value=3e-11, Identity=52%"; Hit description =Putative sugar transporter
MAEFLRTSLHAVVSLGEKFLFLALGGLLFGYDIGATSGATISLQSPELSGISWFNLSAIQLGLVVSGSLYGALLGSLVAFARADFLGRKKQLITATLLYKFIDTSN

SEQ ID NO: 187457 - protein, 811 aa, Glycine max
  Coding DNA Sequence Number=SeqID_70679
  Gene Ontology: Mol. function=DNA binding; Cellular component=oxygen evolving complex; Biological process=DNA integration
  Homolog annotation: Hit_ID=Q1S1E0; Match level="QueryCoverage=99%, HitCoverage=92%, E-value=1e-113, Identity=34%"; Hit description =Integrase, catalytic region
  Pfam annotation: Domain name=rve; Domain location=221-375; Score =83.3; E_value=7.7e-22; Accession=PF00665.16; Description=Integrase core domain
  Pfam annotation: Domain name=zf-CCHC; Domain location=120-137; Score =7.2; E_value=0.063; Accession=PF00098.13; Description=Zinc knuckle
  Pfam module annotation: Pfam domain module=RVT_2::rve::zf-CCHC; Domain location=543-707::221-375::120-137
MVVSWLVHSVSPSIRQSILWMDNARDIWKDLKSRYSQGDLLRISKLQQEMASIKQGDQRIIDYFTKLRIIWDELESYRLDPTCSCDPKCVCDALTSMIERKGKGTQSNSGKGNFGAKRNKVCTHCGLSNHTIDDCYKKHGYPLGHKFYKVQNPNINNVNTKREEGDGSPLDRNQETQNVDVRLTTQQYKALMSWLQQRAPAQSNSQINQIGTMTNKGNILSVTCSVSKTSQDEWILDFGAIDHVTTFPHLFSLCKKIKHSKAETQSHLKNFVANVERQFETKVKVIRLDNGAEFIMRQFYDDTGIVHQTTCVETPQQNDIIERKHQHLLNVTRSLLFQSNLPTVFWSYALIHSTVLINCMPSPFLNNHTPYEKLHGKIYDIESLRVFGCLCFSSTLIANRKKLDPRVATSIFLGLKPNTKGFIMFDLKTKAISVSRNVIFYKDCFPFIGQDKHDVVTILPIPSSHAIDQPDGVSSELPVDHIMLVPNNVDSDPLTLEQSSNTTKRSLRQTHRPSKYKDFHVSYPSSTVASYSAASKDPVWVEAMNAKIKALELNDTWILTDMPQHKNVIGRKWVYKIKHRSDGSVERHKARLVAKGYTQVEGQDYLDTFSPIAKLTTVRLLLALAAINKWYLKKLDVNNAFLHGDLNEEVYMMLPQGMQVSKLGQVCFEVARKPTGINLCQRKYALDILSDDGMLGSKPVSTPPSNYATKLHQQSGTPLSLEDASSFRRYIKGSPGAGIFLSTATLNPVFHERTKHIEIDYHIVLEKVLRGLLKLLPIPSTNQLADVYTKALMSSAFKFMHSKLGMSDIHS

SEQ ID NO: 187458 - protein, 63 aa, Glycine max
  Coding DNA Sequence Number=SeqID_70680
MFCHWKLGLATPRGGNRPGWPTGAYDLTYIKPGFDYNLESFILHLSVSKEQSLGTRIGVGVGL

SEQ ID NO: 187459 - protein, 400 aa, Glycine max
  Coding DNA Sequence Number=SeqID_70681
  Gene Ontology: Mol. function=nucleic acid binding; Cellular component= chromatin; Biological process=DNA integration
  Homolog annotation: Hit_ID=Q1SRN1; Match level="QueryCoverage=64%, HitCoverage=22%, E-value=2e-48, Identity=37%"; Hit description =Integrase, catalytic region
MPYVHNAGIQATISPQAPPQANLATASSAPSNSWYPDSGASHHVSKEVLLKGLVGLDGLYQFPNLLQLPKSKSSVNTIVCSTSSSETVTSSTNNTSVGSSAPCAVSSFATCNARLAAVADSPSLVSTPILQLYSSYHPTPEPTIDTSASVSQLQFPAPEPIPEPAKSGIVKPRLNPTFPLTHAEPKSVKSAISNPTWYEAMKSEYDALIKLCTWTLVELPSHKMAIGCKLGHDYNETFFPVLKPVAVRILLTLAILNNWPLQQLDVNNAFLNGLLEEEVYMQQPSGFEQSSKQLAASRLYILIYVDDIIIKGNDSKLIQLNTVFSLKDLGDLDYFLGIEVSHHLDGSVTLTQSKYLRDLLAKTRMDEANPIASPMVAGCKLSKSDRWFQNQTIINLDRNQ

SEQ ID NO: 187460 - protein, 69 aa, Glycine max
  Coding DNA Sequence Number=SeqID_70682
MGCYMIHMVNILGNSYSYPFFVSMLSAFDDERLLPHHQGGDKLATQQGREGGVVSWRNREARAEFDRVN

SEQ ID NO: 187461 - protein, 57 aa, Glycine max
  Coding DNA Sequence Number=SeqID_70683
MPLLLPKYTREHDQSFKGGQNGHFMKVYDPKFAQASIWLAWAKEKTSAISKPLAWAS

SEQ ID NO: 187462 - protein, 98 aa, Glycine max
  Coding DNA Sequence Number=SeqID_70684
MYGVEGVTDHATDEVQKEPHELVTDPVGANTEGFPGVLHHTLVLTSYADHVTARVWAWEEHTKLKLASHERKVDKFGRLAHEIEGIVASIGLTFEIRK

SEQ ID NO: 187463 - protein, 158 aa, Glycine max
  Coding DNA Sequence Number=SeqID_70685
MERHQAVLEFQKAAAKVESKVEKRFEQHLAGREHEGDFAHRYLEWSSSKPERLCSTQQEEAQSFREKEKKKLKYRYSNGDEFISKPCNSGSKLFGSRPRVKPNDTCMCASGAPSSACGLRWTTRMVTDVEVVVVHMLLAEVVDLALVVVPSLACNIFQ

SEQ ID NO: 187464 - protein, 97 aa, Glycine max
  Coding DNA Sequence Number=SeqID_70686
  Subcellular localization annotation: CTP_CleavageSite=50; ConfidenceScore=5.06e-01
NFKKYCTQRQAQGDAPQAAGAPPPPHQAGPAGMQSQGFASFSCPTPDQFRAEVAWPGDWPEAQAGEAPPEAPDDGEEAHEDEEMADLLDFLGGSGAT

SEQ ID NO: 187465 - protein, 87 aa, Glycine max
  Coding DNA Sequence Number=SeqID_70687
MSFPQFMVPFVACVSLSETCALSENHPLSETLSPLSELGESGGESAMHLCAQRIINLLSESFVSSRAKRAQLTQRNFINSRLAQKWR

SEQ ID NO: 187466 - protein, 152 aa, Glycine max
  Coding DNA Sequence Number=SeqID_70688
  Homolog annotation: Hit_ID=Q6CQF2; Match level="QueryCoverage=47%, HitCoverage=88%, E-value=4e-15, Identity=58%"; Hit description =Kluyveromyces lactis strain NRRL Y-1140 chromosome D of strain NRRL Y- 1140 of Kluyveromyces lactis
MTTVPAVLIDQHPLWGLDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQVPRHAKGRALPSTIAMMTSPRAYQQPGLGPPSQPAS

SEQ ID NO: 187467 - protein, 117 aa, Glycine max
  Coding DNA Sequence Number=SeqID_70689
MKYPTIILPRLGYATEGQAVGVPPAMVERGKFDQIEERLRAIEGGGDYAFVDMEELCLVPDIVIPPKFKVPDFDKYKGTMMKKDDWRRHFKEKMSQEEAHHHRKPWQKMVEDVSYNL

SEQ ID NO: 187468 - protein, 136 aa, Glycine max
  Coding DNA Sequence Number=SeqID_70690
MSPPPLEPHNHSQTHLKLSGRLPLQAPFSIGGLDGACALSATLDRLARISEFWLSARLLAQQMDSSGALSGMSPCSANTHSSSFFQILPRAQPKEWCAQRMTRLFWLSVLVVLAQNLFYNWCLFYTSLSSEISIEN

SEQ ID NO: 187469 - protein, 86 aa, Glycine max
  Coding DNA Sequence Number=SeqID_70691
MVDRGEGSREPILIEKMGKNEKKEDGAIVVVGVDTRLTTPRSVKETQEGGMSVLNNTKSHNFVGGVTRRTKTLELSLVSNTPLVNS

SEQ ID NO: 187470 - protein, 254 aa, Glycine max
  Coding DNA Sequence Number=SeqID_70692
MQSQGLALPLEPEVVPSAARVSTKESYVDPLGDIQTRVDVEEVKDADALVPVPTDEGAVGPIKPADRPDHEVDDPLYLMALTIPRLFLKPLQVMWDAIVFGVFNQDFPLHLTETSMRAGNSDVYGFLEPQSIQRSEQSQFESESYIKNWMQNSKRDVYLGAYLNGTHWQMIVILPKKNLVVWFCSLHNRSDNYLKGIINSALKGLDDTPQPKSKAGARWIVVKYFNDVKPLEAERLKALRIQWAQYYLKVRNQT

SEQ ID NO: 187471 - protein, 143 aa, Glycine max
  Coding DNA Sequence Number=SeqID_70693
HLTETSMRAGNSDVYGFLEPQSIQRSEQSQFESESYIKNWMQNSKRDVYLGAYLNGTHWQMIVILPKKNLVVWFCSLHNRSDNYLKGIINSALKGLDDTPQPKSKAGARWIVVKCNRQKGSTECGYYVMHWMFTIILGTFRNN

SEQ ID NO: 187472 - protein, 105 aa, Glycine max
  Coding DNA Sequence Number=SeqID_70694
  Gene Ontology: Biological process=biosynthetic process
  Homolog annotation: Hit_ID=Q6DW76; Match level="QueryCoverage=83%, HitCoverage=9%, E-value=3e-27, Identity=68%"; Hit description =Digalactosyldiacylglycerol synthase 1, chloroplast precursor
MDNSRLNTMINANCPQELLHSVSSRNLSHAFRATLYKGHAHGNGNINDQLDLPITSVLQSTGHWYEGGLWTNHAKHHPLDNERHVAIVTTATLPWMTGTVVNPLF

SEQ ID NO: 187473 - protein, 106 aa, Glycine max
  Coding DNA Sequence Number=SeqID_70695
  Homolog annotation: Hit_ID=Q1S193; Match level="QueryCoverage=39%, HitCoverage=8%, E-value=4e-08, Identity=64%"; Hit description =Alpha/beta hydrolase fold
MDDKVVPPSMTNFVHHMLLGVAVHKLPYEGPFSISIEVDQANLEETNIEQQVSTKRNHEDMKLTSNPTMTMTARLAVRTVRLAVAKGRHTRRRGVAMKTGINAELR

SEQ ID NO: 187474 - protein, 70 aa, Glycine max
  Coding DNA Sequence Number=SeqID_70696
  Subcellular localization annotation: CTP_CleavageSite=33; ConfidenceScore=5.21e-01
MPLHHGPLCNDAAERDTRANNATGSSPTSKALRAKMVTAKYASSVRGRRSAARFHEGRWRGGGGATLWQS

SEQ ID NO: 187475 - protein, 269 aa, Glycine max
  Coding DNA Sequence Number=SeqID_70697
  Gene Ontology: Mol. function=protein serine/threonine kinase activity; Cellular component=membrane; Biological process=protein amino acid phosphorylation
  Homolog annotation: Hit_ID=Q9SZM7; Match level="QueryCoverage=80%, HitCoverage=40%, E-value=4e-79, Identity=65%"; Hit description =Protein kinase like protein
  Pfam annotation: Domain name=Pkinase; Domain location=83-269; Score =67.7; E_value=3.8e-17; Accession=PF00069.15; Description=Protein kinase domain
  Pfam annotation: Domain name=Pkinase_Tyr; Domain location=83-269; Score=49.3; E_value=1.7e-15; Accession=PF07714.7; Description =Protein tyrosine kinase
  Pfam module annotation: Pfam domain module=Pkinase::Pkinase_Tyr; Domain location=83-269::83-269
MEGQGTSFPSQFSLNVVGSSCPSNSGVNDFICLYSKDIILTSLLSETGLDIQEAHAFSTIDGYSLDVFVVGGWAVEETEKLKYELAKKVQRLQFSSSCFSLSGRYKGTFCNQDVAIKVLKHESLNDNMLREFAQEVYILSKIQHKNVVKFVGACTKPPNLYLVTEYMSGGSMFDFLHKQKTVLALPSLLKVAIDVSEGMKYLHQNDIIHRDLKAANLLIDENGVVKVSDFGVARVHDQSGIMTAETGTYRWMAPEAWMRLFKDTIGSSL

SEQ ID NO: 187476 - protein, 65 aa, Glycine max
  Coding DNA Sequence Number=SeqID_70698
MEVKSFPQQRETLGDGKIRDESPTRFWKDMWCGSENLQHKFARLFLNSKQKDACVETIGSWRNDR

SEQ ID NO: 187477 - protein, 202 aa, Glycine max
  Coding DNA Sequence Number=SeqID_70699
  Gene Ontology: Mol. function=RNA-directed DNA polymerase activity; Biological process=RNA-dependent DNA replication
MSLQEDFWRNTILRESLLKQESRIKWLKESDCNSKFFHMAVNWQRRKNMTRGINVDGSWNKDPFVVKEEAQIFYKIRFSEDFWERPCLEEVHFESISLDDNAMLIEGFGEEEVKEAILECGNSKSRGSNGYNFILLKECWSFLKKDIHEFLGDFHASENFPRGANASFVALIPKIEEPQGWGVRGGGGYRVISLVGCMYKIV

SEQ ID NO: 187478 - protein, 167 aa, Glycine max
  Coding DNA Sequence Number=SeqID_70700
  Gene Ontology: Mol. function=electron carrier activity; Cellular component=nucleus; Biological process=cell redox homeostasis
  Homolog annotation: Hit_ID=Q5DMW9; Match level="QueryCoverage=97%, HitCoverage=85%, E-value=7e-36, Identity=40%"; Hit description =Protein disulfide isomerase (PDI)-like protein 3
VKVSDLEGKVVGLLFAANWYPPCRGFTQVLAGIYEELKSRVPQFEIVYVSSDEDLNAFNSFYGSMPWIAIPFSDLETKKSLTRKFDVEAVPCLILLQPDDRKEHATVRDGVELIYRYGIQAYPFSKDRLEQLQKEDKVKRDNQTLTNLLANHHRDYVLSHTHTGLKK

SEQ ID NO: 187479 - protein, 337 aa, Glycine max
  Coding DNA Sequence Number=SeqID_70701
  Gene Ontology: Mol. function=pseudouridylate synthase activity; Cellular component=signal recognition particle, endoplasmic reticulum targeting; Biological process=RNA processing
  Homolog annotation: Hit_ID=Q1SRH6; Match level="QueryCoverage=98%, HitCoverage=71%, E-value=1e-160, Identity=85%"; Hit description =Pseudouridine synthase, RluD
  Pfam annotation: Domain name=PseudoU_synth_2; Domain location=43-242; Score=174.6; E_value=2.5e-49; Accession=PF00849.12; Description=RNA pseudouridylate synthase
MMLEQVSFNVKSGDEIKCTIAELQNLRAVPQNIPLDIVYEDEHVLVINKPAHMVVHPAPGNTSGTLVNGILHHCNLPNVEFSKDEALSDTEDSDDEFNSYISLASSCEGLNSRLSVASNSIRPGIVHRLDKGTSGLLVVAKDEHSHMKLSEQFKQRTIKRLYVSLTAGVPTPVAGRVEVPVGRDTNNRIRMTAVTGPVNSKKARYAASRYKVIEILAGGSCSLVEWKLETGRTHQIRAHAKYLGVPLLGDELYGGTKSMVLSLLRPRTPISLHSKIVKMVSRLDRPCLHAWTLGFQHPHTGEQVHFSCEPPADFAEILSQLRRIGSETVSFTKRSNS

SEQ ID NO: 187480 - protein, 228 aa, Glycine max
  Coding DNA Sequence Number=SeqID_70702
  Gene Ontology: Mol. function=electron carrier activity; Biological process=intracellular signaling cascade
  Homolog annotation: Hit_ID=Q1SRH5; Match level="QueryCoverage=88%, HitCoverage=80%, E-value=5e-91, Identity=77%"; Hit description =Protein kinase C, phorbol ester/diacylglycerol binding; Thioredoxin domain 2; Thioredoxin fold
  Pfam annotation: Domain name=AhpC-TSA; Domain location=2-123; Score= -24.7; E_value=0.098; Accession=PF00578.11; Description=AhpCTSA family
  Pfam annotation: Domain name=C1_1; Domain location=175-218; Score =3.0; E_value=0.012; Accession=PF00130.12; Description=Phorbol estersdiacylglycerol binding
  Pfam annotation: Domain name=C1_3; Domain location=183-211; Score =22.4; E_value=0.0012; Accession=PF07649.3; Description=C1-like domain
  Pfam module annotation: Pfam domain module=AhpC-TSA::C1_1::C1_3; Domain location=2-123::175-218::183-211
MDPVPRDGCCSCTQVPVASLVGKTIGLYFSAEWCVPCAKFTPKLISVYEKIKHELAEKGEEDFEVVLISSDRDQASFDSYYSTMPWLALPFGDPEIKNLVRHYNVQGIPWLVIIGPDGKTITVHGRSLINLYQENAYPFTKAKVEELEKQLEEEAKGLPALVYHQGHRHDLNLVSDGNGGGPFICCVCDEQGSSWAYQCLQCGYEVHPKCVRTVERDDNVLVDTTGCF

SEQ ID NO: 187481 - protein, 321 aa, Glycine max
  Coding DNA Sequence Number=SeqID_70703
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q1SRJ7; Match level="QueryCoverage=89%, HitCoverage=99%, E-value=1e-120, Identity=76%"; Hit description=2OG -Fe(II) oxygenase
  Pfam annotation: Domain name=2OG-FeII_Oxy; Domain location=161-284; Score=68.1; E_value=2.8e-17; Accession=PF03171.10; Description=2OG -Fe(II) oxygenase superfamily
MAKGKHSHTRAQGKKWSTFSLVLWALFFLTLILVVLLALGIVYLPTTDDDFPTTELSAFRRKTSQSGESLVENSEQWTEILSWEPRAFIYHNFLSKEECEYLIELAKPHMVKSSVVDSKTGKSTESRVRTSSGMFLKRGRDKIIQNIEKRIADFTFIPVENGEGLQILHYEAGQKYEPHYDYFLDEFNTKNGGQRIATVLMYLSDVEEGGETVFPAANANFSSVPWWNDLSQCARKGLSVKPKMGDALLFWSMRPDATLDPSSLHGGCPVIKGNKWSSTKWLHLHEYKTKYEPIVLLKIDVLQMKKFKENFIPKISIVMQT

SEQ ID NO: 187482 - protein, 186 aa, Glycine max
  Coding DNA Sequence Number=SeqID_70704
  Gene Ontology: Mol. function=protein serine/threonine kinase activity; Cellular component=plastid chromosome; Biological process =protein amino acid phosphorylation
  Homolog annotation: Hit_ID=Q1SRK0; Match level="QueryCoverage=97%, HitCoverage=67%, E-value=4e-84, Identity=40%"; Hit description =Peptidase S8 and S53, subtilisin, kexin, sedolisin; Tetratricopeptide - like helical
  Pfam annotation: Domain name=PPR; Domain location=10-44; Score=36.2; E_value=1.1e-07; Accession=PF01535.11; Description=PPR repeat
  Pfam annotation: Domain name=PPR; Domain location=115-149; Score =23.2; E_value=0.00094; Accession=PF01535.11; Description=PPR repeat
  Pfam annotation: Domain name=PPR; Domain location=151-185; Score=6.5; E_value=1.3; Accession=PF01535.11; Description=PPR repeat
  Pfam annotation: Domain name=PPR; Domain location=45-79; Score=15.8; E_value=0.1; Accession=PF01535.11; Description=PPR repeat
  Pfam annotation: Domain name=PPR; Domain location=80-114; Score=32.9; E_value=1.1e-06; Accession=PF01535.11; Description=PPR repeat
  Pfam module annotation: Pfam domain module=PPR::PPR::PPR::PPR::PPR; Domain location=10-44::115-149::151-185::45-79::80-114
MRLGGSADTISYNFIIESHCRDENPEEAVKVLNLMVTKGVAPNASTFNFIFGCIAKLHDVNGAHWMYARMKELKCLPNTLTYNILMRMFAKSRSTDMVLKMKKEMDENQVEPNVNTYRILISMFCEMKHWNNAYKLMKEMVEEKCLRPNLSVYELVLELLRKAGHLKKHEELVDKMVARGFVTHPW

SEQ ID NO: 187483 - protein, 64 aa, Glycine max
  Coding DNA Sequence Number=SeqID_70705
MDCRFQMHTYMHHLADQDKPIFQEEAGPVGAQGVAQGDGGRAEDDEDMTNLVNYFIGGDEAPQP

SEQ ID NO: 187484 - protein, 61 aa, Glycine max
  Coding DNA Sequence Number=SeqID_70706
GPLALSVIGSMWTTGLFAPSGLMAKDHSRVALCVRFKVDKDTDATTGGGEGGKACGVAMVL

SEQ ID NO: 187485 - protein, 164 aa, Glycine max
  Coding DNA Sequence Number=SeqID_70707
MIEEKIKPCKGENHEDGEARHVNNWNLTTLVVAYNIVRAKGKNLRDGAFGEVRGQIHNIGAQIRNVGDQIYASSTQICNFCGAMSVVRLGVCCWLVVSGVGFACGYGGNEKVRVSVRELRERLNVKVRERGHKNENFSKMVFPKTVIEHFIQRLSFENCHENLQ

SEQ ID NO: 187486 - protein, 89 aa, Glycine max
  Coding DNA Sequence Number=SeqID_70708
  Gene Ontology: Mol. function=transferase activity; Biological process= DNA integration
  Homolog annotation: Hit_ID=Q1S0G2; Match level="QueryCoverage=98%, HitCoverage=12%, E-value=3e-17, Identity=67%"; Hit description =Peptidase S8 and S53, subtilisin, kexin, sedolisin; Polynucleotidyl transferase, Ribonuclease H fold
MGRLRPIKLALLLRDIIKRKILLAIATYYDHEIWQMDVKTTFLNGELKKDMYMTQQEGFTSLSDHNKVCKLQTIHLWIETSFQKLEHSL

SEQ ID NO: 187487 - protein, 299 aa, Glycine max
  Coding DNA Sequence Number=SeqID_70709
  Homolog annotation: Hit_ID=UPI000044A8F0; Match level="QueryCoverage =44%, HitCoverage=99%, E-value=1e-16, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFRGLHILAFRGQHVLAFSFVGLHALTFKGLHVLAIRGLHALTFRGLHILHFRGLHVLAFGGLHVLAFRGLHSLAFRGLHVLVFRGLHVLIFRGLHVLAFRGLHVLTFRGLHVLAFRGLRALAFSGIHIRTLREFKPPPDIGGRSTVQAELERKAIMQLLCIPGQDFTRAAAKRQRSQCRSPPADVSVGLCHPDIGKYAYGSTDFLYHPLFAGIVPARHPVDPEKSNRVLGFLALIMGFYQFYGVPVTPGKVIRSPTNQAFIKKYCAPRQVQGETPQQPGDGWQRATNTPPPPL

SEQ ID NO: 187488 - protein, 1199 aa, Glycine max
  Coding DNA Sequence Number=SeqID_70710
  Gene Ontology: Mol. function=DNA binding; Cellular component =chromatin; Biological process=DNA integration
  Homolog annotation: Hit_ID=Q1SAI8; Match level="QueryCoverage=99%, HitCoverage=99%, E-value=0.0, Identity=58%"; Hit description =Integrase, catalytic region
  Pfam annotation: Domain name=rve; Domain location=408-533; Score =15.4; E_value=0.00031; Accession=PF00665.16; Description=Integrase core domain
  Pfam module annotation: Pfam domain module=RVT_2::rve; Domain location=700-956::408-533
MAESAKFHPALTITNVKCLVPVTLDNEQALYYSWAALFTNLTRVHDLYDHIVPPTEEPARAAYLVAKTVDPAMWKRLDAAILQWIYGTISSDLLLAILRRDDTAEGAWKRLHALFQDNKASQATLLKEDFTSAIFEEHHTIDSYCNYLQSLADQLVAVDAPVSNGRLVLCLTGSLPEAYSGTVDFIQNQEPLPSFESCRSWLKMAERTIKARVARESGTRGGTAMVAATSNDSSSAPKRNNSNNKGHNNNKNKGQGKASGQQGWTIPPCPFPAYSWQPQPNYTAQRPPAGPGVLGPKPQAFNVMTPSTASYTPTDIEAAMHALSFSQPDGNYYMDTGATSHMTADAGILSSYFNSSTKNHNFVVGSGHLIPVVGHGSTNLAPPHPPFVLQNVLHAPKLIKNLISVRKFTTDNMVSISFDSFGFSTSPIASSSGHRCYVLFLDDYSKFLWTFPIAKKSQFFDYHGLVFRLSCPHTSSQNGKAERHIKSINNIIRTILAHASMPPSFWHHALSMATYLLNILPSKERSSPCAYLGPAPNHRGSKCYDMSSGKIIICRHVHFVETEFPFSKFHKTTPTNYDFLSDNIDPSIMHVISQNLAPQNPQPDPTSHAAQSRPTPHVAPTLQQPPPTSSPILASPTSCGPVPASTPNPMLHRMTTRSMSGIHKPNPKYSTNCHATTTKDISPIPKNPVSALHDPNWNRAMSDKFTALIDNKTWELVPKPPDVNVIRSMWVLRHKYKSDGSFERYKARLVGDGKTQAQGVDCDETFSPVVKPATIRAVLSIAVSKSWPIHQMDVKNAFLHGHLNETGYMHQPMGFRDKNHPNHVCLLKKSLYGLKQVPRAWYQRFADFVATIGFSHSKSDYSLFIYKNGSDTAYILLYVDDIILTASSDRLRKYFMTLLGSEFAMKDLGPLSFFLGIAVTRHAHGLFLSQKQYAAKIIERAGMCNCSSCPTPVDTKSKLSATDDAPFNDPTKYRSLAGALQYLTFTQPDISYVVQQICLHMHAPTNEHMSALKRIICYLQGTLSHGLHLYKSTIDRLISYTDADWGGCPDTRRSTSGYCVFLGDNPISWSSKRQPILSRSNAEAEYRGVANVVSDSCCIRNLLLELHCPIQKATIVYCDNVSATYLSGNRVQHQRTKHIEMDIHFVREKVAHGEVRVLHVPSRYQIADIFTKGLPRVLFNDFRDSLSIREPPASTEGEC

SEQ ID NO: 187489 - protein, 94 aa, Glycine max
  Coding DNA Sequence Number=SeqID_70711
TSFGYRKDRNGQWLKKDALPPQDERTPSPPPQRDDSALMNEVLSELQGLRSYAGECFDSLDTRFAGMDIRLTQLEEDVGYIRQSFDLPPPPPPS

SEQ ID NO: 187490 - protein, 74 aa, Glycine max
  Coding DNA Sequence Number=SeqID_70712
  Gene Ontology: Mol. function=RNA-directed DNA polymerase activity; Cellular component=intracellular; Biological process=RNA-dependent DNA replication
MDISPAYSCLLGRPWIHSVGVVPSTLHQKLKFVVEGQLVIVSGEEDILPRLSGVALMVARVMLRDGYEPGIGLG

SEQ ID NO: 187491 - protein, 392 aa, Glycine max
  Coding DNA Sequence Number=SeqID_70713
  Gene Ontology: Mol. function=phosphopantetheine binding; Cellular component=nucleus; Biological process=metabolic process
  Homolog annotation: Hit_ID=Q3PAE8; Match level="QueryCoverage=99%, HitCoverage=31%, E-value=1e-124, Identity=59%"; Hit description =Amino acid adenylation
  Pfam annotation: Domain name=AMP-binding; Domain location=84-390; Score=195.0; E_value=1.8e-55; Accession=PF00501.18; Description=AMP -binding enzyme
IALYSREDVEAHAARLLHFVSSALQADDIAAVPLATTDEVQQVLHDFNATAHALPETTLVELLQQGMDRDPHAPALVFGDTTLDYATLEARSFALAAQLRTMDVGPGSVVAVALPRSLELVIALVAVLRAGAAYLPLDLAHPDERLARIFASAQPVCVLAAADVSARVAGVPVLAPEQWTALSFAAPWADPAPDDAAYVIYTSGSTGEPKGVVIEHRAIVNRLLWMREHYDIRADDRVLQKTPATFDVSVWEFFLPLLCGATLVVAGPDAHRDPTELARLIREHGITTAHFVPSMLDAFLAAPASEGLQLRRVFTSGEALDASSRDRFHARVHAELHNLYGPTEAAVDVSYWPASAQDRSRPVPIGRCRWACPVTCTWVASSWRVAISVAMI

SEQ ID NO: 187492 - protein, 180 aa, Glycine max
  Coding DNA Sequence Number=SeqID_70714
MVGQGQKELGSTSSPHCVQIKNKHAFLPYGLPPNYTPPNVADTLEENVNNSTPIPSKGQQPQFDPAHIPQPMEETHGIPHHNLANFEPCLEYAPEGQAIGGVPLPNTWEGPYLLPQPQPLHFVVGRIPPTMVEKGKLDRIEERLMAIEGGGDYAFADIEELSLVPNVVIPPKFKTPDFDE

SEQ ID NO: 187493 - protein, 268 aa, Glycine max
  Coding DNA Sequence Number=SeqID_70715
  Gene Ontology: Cellular component=integral to membrane
  Homolog annotation: Hit_ID=UPI00005F902F; Match level="QueryCoverage =60%, HitCoverage=22%, E-value=7e-67, Identity=77%"; Hit description =COG2982: Uncharacterized protein involved in outer membrane biogenesis
  Pfam annotation: Domain name=Rotamase; Domain location=9-81; Score =82.6; E_value=1.2e-21; Accession=PF00639.11; Description=PPIC-type PPIASE domain
MAKTAAALHILVKQEAQAKALLAQLEKGANFQQLAKKHSTCPSGRNGGDLGEFRKGQMVPAFDKAVFTCPLLQPYGPQCGRRRDHGPQRDGCGTTRQQRTGFDSGIRVFEGAAHIQRRTQRNDTNALALRIDRQIQALISKVSVAGNVDHRVLGIEHEQPRRRQSLTDVQVGRGTVDAHLIVAKQFTHHIVTNVQPGNLHQAAADQAIVHQQFQLAITGAQQVGHRIAGAGQAGIPVELAETTLHGGDIREQLTQLQLARMQSARPRI

SEQ ID NO: 187494 - protein, 80 aa, Glycine max
  Coding DNA Sequence Number=SeqID_70716
  Gene Ontology: Mol. function=drug transporter activity; Cellular component=membrane; Biological process=multidrug transport
  Homolog annotation: Hit_ID=Q1T635; Match level="QueryCoverage=83%, HitCoverage=13%, E-value=9e-22, Identity=70%"; Hit description=Multi antimicrobial extrusion protein MatE
LGMGSALETLCGQAYGAGQSTMLGVYMQRSWVILFVTALILLPLYIWSPPILRLFGQTAEISDAAGQFYASLHIILNLLL

SEQ ID NO: 187495 - protein, 238 aa, Glycine max
  Coding DNA Sequence Number=SeqID_70717
MAPKKLPAKRSRKDATREGSSAALQANMDFDGHRDEEYAEFQEEIARRKWAQLASPIAKFDPEIVMEFYANAWPTEEGVTDMRSWVRGQWIPFDGMPSISFWGIHWFWRKASVVSSPRGGFRPPALMRSLSVSCYAFRGITPPRHPVDSEKSNRALGFPALIIGLFQFYRVSEGAGSGTLAARGGPAVASCRCATTASRGGTISKVHFQSPVEDRTLDAQDPSPFPWPTPKQFEATMA

SEQ ID NO: 187496 - protein, 123 aa, Glycine max
  Coding DNA Sequence Number=SeqID_70718
  Subcellular localization annotation: CTP_CleavageSite=15; ConfidenceScore=5.68e-01
MTTSSITAPFEPTSKIMTPSSTQPPNTDNPKVPIWMTRITTITKLSNRSMLSEARRAYARTRILPPNTTRTRTKKKMIRKGRCFYLDGTTMNSKEMRKNPCCFLSEVKRPSATIVPGHGSRGI

SEQ ID NO: 187497 - protein, 33 aa, Glycine max
  Coding DNA Sequence Number=SeqID_70719
APGCPALAVAPAKAPGPWALAEAPVSGARTRAP

SEQ ID NO: 187498 - protein, 360 aa, Glycine max
  Coding DNA Sequence Number=SeqID_70720
  Homolog annotation: Hit_ID=P93743; Match level="QueryCoverage=37%, HitCoverage=35%, E-value=3e-23, Identity=51%"; Hit description =Expressed protein
  Pfam annotation: Domain name=WRC; Domain location=226-271; Score =71.9; E_value=2e-18; Accession=PF08879.1; Description=WRC
MRIRKRQVPFPLLPATYSDPNLINRSPVMVQLNDATKASSCTHHHGSTTTAPSPLLDCPQPSDQPLPLIGKPTNGSDESSGEGQKKQEEESSVKDGRRKEEGEGHKGNGARRGSISCSEKLAETFSSPTSPPKQDGRWCEGDKAFPPKKRRGAFENATEDINVNDDNNDKKNSKTKTKRMKRKMNKSSRQDDSNEEEVENQEEAATKETKPEQANVGKKRVRGSALMEGSRCSRVNGRGWRCFQQTLVGYSLCEHHLGKGRLRSMTSVRNKSIGTTSVAPKNNIVPQSEHSFGKQTTKSSSSVTEEYPLGNDAENNDEKKPVIVTKRRMKLGMVKARSISSLLGQTNTEIVSIAEDNDNK

SEQ ID NO: 187499 - protein, 347 aa, Glycine max
  Coding DNA Sequence Number=SeqID_70721
  Gene Ontology: Mol. function=nucleic acid binding; Cellular component= membrane; Biological process=nuclear mRNA splicing, via spliceosome
  Homolog annotation: Hit_ID=Q2XDD7; Match level="QueryCoverage=100%, HitCoverage=41%, E-value=1e-158, Identity=83%"; Hit description=ATP -dependent helicase HrpB
MRDTGVCRQLGHGLAMFAEAVAAAGFVGVEPCQQVLGLGERGSRWLVEPTQLLGRHAPACQLQGQAGQVGLQYLGTAMGGQLLMLSLGPQPIAHAGLQAAGTAGTLGSTGTRDALGVQAGHATAWIEARYPCQAGIDHHSHTVDGQAGLGNIGGQHHLAQALGRRVDGSALGIEVEFAMQRTQQDFAPFSQRFLQALVHPADLGLARQEHQHTTGLLGQRLQHAVHYPWLDELTRLEGASPADIHRVHAALAADHRGLVQQARQALPLQGRRHQQDLQWRVVPQQFATIQAQRQGQVGVKAALVKLIEDQQPYPLQRRVGLQAAGEDAFGHHLDAGVRPNLAVQPNA

SEQ ID NO: 187500 - protein, 510 aa, Glycine max
  Coding DNA Sequence Number=SeqID_70722
  Gene Ontology: Mol. function=monooxygenase activity; Cellular component=membrane; Biological process=electron transport
  Homolog annotation: Hit_ID=Q1SKI2; Match level="QueryCoverage=96%, HitCoverage=97%, E-value=1e-172, Identity=61%"; Hit description =Arthropod hemocyanin/insect LSP; E-class P450, group I
  Pfam annotation: Domain name=p450; Domain location=41-500; Score =346.2; E_value=5.5e-101; Accession=PF00067.12; Description =Cytochrome P450
MALLFLFFVALISFLFTILIVQKLGKKSKKTDDTTCDMHMPHGPRKLPIIGNIYNLICSQPHRKLRDLAIKYGPVMHLQLGEVSTIVISSPDCAKEVMTTHDINFATRPQILATEIMSYNSTSIAFSPYGNYWRQLRKICILELLSLKRVNSYQPVREEELFNLVKWIASEKGSPINLTQAVLSSVYTISSRATFGKKCKDQEKFISVLTKSIKVSAGFNMGDLFPSSTWLQHLTGLRPKLERLHQQADQILENIINDHKEAKSKAKGDDSEAQDLVDVLIQYEDGSKQDFSLTKNNIKAIIQDIFAAGGETSATTIDWAMAEMIKDPRVMKKAQAEVREVFGMNGRVDENCINELQYLKLIVKETLRLHPPAPLLLPRECGQTCEIHGYHIPAKTKVIVNAWAIGRDPKYWTESERFYPERFIDSTIDYKGNSFEFIPFGAGRRICPGSTSALRTIDLALAMLLYHFDWNLPNGMRSGELDMSEEFGVTVRRKDDLILVPFPYHPLPVT

SEQ ID NO: 187501 - protein, 360 aa, Glycine max
  Coding DNA Sequence Number=SeqID_70723
  Gene Ontology: Mol. function=monooxygenase activity; Cellular component=membrane; Biological process=electron transport
  Homolog annotation: Hit_ID=Q1SI93; Match level="QueryCoverage=98%, HitCoverage=70%, E-value=1e-124, Identity=63%"; Hit description=E -class P450, group I
  Pfam annotation: Domain name=p450; Domain location=1-346; Score =103.4; E_value=6.7e-28; Accession=PF00067.12; Description=Cytochrome P450
PIREEELSNLVKWIDSHKGSSINLTQAVLSSIYTIASRAAFGKKCKDQEKFISVVKKTSKLAAGFGIEDLFPSVTWLQHVTGVRPKIERLHQQADQIMENIINEHKEAKSKAKGNQSEAEDLVDVLIQYEDGSKPDFSLTRNNIKAIILDIFGAGGETSATTIDWAMAEMVKNSGVMKKAQAEVREVFNMKGRVDENCINELKYLKQVVKETLRLHPPIPLLLPRECGHTCEIQGYKIPAKSKVVINAWAIGRDPNYWTEPERFYPERFIDSTIEYKGNDFEYIPFGAGRRICPGSTFASRIIELALAMLLYHFDWKLPSGIICEELDMSEEFGVAVRRKDDLFLVPFPYHPLPFILTSQ

SEQ ID NO: 187502 - protein, 91 aa, Glycine max
  Coding DNA Sequence Number=SeqID_70724
MGFVFGKEGLVLVLVLRRFRPHLKPDVFLSAPQILVSDTEDNSRIIIGRTNLFNPCKNAGKTNPFRCQCKRIWMNLMQDGSARLPTPKLLF

SEQ ID NO: 187503 - protein, 254 aa, Glycine max
  Coding DNA Sequence Number=SeqID_70725
  Gene Ontology: Mol. function=nucleic acid binding; Cellular component= intracellular; Biological process=DNA integration
  Homolog annotation: Hit_ID=Q1S1X7; Match level="QueryCoverage=58%, HitCoverage=17%, E-value=7e-26, Identity=35%"; Hit description =Integrase, catalytic region; Zinc finger, CCHC-type; Peptidase aspartic, catalytic
MVIRRDAVFDEHLPEIVNTTMTMSDRASPGSMESRSIASGVLLSKIEIVAPLNPLFDMDPSTFQEAMNNQEKDRWMGVMVEEINLQGNDTNGLIPTSFGLVTSDGYVEKVLDKFNMSNAKLVSTPLEKHFKLSVNQCLKTNAEVECMSNVPYANAVGYLMYVMVTIGHGIMFGDHQGDPSSVARYVNFGYAGDFDDKRSTTGHAFTLLGIEQGGVQLHCDSQSATDLAKNQVCHAKTKHINVRFHEIRELMTSG

SEQ ID NO: 187504 - protein, 80 aa, Glycine max
  Coding DNA Sequence Number=SeqID_70726
MSRMIGARLVCSWKSMRVLEWQQWCNGEIQLLVQYVDGVLRGLKIRGLECMLRSSHLSRGSASFGSEWNYVLISQTSSLG

SEQ ID NO: 187505 - protein, 87 aa, Glycine max
  Coding DNA Sequence Number=SeqID_70727
MWYRLTIQTNTLREMSTIVSKTSNNFGSVYMGNDKACVVIGMRHVQIAMDNGGVGTLPMVLVIGLMKIGIPSSVDCDEGTMNCRKHL

SEQ ID NO: 187506 - protein, 182 aa, Glycine max
  Coding DNA Sequence Number=SeqID_70728
  Subcellular localization annotation: CTP_CleavageSite=48; ConfidenceScore=5.81e-01
MAVSSLSVTPLSLSNSSPSLSSKPKFPSLCFLSGNNTTLRVTCPKPLHSSTVVHVATEALDSSPDPLDPPPETLDDDSDATTFEHVCLIMCEIMSLGLYIMWRFVEIRKYNGTGFNVVKVGDLGTPSTSAISIGGDADTGIEDPTISVCKKVIEFKEWPGNIRKAIVLGCAPIDANQEIFSS

SEQ ID NO: 187507 - protein, 391 aa, Glycine max
  Coding DNA Sequence Number=SeqID_70729
  Gene Ontology: Mol. function=dopamine beta-monooxygenase activity; Biological process=histidine catabolic process
  Homolog annotation: Hit_ID=Q9AR54; Match level="QueryCoverage=91%, HitCoverage=89%, E-value=2e-91, Identity=45%"; Hit description =Putative membrane protein
  Pfam annotation: Domain name=Cytochrom_B561; Domain location=181-383; Score=-74.4; E_value=0.023; Accession=PF03188.6; Description =Cytochrome b561
  Pfam annotation: Domain name=DUF568; Domain location=93-221; Score =187.4; E_value=3.4e-53; Accession=PF04526.4; Description=Protein of unknown function (DUF568)
  Pfam module annotation: Pfam domain module=Cytochrom_B561::DUF568; Domain location=181-383::93-221
MAVSSIRNPFLLLLLLLTFFTAIIVPATPQPCNSYKFPNKVNYAACKDLPVLESSLHWNYHPSSGAIDVAFNKANVNDSSWVAWAINPTSKGMLGSQAFVAVYRSDGSIKAYTSPITSYATMLQEGNLSFPVYGVSASYTNRHVIIFASFQLPGNTTLVNHAWQEGLVSDDGTLRPHSFSRANLQSFGTLDFLSGKVSQTGGNVDSRITLRKVHGILNTISWGILMPIGVILARYLKVFDGLGPTWFHLHRACQSLAFFIGIAGFGTGLYIGNHYGVHNAPHRCVGITLLCLAIIQVCVAVFLRPKKDHKYRMFWNIFHYLVGYSIIALAIWNVWKGFEILNAQNIWKKTYVGSIISLAIIAMVLEVITWTWVCIKKRVKNPENHVEIVIS

SEQ ID NO: 187508 - protein, 156 aa, Glycine max
  Coding DNA Sequence Number=SeqID_70730
MRNFDNEDDGRMRTRVMRESEEEGNHWGYSTKLMLYDDPWKIKKLLTKSDLGNLSRLLLPKELIEDLVLPVLSVESQREAKTQKGTKITIWDVDTQSMHYLVFKFWASSRSYVFIDNWNKDFVNRRNLHIKDEIGLHWDLYKNRFNFSVLVRAPLN

SEQ ID NO: 187509 - protein, 238 aa, Glycine max
  Coding DNA Sequence Number=SeqID_70731
  Subcellular localization annotation: CTP_CleavageSite=44; ConfidenceScore=5.77e-01
MAISRYLSSSSTVSSSLTSLSSLPLRFFLRSVPTDPTFAPIFTSGVVKSPVFLCLLDFPASGSVFLERDDHASLEAYEIEKKGVCTRCHCFEIKCISAGVLLTPVGILFMAVNNCCFVEWKEQFVSQERGNRVVHYYLKDSAGESVLAVVGTERSVRHMCYVVAEEFLEICGMEGSIPTGFKWRSRREVVDWLTSTLSKQNLQGDRSGNSATRPRHLMDFVQIHSVTRMLSWQGGIGS

SEQ ID NO: 187510 - protein, 378 aa, Glycine max
  Coding DNA Sequence Number=SeqID_70732
  Gene Ontology: Mol. function=metal ion transporter activity; Cellular component=membrane; Biological process=metal ion transport
  Homolog annotation: Hit_ID=Q6VM15; Match level="QueryCoverage=78%, HitCoverage=85%, E-value=1e-123, Identity=74%"; Hit description =Metal transport protein
  Pfam annotation: Domain name=Zip; Domain location=52-345; Score =204.1; E_value=3.3e-58; Accession=PF02535.12; Description=ZIP Zinc transporter
MSPSFCTSLFLFTLSLLFFLFFSLSVSAHSGHHDDGDADSDATPDLRARPLILAKVWCLIVIFIATFVSGVSPYILKWNEGFLVLGTQFAGGVFLGTAMMHFLSDANETFGDLTQKEYPFAFMLACAGYLMTLLADAVISSLFNNMGRHAQDVQGQGADVNKLSSNGVTSQSQHRSHDANHHLASPALGYVHSVGDTVLLIVALCAHSVFEGLAIGVAETKADAWKALWTICLHKIFAAIAMGIALLRMIPDRPLVSCAVYAFAFAISSPIGVAIGIILDATTQGHVADWIFAISMGLACGVFIYVSVNHLLAKGYMPHRPTKVDSAYFKFLAVFLGVGVIAVKRWQKFASNDRKDGHVLKTKRTYRSLGKKVTSHRG

SEQ ID NO: 187511 - protein, 200 aa, Glycine max
  Coding DNA Sequence Number=SeqID_70733
MEDDAWATWCLLSAASEEQTWETELAMVEVAVAVAEAESAAEATVEAAAESAVVAPKMAEVAAESTTEVGMVRDLVVWVQSMETAEGSGGRVAKAVGGEGRPVGSRGGVEAPYGEWQPWKLRLVVAEMKEGFSRDRTSSATVGGYSQNQSQGIELDVQREEGCAATKVCGNGYGSHGRQPWALNESTKCYLKISSMFPSI

SEQ ID NO: 187512 - protein, 362 aa, Glycine max
  Coding DNA Sequence Number=SeqID_70734
  Gene Ontology: Mol. function=RNA-directed DNA polymerase activity; Biological process=RNA-dependent DNA replication
METQCQGENIQPETSLRGIINTIARGFIEAHKKPTPIAFTDENFDGKDQCHNDPMVVKIEVANFLVSKVLLDNGSLVDVMYWEKDARVHNITSSMPLSQQQPERNEESIAQVLTKNVDLFAWSTSDMLGIDPKFNFHRLVICPEARPVTQRKRKLDSARRKVVDKEAKKLLSVGFIKEVQYTTWLANMVMLYVNGSSNEKSSEAGIILESSDEEILEQSLRFKFEIMNNQAKYEALLVYLILEKEVGAKHLKFWSDSKLVTIEDLDNLGIRHRETSVEHSQSNGQTETANKGQAEKLQAGDLVLRKYGEALKDAKEGKLVANLEGPVRVVESLKTGAYRLEYLSNKAILRTWNATHLKFYYS

SEQ ID NO: 187513 - protein, 48 aa, Glycine max
  Coding DNA Sequence Number=SeqID_70735
MTGRIITGSADSRYIGRVQLPQERKEWRFYARFGLVLNTPTSLGHQDE

SEQ ID NO: 187514 - protein, 226 aa, Glycine max
  Coding DNA Sequence Number=SeqID_70736
MFSPQVHPIRESSNDDPFHHHGGNDATSDNVSNIYACNTTLIGGVASLDVDVVAPVGGATTAKWGLRPNSSVCENPLPNVIYLDLEATIVHIIVPRPFILLSPPLRKPSYTLVHGEGDPWFPFYWTPSPNKDTRELVPYMSHFDQEAKTAKRAKATNAQAGKAKEEQHDHVEDEWVPFPPPISLGAAKRVKAIHAKVGSKGDFKTKALSFKQYQTFGITSSVQQAS

SEQ ID NO: 187515 - protein, 258 aa, Glycine max
  Coding DNA Sequence Number=SeqID_70737
MSVASNRDTNTNEIELPTNMGNTYSANLRIELYKWSSVEFPQEHALIYTSLTDKSNFSIFRLSVKPEKVLFRFADSLCDNHPVRLHTEVTAERNNYGSFNFRVVRIVEAGTNNQAKTPLFDEACFDYHCERKVCSFHVGRRTGMLGSWKVDHWYKVDFKTYFTFKVNIVCDKVTGLSAKFKGPFRSEFGQFDEESGSLIQCQVNGEPPKHINSIVQSMFTGNQYILFKQGKGNTLIDDDDEESNCISTLVSNLVKWHR

SEQ ID NO: 187516 - protein, 70 aa, Glycine max
  Coding DNA Sequence Number=SeqID_70738
  Homolog annotation: Hit_ID=Q9LSN4; Match level="QueryCoverage=84%, HitCoverage=32%, E-value=2e-07, Identity=46%"; Hit description =Arabidopsis thaliana genomic DNA, chromosome 3, TAC clone:K14A17
MVNAILANATDTLNYIKKHIKITPDLELEHKLALCADSYSPVVMYILPQAADAISQGQFGSFESKLEKVH

SEQ ID NO: 187517 - protein, 69 aa, Glycine max
  Coding DNA Sequence Number=SeqID_70739
MAACGGHRWLWVVEKKLGTLEMERKRLEHIRSHIADRNGLIVDTCPMNLQTKFRDDPTVNEYRRTFLPR

SEQ ID NO: 187518 - protein, 495 aa, Glycine max
  Coding DNA Sequence Number=SeqID_70740
  Gene Ontology: Mol. function=sugar porter activity; Cellular component=integral to membrane; Biological process=carbohydrate transport
  Homolog annotation: Hit_ID=Q1S4G3; Match level="QueryCoverage=99%, HitCoverage=98%, E-value=0.0, Identity=78%"; Hit description=Sugar transporter superfamily; Major facilitator superfamily MFS_1
  Pfam annotation: Domain name=MFS_1; Domain location=24-438; Score =114.9; E_value=2.4e-31; Accession=PF07690.6; Description=Major Facilitator Superfamily
  Pfam annotation: Domain name=Sugar_tr; Domain location=20-479; Score =393.1; E_value=4.2e-115; Accession=PF00083.14; Description=Sugar (and other) transporter
  Pfam module annotation: Pfam domain module=MFS_1::Sugar_tr; Domain location=24-438::20-479
MEHGGKEDQTTTFNKYAFACAVVASMVSIISGYDTGVMSGAMIFIKDDIGISDTQQEVLAGILNLCALVGSLAAGRTSDYIGRRYTILLASLLFMVGAILMGYGPNYAILMLGRCVGGVGVGFALMIAPVYSAEISSASSRGFLTSLPELCIGIGILLGYISNYFLGKLTLRLGWRLMLGVAALPSLALALGILAMPESPRWLAMQGRLADAKNVFLRVSNTEQEAELRFGEIKVVMGFNDCEVEEKNVKPSYKSQGEGVWKELLVRPTPKVRWMLIAAVGIHFFEHATGIEAVMLYSPRIFKKAGVTSKDKLLLATVGIGLTKIIFLVLALFLLDKVGRRRLLQISTGGMVCGLTLLGFSLTMVDSSSEKLLWALSLSIGATYGYVAFFNVGLGPVTWVYASEIFPLKLRAQGASIGVAVNRTMNAVVSMSFISVYKAITIGGSFFMFAGISIVAWVFFYFFLPETKGVPLEEMEMVFSKKSSGKNVAIENGPR

SEQ ID NO: 187519 - protein, 111 aa, Glycine max
  Coding DNA Sequence Number=SeqID_70741
MGGTYSDLEAERYKWSSEEFPQETALKYTPVSDKSKFSIFRLSVRPEKVLLRLADTLCHDHPVRLHMELTAERHNGYFNPRLVRVVVEGVNTLSDLDVNALGAHTHFSYSC

SEQ ID NO: 187520 - protein, 58 aa, Glycine max
  Coding DNA Sequence Number=SeqID_70742
DDESDEQNDGDSDEVYFVEAFGKRRHREVPFGGGDSDCGAAGDGHVNDKLSVAEGEEE

SEQ ID NO: 187521 - protein, 100 aa, Glycine max
  Coding DNA Sequence Number=SeqID_70743
MAKIPFSLFANFLPLILAEEMFRGHLQKNFLPQLTEDGSSVDARGTFLPRVSAEEELRKNHLPWNNAKELLPPESTEEGSSLNDFFLSQVDQWPILVCTA

SEQ ID NO: 187522 - protein, 403 aa, Glycine max
  Coding DNA Sequence Number=SeqID_70744
  Gene Ontology: Mol. function=zinc ion binding; Biological process =regulation of transcription
  Homolog annotation: Hit_ID=Q6F2W0; Match level="QueryCoverage=60%, HitCoverage=56%, E-value=2e-30, Identity=39%"; Hit description =Putative Dof zinc finger protein
  Pfam annotation: Domain name=zf-Dof; Domain location=32-94; Score =138.6; E_value=1.6e-38; Accession=PF02701.6; Description=Dof domain, zinc finger
  Subcellular localization annotation: CTP_CleavageSite=41; ConfidenceScore=5.16e-01
MATAPATKDQEPTQGRKFTTTTTTTTTTTRPAPEQGVKCPRCDSSNTKFCYYNNYSLTQPRHFCKTCRRYWTNGGALRNVPIGGGCRKNKRVVVKPSSSSSSSLSSSPRFSNEFSLRGLNVPPSVEFNLGALPFPASSRLNIPTTLNTGLFSNQFSSSPLSFGGDVNSVSVTNNALSGFQLDATPATVLSNSLMSLASNNNTQNNNNFWALQDRSQGSTLLLSDSFNSSAMQSMQQSLNVHSSLASSIESLSCVNQDLHLKMQQQRYATMMFGGDSYHHKGGGGGGGDENNGVSFSQTANRFENQKQLVGNPVMFQNLEISKPPGSSVTEDPSGATVTTTVAPPTEWFFGNSSFSSAGNGNDGANSNNNNINININDANNNWSDALAWGDFQQQQQQQYSALP

SEQ ID NO: 187523 - protein, 196 aa, Glycine max
  Coding DNA Sequence Number=SeqID_70745
  Gene Ontology: Mol. function=protein binding; Cellular component =perinuclear region of cytoplasm; Biological process=intracellular signaling cascade
  Homolog annotation: Hit_ID=Q1S4F9; Match level="QueryCoverage=99%, HitCoverage=42%, E-value=6e-71, Identity=71%"; Hit description =Leucine-rich-associated
  Pfam annotation: Domain name=LRR_1; Domain location=112-134; Score =3.3; E_value=69; Accession=PF00560.23; Description=Leucine Rich Repeat
  Pfam annotation: Domain name=LRR_1; Domain location=41-61; Score=7.4; E_value=12; Accession=PF00560.23; Description=Leucine Rich Repeat
  Pfam annotation: Domain name=LRR_1; Domain location=63-84; Score =11.0; E_value=2.4; Accession=PF00560.23; Description=Leucine Rich Repeat
  Pfam annotation: Domain name=LRR_1; Domain location=88-108; Score =14.8; E_value=0.32; Accession=PF00560.23; Description=Leucine Rich Repeat
  Pfam module annotation: Pfam domain module=LRR_1::LRR_1::LRR_1::LRR _1; Domain location=112-134::41-61::63-84::88-108
METALDGEKDHAAARTLTLDGAVKCVQGRLPPPSLLERFQNLQHLSIANVGVSSLEQFPRLRNLQKLNLSDNRIAGGLEFLVQAGLDSLRDLDLSNNRIQYIEDLAPLAQVKLVSLDLYECPVTRVKDYRSRVFGLIKSLKYLDKMDAEENERPESDDEDEDEDEEEEEELEEDDPGSGEIDGGEEDRPFGINNGH

SEQ ID NO: 187524 - protein, 483 aa, Glycine max
  Coding DNA Sequence Number=SeqID_70746
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=93%, HitCoverage=35%, E-value=8e-75, Identity=33%"; Hit description=Chromo
  Pfam annotation: Domain name=zf-H2C2; Domain location=230-267; Score =15.2; E_value=0.0035; Accession=PF09337.1; Description=His(2)-Cys(2) zinc finger
MTFLYGLPCPFSSPILLVKKHHWFSKLDLLQGYHQILMHEGYASITTPLHKLITKDPFERTQAAQQAFTKLNEALTTAPVLMLPNFSLPFTLETDASGVGMGAVLSQNGHPIAFFSKPFSPKLLRASAYVRELFAITFVVKKWQQYLLGHRIIILTNHRSLKELLTQVVQTPNGTQARHRTKSGFIQFRQDILTKAEAHPDCVVKKGCIWLPPGSSFIQTLLHEYHSTPIEGHMGSNKTRACLTENFDWPGLHRDVEQFVATCLDCQHTKYEAKRVASLLNSLPVPCQSWEDLSLDFITGLPSFHGNTAILVVVKRTVQTQWDSPEDEFGVSSPDGWTNYGSKSCHRTVLCVFVHKKPTLWGKLLHWVEWSYNTSKHSGSGVSPYEITFGKKPITLPQYITSTLKVDAVDDMFTNREAVFEEVRKKLMKAQAVMKHFADHKHRDVTFQVGDIVMVKLRPYKQTSVAGPQSVPPKLAKRFYGPF

SEQ ID NO: 187525 - protein, 376 aa, Glycine max
  Coding DNA Sequence Number=SeqID_70747
MGIPIRTHINWVRIREEMYMVVGSGVGTVWVEESSAGGGINITFEFPNMPTVQIDQEYEVMYLDWNYFANPVALERMKSNLGLGRAMNVGWVKWLYNGIICLSVIILIHDEKENCRGTLVSSVEASSFGGAGNNGGGDVVKAVKGQPDRVMFGTAQVTYPPEGERAPPPEPVLMAIRLGPHDESLAASGILILRGGEPRLQSLQESCPRRELTIVGHPLKPGVEWYSKNWLILKIQQRASLPSKQGTSNFRQWACTEEAKEGRTMEEAEGEEVIEFLVTRPSSNRSEDAFNLVDSAMVQRQREYQNVRLPTIYTGLQGSVPPEKNERRELEDEEIFHCHFLLTRDRNANSALCRYTKSFRYVGVLCCLLGLAFAIA

SEQ ID NO: 187526 - protein, 216 aa, Glycine max
  Coding DNA Sequence Number=SeqID_70748
  Gene Ontology: Mol. function=helicase activity
  Homolog annotation: Hit_ID=Q1SRJ5; Match level="QueryCoverage=97%, HitCoverage=25%, E-value=1e-64, Identity=53%"; Hit description =Probable helicase [imported]-Arabidopsis thaliana-related
MASITDEIDQIISVKILSQQDDPELYSLVKNHLVHGPCGSLNPRYPCMKKGKCSRFYPKKFQPHTVLDADGFPVYRRRNNGNAIEKNGVIVDNKYIVPYNARLLRKYQVHINIEWCNQSTSIKYLFKYINKGYDRVTTILIDEDNDQTENGGTHNDEIKEYLDCRYISPCESTWRIFGFPIHGRKPVVERLHFHLPGQHSVLYEDHDDLDDVLSKP

SEQ ID NO: 187527 - protein, 183 aa, Glycine max
  Coding DNA Sequence Number=SeqID_70749
MMCGSNDFQDYFDDAKESRVKQIPKIQESSFKNQVSRIKIQESREDSIKISTKKVFQNIEQHKKFSQNHYQRVLLSGNRLPEGIQVKGTSTWLFKENKGGYIPCGSLACKGFYKVERNLKNRLVAWGLDDRLEIKQTKQDEFDPNHDLKVIKKRDPNLNLPIEPKLYENEQPNYMERGSFISY

SEQ ID NO: 187528 - protein, 167 aa, Glycine max
  Coding DNA Sequence Number=SeqID_70750
MAKFSVISVDEYQLLQILHQVASITIQVVGIIVSNHGACQLDYSPSTSLVLKESQASISCIEARRRADIRALALNKDNTNLLVSTLDKQSIIFTDPIAGRLSRILMRREQANGSKLFVLWYVCNTNLLVSTLDKQSIIFTDPIAGRLSRILMRREQANGRQEDLVGY

SEQ ID NO: 187529 - protein, 108 aa, Glycine max
  Coding DNA Sequence Number=SeqID_70751
MSKREHESFKEYAQWWRDLAAQVVPPMIEREMITMIVDTLSVFYYEKLVGYMPYSFMDLVFAGERIEVGLKRGKFDYVSLTDTNNRRIREAREKRKEGDAHVVTLAPA

SEQ ID NO: 187530 - protein, 721 aa, Glycine max
  Coding DNA Sequence Number=SeqID_70752
  Homolog annotation: Hit_ID=Q1S0F5; Match level="QueryCoverage=43%, HitCoverage=62%, E-value=2e-39, Identity=34%"; Hit description=IMP dehydrogenase/GMP reductase
ICDLATVEVSMEAIASLTQYYDQPLRCFTFEDFQLVSTVKEFEEILGCPLGGRKPYLFSGFYPSTARITKVVKISAQELDRAKQNRNGVVGVPRKCLEEKANALANQGEWASFIKILALLIFGVALFPNVERLVDLVAIDAFLAFHNSKESLVVAILANMYDTFDQRCEKSGAKIVCCTPALYVWLVSHLFPQEGRPGCPLQGHHLSDEKGKANWDQLLASMEGASINWFPHWKEGRIGILCSCKGFPNVPLMGTRGCINYNPILSIRQLGYPMRGVPSEESIAPFIARGFSDPNARVLQGVHKAWDMVQRNDKELRGSSNGIIGAIAEALKESEEVQALKGLKGRTQLKKFQGASWGSNSELKLRRDERDQSQVEGVILKDELKVCLRSKRNLSQQLSETEGNMWVIIDEYKEKLNLAVTHKQRLEDEYAKISAEREARERGVNTITKRAPRHPYRTHSKFRAMGDVEEVQEQMKANMLALKDQMASMMEAVLVMKRLIESNAATAATASTAAEADPVHPSTTNLAHQLTPNMVGRGRDTLGNANSPHLGYNRSAYPYGLPLNFTFPTMHQNMDHATPPTFEGQPPQPTGGVREDHRERAQGDVDSYPLFTTEGPTPNVLPQPNIVGVSQPCPMQPLLFFVGGPPLVVEGREKLDLIKERLRAVEGFGDYPFADMVDLCLVPDVVIPPKFMVSYPNFVRGPLLDDMRPFFGACEVLGIHH

SEQ ID NO: 187531 - protein, 49 aa, Glycine max
  Coding DNA Sequence Number=SeqID_70753
MCHHVSLQLTTVRTLVVSFPLFIILNPSFENKAKSITKMQDESLKRQLS

SEQ ID NO: 187532 - protein, 123 aa, Glycine max
  Coding DNA Sequence Number=SeqID_70754
MVSRTPNISILAKEEKVQKAADDLLNESNWLSETHPLSEASSSLSGWKTLQEDKSEICTLSVQPACPARMLSLLTLTRYARSTSLRELRSPRDFKTLRLAENKRGDHHQEPQPEASYMKNREK

SEQ ID NO: 187533 - protein, 169 aa, Glycine max
  Coding DNA Sequence Number=SeqID_70755
  Gene Ontology: Mol. function=cysteine-type endopeptidase activity; Cellular component=vacuole; Biological process=proteolysis
  Homolog annotation: Hit_ID=Q6Y1F0; Match level="QueryCoverage=58%, HitCoverage=35%, E-value=3e-40, Identity=68%"; Hit description =Cysteine protease 14
  Pfam annotation: Domain name=Peptidase_C1; Domain location=46-169; Score=-1.5; E_value=1.5e-11; Accession=PF00112.13; Description =Papain family cysteine protease
MPIFSPHMPSINGENEEDDVHATRNDHDEGLWENMRMTHVNTLKRSPPPSDAPSPTTLRKTRQTTWLRRTYNNGCNGGLMDYAFSFIVENGELHKEEDYPYIMEEGTCEMTKALANQTLSVAMEASGRDFQFYSGGVFDGHCRNDLDHSVVAVGYGTAKWVDYIIVKNS

SEQ ID NO: 187534 - protein, 86 aa, Glycine max
  Coding DNA Sequence Number=SeqID_70756
  Subcellular localization annotation: CTP_CleavageSite=62; ConfidenceScore=5.60e-01
MATFCVKKQRHFRNPKLSPSKLGYSRKSLTSLKHSDPLVPSCSPSFPAFIEFVSGVLTLFIYSSTIEAVQVFVALTSCVAIVTQSW

SEQ ID NO: 187535 - protein, 61 aa, Glycine max
  Coding DNA Sequence Number=SeqID_70757
MSHHQMIMMIQIPQKSQRKRLFASGEWSGLKDEMKEYELGKASLLVAWGLFVRFFHSSLMP

SEQ ID NO: 187536 - protein, 132 aa, Glycine max
  Coding DNA Sequence Number=SeqID_70758
  Gene Ontology: Mol. function=nucleic acid binding
  Homolog annotation: Hit_ID=UPI0000162ACD; Match level="QueryCoverage =77%, HitCoverage=13%, E-value=6e-12, Identity=46%"; Hit description =RNA binding / nucleic acid binding
MDESLRKLLTKHMKERSILSVKVKKHLKNGKNVSMGLGFVEFDAPEIATNVRKDLQGQFWTTMLLFYNLVMSRMMGKNKRQLRRIRVQQNCSRKMLLLRQQRRTCHEALKNMTYVMKQSYQWPYIVPSLRDL

SEQ ID NO: 187537 - protein, 129 aa, Glycine max
  Coding DNA Sequence Number=SeqID_70759
  Subcellular localization annotation: CTP_CleavageSite=34; ConfidenceScore=5.08e-01
MDSISESAKVITFCAVSFCSRSSQPPRQGNLTSLAAAVRDRDNLIKTPKPKYVEYNNDRKCESDGERDHEIDGEGDRERDNEGHRKSDKEGLGQVESNEGRKEGLGRRSRLGKEKGRVCWDWGGEGKIG

SEQ ID NO: 187538 - protein, 107 aa, Glycine max
  Coding DNA Sequence Number=SeqID_70760
MAEWLIAPILKTGIVRNKELSRVRIPFSPLSRKILSSSHIEIGCEYQTRTQKWVEVEDPLNDVGVGDLKTEKDYAMKPWSGIRSTEKDSGTQSKFLVRGSVNRSKRC

SEQ ID NO: 187539 - protein, 102 aa, Glycine max
  Coding DNA Sequence Number=SeqID_70761
  Gene Ontology: Mol. function=DNA binding; Biological process=DNA integration
MQATMQLVQCWDREKAGSCSYQVSANEEFDLVIKEKKGSENLVADHLSRLVNEEVTLKELEIHDAFPDESLLVVNERPWFADRANYKAAGILPKDINCQQRK

SEQ ID NO: 187540 - protein, 111 aa, Glycine max
  Coding DNA Sequence Number=SeqID_70762
  Subcellular localization annotation: CTP_CleavageSite=46; ConfidenceScore=5.12e-01
MGSFANIFRQGAILHVNCMHALSKPSVRLASSLAVKNPPSPLAISSCMGEPDAGIAIGAGGLQEELASLTGELKFKKISAYKAQREALVKFLILFALSYTVWLLFLIRALG

SEQ ID NO: 187541 - protein, 81 aa, Glycine max
  Coding DNA Sequence Number=SeqID_70763
MGLHACTTQTASGTGEFGVWEGIASANGDIAMQGEPPVKLASSKLQKAGLLFSSGRLAFSMVGSLFQRWQAKGKLQLPLAS

SEQ ID NO: 187542 - protein, 49 aa, Glycine max
  Coding DNA Sequence Number=SeqID_70764
MSHQPKKAHRDNVYGPINLKQVQKNDQSTLRSSGPYGNSSNLDQEDAAS

SEQ ID NO: 187543 - protein, 54 aa, Glycine max
  Coding DNA Sequence Number=SeqID_70765
MVTSKKTAKRTTAVRGGYWWLRVVNNKLGSLGKGFGRKKQKGMVVFQGYTKNKT

SEQ ID NO: 187544 - protein, 430 aa, Glycine max
  Coding DNA Sequence Number=SeqID_70766
  Gene Ontology: Mol. function=protein serine/threonine kinase activity; Cellular component=integral to membrane; Biological process=protein amino acid phosphorylation
  Homolog annotation: Hit_ID=Q9CA77; Match level="QueryCoverage=99%, HitCoverage=59%, E-value=1e-143, Identity=33%"; Hit description =Putative receptor protein kinase; 10992-14231
  Pfam annotation: Domain name=LRR_1; Domain location=121-144; Score =4.7; E_value=37; Accession=PF00560.23; Description=Leucine Rich Repeat
  Pfam annotation: Domain name=LRR_1; Domain location=146-168; Score =14.8; E_value=0.31; Accession=PF00560.23; Description=Leucine Rich Repeat
  Pfam annotation: Domain name=LRR_1; Domain location=170-192; Score =14.1; E_value=0.51; Accession=PF00560.23; Description=Leucine Rich Repeat
  Pfam annotation: Domain name=LRR_1; Domain location=194-216; Score =14.0; E_value=0.55; Accession=PF00560.23; Description=Leucine Rich Repeat
  Pfam annotation: Domain name=LRR_1; Domain location=218-240; Score =14.1; E_value=0.5; Accession=PF00560.23; Description=Leucine Rich Repeat
  Pfam annotation: Domain name=LRR_1; Domain location=242-264; Score =8.2; E_value=8.4; Accession=PF00560.23; Description=Leucine Rich Repeat
  Pfam annotation: Domain name=LRR_1; Domain location=25-47; Score=6.4; E_value=18; Accession=PF00560.23; Description=Leucine Rich Repeat
  Pfam annotation: Domain name=LRR_1; Domain location=367-389; Score =5.7; E_value=25; Accession=PF00560.23; Description=Leucine Rich Repeat
  Pfam annotation: Domain name=LRR_1; Domain location=390-412; Score =9.0; E_value=5.8; Accession=PF00560.23; Description=Leucine Rich Repeat
  Pfam annotation: Domain name=LRR_1; Domain location=414-428; Score =2.0; E_value=1.2e+02; Accession=PF00560.23; Description=Leucine Rich Repeat
  Pfam annotation: Domain name=LRR_1; Domain location=49-71; Score =17.0; E_value=0.069; Accession=PF00560.23; Description=Leucine Rich Repeat
  Pfam annotation: Domain name=LRR_1; Domain location=73-95; Score =11.6; E_value=1.9; Accession=PF00560.23; Description=Leucine Rich Repeat
  Pfam annotation: Domain name=LRR_1; Domain location=97-119; Score =8.5; E_value=7.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=121-144::146-168::170-192::194-216::218-240::242 -264::25-47::367-389::...
  Pfam module annotation: Domain location=390-412::414-428::49-71::73 -95::97-119
LREFSISENFLTGVVPSKAFPINCSLENLDLSVNEFDGKPPKEVANCKNLEVLNLSSNNFTGDVPSEIGSISGLKALFLGNNTFSRDIPETLLNLTNLFILDLSRNKFGGEVQEIFGKFKQLKFLVLHSNSYTRGLNTSGIFTLTNLSRLDISFNNFSGPLPVEISQMSGLTFLTLTYNQFSGPIPSELGKLTRLMALDLAFNNFTGPIPPSLGNLSSLLWLTLSDNSLSEEIPPELGNCSSMLWLNLANNKLSGKFPSELTRIGRNARATFESNNRNLGGVVAGNSECLAMKRWIPADYPPFSFVYTILTRKNCRALWDRLLKGYSIFPMCSSHPSSRPSHITGYVQLSGNQLSGEIPSEIGTMVNFSMLHFGDNKFTGKFPPEMVDLPLVVLNITRNNFSSELPSDIGNMKCLQDLDLSWNNFSGAFP

SEQ ID NO: 187545 - protein, 224 aa, Glycine max
  Coding DNA Sequence Number=SeqID_70767
MVVNGEGHRENGFRVAPVEGDDVEEEDDEDDSGEEIDEEEGDDDDVVEVHEIEDSDDEDGVEEYDDEDDDEDDDEEEEEVDNDEGDFAEPESTGRLTSTEGEIDGHEQGEEDGDEDDNGETGEDEMGVEDDGEFEDDDEEEDYGAGYLVQPVGQSDALNAGGADVDGGNDDDGEEEDEVDDDDDDQVLPPPDSSHKRKRDDEEDVDDDDDVASMCWKQGNLSFR

SEQ ID NO: 187546 - protein, 257 aa, Glycine max
  Coding DNA Sequence Number=SeqID_70768
MELTAERDNNGSFNLGLVRVVADGITSEQTVRDTEAHFDHICGTKSCFFAVMRKGGNVSVGSQMITWEVLHSYNVSLTTHVRYYVNIECDKVTGLRAKFRGPFKCEGQVLREGLLKQSEGSSLIQCKVSGKPKKAFCAFVKSEFAGKEYILFQQQGERVNVFNSGSFHGHGNGSNYKDCNIVMKYEAVENSHRTGFVIKWRFFPFLPFLIRERGPFLGSGSERGRKNGKRGGEDPECPHFIDGWEIWIPFSLYIFVI

SEQ ID NO: 187547 - protein, 585 aa, Glycine max
  Coding DNA Sequence Number=SeqID_70769
  Gene Ontology: Mol. function=protein serine/threonine kinase activity; Cellular component=integral to plasma membrane; Biological process=protein amino acid phosphorylation
  Homolog annotation: Hit_ID=Q1S4F8; Match level="QueryCoverage=97%, HitCoverage=83%, E-value=1e-177, Identity=58%"; Hit description =Protein kinase
  Pfam annotation: Domain name=Pkinase; Domain location=242-497; Score =105.9; E_value=1.1e-28; Accession=PF00069.15; Description=Protein kinase domain
  Pfam annotation: Domain name=Pkinase_Tyr; Domain location=242-514; Score=160.0; E_value=6.3e-45; Accession=PF07714.7; Description =Protein tyrosine kinase
  Pfam module annotation: Pfam domain module=Pkinase::Pkinase_Tyr; Domain location=242-497::242-514
MSSPHNSAPHNSTPDNSSPDDATPDNSIPDNSTPDDATPDNSIPDNFTPDNSTPDNSTPDNSNGSHKSSSMSPPSMERHNTPTSGKDSPNKSLNAKSSGSNNDSGDKAAMGAGIGVGCKKKKRKQKYYYPDPSQGKASNYYNSGQHPLPSWQAGSGPHGGDHVMRVQQQQGMGMGMGMGMGMGMGPHSGGWGAPPHPMMSSGEMSSNYSLGMSSSSPGLSLALNANGGTFTYEELAAATKGFANENIIGQGGFGYVHKGILPNGKEVAVKSLKAGSGQGEREFQAEIEIISRVHHRHLVSLVGYCICGGQRMLVYEFVPNSTLEHHLHGKGMPTMDWPTRMRIALGSAKGLAYLHEDCSPRIIHRDIKASNVLLDQSFEAKVSDFGLAKLTNDTNTHVSTRVMGTFGYLAPEYASSGKLTEKSDVFSFGVMLLELITGKRPVDLTNAMDESLVDWARPLLNKGLEDGNFRELVDPFLEGKYNPQEMTRMAACAAASIRHSAKKRSKMSQIVRALEGEASLEDLKDGMKLKGSGNGNSSAYPSSYGSSEYDTMQYNADMIKFRQAIMSSQEFNDSSELSSKEMSYH

SEQ ID NO: 187548 - protein, 121 aa, Glycine max
  Coding DNA Sequence Number=SeqID_70770
MESPQKLSIVNAIERERIIANTGGYFRVNGNGSMYKNCICIFLMNHHGAGTGTKLGKLWLPTVVATAIAMVVPTALKSIGSIEGARIAKERFLEVFLKEFFDGCIIWLNSCKSTSSHRKEL

SEQ ID NO: 187549 - protein, 41 aa, Glycine max
  Coding DNA Sequence Number=SeqID_70771
MERSRHWWKLLLRIEWFLNEKGVRVENGDTNSFKLPITSFQ

SEQ ID NO: 187550 - protein, 152 aa, Glycine max
  Coding DNA Sequence Number=SeqID_70772
MQSHHQQLNVIPNPEPTEKALMLALESWKKIEKAKVDRRFLEISVLADVFSACLAILHFFKFYFQHLPAFESHNRLLIFSFPSLPTQHKSKLRLSQFVNKQSVAHLTISDQDKSYWHILGVPKLRATRTVFVKIKDINEKRKRNQNSFHLHG

SEQ ID NO: 187551 - protein, 63 aa, Glycine max
  Coding DNA Sequence Number=SeqID_70773
MGGDTNIVVFETTQLASVSAGSVEHGKIVHGIKNMAYFLLVPDKEEQDQQEKHFCNGDKDLFG

SEQ ID NO: 187552 - protein, 80 aa, Glycine max
  Coding DNA Sequence Number=SeqID_70774
MEKYVEQPREWKMKRLEKKTHGTIRGATKGVGNEKTPPFGMGKTMRCHCMEYEFIDPLKNLISTLTKSRHKEEALGIEET

SEQ ID NO: 187553 - protein, 152 aa, Glycine max
  Coding DNA Sequence Number=SeqID_70775
MDQKVGPTEILKRDNFLANWGMLIEGSQLLKQGDYLCFFSALQSKVTNLDLEAQDFDKDGTVGLFEELDIDQSDSLFLRNWNAKFGGHLLNGFHTQIWFLSFPSTGYMQCKGRMSNMLDLQDNINVTFHCYIFCKDCIHDCLTYYVTPTMAS

SEQ ID NO: 187554 - protein, 236 aa, Glycine max
  Coding DNA Sequence Number=SeqID_70776
MYLFPSPKHYIREALMALTHKHSHLITTSIQKLSLLFTHTIDKNCMFLLCNGLLVFVGITRSLSGSSGVAESESSSKYVEDGSQSPYSDVEANEAIILEEKEVIEKIHEPHGQNTEAEHAIEIKYSSEEGEEESIGNIILEGEEQEKEKENKESVLKDDKEPEGETASFGAGEEDKESEIDEFLIGESVEEEEVVEEPNWVLSTEELNRKFDDFIRKMKEDLRIEAQRQLLMDFEA

SEQ ID NO: 187555 - protein, 724 aa, Glycine max
  Coding DNA Sequence Number=SeqID_70777
  Gene Ontology: Mol. function=protein binding; Cellular component =membrane; Biological process=defense response
  Homolog annotation: Hit_ID=Q19PL5; Match level="QueryCoverage=97%, HitCoverage=72%, E-value=1e-108, Identity=34%"; Hit description=NBS -LRR type disease resistance protein
  Pfam annotation: Domain name=LRR_1; Domain location=404-425; Score =6.7; E_value=16; Accession=PF00560.23; Description=Leucine Rich Repeat
  Pfam annotation: Domain name=LRR_1; Domain location=427-448; Score =17.3; E_value=0.054; Accession=PF00560.23; Description=Leucine Rich Repeat
  Pfam annotation: Domain name=LRR_1; Domain location=450-471; Score =10.0; E_value=3.9; Accession=PF00560.23; Description=Leucine Rich Repeat
  Pfam annotation: Domain name=LRR_1; Domain location=607-629; Score =2.6; E_value=92; Accession=PF00560.23; Description=Leucine Rich Repeat
  Pfam annotation: Domain name=LRR_1; Domain location=679-701; Score =1.7; E_value=1.4e+02; Accession=PF00560.23; Description=Leucine Rich Repeat
  Pfam annotation: Domain name=NB-ARC; Domain location=1-282; Score =136.6; E_value=6.8e-38; Accession=PF00931.13; Description=NB-ARC domain
  Pfam module annotation: Pfam domain module=LRR_1::LRR_1::LRR_1::LRR _1::LRR_1::NB-ARC; Domain location=404-425::427-448::450-471::607 -629::679-701::1-282
FNNISNNVYQGKTAIVKNVYNMQEQVSLQKKGTSYFEFCAWITMSGPQVDDHNMLIIRQIIENILEKDPGASATLQKETTAIHSLIRKVREYLKDKRYLIVFDDVHSSKFWNVIKHALTPNRSKSSKVIITTRDENVAKFIGSDDVYKVEPLSQSDALKLFCHKVFQSEKVENPELNALSQEFVEKSDGVPVAIVTFAGLLATTSKTTTKWRMVLNKLDSLLQRNSLFDSMKEVMLESYHDLPSHLKRCFLYFGIFPEGYSISCMRLVRLWVAEGFVEKRDDTSMEELAKEYLTELIRRCLVHLSRVDFDGRPKSCHVYDLMHKLIARICEEQMFCQVMKDKTAPSSSNSNLDSSLPRRLSIIKSWDAAAMKRAEKWEKVRSCFVFDDAKKWLVTKELFSSFELLSQLDLSNARLDNLPKKVGNLFNLKYLSLRNTNIKSIPESIGNLERLQTLDLKRTQVDVLPKKIKNLVKLRHLLAYFIYNQNSGLDRLQGVKVNEGLKNLTSLQKLSFLDASDGSVIEELKQLEKLRKLGIIKLREEYGEELCKVIEKMDHLCSLSIGAMGNDDGNHGMLQLKSIRNPPSSLQRLYLYGRLERLPSWISKVPNLIRLCLRWSILKEDPLPYLKDLSELSYLEFYDAYGGDELHFKNGWLKRLKVLCLESLPKLKTIKIDEGAIPLLAELKIGKCHEMVKVPRDIQNLTSLQKLYLYDMHEQYINRMVDTQ

SEQ ID NO: 187556 - protein, 705 aa, Glycine max
  Coding DNA Sequence Number=SeqID_70778
  Gene Ontology: Mol. function=protein binding; Cellular component =membrane; Biological process=defense response
  Homolog annotation: Hit_ID=Q1SW19; Match level="QueryCoverage=92%, HitCoverage=68%, E-value=1e-106, Identity=36%"; Hit description =Disease resistance protein
  Pfam annotation: Domain name=LRR_1; Domain location=361-382; Score =6.7; E_value=16; Accession=PF00560.23; Description=Leucine Rich Repeat
  Pfam annotation: Domain name=LRR_1; Domain location=384-405; Score =17.3; E_value=0.054; Accession=PF00560.23; Description=Leucine Rich Repeat
  Pfam annotation: Domain name=LRR_1; Domain location=407-428; Score =10.0; E_value=3.9; Accession=PF00560.23; Description=Leucine Rich Repeat
  Pfam annotation: Domain name=LRR_1; Domain location=564-586; Score =2.6; E_value=92; Accession=PF00560.23; Description=Leucine Rich Repeat
  Pfam annotation: Domain name=LRR_1; Domain location=636-658; Score =1.7; E_value=1.4e+02; Accession=PF00560.23; Description=Leucine Rich Repeat
  Pfam annotation: Domain name=NB-ARC; Domain location=2-239; Score =81.6; E_value=2.4e-21; Accession=PF00931.13; Description=NB-ARC domain
  Pfam module annotation: Pfam domain module=LRR_1::LRR_1::LRR_1::LRR _1::LRR_1::NB-ARC; Domain location=361-382::384-405::407-428::564 -586::636-658::2-239
MSGPQVDDHNMLIIRQIIENILEKDPGASATLQKETTAIHSLIRKVREYLKDKRYLIVFDDVHSSKFWNVIKHALTPNRSKSSKVIITTRDENVAKFIGSDDVYKVEPLSQSDALKLFCHKVFQSEKVENPELNALSQEFVEKSDGVPVAIVTFAGLLATTSKTTTKWRMVLNKLDSLLQRNSLFDSMKEVMLESYHDLPSHLKRCFLYFGIFPEGYSISCMRLVRLWVAEGFVEKRDDTSMEELAKEYLTELIRRCLVHLSRVDFDGRPKSCHVYDLMHKLIARICEEQMFCQVMKDKTAPSSSNSNLDSSLPRRLSIIKSWDAAAMKRAEKWEKVRSCFVFDDAKKWLVTKELFSSFELLSQLDLSNARLDNLPKKVGNLFNLKYLSLRNTNIKSIPESIGNLERLQTLDLKRTQVDVLPKKIKNLVKLRHLLAYFIYNQNSGLDRLQGVKVNEGLKNLTSLQKLSFLDASDGSVIEELKQLEKLRKLGIIKLREEYGEELCKVIEKMDHLCSLSIGAMGNDDGNHGMLQLKSIRNPPSSLQRLYLYGRLERLPSWISKVPNLIRLCLRWSILKEDPLPYLKDLSELSYLEFYDAYGGDELHFKNGWLKRLKVLCLESLPKLKTIKIDEGAIPLLAELKIGKCHEMVKVPRDIQNLTSLQKLYLYDMHEQYINRMVDTQSEDYKIINKIPLVEYSKDDHFSLY

SEQ ID NO: 187557 - protein, 53 aa, Glycine max
  Coding DNA Sequence Number=SeqID_70779
MTGTNSHTTMIDGPGCCWMGSFVLKSFNFLEQTHSQVNIEYLSRVVFNTNDGN

SEQ ID NO: 187558 - protein, 117 aa, Glycine max
  Coding DNA Sequence Number=SeqID_70780
  Gene Ontology: Mol. function=mannitol dehydrogenase activity; Cellular component=cytoplasm; Biological process=lignin biosynthetic process
  Homolog annotation: Hit_ID=P93257; Match level="QueryCoverage=96%, HitCoverage=31%, E-value=7e-46, Identity=77%"; Hit description =Probable mannitol dehydrogenase
MGTLDGIIDTVSAIHPLPPLLGMLKSQGKLVMVGLPEKPLELPIFPLLAGRKIIADSVIGGIKETQEMIDFAAKHDVKPAIEVIPINYVNTALECLLKADVKYRFVIDIGKTLKPSS

SEQ ID NO: 187559 - protein, 85 aa, Glycine max
  Coding DNA Sequence Number=SeqID_70781
MEEVSSLVAQGKNSKIEDTIVEASKKYHLRQFKEKIAKLRTQLLEPPKSFGEESRGKGNLMACDVCCYLVPNFLRLGINFQYQTL

SEQ ID NO: 187560 - protein, 45 aa, Glycine max
  Coding DNA Sequence Number=SeqID_70782
MRLDAYFVEESQLVGIDRKKRELTNWLTEKEGPVKVVVGPGGIDT

SEQ ID NO: 187561 - protein, 68 aa, Glycine max
  Coding DNA Sequence Number=SeqID_70783
MYLRHECGREEQQSCAWLWRLTQARLRWSEGGVTSSCDVIDDIVVDSVEDQTSLEKEKDQGRGGANGE

SEQ ID NO: 187562 - protein, 227 aa, Glycine max
  Coding DNA Sequence Number=SeqID_70784
MFLVALTKKKGYQDEKQKEELHPSLEVTHTEVNQQSEPDENLEQQAEAHSDYSFPTDSESCNFSIMDETFELNVQEHRLQEDMQSDYSLPSDSESSDDSIMGESFEMDHIGNQNEDIISESLNSDDDYEEDEDEEEEDTLIEINLPSSHFPDLIEDPKQKLQTKLPDFLPDSIFKQQGLMELLEEINDMNEDENLIEIDISMGSINNPDFRLKQGLAYFQDECVLSD

SEQ ID NO: 187563 - protein, 177 aa, Glycine max
  Coding DNA Sequence Number=SeqID_70785
MNSTKRILSAAEGNLGARLDFRKNATPLSLERQQRSSSNNGCSGSSFDFHDGAIFGMSLLCGSTIRERKSLNDFVEGPKDAKGKGKIDYEGQSNDERSLTSSIEGSSRVGDAKGSLKVNLDMEMQLRMMPLLKCVARHVWYAITQDNINVVCQQPGRLLELEPEDLQTLVPWDFIQR

SEQ ID NO: 187564 - protein, 185 aa, Glycine max
  Coding DNA Sequence Number=SeqID_70786
  Gene Ontology: Mol. function=methyltransferase activity; Biological process=cell cycle
  Homolog annotation: Hit_ID=Q1SAG0; Match level="QueryCoverage=92%, HitCoverage=19%, E-value=4e-60, Identity=67%"; Hit description =Cullin; N-6 Adenine-specific DNA methylase
MEEPNPCFFNPAILDSLTDDSVHEILDSYNDFCNATQSLLAGNGDLSVASDFVSHVHTLCKHRLRSLVQDHFFRLLEETFERNGASRFWRHFDPYFHVAGLNKNDDLDIDEDEIQSVLYNALEEITLEKQYQEKCLLMLVHALQSYKDQVSEDKHGFEGDRNYLTSKYQWIVSSVLMASLSRHFP

SEQ ID NO: 187565 - protein, 707 aa, Glycine max
  Coding DNA Sequence Number=SeqID_70787
  Gene Ontology: Mol. function=protein dimerization activity; Cellular component=chromatin; Biological process=electron transport
  Homolog annotation: Hit_ID=Q9LIE1; Match level="QueryCoverage=98%, HitCoverage=98%, E-value=1e-174, Identity=43%"; Hit description =Transposase-like protein
  Pfam annotation: Domain name=DUF659; Domain location=225-377; Score =243.0; E_value=6.4e-70; Accession=PF04937.6; Description=Protein of unknown function (DUF 659)
  Pfam annotation: Domain name=zf-C2HC_plant; Domain location=16-72; Score=100.1; E_value=6.7e-27; Accession=PF07567.3; Description =Protein of unknown function, DUF1544
  Pfam module annotation: Pfam domain module=DUF659::zf-C2HC_plant; Domain location=225-377::16-72
MGSNLEPVPITSQKHDPAWKHVQMFKNGDKVQLKCIYCLKMFKGGGIHRIKEHLACQKGNASTCSRVPHDVRLHMQQSLDGVVVKKRRKQRIEEEIMSVNPLTTVVNSLPNNNNRVVDVNQGLQAIGVEHNSSLVVNPGEGMSRNMERRKKMRATKNPAAVYANSEGVIAVEKNGLFPKKMDNHIYMAIGRFLYDIGAPFDAVNSVYFQEMVDAIASRGVGFERPWHHELRGWILKNSVEEVKNDIDRCKMTWGRTGCSILVDQWTTETGKILISFLAYCPEGLVFLRSLDATEISTSADFLYDLIKQVVEEVGAGQVVQVITSGEEQYGIAGRRLTDTFPTLYLSPSAAHCIDLILEDFGNLEWISAVIEQARSVTRFVYNYSAILNMVKRYTLGNDIVDPSFSHFATNFTTLKRMVDLKHNLQALVTSQEWADSPYSKQTAGLEMLDCLSNQTFWSSCDMIVCLTAPLLKVMRIASSEMRPAMGYVYAGMYRAKEAIKKALGKREEYMVYWNIIHHRWERLWHHPLHAAGFYLNPKFFYSIQGDIHGQIVSGMFDCIERLVPDTRIQDKIIKEINLYKSASGDFGRKMAVRARDNLLPSEWWSTYGGGCPNLSRFMSKEQDFSDPLSFDNISNVEEWIRPRDLYIDDECGNSDWMALDPSSVNTMLLRPLNDEAEDLGEGYDDYEIFSCGKDSEDENTGDKLLEQ

SEQ ID NO: 187566 - protein, 251 aa, Glycine max
  Coding DNA Sequence Number=SeqID_70788
  Gene Ontology: Mol. function=molecular_function; Cellular component =cellular_component; Biological process=regulation of progression through cell cycle
  Homolog annotation: Hit_ID=Q9LZL8; Match level="QueryCoverage=99%, HitCoverage=82%, E-value=4e-87, Identity=63%"; Hit description =Thaumatin-like protein
  Pfam annotation: Domain name=Thaumatin; Domain location=29-249; Score= 210.2; E_value=4.7e-60; Accession=PF00314.8; Description=Thaumatin family
MATSSHYFIFFSILVSISLTDGTQLIIVNNCKESVWPGILGNGGHPSPKHGGFHLGSGEEIVIHVPKVWSGRIWGRQGCCFDQNTAKGSCQTGDCGGLLQCNGIGGVPPATLVEMTLGTSQSPLHFYDVSLVDGFNLPVSVKPVEGGGGGGAGCGVAACEANLNVYCPSSLVVERNGKVVGCKSACLAAKSDRYCCTGEFAGGRYYCKPTVFARLFKTVCPNAYSYAYDDDSAVLKTCVAPRYVITFCPPH

SEQ ID NO: 187567 - protein, 511 aa, Glycine max
  Coding DNA Sequence Number=SeqID_70789
  Gene Ontology: Mol. function=protein serine/threonine kinase activity; Cellular component=cell surface; Biological process =protein amino acid phosphorylation
  Homolog annotation: Hit_ID=Q9M2S4; Match level="QueryCoverage=91%, HitCoverage=68%, E-value=1e-155, Identity=58%"; Hit description =Probable serine/threonine-specific protein kinase
  Pfam annotation: Domain name=Lectin_legB; Domain location=1-103; Score=-47.7; E_value=3.6e-07; Accession=PF00139.10; Description =Legume lectin domain
  Pfam annotation: Domain name=Pkinase; Domain location=189-459; Score =176.5; E_value=6.5e-50; Accession=PF00069.15; Description=Protein kinase domain
  Pfam annotation: Domain name=Pkinase_Tyr; Domain location=189-459; Score=115.1; E_value=2.1e-31; Accession=PF07714.7; Description =Protein tyrosine kinase
  Pfam module annotation: Pfam domain module=Lectin_legB::Pkinase::Pkina se_Tyr; Domain location=1-103::189-459::189-459
HVGINLNNLASNKSVEAAFFTSTNNKQKLNLKSGEVTQAWVDYDSLKNNLEVRLSTTSSKPTSPILSYKVDLSQIIQDSMYVGFSSSTGLLSSSHYILGWSFKINGDAKTLSLKNLPSLSASSKPQKRLIFALSLSLIIPTVLAATALACYYFLLRKMRNSEVIEAWEMEVVGPHRFPYKELHKATKGFKDKNLIGFGGFGRVYKGVLPKSNIEVAVKRVSNESKQGMQEFVSEISTIGRLRHRNLVQLLGWCRKQNDLLLVYDFMRNGSLDKYLFEQPKRILSWEQRFKIIKGVASGLVYLHEEWEQTVIHRDVKAGNVLLDNQMNGRLGDFGLAKLYEHGSNPSTTRVVGTLGYLAPELTRTGKPTTSSDVYAFGALVLEVLCGRRPIEVKALPEELVLVEWVWERWRVGNVLAVVDPRLGGVFDEEEALLVVKVGLSCSAEAPEERPSMRQVVRYLEREVAPPEVLVEGKKEGGGDGEFKGYAHSYSTASFFDVESESASSLSLSGGR

SEQ ID NO: 187568 - protein, 98 aa, Glycine max
  Coding DNA Sequence Number=SeqID_70790
EPARTLQRTVEWILPTPTPYRLVEPVQVIEVTSSEEDPEEDPEELPPEPAVDALDFPKGDEDPFPEVDSPEDVMSASEADSTEESGLEGIVTSGGSSS

SEQ ID NO: 187569 - protein, 627 aa, Glycine max
  Coding DNA Sequence Number=SeqID_70791
  Gene Ontology: Mol. function=receptor activity; Cellular component =integral to membrane; Biological process=red or far red light signaling pathway
  Homolog annotation: Hit_ID=Q6R8G7; Match level="QueryCoverage=98%, HitCoverage=71%, E-value=0.0, Identity=54%"; Hit description=PHO1 -like protein
  Pfam annotation: Domain name=EXS; Domain location=416-601; Score =238.6; E_value=1.3e-68; Accession=PF03124.5; Description=EXS family
MAMEMIEESNSHNEQSDNQEHVKPKVEAEKPKNTRVTRPAPLEILDRVHFNHNYETPRSTIKGVLNFHSNTELVNFSRKNLNKVEEQLKRTFIEFYRKLRLLKSYSNFIMQITSRDGAKAYMEMVDNSYLGSSDVVTKLMDRVEKTFTKHFYNSNRNKAMRILRPKTKRERHRVTFSMGKHHHIHIDSNLGAKEDKFLFTFLLSPDTVDTFSGFFAGCTTALVLALILIIRTRNIFDNSETTKYMETLFPLHSLYGFIVLHLLMYAANVYFWRQYRVNHSFIFGFKRGTGLGYNEVLLLGFGLAVFALGSVLANLDMQIDPETKDYKTLTELIPLILLLVVIAILLCPLNIIYRSSRVFFLICLFHCICAPLYKVTFPDFFLADQFTSQVQALRSFEFYICYYCGGDFKQRENTCNSNSVFITFSFIVAVIPYWCRFLQVTILVNSSQLLELCLLECLRRLFEEKDPMQGYNGLKYFLTIIAVCLRTAYSLNNSMVWMVLAMIFSIFAAVASTYWDLVIDWGLLQGHSKNRWLRDKLAIPHKSVYFIAMVLNVLLRFAWLQTVLNFKFTFFHKQAVSSIVACLEIIRRGIWNFLRVENEHLTNVGKFRAFKSVPLPFNYDEDEDKDD

SEQ ID NO: 187570 - protein, 88 aa, Glycine max
  Coding DNA Sequence Number=SeqID_70792
  Gene Ontology: Mol. function=catalytic activity; Biological process =cellular metabolic process
  Homolog annotation: Hit_ID=Q9SYM5; Match level="QueryCoverage=97%, HitCoverage=13%, E-value=1e-24, Identity=59%"; Hit description =Probable rhamnose biosynthetic enzyme 1
MVVVTADFGKSEGSDDVGLDGLDFVGLAPVDIGATHDAGSIEDVGGLKLGYVSFEGGPVLEATRAVLGPAEGAEVAAKTARVAIDEKV

SEQ ID NO: 187571 - protein, 139 aa, Glycine max
  Coding DNA Sequence Number=SeqID_70793
MMIKFLACNNKSMFDLYFVPSLECQTCGRPKVMSRQHIWTLEITQSMLGAPGPLRLPNCAMTHVNACGQHMTILRRFGPPLQWNVVVVDGGVRCKYVVQPWYQFLADNDFSHDDEVSFYYRTIDKTWEIVIRRKKNWDY

SEQ ID NO: 187572 - protein, 101 aa, Glycine max
  Coding DNA Sequence Number=SeqID_70794
MAFSPAPMLFWHPFQLREEVSLKVPVEPNSDLSRLIPYGVTVTYLPSLEVATLVVNIPVSNVPPRKVHFRYELQPIFQLMWKVDTLYNQFQNLSPPIDHSH

SEQ ID NO: 187573 - protein, 1421 aa, Glycine max
  Coding DNA Sequence Number=SeqID_70795
  Gene Ontology: Mol. function=RNA-directed DNA polymerase activity; Cellular component=chromatin; Biological process=chromatin assembly or disassembly
  Pfam annotation: Domain name=Chromo; Domain location=1340-1394; Score= 57.4; E_value=4.7e-14; Accession=PF00385.14; Description='chromo' (CHRromatin Organisation MOdifier
  Pfam annotation: Domain name=RVP_2; Domain location=361-492; Score= -50.8; E_value=0.0091; Accession=PF08284.2; Description=Retroviral aspartyl protease
  Pfam annotation: Domain name=rve; Domain location=1090-1194; Score =8.5; E_value=0.0012; Accession=PF00665.16; Description=Integrase core domain
  Pfam annotation: Domain name=zf-H2C2; Domain location=1031-1072; Score=15.2; E_value=0.0035; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1340-1394::361 -492::616-785::111-200::1090-1194::1031-1072
MDHRVEALEEGLNEVRASIAGVQATMRESYANIVALLEKHLGKSIATEGGTSEKKDKPESSEVKNNVTLEFRQSAKKVELPSFDGDDPAGWISRAEVYFRVQGTTPAVKVSLAQLCMDGLTIHFFNSILRENEDLSWEELKEALLERYGGHGEGDVYEQLTDLKQEAIDDYITEFEYLVAEIPRLPEKQYRGYFLHGLKPEIKGRVRSFAALSEMRRTKLLQVARVVEREVEGGSELKPNRGPRFGFGSGSHKNGSQSDWVMVRRREGSRNEGVKSNTDGPKGDRKRIGPRDRGYTQLTYNELMDYKQKGLCFKCKNPFGPMHRCPAKELRVLIVDDVENEEDEERILAVEVGEEEDEKGEMSILNLHHITHETHHTMKFQGTIRGVEVLILVDSGAIHNFISQKLVHQMDWPIEPTAEMNVKLGNGFQISTQGVCRGLEMCIGDLKMNPEMHLFELGGIDVVLGIDWLKTLGDTITNWKQQTMSFWKDKSWVTLKGHEGCRRQTVALQSILNRPKPTSQGLLWEMDNVKHKGKGVNELSIQQQAEMEVLFNKFEHVFQTPTGLPPKRNRDHAITLTDGHGPVNVRPYRYPHHHKNEIEKQVKEMLTAGIIRHSTSSFSSPVILVKKKDGTWRMCIDYRALNKATIPDKFPISVIEELLDELHGARYFSKLDLKSGYHQVRVKDSDVGKTAFRTHEGHYEFLVMPFGLTNAPATFQGLMNDIFRPLLRKNVLVFFDNILVCSKDWETHLHHLEEVLRLLAAHSLVANQKKCYFGQRSIEYLGHMITEEGVAVDSRKVDSVLSWPQPKNVKRVRGFLGLTGYYRKFIRDYGKIAKPLTELTKKDGFKWGVEAQKAFDELKKRLTTAPVLTLPNFSKEFVIECDASGSGIGAILMQDKKPIAYFSKALGVRNLTKSAYEKELMVVVLAIQHWRPYLLGRKFVGRLNKGADALSRIHETGELQVLHSQIKWLQEDQIKAENDKDERLRKIMSEVQQNPDKWPGYEYRHGVLLYEGRLVLSAHSIVIPTLLEEFHSTPHGGHSGFYKTYRRLAANVYWIGMKNHVQEFVRRCDTCQRQKYMATSPGGLLQPLPVPNQIWEDISMDFITGLPKSKGYETVFVVVDRLSKYVHFIPLKHPYTARSVAEGTKLRMSTAYHPETDGQMEVPKTWISWLHWAEYWFNTTFHSATEKTPFEIVYGRPSPSLYRWVQGETRVEAVQRDLVDRDEALKQLRNQLLRAQEKMKAQADKRRSDRSFVCGKWMFVKLRAHRQQSVVTRINAKLAARYYGPYPIVEKIGHVAYKLKLPEGSRVHPVFHVSLLKKVVGTYQDDAELPELLEEPIEVYSPEAVLATRKVKHQNEEVRQVLIHWKGRTAEEATWEDEIMIRSQFPSFDLEDKVNIEGGAVDRTHVAAEDRTPEQLIHHTT

SEQ ID NO: 187574 - protein, 56 aa, Glycine max
  Coding DNA Sequence Number=SeqID_70796
MNLRGRQVEISDPMCPLCNNSEEVAAHLFFNCCKEQENSTVVRKRFLKEQHEEKTK

SEQ ID NO: 187575 - protein, 147 aa, Glycine max
  Coding DNA Sequence Number=SeqID_70797
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=100%, HitCoverage=19%, E-value=3e-50, Identity=68%"; Hit description =Kinesin, motor region; Prefoldin
MQLSSQEEAIKQKDVLATEVSSLRGELQQVRDERERQLSQVQTLSSELEKVKESRKHSSTELDSLTLKANDLEEKCSLKDNQIKALEEQLATAEKKLQVSNISAYETRTEYKGQQNFVNALQRRLADAEYKLIEEERLRKKLHNTIL

SEQ ID NO: 187576 - protein, 305 aa, Glycine max
  Coding DNA Sequence Number=SeqID_70798
  Gene Ontology: Mol. function=nucleic acid binding; Cellular component= chromatin; Biological process=DNA integration
MVFVSQIEPRNIDEALYDEHWLLAMHEELNLFKRNEVWDLVPKPIPHKSIETKWVFQNKLDESSIIVRNKAKLVAKGYNQEEGIDYYETYAPIARLEAIRLLLDFTCIMDFRLFQMDVKSVFLNGYIEEEIYVDQPPDVYDGRVELFPWTSSQANETWNLPMSNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 187577 - protein, 88 aa, Glycine max
  Coding DNA Sequence Number=SeqID_70799
  Homolog annotation: Hit_ID=Q1SPB9; Match level="QueryCoverage=58%, HitCoverage=8%, E-value=5e-07, Identity=50%"; Hit description =Transposase
MAKNLHPYQVKLQLPDTHNDHLILHLQCLKCTDEGFHGIDLTWESFSFMLVVGMRYQVTSMKIVRDRGSNMKKLWNLKKFYLFTCPSL

SEQ ID NO: 187578 - protein, 95 aa, Glycine max
  Coding DNA Sequence Number=SeqID_70800
MSRMLFRKGSSEKQYWAYRKTTLEEAPALQNRLFGKDFFLSESWNLWRWKAGVLREEEKKEWKGLWEEEGEENEEDTRGRGRLGVFKRMGGARCD

SEQ ID NO: 187579 - protein, 144 aa, Glycine max
  Coding DNA Sequence Number=SeqID_70801
  Homolog annotation: Hit_ID=Q9FM72; Match level="QueryCoverage=62%, HitCoverage=11%, E-value=3e-24, Identity=59%"; Hit description =Arabidopsis thaliana genomic DNA, chromosome 5, P1 clone:MDF20
MTLAFSALVAFKLSRRKTDDTFKLLHTILFGRRGKAVEIKSNILRFSGFVWRDNEEKQMIKVKEKLDKCNKEKLLEFCDVLDITINKATSRKPSKGTKRKRVVKWGSSRSGTTSRRSVKWSHVRESCATVELEEVFVDKRKAVL

SEQ ID NO: 187580 - protein, 143 aa, Glycine max
  Coding DNA Sequence Number=SeqID_70802
MEDDYFNQMFGEVDMDMDDTVKNEDCSNFFTTRKVIISSLLMQSYPARALGRRLQVDWARDPREGPRVLMSLRVFDTRDELLKWVQEVAFELGFVVVILRSDIRNQPGRKTFIVLGCEKGDKYNIKKMQRQSLGLENVIALLG

SEQ ID NO: 187581 - protein, 926 aa, Glycine max
  Coding DNA Sequence Number=SeqID_70803
  Gene Ontology: Mol. function=nucleic acid binding; Biological process= DNA integration
  Homolog annotation: Hit_ID=Q1T4S3; Match level="QueryCoverage=85%, HitCoverage=93%, E-value=1e-100, Identity=40%"; Hit description=Zinc finger, CCHC-type
  Pfam annotation: Domain name=zf-CCHC; Domain location=326-343; Score =6.7; E_value=0.077; Accession=PF00098.13; Description=Zinc knuckle
  Pfam module annotation: Pfam domain module=RVT_2::zf-CCHC; Domain location=576-780::326-343
MPSLPINAVPVTGGLVNSSFGVVNNFAYYVTAKLTDDNFLLWKQQIEPVLKVHHLQRVVVSLLIPPKYLIQEDADMNIDNHDLSVEVLKFLVISILGSQYCFSFFCSILHPTFAMLSLPINAVPMTGGLVNSSSGVVNNFAYHVMAKLTDDNFLLWKQQIEPVLKVHHLQRFVVSPLIPPMYITQEDADMDKENPAYATWEYQDQNTRKGECSIGEFLTRIKTIVDSLLAIGQPVSVQEQIDVILEGLPSEYGGGKDRVNMIEEIQSLPLAQEQRLEKGRGGRSGYGYRGDRNYGNNDNKNYGNNENKVFGNGDHRNYGNTDRYKIQCQVCYKFDHDAADCYHRFNPNYVAQQYNQNQSLNQHRNYSYQRSNCQALNNKSQSQQNAQAPQAYLANANPTQQSQNWYINYGATHHVTASPQNLMNEVPTSGNEQVFLGNGQGLPITGSTVDGSILLRGALSQDGLYVFSNLLNSSFKFTVGKAAANVHMSSLSDLSSHCNNLVPTEQAASSTPVNDESSHSTALSSHPPSQPPNTHPMQTRSKLGIVCPRLHPTLLLTTAESTSVKHALSSLEWKEAMQQEYSTLMANNTWSLVPLPSGRKAIGCKWAFRVKQNPGGSILKYKAWLVAKGFNQIPGQDYSETFSPVVKPYLEEEVYMTQPPGFAGSDKSMVCKLKKAIYGLKQAPRAWYERLSKTLLIFGFVQSKCDPSLLVFKTVFDCLYLLIYVDDITITGSSSVLIQKLITKLHAVFALKQLAKYIRDLLEKLRWLDAKPILTALPSDLKLTKHGTTKIVLVPVADAILYRTHGGTLEGCHAYFKVSEVYYRLWVVFKICSSRRTYTLEAFCDSDWRMDMVDRRSISGGCIFFGPNPVSWWSKKQTSVARSTIVAEYRSLTVTASELLCSILTKRTLLKSLLQLSTVIISALLP

SEQ ID NO: 187582 - protein, 74 aa, Glycine max
  Coding DNA Sequence Number=SeqID_70804
  Gene Ontology: Cellular component=membrane; Biological process =intracellular signaling cascade
  Homolog annotation: Hit_ID=Q2QQ55; Match level="QueryCoverage=54%, HitCoverage=27%, E-value=6e-08, Identity=60%"; Hit description =Cornichon protein, expressed
MTRYVKREHLIDVTEVFRVLNAEKKYRIAKLALYLTVLIVTIFRPSIRILAAGRVILYSSKFEELDIRLNPIGF

SEQ ID NO: 187583 - protein, 499 aa, Glycine max
  Coding DNA Sequence Number=SeqID_70805
  Homolog annotation: Hit_ID=Q9FM72; Match level="QueryCoverage=30%, HitCoverage=20%, E-value=1e-51, Identity=63%"; Hit description =Arabidopsis thaliana genomic DNA, chromosome 5, P1 clone:MDF20
MGEEEPANEVSKTDSNGKSLQEKTLDETTEKKDLETDGGKVLENNGIKENIVKEIEDKKADGVEKVEEDKKIVVVKEAKEDKKEDGVKEAKEDKIEEGVEEVKKDNKEDGVEEAKEDTKEYGVEEVKEDKKDGVEAVNEDKKQDRVEEVEEDKEVDGVKEVIEDKEVDDVKEVKEDKEIDGVKEVVEDKKGDELKEIEEDKKDDHISETDKMDEDTKVKETIEGKQENEKVQAEKPEVDAMEVEGGIQEEESDEKEKKDVAMEEDEDEDKDNIDKSKEEEKAEDSKGKKGSKKRGIGKIDGEKVKEKRTEPKKTEPRTPTIERPVRERKSVERLVASIDKDATKEFLIEKGRGTPLKNIPNVAFKLSRRKTEDTFKLLHTILFGRRGKAVEIKSNISRFSGFVWRDNEEKQRIKVKEKLDKCNKEKLLEFCDVLDITINKATSRKEDIIAKLIDFLVAPHATTTVLLAEKDKPSKGTKRKRVVKRGSSRSATTSRRSVK

SEQ ID NO: 187584 - protein, 308 aa, Glycine max
  Coding DNA Sequence Number=SeqID_70806
  Homolog annotation: Hit_ID=Q10H93; Match level="QueryCoverage=18%, HitCoverage=8%, E-value=5e-14, Identity=68%"; Hit description =Expressed protein
  Pfam annotation: Domain name=DEK_C; Domain location=227-280; Score =72.5; E_value=1.4e-18; Accession=PF08766.1; Description=DEK C terminal domain
RVKFPVQKENRSCSGIESQRGQTIHEISKRKGRSSVLERLRQLGFRDSGSEITGCGSSESQKKNEDSTVVRRKSASDTDESEEDKKDEENEENENGVADKSEDETPEKSESEDKSDSGSESEDIKEKKKHSKTSSTKKESAKKSKIEKIAVPNKSRSPPKRAPKKPSFNLSKSDEDSDESPKVFSRKKKNEKGGKQKTSTPTKSASEEKTEKVTRGKGKKKEKSRPSDNQLRDAICEILKEVDFNTATFTDILKKLAKQFDMDLTPRKASIKFMIQEELTKLADEANDDGEEDAEKDEAPSTGQEVEA

SEQ ID NO: 187585 - protein, 308 aa, Glycine max
  Coding DNA Sequence Number=SeqID_70807
  Homolog annotation: Hit_ID=Q9FM72; Match level="QueryCoverage=33%, HitCoverage=13%, E-value=9e-11, Identity=42%"; Hit description =Arabidopsis thaliana genomic DNA, chromosome 5, P1 clone:MDF20
  Pfam annotation: Domain name=DEK_C; Domain location=225-278; Score =68.6; E_value=2e-17; Accession=PF08766.1; Description=DEK C terminal domain
SQKKNEDSSVVRRKSTSDAEDESEEEERDEENEEENENGVPNKSEDETPEKSESEDKSDSGSESEDTKEKKKPSKTSSTKKESAKKSKIEKITVATKTRSPHKRTPKKASFNLSKSDDDSDESPNPKVFSRKKKNEKGGKQKTDDDSDESPNPKVFSRKKKNEKGGKQKIDDDSDESPNPKVFSRKKNEKGGKQKRSTPTKSTSKEKTEKVTKGKGKKKEKSSPSDNQLRDAICKILKEVDFNTATFTDILKQLAKQFDMDLTPKKASIKLMIQEELTKLADEADDEEDGEEDAEKDEAPSTGQEVKA

SEQ ID NO: 187586 - protein, 71 aa, Glycine max
  Coding DNA Sequence Number=SeqID_70808
MVKQIFHQVKTKQVKYTCQACNGYDLPISEFRTEFGKNLMVLTLEIEAARKSQGSSLQLQTCLRLQRDFTN

SEQ ID NO: 187587 - protein, 503 aa, Glycine max
  Coding DNA Sequence Number=SeqID_70809
  Gene Ontology: Mol. function=nucleic acid binding
  Homolog annotation: Hit_ID=Q9FM71; Match level="QueryCoverage=92%, HitCoverage=66%, E-value=4e-87, Identity=40%"; Hit description =Arabidopsis thaliana genomic DNA, chromosome 5, P1 clone:MDF20
  Pfam annotation: Domain name=RRM_1; Domain location=38-109; Score =84.3; E_value=3.6e-22; Accession=PF00076.12; Description=RNA recognition motif. (a.k.a. RRM, R
GWWNGVGNSVSAVSGVNTGGVGGGGGGGAAGGSGGTILFVGDLHWWTTDAELETELSKYGPVKEVKFFDEKASGKSKGYCQVEFFDPSAATACKEGMNGHVFNGRPCVVAFASPFTVKKMGEAQINRNQQMNPSAVPQGRRGPADAGAKPGGSNISTVGNYQGGEGNRGYGRGGGNWGRGNNPGMGNRGPVNPMRNRGGGMGGRGIMGHGGNGFGQGMGGTPPMLHPQSMMNQGFDPAFGGPMGRMGGYGGFPGAPTPPFSGILPSFPGVGGVGLPGVAPHVNPAFFGRGMPVNGMGMMPGSGMDGPNMGMWSDPNMGGWGGEEPGGGKAGESSYGEEAASDHQYGEVSHDRAGWPMREKDRGSERDWSGTSERRYRDDRDQGYERDAPKEEDMGHDHEWSERRHRDDRETGRERSRDRDRERSRDRDRDRERDHRERDRHREDRDKYADHHRYRDREAEHDDEWERGRSSRMHSKSRLSQEEEHHSRPRDADYGKRRRLTSE

SEQ ID NO: 187588 - protein, 107 aa, Glycine max
  Coding DNA Sequence Number=SeqID_70810
MSSSLNLPLRFVFEFAQAPRVPVLDIVLAPGWWVREFVSWWVRKFLSWWVRELIYVGASLVLNIGTLPWCCFKSRNLAGIAFDSCYNYINSIAFTPSPINYVIKGSP

SEQ ID NO: 187589 - protein, 65 aa, Glycine max
  Coding DNA Sequence Number=SeqID_70811
  Homolog annotation: Hit_ID=Q1S453; Match level="QueryCoverage=84%, HitCoverage=4%, E-value=1e-10, Identity=60%"; Hit description =CMP/dCMP deaminase, zinc-binding; Bacterial bifunctional deaminase- reductase, C-terminal
MAVAKLHFEVCGGTTAKFVDGVDDLDLCSSGALGVEVALTEDFVEGGDDDIAKVGGGGRCHFSNI

SEQ ID NO: 187590 - protein, 221 aa, Glycine max
  Coding DNA Sequence Number=SeqID_70812
MGIFLAIEEHTRLPWNKFLNKSHISLLYAAFTFSHACTPFFVSLLTANPNLKKLKERDPKMDEAEGGYGESGDPMDQFHRNEAISAVADDGFLGEEEDDDYEDLYNDVNVGEGFLQSLRKNDDSGFRNDDVEEKKPPPPPPAVPDATGVSIPGDGGGGEGVGGGGSGVVESRVSGSVDGFQNQGFRGNDVGSKGGIRVELGNQSRNLSEIEDQDGNDGDVV

SEQ ID NO: 187591 - protein, 202 aa, Glycine max
  Coding DNA Sequence Number=SeqID_70813
  Gene Ontology: Mol. function=nucleic acid binding; Cellular component= oxygen evolving complex; Biological process=DNA integration
  Homolog annotation: Hit_ID=Q1T010; Match level="QueryCoverage=63%, HitCoverage=11%, E-value=7e-30, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MPLVPTDCIILPNKKIEISKDVVIDDKGNREELNETEENTTPQGVQFPKLPPNKKAIDVKWVFKLKLNLGGSIARHKVKNEFEMIDLGKLAYFLGMEFVTVPSGIILDQKKYAMDVLKRFNMNDCKPSITLVEVGLKLDNTSEDDELVDPTLFKFMVEPRKSHFMVANKILRYLKGTMKYGMLFPSESNQGEAELVGYTDVD

SEQ ID NO: 187592 - protein, 104 aa, Glycine max
  Coding DNA Sequence Number=SeqID_70814
  Gene Ontology: Mol. function=nucleic acid binding
  Homolog annotation: Hit_ID=Q1T010; Match level="QueryCoverage=92%, HitCoverage=9%, E-value=5e-14, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGYIGKMLHWWRQDLKGVASIVAKMRGCSEQITDVIIMENIMFMVTQSINHIIVAIEESKEVENMKIEELQGSLEAQALKLIQRNQAKVVDQALQAQVKEGLER

SEQ ID NO: 187593 - protein, 153 aa, Glycine max
  Coding DNA Sequence Number=SeqID_70815
MDNKGSKLGVESPGRTGAATEGRADEDGADALLISYEKVKNINNNLDISKGEIKSALRKSKERREEESKHKFYTGSATTRAYIQSLSNLLRFPFLVKILYKQRATKDVPSPVLFEQPSRCTLYLKRTTKDVPSLVFTITTKKLPASYTKFSNG

SEQ ID NO: 187594 - protein, 83 aa, Glycine max
  Coding DNA Sequence Number=SeqID_70816
MSVEEFIQTVAWPGVQPSPSGEVIAQEDVVSPEPFPQSEPSPSPSPEPEPSATAPMLDQSTSQDPPSAPMFDLNEHAQDHSQD

SEQ ID NO: 187595 - protein, 693 aa, Glycine max
  Coding DNA Sequence Number=SeqID_70817
  Gene Ontology: Mol. function=nucleic acid binding
  Homolog annotation: Hit_ID=Q9FM71; Match level="QueryCoverage=99%, HitCoverage=100%, E-value=2e-84, Identity=40%"; Hit description =Arabidopsis thaliana genomic DNA, chromosome 5, P1 clone:MDF20
  Pfam annotation: Domain name=RRM_1; Domain location=228-299; Score =64.9; E_value=2.7e-16; Accession=PF00076.12; Description=RNA recognition motif. (a.k.a. RRM, R
MDEGEGGDPMDQFHRNEAISAVADDGFLGEEDDDYEDLYNDVNVGEGFLQSLRKNEDSGFRNDVVEDKKPLQQPDQDPVVGVSIPGVGGGGGSGVVEGRVSGNVDGLQNQGFRGGNSGGGGGSGGLKVELGQPSGKLSEIEEQGGNDGTDVQGIGQQPHGGVVGSVGNEGLVRQGQGGGGGAGNVNRVGGNGVGNSVSTVNSVNTGGGGGVVVVGGGAPPGGGGGTILFVGDLHWWTTDAELEAELSKYGSVKEVKFFDEKASGKSKGYCQVEFYEAFAATACKEGMNGHVFNGRHCVVAFASPFTVKKMGEAQINRNQQMNQTAVPQGRRGPADAGAKPGGSNISTGGNYQGGDGNRSYGRGGGGNWGRGNNPGMWNRGPINPMRNRGGGMGGRGIMGNGGNGFGQGMGATPPLLHPQSMMNQGFDPAFGPMGRMGSYGGFPGAPTPPFSGILPSFPGVGGVGLPGVAPHVNPAFFGRGMPVNGMGMMPGSGMDGPNMGMWSDPNMGGWGGEEPGGGKAGESSYGEEAASDHQYGEVSHDRAGWPMREKDRGSERDWSGTSERRYRDDRDQGYDRDAPKEKDMGHDHEWSERRHRDDRETGRERSRDRDRERSRDRDRDRERDYRERDRHKEDRDRYADHHRYRDREAEHDDEWERGRSSKPHSKSQLSQEEEHHSRPRDADYGKRRRLTSE

SEQ ID NO: 187596 - protein, 119 aa, Glycine max
  Coding DNA Sequence Number=SeqID_70818
  Gene Ontology: Mol. function=catalytic activity; Cellular component =peroxisome; Biological process=metabolic process
  Homolog annotation: Hit_ID=Q84K86; Match level="QueryCoverage=79%, HitCoverage=17%, E-value=7e-30, Identity=70%"; Hit description=4 -coumarate:CoA ligase-like
MYKPKLVVFFGHMQVAPAELEAILLSHSSVEDAAVVPLPDEETGEIPAASVILSPGAKESEEDIMNYVASNAAHYKKVRVVHFVDAIPKSPSGKIMRRLVKEKMVEKMKTKSLTKSKNI

SEQ ID NO: 187597 - protein, 130 aa, Glycine max
  Coding DNA Sequence Number=SeqID_70819
MTQKIKDQLEESITEKDVRMKAQAIQKQNTTPHVLSREGYELLEKKLIYEKKKKQLEEVAKFGSTNTLIDPPSSIRRHVKWKMARTKKTYQMTCEATKEIGDKINSLEEQVSQGSFVSYGCQDVLTTAIG

SEQ ID NO: 187598 - protein, 161 aa, Glycine max
  Coding DNA Sequence Number=SeqID_70820
  Gene Ontology: Mol. function=drug transporter activity; Cellular component=membrane; Biological process=multidrug transport
  Homolog annotation: Hit_ID=Q1SCN3; Match level="QueryCoverage=99%, HitCoverage=68%, E-value=7e-33, Identity=51%"; Hit description=MatE, putative
AIIASAFARDDYKKVIASASRVLQLGLILGLVLSVLLLSLLPFASRLFTNDINVLQLISIGIPYVAATQPINALAFVFDGVNYGASDFTYSAYSMFISPSWHMHLLLLPDYGSIGEHIEFIYAVLKPWLYRYLDCVVDLHDSKDICRLLEDWYWIRALELP

SEQ ID NO: 187599 - protein, 71 aa, Glycine max
  Coding DNA Sequence Number=SeqID_70821
MAGDVACFNIKANIIIRQSETGNLVNDKPEWKSQVKFNCNRFQTTKDVNPSILSISDDVCLLKNDKGISRS

SEQ ID NO: 187600 - protein, 61 aa, Glycine max
  Coding DNA Sequence Number=SeqID_70822
MAAFQICLQIWMATSLLADGLAVAAQMCAAVILQATSKINTISASMEYGIMSSMNLGKETK

SEQ ID NO: 187601 - protein, 192 aa, Glycine max
  Coding DNA Sequence Number=SeqID_70823
  Gene Ontology: Mol. function=drug transporter activity; Cellular component=membrane; Biological process=multidrug transport
  Homolog annotation: Hit_ID=Q8S6Q1; Match level="QueryCoverage=89%, HitCoverage=32%, E-value=6e-39, Identity=51%"; Hit description =Putative membrane protein
MLNISHELLDLLCPVELAAVGVSIAIFNQISKITIIPLVSVTTSLVAEEDAVDEQNQQSEREMLMKVSNEDVKLDVHDHAEKAGNSSSANVGRVAKLDHDKSYIPSASSGIVIGGLLGVLQALFLIFTAKPMLSYMGVDSNSPMFKPAQQYLTLRSFGAPAVIISMAIQGVFRGIKDTKTPLYATVESLLKE

SEQ ID NO: 187602 - protein, 123 aa, Glycine max
  Coding DNA Sequence Number=SeqID_70824
  Subcellular localization annotation: CTP_CleavageSite=40; ConfidenceScore=5.36e-01
MNMDYRMKMHRGTSSTTVVNAPVVILLTFLRRAFISLTLKCSRTKTGETSTPTLKYSKTTTGEIYPDIEMKKYNNGFYGYPTLKWIQTTTGSSIKCVVQSFYIMTILKCSLMLSSHITKTTLG

SEQ ID NO: 187603 - protein, 99 aa, Glycine max
  Coding DNA Sequence Number=SeqID_70825
MYAFLESQSLVVSKDRRSECQQYLERWLKESDREVYVGPYFHHVMTKLKTSLSPESKAAAPKWIEVKWFADATSLDIDNITTIQNKWARYFLKAACKKG

SEQ ID NO: 187604 - protein, 61 aa, Glycine max
  Coding DNA Sequence Number=SeqID_70826
MAKLMTYPKCPSQEILGLMFHSLHWPNQLKRLIVLMESKCCASQAIGLLDKDYSNLNKWTK

SEQ ID NO: 187605 - protein, 57 aa, Glycine max
  Coding DNA Sequence Number=SeqID_70827
MTIPLWPLNATDVPRSGIGVCRSLCRLAGSHWNPLQWCPSWTSSWGASLQPILGCLL

SEQ ID NO: 187606 - protein, 59 aa, Glycine max
  Coding DNA Sequence Number=SeqID_70828
MTKILSSTFVLGNIDKGFEEKLKPEDSCLACQTHLASSSRLARRSPYSMKKLLREPEVR

SEQ ID NO: 187607 - protein, 355 aa, Glycine max
  Coding DNA Sequence Number=SeqID_70829
  Gene Ontology: Mol. function=zinc ion binding; Cellular component =cellular_component; Biological process=protein modification process
  Homolog annotation: Hit_ID=Q9FN44; Match level="QueryCoverage=97%, HitCoverage=63%, E-value=1e-150, Identity=53%"; Hit description =Genomic DNA, chromosome 5, P1 clone:MYJ24
MPSSPESIFLEDFGQTVDLTRRIREVLLNYPEGTTVLKELIQNADDAGATTVSLCLDRRSHPAGSLLSDSLAQWQGPALLAFNDAVFTEEDFVSISKIGGSTKHGQASKTGRFGVGFNSVYHLTDLPSFVSHKYVVLFDPQGVYLPRVSAANPGKRIDFTGSSAFSFYRDQFSPYCAFGCDMQSPFSGTLFRFPLRNADQAAKSKLSRQAYSPEDISSMFVQLFEEGVLTLLFLKSVLCIEMYLWDAGEPEPKKIHSCSVSSVTDDTVWHRQSLLRLSKSLNTIAEVDAFPLDFLIERISGDEAERQTERFYVVQTMASTSSRIGSFASTASKEYDIHLLPWASVAACISDNFLN

SEQ ID NO: 187608 - protein, 119 aa, Glycine max
  Coding DNA Sequence Number=SeqID_70830
MRNGEEKHIKSVVHKTELLICVALSDTVWPRALSSLCSGTTRFRNGVKRKMSLGLEAIVMSSVETAQGVLQIHDQYHERGTDTVEWAMAELIHNPNIMSKAKAELAKTPLLASNSERDF

SEQ ID NO: 187609 - protein, 485 aa, Glycine max
  Coding DNA Sequence Number=SeqID_70831
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9XF22; Match level="QueryCoverage=97%, HitCoverage=98%, E-value=1e-164, Identity=59%"; Hit description =Cellulase homolog
  Pfam annotation: Domain name=Glyco_hydro_9; Domain location=28-484; Score=798.7; E_value=3.3e-237; Accession=PF00759.9; Description =Glycosyl hydrolase family 9
MTLSSVVFIFIVLLCCSSQIQNVASAADYREALTKSLLYFEGQRSGKLPPNQRLKWRGDSGLQDGHDAGINLVGGYYDAGDNLKLGFPLAFTITMLSWSTIEFKDQLSQQNELQNALNAIKWGTDYLMKAHPQPDVLYGEVGDPNTDHSCWQRPEDMTTPRGSLRIDDQHPGSDLAAETAAALAAASIAFRSVNKKYASSMLLHATQLFDFANNHQGMYSDSITPAKQIYSSSGYKDELLWAAAWLQRATKMQKYLDYLGGAGDTGGVRTVFSWDDKYVGAHVLAAKLVLDGEVGASGIWAQYKSQAEEYICSCAQKSNQNTDKTAGGLLWFLPWNNNQYVATATFVMSVYSNYLSSKGASLQCSAGNVTPDDLTSLVRSQVDYILGSNPKGISYMVGYGPNFPQQIHHRGASIVSININHNPVSCQGGFQEWFYKNAPNPNVLEGAVVSPDRNDNYEDSRNNYQLAEPATVTLAPLVGVLAHLA

SEQ ID NO: 187610 - protein, 193 aa, Glycine max
  Coding DNA Sequence Number=SeqID_70832
  Gene Ontology: Mol. function=RNA-directed DNA polymerase activity; Biological process=RNA-dependent DNA replication
  Homolog annotation: Hit_ID=Q1SUI8; Match level="QueryCoverage=86%, HitCoverage=63%, E-value=1e-13, Identity=28%"; Hit description=Beta tubulin
MWVNVVPLKIFSIWQAAQDRIPSLQNLVYRKVLREEDVICKICEDATEDTTHILMECKKSWNAWSRVLDWWVLSASLHTDEHNFFQFRGLIDQSIKQRWHWCLVWYAVLWIIWKSRNDLIFSESERGLKEMLEKIQVALTWEWNKAAGMHWVHLTVLSTFGHEEVWKWLQVLLEEDDQTIGFILFEAVMKKNE

SEQ ID NO: 187611 - protein, 328 aa, Glycine max
  Coding DNA Sequence Number=SeqID_70833
  Gene Ontology: Mol. function=binding; Cellular component =mitochondrial inner membrane; Biological process=transport
  Homolog annotation: Hit_ID=Q01GI9; Match level="QueryCoverage=80%, HitCoverage=31%, E-value=4e-32, Identity=34%"; Hit description=[C] KOG0764 Mitochondrial FAD carrier protein
  Pfam annotation: Domain name=Mito_carr; Domain location=105-189; Score=31.2; E_value=3.7e-06; Accession=PF00153.17; Description =Mitochondrial carrier protein
  Pfam annotation: Domain name=Mito_carr; Domain location=203-301; Score=37.8; E_value=3.7e-08; Accession=PF00153.17; Description =Mitochondrial carrier protein
  Pfam annotation: Domain name=Mito_carr; Domain location=6-99; Score =58.4; E_value=2.4e-14; Accession=PF00153.17; Description =Mitochondrial carrier protein
  Pfam module annotation: Pfam domain module=Mito_carr::Mito_carr::Mito_ carr; Domain location=105-189::203-301::6-99
MNVDLESLAEATSGAIGSLISTTILYPLDTCKTKYQAEARSSGRIKYRNLTDVLLEAISNRQVLSLYQGLGTKNLQSFISQFVYFYGYSYFKRLYLEKSGYKSIGTKANLVIAAAAGACTAIATQPLDTASSRMQTSEFGKSKGLLKTLTEGTWSDAFDGLGISLLLTSNPAIQYTVFDQLKQRALKNKQNNADKGTSPASLSAFMAFLLGAISKSIATCLTYPAIRCKVIIQAADSAEPTSKTMIKSQKTVSSVLYGIWKREGLLGYFKGLHAQILKTVLSSALLLMIKEKISATTWVLILALKSYWRKKLQFVADNECGWSAKCAL

SEQ ID NO: 187612 - protein, 124 aa, Glycine max
  Coding DNA Sequence Number=SeqID_70834
MVWGVGNEVVGKAEPRLGLGLAEQVLVAVEDDCPRVSLLGGTPTLQLGPEVSPETKQLSKNGGGRPMVQFASSSNLERRRKHGGDPSQKVVNLLSEGIHGFTKEGLMVREAKQSLIKLIRGTHG

SEQ ID NO: 187613 - protein, 543 aa, Glycine max
  Coding DNA Sequence Number=SeqID_70835
  Gene Ontology: Mol. function=RNA-directed DNA polymerase activity; Cellular component=chromatin; Biological process=chromatin assembly or disassembly
MGQLSGHPVVVLVDGGSTHNFIQQELVTLLHLPYQPTPSPLRVMMGNDQNLQCTSFCEAIILDIQSTPFTQPNTLPTERETNHHIHLLPHSAPVNVWPYRYPHFQKCEIETQMLQKGLIQPSTSPFSSPVLLVKKNDDTWHFCVDYHALNAITIRDRFPIPTIDELLDELGGARCFSKLDLLQGYHQIRMHSDDIPKTAFRTHHGHYKFRVMPFGLCNAPSSFQAMMNAIFRPYLRQFIIVFFDDILIYSPCFADHLLHLELAFQVLSAHHFVLKLTKCFFAQDQVEYLGHLVSYRGVEPLASKVAAIHNWPIPWTTRAVQSFLGLAGFYRCFIRGYASSAAPLVHITTMNQFAWSPLAQNAFDQLKQALSHAPVLALPDLTMSFTVEMDVSGIGMGPFPPKLLRASAYVHELFAITAAVKKWRQYLLDHRFTIITDHRSLKELLTQVIQTPEQHIYLARLMGYDYQIQYRSGAHNQAVDALSQCFDQDSTLLSLSMPCPLFMTELYNQLDAHQEYNQLQQEILKNLEKHAGLSLAQKLILRK

SEQ ID NO: 187614 - protein, 178 aa, Glycine max
  Coding DNA Sequence Number=SeqID_70836
  Gene Ontology: Mol. function=transferase activity
  Homolog annotation: Hit_ID=Q1SPY9; Match level="QueryCoverage=96%, HitCoverage=23%, E-value=7e-53, Identity=61%"; Hit description =Ankyrin
  Pfam annotation: Domain name=Ank; Domain location=127-160; Score=4.1; E_value=8; Accession=PF00023.20; Description=Ankyrin repeat
  Pfam annotation: Domain name=Ank; Domain location=45-75; Score=1.4; E_ value=20; Accession=PF00023.20; Description=Ankyrin repeat
  Pfam annotation: Domain name=Ank; Domain location=90-126; Score=22.6; E_value=0.0014; Accession=PF00023.20; Description=Ankyrin repeat
  Pfam module annotation: Pfam domain module=Ank::Ank::Ank; Domain location=127-160::45-75::90-126
ELPYDSSADEVADSLAEYTLEGKWEKVIKMYNEVEVCHTAMINESMGTALHVAVDLDEEGVVEELVKAIIRHRQGEQSVKIKALEMENDHGDTPLHVAASRGFAKICKLIIGTNNERMYLVSRKNKHGETPLFQAAINWKKQAFAYLSHISNHSATLQDLERGNGDTILHCAIRREYF

SEQ ID NO: 187615 - protein, 144 aa, Glycine max
  Coding DNA Sequence Number=SeqID_70837
MEIVGKIHGLPRSLVSDRDPLFVNKFCLLKVILNKDPKLLCPNASLSTNLSSPLWPSLIIAEHKSKLPGKFWCNGRDYHLEDKVSFQGPTTDTKTEASTSKKEVKIATTDQEHETRVQSQNTWVQSVGKPKRFITRPSYLNDYI

SEQ ID NO: 187616 - protein, 133 aa, Glycine max
  Coding DNA Sequence Number=SeqID_70838
MTTLDDFKLLIVEPCNADERVFMRAVKGREVMKGYDYKNLNSLVVNDQMEVGKTKKRKCAKDSSKSDLMKKSTKSVKGPIKGNNAKVEVTHLDEPEVVDKGLEENKVVEGDAESLEKKMRGKKAEKEREMELA

SEQ ID NO: 187617 - protein, 64 aa, Glycine max
  Coding DNA Sequence Number=SeqID_70839
WGLVHSKLEAQWSLHIQYNGPRERKHNIYYFEFGAGKAGQKYWHRERPGKKLQQKILVARVVVA

SEQ ID NO: 187618 - protein, 150 aa, Glycine max
  Coding DNA Sequence Number=SeqID_70840
MNNGHQITHKRSGSNTMEQPTQYESNNTEADIFFVDGLADFRADLKIYESIIINFFACDDNTIFYLHFTPPLNQQTCGRPILHSRQHIWTTEITQCILGAPQPLEIPSHARKYLKECDNHLTILRKNAPPLQWDVVTLDRGIKDKSIIRP

SEQ ID NO: 187619 - protein, 55 aa, Glycine max
  Coding DNA Sequence Number=SeqID_70841
MAMIQSSSVRASSLVLDSIPDTRAHEARSLNEDRILTLPGLENTTQVQMEHVSSL

SEQ ID NO: 187620 - protein, 41 aa, Glycine max
  Coding DNA Sequence Number=SeqID_70842
MEERVPTSMCSREVHMQSPSDISECALSRKVQAKLQMRTKP

SEQ ID NO: 187621 - protein, 81 aa, Glycine max
  Coding DNA Sequence Number=SeqID_70843
MSIEYLPSKIYFFCKDEGTHDGYDNHHQRAESSKEILLVNNMQEILLVNNTSFVHLTAAVARCNAVEGGKDNILLQLYEIE

SEQ ID NO: 187622 - protein, 73 aa, Glycine max
  Coding DNA Sequence Number=SeqID_70844
MVWTDVLYRTMFLCSMMSPGLLNPDVSCMFSLILAKRHPQIPLVGLNLTKAALRHTYQQLGYRTPIPRENTIN

SEQ ID NO: 187623 - protein, 211 aa, Glycine max
  Coding DNA Sequence Number=SeqID_70845
MAFLGETSSQTIVNSWLAFIFPNGVVIHNECGVYFQSSTPVPMRVPNLCDFSTLKSIIHNTLQLNNNQVVDEIHYRRSLEDTGNNIHFQCMQLKHDMDVKTMLMCNDQFSCVGPIELLCTIGRTPDAILNLLQCPSILTHDAVLYYNGRWNMPRQNNFMGYTFTGINPQKFDIPKGCTIDELKDLIKQVAPKGNPPHGIHESQLVRRLFYR

SEQ ID NO: 187624 - protein, 134 aa, Glycine max
  Coding DNA Sequence Number=SeqID_70846
MTGKRKVLGKNNEKTRSYFTWNLEMEHVLADVLRDQRNLGNKGDGGWKRSALNAAAVLSTSFNINVTSDNAKNRIKLWRSWYGISHKSAKPFRFKVLQNWDDIVDLYAKDRAIGHEAETAIDVIHEDFDDVKKN

SEQ ID NO: 187625 - protein, 307 aa, Glycine max
  Coding DNA Sequence Number=SeqID_70847
  Gene Ontology: Mol. function=microtubule motor activity; Cellular component=microtubule associated complex; Biological process =microtubule-based movement
  Homolog annotation: Hit_ID=P46864; Match level="QueryCoverage=51%, HitCoverage=26%, E-value=2e-23, Identity=37%"; Hit description =Kinesin-2
  Pfam annotation: Domain name=Kinesin; Domain location=124-285; Score=- 198.2; E_value=0.063; Accession=PF00225.13; Description=Kinesin motor domain
MSRNFTDCLTMGVKYLEVIKRGSHPNKQMSSQEEAIKQKDVLATEVSSLRGELQQERDERDRQLSQVQTLSSELEKVKESRKHSYTELDSLTLKANDLEALEEQLATAEKKLQELKGNIRVFCRVRPLLADESCSTEGKIFSYPTSMETSGRVIDLAQNGISVVIMPKKSFTFDKVFTPEASQEEVFTTTKSGFNIASMLSSSSNLRLAKPSLCASEHRVRRTRASSQVSASSPSPPYLGMFRLLRVVLSFSLSSSPSKLSCSLCSPSTLKLYVLHLTIILSKVEHRVRRTRASSEVCASSPSPPHV

SEQ ID NO: 187626 - protein, 180 aa, Glycine max
  Coding DNA Sequence Number=SeqID_70848
  Homolog annotation: Hit_ID=Q1SMI5; Match level="QueryCoverage=59%, HitCoverage=5%, E-value=2e-10, Identity=43%"; Hit description =Prefoldin; tRNA-binding arm; t-snare; Protein kinase PKN/PRK1, effector
MIKRNNYDLVGVSSKKIASGFGNEVYKNGTRGWKYECFEVERDNDSYDSIDDESNENSSETESFPAPRYQTFDITRLTDSTLFLGVVSPELSGPPFMYYVVPLVKSLVNNECTENGRQPDEDQTVMAPDAVSYFQDMQRRINAIARTVKQLNESLKPKNEENIQASKHVTQPDQARPSIP

SEQ ID NO: 187627 - protein, 706 aa, Glycine max
  Coding DNA Sequence Number=SeqID_70849
  Gene Ontology: Mol. function=cellulose synthase (UDP-forming) activity; Cellular component=membrane; Biological process=cellulose biosynthetic process
  Homolog annotation: Hit_ID=Q8VZK9; Match level="QueryCoverage=90%, HitCoverage=85%, E-value=0.0, Identity=58%"; Hit description =Putative cellulose synthase catalytic subunit
  Pfam annotation: Domain name=Cellulose_synt; Domain location=1-706; Score=210.2; E_value=4.8e-60; Accession=PF03552.5; Description =Cellulose synthase
MAKQLKLCRPEIYQSKYGERNKGGAEIATMGINQTHVQNKKQKALSKPIIGEIFSVIYKYEEILPRVDIFVCTADPGIEPAVMVMNTVLSVMAYDYPTEKLSVYLSDDAASDITFYALLEASLFAKHWLPFCKKFKVEPTSPAAYFKSIASCTHPNNHVNELVPIKKLYQDMESRIENAAKVGQVPEEVRPKYKGFSQWDSYTSRRDHDTILQILLHGKDSSAKDVDGNVMPILVYLAREKRPQVAHNFKAGAMNSLLRVSSMISNGEIILNVDCDMYSNNSQSLRDALCFFMDEVKGHEIAFVQTPQCFENVTNNDLYGGALRVIYEVEFHGLDGLGGPFYIGTGCFHRREILCGRKFNDQYKNDWKEYKNIDHMKEGSLHELEEKSKALASCTYEENTLWGKKMGLQYGCAVEDVITGLSIKCRGWKSVYYNPQRRAFLGVAPTTLPEALVQHKRWSEGGFQIVLSKYSPAWYAYGLISPGLQMGYCYYNLWVLLSWPTLYYCIIPSLYLLKGIPLFPQMSSPWFIPFAYVILGDSSYCLLEFLWSGGTIQGWWNDTRMWLYKRISSYLFAFFDIILKFFGFSESAFVISAKVAEENVSQRYEKEVMEFGNSSPMLTLLATLALLNLFCLLGMLLKQVFISEGGLRIYETMALQVLLSGVLVLINVPVYQGLYLRKDKGRLPISVAVKSTTLALSACVLFIAIS

SEQ ID NO: 187628 - protein, 112 aa, Glycine max
  Coding DNA Sequence Number=SeqID_70850
  Homolog annotation: Hit_ID=O22633; Match level="QueryCoverage=61%, HitCoverage=87%, E-value=9e-20, Identity=66%"; Hit description=NOI protein
  Pfam annotation: Domain name=NOI; Domain location=33-106; Score=99.8; E_value=7.9e-27; Accession=PF05627.2; Description=Nitrate-induced NOI protein
MVTEYTSCYSFLTSRTNPTFSKRCKRVYTIDLKPLGEKGRPLPKFGEWDVNDPASAEGFTVIFNKARDEKKTGGNPESPGKTATDPHSKPAVEPGKTQTEPGLLPVLPCLAL

SEQ ID NO: 187629 - protein, 243 aa, Glycine max
  Coding DNA Sequence Number=SeqID_70851
  Gene Ontology: Cellular component=integral to membrane; Biological process=transport
  Homolog annotation: Hit_ID=Q6YZD2; Match level="QueryCoverage=74%, HitCoverage=85%, E-value=9e-68, Identity=66%"; Hit description =Coated vesicle membrane protein-like
  Pfam annotation: Domain name=EMP24_GP25L; Domain location=85-147; Score=32.3; E_value=1.7e-06; Accession=PF01105.14; Description =emp24gp25Lp24 family
MMMENGTILKNFNSILLTCVLLNVSISEEMKLGLSNFATAVVIFSSLDAVLGIRFVIDKEDFFSHNVQYEGDRVHASFVVIKVDTSWQHTHEGVDLSVKGPSGEPIKDFHDMTSEIFEFVARNSGPYRFCFINKSPYHETVDFDVHSNHIHFTDQHAKDEHLTPLLDQIVKLEQALFNIQYEQHWLEAQTERQAIASNAMSSRAIHKALLESMTLMGASALQVYLLRRLFERKPAYRVQVPER

SEQ ID NO: 187630 - protein, 64 aa, Glycine max
  Coding DNA Sequence Number=SeqID_70852
MGLTEWRNGIRRTSLRVPRERNTVPLDLASHVTWGGGYAWGRVRGKVTERQWCCHRKPPLKRCN

SEQ ID NO: 187631 - protein, 558 aa, Glycine max
  Coding DNA Sequence Number=SeqID_70853
  Gene Ontology: Mol. function=poly(A)-specific ribonuclease activity; Cellular component=nucleus; Biological process=mRNA catabolic process, nonsense-mediated decay
  Homolog annotation: Hit_ID=Q9LG26; Match level="QueryCoverage=91%, HitCoverage=73%, E-value=1e-143, Identity=51%"; Hit description =Poly(A)-specific ribonuclease PARN
  Pfam annotation: Domain name=CAF1; Domain location=38-306; Score= -35.5; E_value=1e-06; Accession=PF04857.10; Description=CAF1 family ribonuclease
MSGISYLSREQEREALRSLNSTYDSSEWSDIGKLKNVRDIPLLSTADILFTARMKNKFGEWRDGLFQEQNQEDQIQGISKDSKFQVTFFEMHPALRLNGFTSHQLKLIQLVIRKHFKDLSYVSVNSETSGSQQLVVYTDSKDELNLLLKKVKEENHRAEEKKIQAAVGFRHVIDLLSSEQKLIVGYNCFLDIAHVYSKFIGPLPGSPDEFVASVNKCFPHIVDTIILLNTNLMFQEKMKRSRKSLASAFTLFCPQIAAGSRSTDLGSLSHVKVDVEVDGSRSCSWNPGGKHEAGYDAFMTGCIFAQLCSDLGIDFKLRDSSNQLALNEKLQKYVNRLYLSWIHGDIIDLNTGNKVADSSPSHSLKKRYPTILFENIVIIWGFPSKLKANEVRECISKAFGPTSVVSVFHLDATAAFVQFSKTELVSDFLLVKDSLERSDGAISVLHPLSKLLEGGNTCAANYDTYNEICGSPLSEGLFADQAKKVGIKWKTKLTECKVASRGEEHENPSLQANDVNTAMKNVEKTKPNTIDQLGNASSRGQVSTFEIEDSSRVAEANL

SEQ ID NO: 187632 - protein, 546 aa, Glycine max
  Coding DNA Sequence Number=SeqID_70854
  Gene Ontology: Mol. function=cellulose synthase (UDP-forming) activity; Cellular component=membrane; Biological process=cellulose biosynthetic process
  Homolog annotation: Hit_ID=Q8VZK9; Match level="QueryCoverage=99%, HitCoverage=71%, E-value=1e-170, Identity=53%"; Hit description =Putative cellulose synthase catalytic subunit
  Pfam annotation: Domain name=Cellulose_synt; Domain location=1-546; Score=-144.8; E_value=6.6e-05; Accession=PF03552.5; Description =Cellulose synthase
MEKRIEDATKFGEVAKEARLKHMGFSQWDSYSSRRDHDTILQILLHKNDHNNSKDVDGFVLPALVYLAREKRPQYFHNFKAGAMNSLLRVSSNISNGKIILNVDCDMYSNNSQSVRDALCFFMDEEKGQEIAYVQFPQTFENATKNDLYGGSLTSILEVEFPGLDGYGGPLYAGTGCFHKRESLCGMKFSDQYCNDWNSEDDQFKEANLQELEQQSKVLASCNYEENTLWGKEMGLKYGCPVEDVITGLSIQCQGWKSVYYNPPRKAFLGLAPTTLPQTLVQHKRWSEGDLQILLSKYSPAWYGFGRINFGLQMGYSVYCLWAPNCLATLYYSIIPSLYLLKGIPLFPKEKEKVEKGSSIKWNISSPWFIPFAYVIVGETTYSLLEFFFCGGTFQGWWNDQRIWLYKRTSSYLFACIDTILKLFGFSESTFTITTKVTEEDASKRHEKEIMEFGTSSPMLTVLATLALLNLFCFLSVLKDAILGEGDIGAYETMGLQVLLCGFLVFINLPIYQGLFLRKDNGRLPSSIAIKSIVFALGVFISFIFT

SEQ ID NO: 187633 - protein, 115 aa, Glycine max
  Coding DNA Sequence Number=SeqID_70855
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=73%, HitCoverage=11%, E-value=3e-19, Identity=47%"; Hit description =Cellulose synthase-like protein CslE
MAEEESYPLFETRRAKGRVIYTIFSLSLFVGILFIWVYRVSHIPREGEDGKWAWIGLLCAELWFGLYWLLRHPFRWNPVFREPFRHKLSQRYHTHHHHHHHGITLLIIVEIHSLV

SEQ ID NO: 187634 - protein, 646 aa, Glycine max
  Coding DNA Sequence Number=SeqID_70856
  Gene Ontology: Mol. function=nucleotide binding; Cellular component =endoplasmic reticulum; Biological process=response to unfolded protein
  Homolog annotation: Hit_ID=Q6ZFX8; Match level="QueryCoverage=89%, HitCoverage=58%, E-value=0.0, Identity=63%"; Hit description =Putative growth regulator
  Pfam annotation: Domain name=HSP70; Domain location=2-439; Score= -289.9; E_value=4.9e-05; Accession=PF00012.10; Description=Hsp70 protein
MWTHKHDSACVSTSTLKDSAAYWLIDRIGWSTITREKFEELCEDIWEKSLLPVKEVLEHSGLSLEQIYAVELIGGATRVPKLQAKLQEFLGRKELDRHLDADEAIVLGAALHAANLSDGIKLNRKLGMVDGSLYGFVVELNGPDLLKDESSRQILVPRMKKVPSKMFRSVNHNKDFEVSLAYESDNYLPPGVTSPEIAQYQISGLTDASQKYSSRNLSSPIKANIHFSLSRSGILSLDRADAVIEITEWVEVPRKNLTIENSTISSNVSAESAAGNSTEENNESVQTDSGVNKASNISAEEQAATEPATEKKLKRQTFRVPLKIVEKITGFGMSLSQDFLAEAKRKLQVLDQKDADRKRTAELKNNLEGYIYTTKEKIETLEEFEKVSTSEERQSFIEKLDQVQDWLYTDGEDANATEFQEHLDQLKAVGDPIFFRLKELTTRPAAVEHAHKYIDELKQQERGERRAREATEMGKGREGDERGEKEKSERGNRDGKDCSRVESKEALASTRKSRRAGVTFRKIIVFWYLTCKVIKSSEKLKNWLDEKEAEQKKTSGFSKPAFTSEEVYLKVLDLQTKVASINRIPKPKPKVQKPVKNETESSSAQNTETSDSNSADSSSSSDSSANSSEGTSKETVTEQSEGHDEL

SEQ ID NO: 187635 - protein, 75 aa, Glycine max
  Coding DNA Sequence Number=SeqID_70857
MEKDLEVKISSKKLRKKGFEELFSTESLRWILRIQLQLKHSSQSGGSVASNGSSWWPSIVVGGGGRGVRAWVGIC

SEQ ID NO: 187636 - protein, 204 aa, Glycine max
  Coding DNA Sequence Number=SeqID_70858
  Gene Ontology: Mol. function=cellulose synthase (UDP-forming) activity; Cellular component=membrane; Biological process=cellulose biosynthetic process
  Homolog annotation: Hit_ID=Q45KQ0; Match level="QueryCoverage=75%, HitCoverage=23%, E-value=6e-53, Identity=56%"; Hit description =Cellulose synthase-like protein CslE
MGRVEYSPLFETRRCRGRFSHITKGEDGNWAWLGMLASELWFGFYWVLTQALRWNLVFRQPFKNRLSQRYEKKLPRVDIFVCTADPDIEPAMMVINTVLSVMAYDYPTEKLSVYLSDDAGSQITFYALLEASNFAKHWVPFCKRFKVEPRSPSAYFKSLVSSGYPTDPSQAKELGNIKGENSTWIIDPFLVATAHIIAYILQGS

SEQ ID NO: 187637 - protein, 62 aa, Glycine max
  Coding DNA Sequence Number=SeqID_70859
MVNNKRQNVGQTVEITSPCPKRQKPNGLCYRTWMVSIRKTNSGQCYSATIGITKASDFLVLP

SEQ ID NO: 187638 - protein, 239 aa, Glycine max
  Coding DNA Sequence Number=SeqID_70860
  Gene Ontology: Mol. function=transporter activity; Cellular component= intracellular; Biological process=transport
  Homolog annotation: Hit_ID=Q1S959; Match level="QueryCoverage=99%, HitCoverage=78%, E-value=1e-111, Identity=75%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=4-178; Score =17.2; E_value=4.2e-07; Accession=PF00650.10; Description=CRALTRIO domain
MDLYRAIRNSQLIGMSGYSKEGLPVIAVGVGLSTYDKASPTATRKHGRYIGTCVKVLDMTGLKFSALNQLRLLTAISTIDDLNYPEKTDTYYIVNVPYVFSACWKVVKPLLQERTRRKIQVLQGCGKEELLKVMDYASLPHFCRKEDSKSSKHHALGNIGNCFSFNHAFHQQLYNHIKQQSIIVESISPIRQGSFYVDIPEPDPDDAKIAKTIETEFHKLENQKNGFTNSLNGLRVNGH

SEQ ID NO: 187639 - protein, 320 aa, Glycine max
  Coding DNA Sequence Number=SeqID_70861
  Gene Ontology: Mol. function=transporter activity; Cellular component= intracellular; Biological process=transport
  Homolog annotation: Hit_ID=Q1S959; Match level="QueryCoverage=74%, HitCoverage=72%, E-value=1e-108, Identity=78%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=80-259; Score= 3.0; E_value=6.5e-06; Accession=PF00650.10; Description=CRALTRIO domain
MSAVALGNIHFYGSSPVSLRVWFNCQKIAFQVHSSKCIRKKEYSFAKDLGAISAEKDNLDITQHDWALPNFEQLAEAVLRQVGLPVIAVGVGLSTYDKASEKYCIQSHIQLNEYRDQVILPTATRKHGQYIGTTVKVLDMTGLKFSALNQLRLLTALSTIDDLNYLEKTDTYYIVNVPYVFSACWKVVKPLLQERTRRNIQVLQGCGKEELLKVMDYASLPHFCRKEDSKSSKHHALGKTGNCFSFNHAFHQQLYNHIKQQSIIVESISPIRHGSFYVEIQESDPDDAKIAKTIETEFHKLENQKNGFSNSLNGLTVNGH

SEQ ID NO: 187640 - protein, 49 aa, Glycine max
  Coding DNA Sequence Number=SeqID_70862
MDNVLESTYYTIKAVWLGCGREWVADATKSGLRRDCVRCQAQAVVTKRE

SEQ ID NO: 187641 - protein, 304 aa, Glycine max
  Coding DNA Sequence Number=SeqID_70863
  Homolog annotation: Hit_ID=Q8LFZ9; Match level="QueryCoverage=52%, HitCoverage=36%, E-value=2e-75, Identity=84%"; Hit description =Sucrase-like protein
  Pfam annotation: Domain name=Suc_Fer-like; Domain location=4-176; Score=173.2; E_value=6.6e-49; Accession=PF06999.3; Description =Sucraseferredoxin-like
MEGLQPHTWGSKCKTCLTICEGHDGTETSNGDVLIFPDMIRYRRLTHFDVETFVEEVLVKEGEWLPGNPESLKASYVFVCSHGSRDRRCGVFGPILVSRFREEIELHGLQGKVLISSCSHIGGNKYAGNVIIFGSSNNREVTGHLYGYVTPDDVPLLFHQHIIKGEIFDSLWSSILQKTLARIALVLVFWSRNWVCWVMDYASLPHFCRKEDSKSSKHHALGNIGNCFSFNHAFHQQLYNHIKQQSIIVESISPIRHGSFYVDIPEPDPDDAKIAKTIETEFHKLENQKNGFTNSLNGLTVNGH

SEQ ID NO: 187642 - protein, 291 aa, Glycine max
  Coding DNA Sequence Number=SeqID_70864
  Homolog annotation: Hit_ID=Q8S8Z9; Match level="QueryCoverage=42%, HitCoverage=46%, E-value=4e-08, Identity=35%"; Hit description =Syringolide-induced protein 1-3-1B
MSQEENKNAIEFLDEQAFYYDEEDEQWFKEKDDQWAKNIPCYKEDAVKVVLNSVNFDFDMQDLDEFLKVLGTEDSSPERVPDPVIHVTSPISGRVQVPSPPRVHAPAPQRVYTFANLVSATCAPTARVPAPHESPEETFNGIASGQVHALISHQHHLLPQNMESNRVMLAGDSSRSKFVPSKNPFQVASHAQKYFKRKNNPKKERKRKSIHDITLEDINTIVTPCIDQHNWVPPPPNFAAQPHEIRHAQPMQQFNQHNPFHQMQQFQHNMPSQMNIYGYSNNWPHDSEHAN

SEQ ID NO: 187643 - protein, 332 aa, Glycine max
  Coding DNA Sequence Number=SeqID_70865
  Gene Ontology: Mol. function=DNA binding; Cellular component=nucleus; Biological process=regulation of transcription
  Homolog annotation: Hit_ID=Q8S8Z9; Match level="QueryCoverage=39%, HitCoverage=50%, E-value=1e-20, Identity=47%"; Hit description =Syringolide-induced protein 1-3-1B
  Pfam annotation: Domain name=Myb_DNA-binding; Domain location=178 -224; Score=26.0; E_value=0.00013; Accession=PF00249.21; Description =Myb-like DNA-binding domain
MSHEENKNAIEFLDEQAFYYDEEDEQWFKEKDDQWAKNIPCYKEDEANAVLNSVDFDFDMQDLDEFLKDLGTEDSSPERVPDPVVPISGGVQVPSPPRVHAPAPQRVYTFADLVSATSAPAALVPAPHESPEETFNGIASGQVHAPISHQHHLLPQNMESNRVMLAGDSSRSVPCKKYTHWTREEHISFLLGLENVGKSWTYISQKFVPSKNPFQVASHAQKYFKRKNTPNKERKRKSIHDITLEDINTIVTPRIDQDNWVPPPPNFATQPHEIRHAQPMQQFNLHNPFHQMQQFNLHNPFHQMQQFQHNMPSQMDIYGYSNNWPHESEHGN

SEQ ID NO: 187644 - protein, 94 aa, Glycine max
  Coding DNA Sequence Number=SeqID_70866
  Gene Ontology: Mol. function=transporter activity; Cellular component= intracellular; Biological process=transport
  Homolog annotation: Hit_ID=Q1S959; Match level="QueryCoverage=87%, HitCoverage=24%, E-value=2e-23, Identity=62%"; Hit description =Cellular retinaldehyde binding/alpha-tocopherol transport; Cellular ...
  Homolog annotation: Hit description=retinaldehyde-binding/triple function, N-terminal
MEKNPGAARLWKGRITEGPDNSIMMPVMDYASLPHFCRKEDSKSSKHHALGNTENCFSFNHALHQQLYNHIKQLSIIVEPISPIRQGSFYVDIP

SEQ ID NO: 187645 - protein, 120 aa, Glycine max
  Coding DNA Sequence Number=SeqID_70867
  Gene Ontology: Mol. function=transporter activity; Cellular component= intracellular; Biological process=transport
  Homolog annotation: Hit_ID=Q1S959; Match level="QueryCoverage=89%, HitCoverage=35%, E-value=7e-41, Identity=68%"; Hit description =Cellular retinaldehyde binding/alpha-tocopherol transport; Cellular ...
  Homolog annotation: Hit description=retinaldehyde-binding/triple function, N-terminal
MVLLDFILRLENEVMDYASLPHFCRKEDSKSSKHHALGNIGNCFSFNHAFHQQLYNHIKQQSIIVESISPIRQGSFYVDIPEPDPDDAKIAKTIETEFHKLENQKNGFTNSLNGLRVNGH

SEQ ID NO: 187646 - protein, 45 aa, Glycine max
  Coding DNA Sequence Number=SeqID_70868
MSGGWPPAGKPSAIDNARCLVIQQDRPDEVVAVRLRPDLHHPMPA

SEQ ID NO: 187647 - protein, 202 aa, Glycine max
  Coding DNA Sequence Number=SeqID_70869
MILGGVFMQKGQMTEHLCVAESAYELCLVCQCSHSTTPTRTPDLMVGHRFDDSTVEAKLHDESRLIQRCFDDNKDDDKGDDKKLKGQSKNKFKIESRTLQDSRGKLISRIKNQDSRIKLPRIKIKIQESRSRFKTQDSRIKRRLNQDKYEKRVHLLGLLTENKRGYISCGSVLVEGTSTRFKENKGGYIPCGSLLVKGFLQG

SEQ ID NO: 187648 - protein, 201 aa, Glycine max
  Coding DNA Sequence Number=SeqID_70870
MEDAKRIGSGIDVRRPYAMVVKGTYQRPTIQTLEVEKGRRWSVKGYPFKYGGEKCFSIVISLFGTYIAMDEETKKMERLDRAKILMKVTFSLPIAICYNVKINGNLHRRNQEKNSEDNSDHSVLRVEGISSSSKCFYEDYEEGGHGHIGPRRKEDIVVGHGYCLEGSKSHYTKDYAKKVEKQPIEIYGSIGSSHCLPKNQT

SEQ ID NO: 187649 - protein, 326 aa, Glycine max
  Coding DNA Sequence Number=SeqID_70871
  Gene Ontology: Cellular component=trans-Golgi network transport vesicle; Biological process=photoreceptor cell maintenance
  Homolog annotation: Hit_ID=Q4RWH1; Match level="QueryCoverage=77%, HitCoverage=91%, E-value=7e-49, Identity=41%"; Hit description =Chromosome undetermined SCAF14988, whole genome shotgun sequence
  Pfam annotation: Domain name=DUF850; Domain location=66-310; Score =481.8; E_value=8.4e-142; Accession=PF05863.3; Description=Eukaryotic protein of unknown function (DUF850)
  Subcellular localization annotation: CTP_CleavageSite=46; ConfidenceScore=5.01e-01
MVSIQRFAHLSSISQIHPAPSLNPPIDTPFGSIFLREAVTHRDFVLGTRETESDSAARKLGIRAMAEDLVLDTAIRDWVLIPLSVVMVLIGVLRYFVSKLMHSSQTPDAKIVKEGQVIVRARNLRAAANFIPSKAFRARKIYFCNEENGLLFVPKGQGQNPQAQMFSDPNMAMDMMKKNLSMIIPQEMPHWLLLMLFSIFPQTLTFAWVNFFFSGFVAAKIPFPLTQRFRSMLQNGIDLSTVDVSYVSSRSWYFLNLFGLRGFFSLILGEENAVDDTQRMMQMGGFGFDPSKGLSAEKDNLDITQHDWALPNFEQRAEAVLRKVVS

SEQ ID NO: 187650 - protein, 304 aa, Glycine max
  Coding DNA Sequence Number=SeqID_70872
  Gene Ontology: Mol. function=DNA binding; Cellular component=nucleus; Biological process=regulation of transcription, DNA-dependent
  Homolog annotation: Hit_ID=Q8S8Z9; Match level="QueryCoverage=47%, HitCoverage=50%, E-value=1e-15, Identity=39%"; Hit description =Syringolide-induced protein 1-3-1B
  Pfam annotation: Domain name=Myb_DNA-binding; Domain location=161 -208; Score=22.9; E_value=0.0011; Accession=PF00249.21; Description =Myb-like DNA-binding domain
MEDEQWFKEKDDQWAKNIPCYKEDAANVVLNSVHFDFDMQDLDEFLMVLGTEDSSPERVPNPIIPVTPLISGRVQVPSPPRVHAPAPQRVYTFANLVSATSAPTARVPAPHESPEETFNGIASGQVHALISHQHHLLPQNMESYRVMLAGDSSRSVPCKKYTHWTREQHISFLLGLENVGKKSWTYILQKFVPSKNPFQVASHAQKYFKRKNNPKKERKRKSIHDITLEDINTIVTPRIDQHNWVPPPPNFAAQPHEIRHAQPMQQFNQHIPFHQMQQFQHIMPSQMNIYGYSNNWPHDSEHAN

SEQ ID NO: 187651 - protein, 444 aa, Glycine max
  Coding DNA Sequence Number=SeqID_70873
  Homolog annotation: Hit_ID=Q8LFZ9; Match level="QueryCoverage=96%, HitCoverage=81%, E-value=4e-73, Identity=55%"; Hit description =Sucrase-like protein
  Pfam annotation: Domain name=Suc_Fer-like; Domain location=5-239; Score=171.7; E_value=1.9e-48; Accession=PF06999.3; Description =Sucraseferredoxin-like
MGSGDTSSSSDFFCRRHVFLCYKNPAVWPPRIEAAEFDRLPRLLHAAINARKPHIKKEGEKESEKGCSCLFYQGAMTIYGCLSVIGMEWSVIESNGTGWNLVNILLRLTHFDVETFVEEVLVKEGEWLPGNPESLKASYVFVCSHGSRDRRCGVFGPILVSRFREEIELHGLQGKVLISSCSHIGGNKYAGNVIIFGSSINREVTGHLYGYVTPDDVPLLFHQHIIKGEIFDSLWSSILQKTLARIALVLVIWSRNWHRPTKVVPEVEILAMFIKLFDWVCGNFKRVSPSTAVKLYLYLGDCLVIGSNQETASLYMQGGQIGLSEDEQKKKQEQRLQLNGGRNLGGMVAGRCQTDGESCCQDNEDSCCCQNDVFEEMTELSTDNKRENVNVISRINKGKGALRKFSSMPTWLDSWEQEDTYAALAVVCAAVSVAIAYSCYKQLR

SEQ ID NO: 187652 - protein, 70 aa, Glycine max
  Coding DNA Sequence Number=SeqID_70874
MQRNSCWQTCYCIVWHVYHASSVRVQHPPSRAEIEAHEKQCGGIPLKICRVREGRVNLFSSDKVELPVLP

SEQ ID NO: 187653 - protein, 47 aa, Glycine max
  Coding DNA Sequence Number=SeqID_70875
MSMHSSLSSSSLLHDPICDAANIKVGRFVFRSAIHLLFRSWFMNLRV

SEQ ID NO: 187654 - protein, 337 aa, Glycine max
  Coding DNA Sequence Number=SeqID_70876
  Gene Ontology: Mol. function=DNA binding; Cellular component=nucleus
  Homolog annotation: Hit_ID=Q8S8Z9; Match level="QueryCoverage=31%, HitCoverage=44%, E-value=2e-21, Identity=51%"; Hit description =Syringolide-induced protein 1-3-1B
  Pfam annotation: Domain name=Myb_DNA-binding; Domain location=182 -229; Score=27.7; E_value=4.1e-05; Accession=PF00249.21; Description =Myb-like DNA-binding domain
MSHEENKNVIEFLDEQAFYYDEEDEQWFKEKDDQWTKNIPCYKEDAANVVLNSVDFDFDMQDLDEFLKDLGTEDSSPERVPDPVVPVTPPTSGRVQVPSPPRVHAPAPQRVYTFADLVSATSAPTARVPTPHESPEETFNGIASGQVHAPISHQHHLLQQNMESNRVMLADDSSRSVPCKKYTHWTREEHISFLLGLENVGKKSWTYISQKFVPSKNPFQVASHAQKYFKRKNTPKKERKRKSIHDITLDDINTIVNPRIDQHNWIPPPPNFATQPHEIQQAQPMQQFNLHNPFHQMQQFNLHNPFHQMQQFQHNMSSQMDRYGYFNNWLHAMEHGN

SEQ ID NO: 187655 - protein, 351 aa, Glycine max
  Coding DNA Sequence Number=SeqID_70877
  Homolog annotation: Hit_ID=Q8LFZ9; Match level="QueryCoverage=42%, HitCoverage=45%, E-value=6e-55, Identity=58%"; Hit description =Sucrase-like protein
  Pfam annotation: Domain name=Suc_Fer-like; Domain location=59-223; Score=82.1; E_value=1.7e-21; Accession=PF06999.3; Description =Sucraseferredoxin-like
  Subcellular localization annotation: CTP_CleavageSite=87; ConfidenceScore=5.40e-01
MTKEKIKKEKTLHTLHSVHSRKLQGAITSTLPHLPSFSFFFFFKKASSFSVCTMMGSGDASSSSDFFCRRHVFLCYKNPAVWPPRIEAAEFDRLPRRLTHFDVETFVEEVLVKEGEWLPGNPESLKASYVFVCSHGSRDRRCGVFGPILVSRFREEIELHGLQGKVLISSCSHIGGNKYAGNVIIFGSSIKYQQRSHWALVRRRFPLHIIKGEIFDSLWSSILQKTLARIALVLVFWSRSWVCGVMDYASLPHFCRKEDSKSSKHHALGNIGNCFSFNHAFHQQLYNHIKQQSIIVESISPIRQGAFYVDIPEPDPDDAKIAKTIETEFHKLENQKNGFTNSLIGLTVNGH

SEQ ID NO: 187656 - protein, 243 aa, Glycine max
  Coding DNA Sequence Number=SeqID_70878
MMCRRTELYRELKQRITHFRHFCDTHQKHLQDLELLKCFKSEIQFELASNHFQNAQSGSLGDFVVDPTSPNSKDVVLRRKFDSGEEVAISAILGPPNYVKDLIFPRDAFMKKLIRALILTSTMLIISNHLHVSALPFTEALYSGSKSKSYSVKEGYETLQQQSNNEESDFFKNLWSIPAPSKVWKSIYKWANLEIAMPIGTKAHFSQHTGICVGRKKNTAWWDSMDGSDMGIMVAQEQHSFEC

SEQ ID NO: 187657 - protein, 303 aa, Glycine max
  Coding DNA Sequence Number=SeqID_70879
  Gene Ontology: Mol. function=transporter activity; Cellular component= intracellular; Biological process=transport
  Homolog annotation: Hit_ID=Q1S959; Match level="QueryCoverage=86%, HitCoverage=80%, E-value=1e-128, Identity=82%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=56-242; Score= 18.4; E_value=3.4e-07; Accession=PF00650.10; Description=CRALTRIO domain
MLTLFDKLAHVGVNRLNTIKNHIIVGTGIWVKSLYNEIHMKPIPMDLYRAIRDSQLIGMSGYSKEGLPVIAVGVGLRTYDKASDKYYIQSHIQLNEYRDQVILPTATRKHGRYIGTCVKVLDMTGLKFSALNQLRLLTAISTIDDLNYPEKTDTYYIVNVPYVFSACWKVVKPLLQERTWRKIQVLQGCGKEELLKVMDYASLPHFCRKEDSKSSKHHALGNTGNCFSFNHAFHQQLYNHIKQQSIIVESISPIRQGSFYVDIPEPDPDDAKIAKTIETEFHKLENQKNGFTNSLNGLRVNGH

SEQ ID NO: 187658 - protein, 104 aa, Glycine max
  Coding DNA Sequence Number=SeqID_70880
TLDDELQDALKEYLIAKGIGLGSGIALTVKLITAVEDCQELSCDQRIQLLKNFFFKGLRYWFESKPKFGTIKVNYDDSASGDNGLAGCGGVIRDHFGFGQFHYG

SEQ ID NO: 187659 - protein, 166 aa, Glycine max
  Coding DNA Sequence Number=SeqID_70881
  Gene Ontology: Mol. function=nucleoside-triphosphatase activity; Cellular component=integral to membrane; Biological process=transport
  Homolog annotation: Hit_ID=Q1S953; Match level="QueryCoverage=83%, HitCoverage=20%, E-value=2e-57, Identity=81%"; Hit description=AAA ATPase
  Pfam annotation: Domain name=ABC_tran; Domain location=8-158; Score =32.5; E_value=2.3e-10; Accession=PF00005.17; Description=ABC transporter
MNVCQYFSFSFFTLPARIGFVIQEDVLYPQLTVEETLVFSALLRLPTHMSKQQKYAKVDTTIKELDLERCRHTKIVGGYLKGISGGERKRTCIGYEILVDHSLLLLDEPTSGLDSTAANKLLLTLLGLAEARRTIITTIHQPSSRIFHIFDKLLISERLSCLLWKG

SEQ ID NO: 187660 - protein, 91 aa, Glycine max
  Coding DNA Sequence Number=SeqID_70882
  Gene Ontology: Mol. function=nucleoside-triphosphatase activity; Cellular component=integral to membrane; Biological process=transport
  Homolog annotation: Hit_ID=Q1S953; Match level="QueryCoverage=85%, HitCoverage=11%, E-value=7e-17, Identity=56%"; Hit description=AAA ATPase
MVAHVLYPTFFMVILYFMAGFKRTVASFFLTLFTILLIVITSQGAGELFGAAIMSVQRAGTAPSLILLLFLLTGGYNVQQQLECMYVLQLM

SEQ ID NO: 187661 - protein, 155 aa, Glycine max
  Coding DNA Sequence Number=SeqID_70883
  Gene Ontology: Mol. function=sequence-specific DNA binding; Cellular component=nucleus; Biological process=regulation of transcription, DNA-dependent
  Homolog annotation: Hit_ID=Q1S5S6; Match level="QueryCoverage=57%, HitCoverage=24%, E-value=1e-10, Identity=44%"; Hit description=Zinc finger, GATA-type
  Subcellular localization annotation: CTP_CleavageSite=92; ConfidenceScore=5.06e-01
MAAQIPSGDGYGGGVVETVVDAGGGVAGTAPFPSAFAAPAPCVQAPAPVPTTAVSVTAATVLLPRPDLCHFFRRSRTGFGSGGRWNDDLVIRGRRRWGQDQEARCPVARGPTGPLAAGLGWNRHFRIEYWAVSGGLWGVGPASSGGGLVVELAGL

SEQ ID NO: 187662 - protein, 53 aa, Glycine max
  Coding DNA Sequence Number=SeqID_70884
MGKLENADMKIGRGTKMCTPWHEKLDDWVSQDGDFDEELHYRPVCGAMLSHKG

SEQ ID NO: 187663 - protein, 248 aa, Glycine max
  Coding DNA Sequence Number=SeqID_70885
  Gene Ontology: Mol. function=ribonuclease H activity
  Homolog annotation: Hit_ID=Q1SZM6; Match level="QueryCoverage=80%, HitCoverage=86%, E-value=1e-21, Identity=28%"; Hit description =Ribonuclease H
MAFTDESLCRLKDGFKFRLRRGNASLFYEKWFNGDLLCQHLEERGYAEEDFLHLIRDCPRALVIWKHFHLDFDRARNAQAIQGDVWTTWYTTNQIQVLKKIISTTTTLTTLGPPREVVWKPPTNATLKRTVGGSSIGNSGPFSFGGIIRNNLIRRLGHRDVVCESNSKATHHLIYDANTGYLPHAAIINKIKDYKSKPWILHFCHILREGNKWANALARIRSSHEDNFVQWDTPPQQLHSLLLADVVG

SEQ ID NO: 187664 - protein, 655 aa, Glycine max
  Coding DNA Sequence Number=SeqID_70886
  Gene Ontology: Mol. function=molecular_function; Cellular component =integral to membrane; Biological process=biological_process
  Homolog annotation: Hit_ID=Q9FG69; Match level="QueryCoverage=98%, HitCoverage=99%, E-value=0.0, Identity=63%"; Hit description =Arabidopsis thaliana genomic DNA, chromosome 5, P1 clone:MYN21
  Pfam annotation: Domain name=BacA; Domain location=122-267; Score= -172.9; E_value=0.091; Accession=PF02673.9; Description=Bacitracin resistance protein BacA
  Pfam annotation: Domain name=UPF0118; Domain location=207-639; Score=- 57.4; E_value=0.0068; Accession=PF01594.7; Description=Domain of unknown function DUF20
  Pfam module annotation: Pfam domain module=BacA::UPF0118; Domain location=122-267::207-639
  Subcellular localization annotation: CTP_CleavageSite=67; ConfidenceScore=5.07e-01
MELVPYSDPSSATPAWQDMFRSASSRHPTSAPPSHAPPSPSPPAPPNPPFDADPDGKNTFSGDPQVRLALYIAMAHAGLAFAIFILYTFSKLLEQYLRPLQWAVLCSIPLRGIQQTLVAFWSEPLHLGLTETVLAVPVAVFRAFAGTLVEIREASFRVILRKPKPQQNRPLRKRSGFYKLLRLLVSFGIFIITYERLGGFGALSLLGLGFLFSSKNVDSTMHALSSFRSLSFRRSAISAFFTRGILRKLKIIVAIGLIVCMIVGFLSGVIFFSYKIGVEGKDAMISLKLHVEENNYAERIGVKKWMDDNDVAGVVDSYTTKIYETVSDQIDGLAVQYNMTEFVTGIKHFVISTPVNSSAPSKALMTPSPYAEKFLSLKTRVRNREWSQIYTEADSILRELVITREDLVEKAKGFAFKGMDVSQRIFASSRTVLGSSTKFMFSIANSIISGAAEVFNFVSQSMVFIWVLYYLITSESGGVTEQVMYMLPISNSTRIRCVEVLDKAISGVLLATAEIAFFQGCLTWLLFRLNKIHFLYMSTVLAFISPLLPIFPSWLATIPAAVQLVLEGRYIMAIVLSIVHLFLMDYGASEILEDVPGNSAYLTGLSIIGGMTLFPSALEGAIMGPLITTVMIALKDLYAEFVLQEPKDKSKQKAS

SEQ ID NO: 187665 - protein, 170 aa, Glycine max
  Coding DNA Sequence Number=SeqID_70887
  Gene Ontology: Mol. function=zinc ion binding
  Homolog annotation: Hit_ID=Q1S950; Match level="QueryCoverage=98%, HitCoverage=51%, E-value=4e-56, Identity=66%"; Hit description=Zinc finger, RING-type; RINGv
  Subcellular localization annotation: CTP_CleavageSite=58; ConfidenceScore=5.84e-01
MASFPSNSALEHSMASAQQNSNPHASSPSFMTRVAMRISRSRWFTFLRRVFHYQNGPRSNLGSNPFNSSTWMMLELIALLVQIASTTFTLAISKSEKPIWPMRVWIAGYDIGCVLNLLLLCGRYHQLHVTQGNNALSLSELEQQRNNEESSTKKLQFIGYLLCECAENIG

SEQ ID NO: 187666 - protein, 86 aa, Glycine max
  Coding DNA Sequence Number=SeqID_70888
MGCDIFVSQHALLQASETRLSGAFSKGGKCAESPPMFICGKRRKNRRKLVKKNIPSLGVVFTFDEGRQKRGSYSYVPSIEEEIRPT

SEQ ID NO: 187667 - protein, 195 aa, Glycine max
  Coding DNA Sequence Number=SeqID_70889
MVKEECKEVSVSSKRLAKKESHFEIKTNIKEISPLRQPPHLLLCKKTLVSTSTPLRLEVIPQVKELLDEGLVCKSLNPCALLVPKIGVPIDPKRIKVIPDWPTPPSIRVIWNCHDLTNFYKRPTWAFQILPPEGCCLWRNQPRLGELGGKLLPYFAINRGRSEGRRGSAFLALLILSKLLRKIISVKKIQAEALP

SEQ ID NO: 187668 - protein, 465 aa, Glycine max
  Coding DNA Sequence Number=SeqID_70890
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=92%, HitCoverage=75%, E-value=1e-162, Identity=63%"; Hit description =Putative amino acid acetyltransferase
MPNNPLSLSTTCKRRNVFSEEFNGSVAEEESFSSMDDKQFVRWFRETWPYLWAHRGATFVVIISGRQPKYVGPYRITDDESLAAAMEAAGRIRLMIEAKLSPGPSIYNIRRHGDNSRLHEVGVSVASGNFLAAKRRGVVKGIDFGSTGEVKKVDISRMRERLDGNCIVILSNLGYSSSGEVLNCKAYPKSIVGLPAFGMLQAGSRLGAYEVATACALAVRADKLICITDGPILDESGHLIRFLPLQEADMLIRKQVEESETAANYVKAVAEESFKSLKNFNGAVHSPRNGKPFSEYHNSTFHNGVGFDNGNGLSGKHGFAIGGQESLSRTNGYLSELAAAAFGGVQRVHLLDGTISGVLLLELFKRDGMGTMVASDLYEGTRMAQVTDFSGIKQLIQPLEESGILVKRTDEELLQSLGSFIVVEREGQIIACAALFPFFEEKCGEVAAIAVSPDCRGQGQGDKLL

SEQ ID NO: 187669 - protein, 961 aa, Glycine max
  Coding DNA Sequence Number=SeqID_70891
  Homolog annotation: Hit_ID=Q9LHL0; Match level="QueryCoverage=99%, HitCoverage=99%, E-value=3e-41, Identity=32%"; Hit description =Arabidopsis thaliana genomic DNA, chromosome 3, P1 clone: MJH23
  Pfam annotation: Domain name=WW; Domain location=178-208; Score=40.9; E_value=4.4e-09; Accession=PF00397.16; Description=WW domain
  Pfam annotation: Domain name=WW; Domain location=929-959; Score=33.0; E_value=1.1e-06; Accession=PF00397.16; Description=WW domain
  Pfam module annotation: Pfam domain module=WW::WW; Domain location =178-208::929-959
MGKRKERRRLAAISNAGRRVKLDLFAEPSGELGGSTLQGDAGGDTDSQHRDGLPNSPSSSGQQPQNPLLLLGQYSDDEGDDGSSKGLNDANVQSPMLNEEAKGIFDEGSKDLDISVPVDLVAQNNGQQNTIQNSTSLDVGYSERNESDGAAGNLQNEIVSKDQIYVSESFDEQVLTDVGLGWKMVMHEESQRYYYWNIETGETSWEVPQVLAHEDQLANDSIPHASVNDKTESAAVGDNSNVHSAVLQDTSAAFIIDGSLETTVTSHKELYGHRSQINGDSVECTNQNQISDVNGNELTRNDGHMSLSDEGHHSSVSKFGDEEQQQLDIDFPSSLVKQSESLLERLKSLKNLKILFLPVPDLTNRILHRSKENLLGQDFLSKYMLEIEIRLSDIRSLASYGSSLLPFWGHSDRKIKLLESLITDDLMQIGNSSHDEVEDKHVPVSEELADQLNGMGHESEVDNNKNEGSPLTSDVSNESQDDASAAVLKDINNKISANGQHVALSNSPGSHMETDVEINSKVEAIINPQEPIHKHGYNVGEDVDMDVDMEVEDMNSSGNTTVIDVSVAKDSMHIDQLVQLNPPVDYHSVLPEEGEFVPPPPDDEWIPPPPPDNEHVPPPPPPDNDQVPPPPGDPLAPSYSVLPSYTETGQPLSYAQYSLSYPGVAPEYYGQAAAEVPSSNIYGQIAMPPAHIYYNSAIPNMYSENPQVMIDPAGTVAYYEVQDGAVSKSIPAINFNDSGVGGADWASSDGPSTSSSIHAPATVSVDEGVSLPPATAESAAENNASSLVPKAQTKAGKVEVFGNLGVLKLILRLLVVRNRKRAVAVGSSLKSNKKWKAAKEELLEEEEEPDSVYEVLERKRQREIEEWHAKQIASGEAKDNANFQPLGGDWREKVKRRRAQAAKESVSTPQDAIEHNQQQPDPSEHSKGLPTNWQAYWDDSTKQIYYGNTVTSETTWTKPTR

SEQ ID NO: 187670 - protein, 195 aa, Glycine max
  Coding DNA Sequence Number=SeqID_70892
  Homolog annotation: Hit_ID=Q6H725; Match level="QueryCoverage=30%, HitCoverage=27%, E-value=5e-17, Identity=71%"; Hit description =Immunophilin / FKBP-type peptidyl-prolyl cis-trans isomerase-like protein
  Pfam annotation: Domain name=FKBP_C; Domain location=54-182; Score =10.0; E_value=0.00046; Accession=PF00254.18; Description=FKBP-type peptidyl-prolyl cis-trans i
MEDANLNYAESNRVSILTVDKFSRRMVLQFLGFNHVICYASPALAAPIMPDIKEPEVIRTVDQFSGESNPVILPLDENQMIVGLKEVLTGMRVGGKRRALIPPSVGYVNENLQPMPEESRKQQGSQLHFVGIGGEKMQGWFSGQSSEEEAKPASSLLADWNSYASAQTSEDSSTFPFDIESAVRSANDTVSGTFS

SEQ ID NO: 187671 - protein, 78 aa, Glycine max
  Coding DNA Sequence Number=SeqID_70893
MWLKLSLLGTVGAPIGEQEIINYLEAHLTYFKLTLHIQPRATMGSGEDNVTKNQKAPFKGTHPSRGQMEERTRDPNRG

SEQ ID NO: 187672 - protein, 140 aa, Glycine max
  Coding DNA Sequence Number=SeqID_70894
  Homolog annotation: Hit_ID=Q9FKU4; Match level="QueryCoverage=41%, HitCoverage=37%, E-value=2e-13, Identity=51%"; Hit description =Genomic DNA, chromosome 5, P1 clone:MDA7
MPRSNHRTAELKGKSKKKIDSPKFCTSGKQSARFWGIVRFKNERTAVKEWKGRKKSDTATGNHLRQQRTAETDCGEVGKEIWVSKGVRDLPGNFQSATSNVPSGKALFALCFTLGCGFIIGSFFALKGPKSQLAHMLSKE

SEQ ID NO: 187673 - protein, 71 aa, Glycine max
  Coding DNA Sequence Number=SeqID_70895
MVLESWNVNLLGEPLALNFVVSMADNLAMELRQKECTEPVKLIKVIWSPPLSLPPPKPSDLSLHAAAVGRS

SEQ ID NO: 187674 - protein, 1092 aa, Glycine max
  Coding DNA Sequence Number=SeqID_70896
  Gene Ontology: Mol. function=protein serine/threonine kinase activity; Cellular component=integral to membrane; Biological process=protein amino acid phosphorylation
  Homolog annotation: Hit_ID=Q6Z8S8; Match level="QueryCoverage=96%, HitCoverage=97%, E-value=0.0, Identity=55%"; Hit description =Putative receptor protein kinase
  Pfam annotation: Domain name=LRRNT_2; Domain location=36-76; Score =60.6; E_value=5.1e-15; Accession=PF08263.3; Description=Leucine rich repeat N-terminal domain
  Pfam annotation: Domain name=LRR_1; Domain location=105-127; Score =10.9; E_value=2.6; Accession=PF00560.23; Description=Leucine Rich Repeat
  Pfam annotation: Domain name=LRR_1; Domain location=129-151; Score =11.8; E_value=1.7; Accession=PF00560.23; Description=Leucine Rich Repeat
  Pfam annotation: Domain name=LRR_1; Domain location=153-175; Score =7.1; E_value=14; Accession=PF00560.23; Description=Leucine Rich Repeat
  Pfam annotation: Domain name=LRR_1; Domain location=177-199; Score =15.1; E_value=0.26; Accession=PF00560.23; Description=Leucine Rich Repeat
  Pfam annotation: Domain name=LRR_1; Domain location=201-224; Score =4.9; E_value=35; Accession=PF00560.23; Description=Leucine Rich Repeat
  Pfam annotation: Domain name=LRR_1; Domain location=226-248; Score =9.6; E_value=4.6; Accession=PF00560.23; Description=Leucine Rich Repeat
  Pfam annotation: Domain name=LRR_1; Domain location=274-296; Score =15.0; E_value=0.27; Accession=PF00560.23; Description=Leucine Rich Repeat
  Pfam annotation: Domain name=LRR_1; Domain location=298-320; Score =11.4; E_value=2.1; Accession=PF00560.23; Description=Leucine Rich Repeat
  Pfam annotation: Domain name=LRR_1; Domain location=322-344; Score =17.2; E_value=0.059; Accession=PF00560.23; Description=Leucine Rich Repeat
  Pfam annotation: Domain name=LRR_1; Domain location=346-368; Score =15.5; E_value=0.19; Accession=PF00560.23; Description=Leucine Rich Repeat
  Pfam annotation: Domain name=LRR_1; Domain location=370-392; Score =13.6; E_value=0.73; Accession=PF00560.23; Description=Leucine Rich Repeat
  Pfam annotation: Domain name=LRR_1; Domain location=394-416; Score =3.9; E_value=52; Accession=PF00560.23; Description=Leucine Rich Repeat
  Pfam annotation: Domain name=LRR_1; Domain location=418-440; Score =14.5; E_value=0.4; Accession=PF00560.23; Description=Leucine Rich Repeat
  Pfam annotation: Domain name=LRR_1; Domain location=442-464; Score =9.5; E_value=4.9; Accession=PF00560.23; Description=Leucine Rich Repeat
  Pfam annotation: Domain name=LRR_1; Domain location=466-488; Score =15.5; E_value=0.2; Accession=PF00560.23; Description=Leucine Rich Repeat
  Pfam annotation: Domain name=LRR_1; Domain location=490-512; Score =11.5; E_value=2; Accession=PF00560.23; Description=Leucine Rich Repeat
  Pfam annotation: Domain name=LRR_1; Domain location=514-533; Score =15.0; E_value=0.27; Accession=PF00560.23; Description=Leucine Rich Repeat
  Pfam annotation: Domain name=LRR_1; Domain location=536-558; Score =13.8; E_value=0.63; Accession=PF00560.23; Description=Leucine Rich Repeat
  Pfam annotation: Domain name=LRR_1; Domain location=560-583; Score =15.0; E_value=0.27; Accession=PF00560.23; Description=Leucine Rich Repeat
  Pfam annotation: Domain name=LRR_1; Domain location=584-606; Score =10.6; E_value=2.9; Accession=PF00560.23; Description=Leucine Rich Repeat
  Pfam annotation: Domain name=LRR_1; Domain location=609-631; Score =9.7; E_value=4.4; Accession=PF00560.23; Description=Leucine Rich Repeat
  Pfam annotation: Domain name=LRR_1; Domain location=633-654; Score =12.2; E_value=1.5; Accession=PF00560.23; Description=Leucine Rich Repeat
  Pfam annotation: Domain name=LRR_1; Domain location=656-675; Score =11.9; E_value=1.7; Accession=PF00560.23; Description=Leucine Rich Repeat
  Pfam annotation: Domain name=LRR_1; Domain location=80-102; Score =6.8; E_value=15; Accession=PF00560.23; Description=Leucine Rich Repeat
  Pfam annotation: Domain name=Pkinase; Domain location=767-1042; Score= 107.6; E_value=3.6e-29; Accession=PF00069.15; Description=Protein kinase domain
  Pfam annotation: Domain name=Pkinase_Tyr; Domain location=767-1042; Score=43.3; E_value=4e-15; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=36-76::105-127::129-151::153-175::177-199::201 -224::226-248::274-296::298-320::322-344::346-368::370-392::394 -416::418-440::442-464::...
  Pfam module annotation: Domain location=466-488::490-512::514 -533::536-558::560-583::584-606::609-631::633-654::656-675::80 -102::767-1042::767-1042
MPGSLRNLSLFPKIFSFTLLLILLNSLLFFPCCYSLDEQGQALIAWKNTLNITSDVLASWNPSASSPCNWFGVYCNSQGEVVELNLKSVNLQGSLPSNFQPLKGSLKILVLSSTNLTGSVPKEIRDYVELIFVDLSGNSLFGEIPEEICSLRKLLSLSLHMNFLQGNIPSNIGNLTSLVNLTLYDNHLSGEIPKSIGSLRKLQVFRAGGNKNLKGEIPWEIGSCTNLVTLGLAETSISGSLPSSIKMLKRINTIAIYTTLLSGPIPEEIGNCSELENLYLHQNSISGSIPSQIGELGKLKSLLLWQNNIVGTIPEELGSCTEIEVIDLSENLLTGSIPRSFGNLSNLQELQLSVNQLSGIIPPEISNCTSLNQLELDNNALSGEIPDLIGNLKDLTLFFAWKNKLTGNIPDSLSECQELEAIDLSYNNLIGPIPKQLFGLRNLTKLLLLFNDLSGFIPPDIGNCTSLYRLRLNHNRLAGSIPPEIGNLKSLNFMDMSSNHLSGEIPPTLYGCQNLEFLDLHSNSITGSVPDSLPKSLQLIDLSDNRLTGALSHTIGSLVELTKLNLGNNQLSGRIPSEILSCTKLQLLDLGSNSFNGEIPNEVGLIPSLAISLNLSCNQFSGRIPSQFSSLTKLGVLDLSHNKLSGNLDALSDLENLVSLNVSFNGLSGELPNTLFFHKLPLSDLAENQGLYIAGGVATPGDKGHVRSAMKFIMSILLSTSAVLVLLTVYVLVRTHMANKVLMENETWEMTLYQKLDFSIDDIVMNLTSANVIGTGSSGVVYKVTIPNGETLAVKKMWLAEESGAFNSEIQTLGSIRHKNIIRLLGWGSNKSLKLLFYDYLPNGSLSSLLHGSGKGKAEWETRYDAILGVAHALAYLHHDCLPAIIHGDVKAMNVLLGPGHQPYLADFGLARTATENGCNTDSKPLQRHYLAGSYGYMAPEHASLQPITEKSDVYSFGMVLLEVLTGRHPLDPTLPGGAHLVQWVRNHLSSKGDPSDILDTKLRGRADPTMHEMLQTLAVSFLCVSTRADERPTMKDVVAMLKEIRPLETSRADPDVLKGGLTAHSSPPPPKNVVSHGSSTCSYNFSDNSIN

SEQ ID NO: 187675 - protein, 879 aa, Glycine max
  Coding DNA Sequence Number=SeqID_70897
  Gene Ontology: Mol. function=binding; Biological process=embryonic development ending in seed dormancy
  Homolog annotation: Hit_ID=Q1S6U5; Match level="QueryCoverage=99%, HitCoverage=99%, E-value=0.0, Identity=62%"; Hit description =Pentatricopeptide repeat
  Pfam annotation: Domain name=PPR; Domain location=345-379; Score =23.5; E_value=0.00077; Accession=PF01535.11; Description=PPR repeat
  Pfam annotation: Domain name=PPR; Domain location=380-414; Score =15.0; E_value=0.13; Accession=PF01535.11; Description=PPR repeat
  Pfam annotation: Domain name=PPR; Domain location=415-449; Score =19.9; E_value=0.0094; Accession=PF01535.11; Description=PPR repeat
  Pfam annotation: Domain name=PPR; Domain location=486-519; Score =14.4; E_value=0.15; Accession=PF01535.11; Description=PPR repeat
  Pfam annotation: Domain name=PPR; Domain location=520-554; Score=9.2; E_value=0.61; Accession=PF01535.11; Description=PPR repeat
  Pfam annotation: Domain name=PPR; Domain location=568-602; Score =15.3; E_value=0.11; Accession=PF01535.11; Description=PPR repeat
  Pfam module annotation: Pfam domain module=PPR::PPR::PPR::PPR::PPR::PP R; Domain location=345-379::380-414::415-449::486-519::520-554::568 -602
MEPLHLHLQGHPAAQFRPNTDKIRRRLIEKGVQPTPKIVHTLRKKEIQKHNRKLKAQPAPPLTQAQAQAAAEEQHLETIKREFRRVMAGKPWEGIQKVEFLEKARRPERDCGGGEKLRRESLTELKEMFEARKMDELKWVFDADLEIDEVWFDEGYGARGKTQKRSEVEVIRFLVHRLSDKEITMKDWKFSRMMKMSGLPFTEGQLLRIVELLGFKRCWKQALSVVQWVYNYKDHRKFQSSEIDAMEWLLLTHCVNEWNGKEIKKNEIGFKHSAGRPNEALQIFNMMRESIHIYPDIAAYHSVAVTLGQAGLLKELLNIVECMRQKPKAFMHRKNWDPVLEPDVVIYNAVLNACVPSKQWKGVSWVFKQLRKSGLKPNGATYGLAMEVMLESGNYDLVHEFFGKMKRSGEVPKALTYKVLVKTFWKEGKVNEAVKAVRDMERRGVIGTASVYYELACCLCNNGRWQDAILEVDNIRSLPHAKPLEVTFTGMIKSSMDGGHINDCICIFEYMKEHCVPNIGAINTMLKVYGQNDMFSKAKVLFEEVKVAKSEFYATPEGGYSSVVPDVYSYNSMLEASATAQQWEYFEHVYREMIVSGYQLDQDKHLSLLVKASRAGKLHLLEHAFDMILEAGEIPHHLFFFELVIQAIAQHNYERAVILINTMAYAPFRVTEKQWTNLFKESEDRISLENLERLLDALGNCDIVSELTVSNLTRSLHVLCGLGTSRNFSSIIPFGSENSVNGLNEGIDDDGNVPKISRRMMIEGVESKNDILVASYHTEPETIAFSRDQVNGGDNSDVMVFRPQNSYIEDGKSLYADSLECTDNLALDKSSDELDEELWDDGSSEDDDGEGVIDKPSAYEILEVNCKQGEEDATIFIVN

SEQ ID NO: 187676 - protein, 63 aa, Glycine max
  Coding DNA Sequence Number=SeqID_70898
  Homolog annotation: Hit_ID=Q0PJG6; Match level="QueryCoverage=54%, HitCoverage=11%, E-value=4e-07, Identity=82%"; Hit description=MYB transcription factor MYB130
MFHESSCIFQIYKPKIMYSYEKTGRKHSQQQNYHLKAKSADDEHEVLFHLDKPIWKVQTPSEG

SEQ ID NO: 187677 - protein, 113 aa, Glycine max
  Coding DNA Sequence Number=SeqID_70899
MTRGYPGDLQTFYPEIDRTFHRLVRHSVHLDHSVHFEHSEHSEHYVYSEHSVAGDSEHFDFEHSATNFHTENMAQPPPCERTVATYPFAGERGKVHGCVFHRRKMRGVTTNVY

SEQ ID NO: 187678 - protein, 81 aa, Glycine max
  Coding DNA Sequence Number=SeqID_70900
MSPHGGDMDGGGKRKERDGVFLAFGIVSLGGRLPGWAISSVVECTPDNCIVVPGLWGCDDLPYGQGLWFKSRMAKLHQGKE

SEQ ID NO: 187679 - protein, 94 aa, Glycine max
  Coding DNA Sequence Number=SeqID_70901
  Gene Ontology: Mol. function=zinc ion binding
  Homolog annotation: Hit_ID=Q1SGH7; Match level="QueryCoverage=79%, HitCoverage=23%, E-value=3e-11, Identity=58%"; Hit description=Zinc finger, RING-type; Thioredoxin-related
AAVVEDVGVSARIGIRRTATINNLGKVENLPVLNVALESMPTVEITESLVATETHSAVCKEHWRARCRASTSTTLIACVQCAAVEVGHVEKESR

SEQ ID NO: 187680 - protein, 396 aa, Glycine max
  Coding DNA Sequence Number=SeqID_70902
  Gene Ontology: Mol. function=transcription factor activity; Biological process=regulation of transcription, DNA-dependent
  Homolog annotation: Hit_ID=Q8P6L2; Match level="QueryCoverage=60%, HitCoverage=89%, E-value=1e-74, Identity=53%"; Hit description =Transcriptional regulator lysR family
MLPVQRHIEPAAGFQYHHAAGAHGGCDQRFRGHAPAESARGGFDETGGGGQGRGLHAVTEVLAGEAGRGDGVVAHRAERVYVAALHRLAFGGHCTQHTAVAQQLQGVVLIVHAQVEQVAMALVQVGDGRHEPGIERVVVDRQGDRRTCGVAAAFGQQFGHCLGLQRLHRPYPAQQCLTGGGGPARCLAHHQHLAKPVLQGLDPLRQCRRTDRQPARRSLEAAFFQHCGKCGQLRMYQVHQYLFSISAQDKEKSVCLNVCRPDHRHRCAERLRAAPGPAAASCGEGGAGLRRYGHRPDPCRRWRHGRAGAAVAAAAAGAAFRWCGLPALVWPAGRPARVARGQCAGRRRGAGRQWAPGAADLPGLHPAQPARLSGYGGTAGQSVHALPGRSALGLCR

SEQ ID NO: 187681 - protein, 233 aa, Glycine max
  Coding DNA Sequence Number=SeqID_70903
  Gene Ontology: Mol. function=pectinesterase activity; Cellular component=cell wall; Biological process=cell wall modification
  Homolog annotation: Hit_ID=Q4PSN0; Match level="QueryCoverage=74%, HitCoverage=50%, E-value=5e-47, Identity=55%"; Hit description =Pectinesterase family protein
  Pfam annotation: Domain name=Pectinesterase; Domain location=55-232; Score=-86.7; E_value=4.3e-15; Accession=PF01095.10; Description =Pectinesterase
MSLGWYHFTFFFLLATLGVVLAHVNHRHHFVRHHHHHHDYNKQTTKKTVHYSSRTIIVDRLGNGHFSTIQSAIDSVASYNKNWVYIYVMAGTYREKVKITSDKPFIVLKGEGQKNTFVEWHDHDSSAESPTFTTMADNVVVKSISFRDLRIRKKIANTYNNNRNANSMEAAVAAMIFGDRSYFYDVGFFGLQDTLWDGQGRHYFKSCTIQGAMDFIFGTGQSLYEVLIMILSC

SEQ ID NO: 187682 - protein, 321 aa, Glycine max
  Coding DNA Sequence Number=SeqID_70904
  Homolog annotation: Hit_ID=Q2HRM7; Match level="QueryCoverage=41%, HitCoverage=21%, E-value=1e-10, Identity=31%"; Hit description =Polynucleotidyl transferase, Ribonuclease H fold
MQVGDPTWNAQNVNVQWVDLDLVNTDRVLTWRADHQPRWQGCIHGKVVLLKKVRSDNVKKKDEDEISMEECKTLILSSNLNDGINSYCDGVKSLSFEINAHYLEFYNHEESSSMWFVVYEKIENYEFFKHDQGMLKDVTFCVPKSSLPNSLIREAHDESVMLHGFSFGIYMEYETLKCFVRCIMHKRDKFKDVVHGMKMSLLVHNFHWVRLAMKFVLKCPRSKRGKHFHLILYGCFLVLVFDTGGWIGKEDFNSRMNSLKEGGDDDHQLRSMDLEAKYGFDGPITRVLAKQMVNEAQSKMENVKHKPKLVNCLRNKENELT

SEQ ID NO: 187683 - protein, 111 aa, Glycine max
  Coding DNA Sequence Number=SeqID_70905
MQKVYTDNHSGISGRQRDSKVSMTDLVSAEDDVNLHVSTGLSAAIDEGRRRRCFSSYRQQKVYTDNHSGISGRQRDSKVSMTDLVSAEDDVNLRVSTGLSAAIDEGRRRRR

SEQ ID NO: 187684 - protein, 87 aa, Glycine max
  Coding DNA Sequence Number=SeqID_70906
  Homolog annotation: Hit_ID=Q1SGH7; Match level="QueryCoverage=70%, HitCoverage=24%, E-value=2e-08, Identity=48%"; Hit description=Zinc finger, RING-type; Thioredoxin-related
MASTIIKGLRPLSSRMSEFLLGSGFDGLLQYSMPTVEITESLVATETHSAVCKEHWRARCRASTSTTLIACVQCAAVEVGHVEKESR

SEQ ID NO: 187685 - protein, 276 aa, Glycine max
  Coding DNA Sequence Number=SeqID_70907
  Gene Ontology: Mol. function=DNA binding; Cellular component=nucleus; Biological process=regulation of transcription, DNA-dependent
  Homolog annotation: Hit_ID=Q0PJJ0; Match level="QueryCoverage=94%, HitCoverage=90%, E-value=2e-99, Identity=67%"; Hit description=MYB transcription factor MYB118
  Pfam annotation: Domain name=Myb_DNA-binding; Domain location=26-104; Score=33.8; E_value=6.2e-07; Accession=PF00249.21; Description=Myb -like DNA-binding domain
MAMKPSTSTSGSGKKIRKPYTITKSRESWSEEEHDKFLEALQLKGAQLNKFVGHLAGSVLFSPRYEASLLLNVREKFDRDWKKIEDFVGSKSVIQIRSHAQKYFLKVQKSGTVAHVPPPRPKRKASHPYPQKASKNVLLPMPASMVYVSSTSTLPPGYVTWDENSLLMNSGSNKSVPSDIGSKGITRIDHSSLSGVGNSTRNLPATEMPKQGKQAQVIHGLPDFADVYSFIGSVFDPDTEGHVQKLKEMDPINFETVLLLMKNLTVNLSSPDFEPV

SEQ ID NO: 187686 - protein, 52 aa, Glycine max
  Coding DNA Sequence Number=SeqID_70908
ANGNATEDGPGTSIASADVDDTDDVDGELDMDELDELSKLIKDINSNKGVRS

SEQ ID NO: 187687 - protein, 117 aa, Glycine max
  Coding DNA Sequence Number=SeqID_70909
  Subcellular localization annotation: CTP_CleavageSite=43; ConfidenceScore=5.01e-01
MWLRMPPVSWDTHFVSKRPFRGDTGSNKDRRKSLKVYQSHTVRGEKVAQDFVGNQRERTTLGRGQGLTFSPWVKVYDKLGFWLKACRMGGHDICQGLASGSRIKGMSYIISMIHMQQ

SEQ ID NO: 187688 - protein, 63 aa, Glycine max
  Coding DNA Sequence Number=SeqID_70910
  Subcellular localization annotation: CTP_CleavageSite=41; ConfidenceScore=5.06e-01
MSVKNLVGCLGVHDKTNHTLVSQVTLTRFKGALKPGVFTPKAYTPKSLSGLLPTDSGPTQKTF

SEQ ID NO: 187689 - protein, 126 aa, Glycine max
  Coding DNA Sequence Number=SeqID_70911
MIITQVLCNRHTKTQTYVQCGTMSVKNLARRLGVHDKTDHTLEVRSLTLGEIIGRLIRVTLFCENAPTIWNQHSIGLKEHSNRVYLSPRPALQRVGQDFSLIIQVQPRKHFNTQTLSMNNTTHTTP

SEQ ID NO: 187690 - protein, 109 aa, Glycine max
  Coding DNA Sequence Number=SeqID_70912
MSPVESPTIATCPFAGGRRVTRGMRVPQKEYARSRHQRLFEEKRRKNRRKTGQKENSKFGSCDHFKALDLENDPFYLVRNINDKLSKSYFLWTSLNRRVDFSLSFTLVI

SEQ ID NO: 187691 - protein, 133 aa, Glycine max
  Coding DNA Sequence Number=SeqID_70913
  Homolog annotation: Hit_ID=Q1T034; Match level="QueryCoverage=61%, HitCoverage=15%, E-value=2e-07, Identity=33%"; Hit description=Zinc finger, CCHC-type
  Pfam annotation: Domain name=zf-CCHC; Domain location=34-51; Score =16.5; E_value=0.0019; Accession=PF00098.13; Description=Zinc knuckle
MRFDKVGLGYNPENQQKMYKNFFASTQKNSSPFLTCFYCDKKGHSASTCYIRKNGSSIRKMVWVPKGSLVKTNIQGPKKIWVPKSKYDYMNEGLLEAMLNPEHKGKGSLGGSEVVKEFYKDSGNLSGLLEDWT

SEQ ID NO: 187692 - protein, 163 aa, Glycine max
  Coding DNA Sequence Number=SeqID_70914
  Pfam annotation: Domain name=Chromo; Domain location=9-60; Score =23.8; E_value=0.00061; Accession=PF00385.14; Description='chromo' (CHRromatin Organisation MOdifier
MASNNHHVVTPLAIVASKVIPSKTGPKHMVLVQWRGLPPEETLWEEWTTLKSTHHLEDKVLLEGHGSVTEKDVEEVPIARGVQEETRVRPHREKSTPAYLKDYKRSHAEWRCIQKLPTTYKYHVSWASNTKYKGLCPAKIAKTVYEEAIMLSLRLKPACRGHV

SEQ ID NO: 187693 - protein, 164 aa, Glycine max
  Coding DNA Sequence Number=SeqID_70915
MSSTSSTASSRLRKYSNIYESVTINFMACEHRWNFDLHFIPSLEQQACGRPLPAFRMHVWTIELTQSLLCDPEPLMLPPLAAIHLPSCGFHMTILRKFVPPLQWLVVPVGPGFHGKYVADPWYRFLVEGDFVHGDELLFYYKSREDIWEMVIRKQRNWGDNDDW

SEQ ID NO: 187694 - protein, 626 aa, Glycine max
  Coding DNA Sequence Number=SeqID_70916
  Homolog annotation: Hit_ID=Q7XB90; Match level="QueryCoverage=88%, HitCoverage=80%, E-value=9e-53, Identity=29%"; Hit description=KEAP1
MFSCVRMRSVRRTQTFNINRTIPFSSNPAINCVGRNLEKYQLGGVIFGCKNSTLKECQSKQLFGLPTNHFSYVKNIDPGLPIFLFNYSDRKLHGIFEASSKGKMYIDPYAWIDDNSDLDRTQYPAQVKVRVRLQCKPLSEDQFSRVIAENYYKNNHFWFELDHRQANKLTSLLASFAFASGCHLRQKTISQSLSSTLKEGEAFETHESETKSLTSLSKTTIATEITSLDGDIKSLDVVRVETEEMNIIYEKLKEWAHESQDLPISDHLDDTEDETEMFTLEKHENDENEMDIEELMELTLVHENPDISVSDHTNDTPHENDICTIRNDYGEVPTGSEEKEKSSSPLIDHQNTIIFDELMQEVEELKTFKKIQTQTNCYLDDMLVLLFLVIVVDREAELKIQHLIDRCTMLELAFNLPPPHAEKTSITSYAEQRVDPTETSFLKGNFNEEAWLSTIDLYCPAERVITLYPVNSAHSCASMVQLNVGSYSPIFDKRTLCPSLNQSKGNLAVLSLNDQMFAVDCANGIDSFSDIEVFDLDNGRWISAHSHSMIDKAFAIAAAEFNNWFHTTFGNGINYLKFFLGGFDGNKKVPSIKEYMWLRKVKVNKNIIDRQRDDKKLHNPLLANGT

SEQ ID NO: 187695 - protein, 55 aa, Glycine max
  Coding DNA Sequence Number=SeqID_70917
MFEICCSQCRSKDFDFDVLMMPYDHDVLMPYEHALLKLRSRQKSKRFKIHHQEEL

SEQ ID NO: 187696 - protein, 324 aa, Glycine max
  Coding DNA Sequence Number=SeqID_70918
  Gene Ontology: Mol. function=helicase activity; Biological process =viral genome replication
  Homolog annotation: Hit_ID=Q1SRJ5; Match level="QueryCoverage=95%, HitCoverage=37%, E-value=2e-87, Identity=48%"; Hit description =Probable helicase [imported]-Arabidopsis thaliana-related
MLSDLTKNHLLGKVVALEIPSQEDDPELYKLVQNHMVHGPCGILRPASPRMKEGKCSRFYPKKFQLTTLIDGDGYPVDRRRNTGQTITKNEIIIDNRCIVPYNPKLLKKYQAHINIEWCNQNTSIKYLFKYINKGYDKVTAVMVHDDTRTVPHANTLNDEIKEYLDCIYISPCESTWRIFGFPIHGRKPSIERLQFHLPRQHSVLYQDHDDIDDLLSNPSISKSKFIAWMNANQAFVEGQSLTYSEFVTKFVYNQKQRCWQLRKKGYTIGKLQWVPPTTGELFYLRMMLTVSRGPISFEDIRIVAGVEYPTYREARFAMGFFTG

SEQ ID NO: 187697 - protein, 92 aa, Glycine max
  Coding DNA Sequence Number=SeqID_70919
MKMTLLCLVLNQNISIKGLRLHCGNGSDKILPFYELMLNPTQFQAKEEKVQVADDSLSEPDPLSEWLLLSKAYNLLSGLGNPRRGSFRDVLA

SEQ ID NO: 187698 - protein, 133 aa, Glycine max
  Coding DNA Sequence Number=SeqID_70920
MGCYKKKGVKPFTIRVEHRQHKSPTPICGRKVTDKDMTKRDTICHAFMVTTVRSSVFRGRIRGRRCRVLVRGGGEVAMKARWFGFVMELQGHGGGVVSKRQQVSRWWYGFTVKQRVSLWSGGGKRDRERKLGL

SEQ ID NO: 187699 - protein, 167 aa, Glycine max
  Coding DNA Sequence Number=SeqID_70921
EGISSPCAEGSEVASRDRSGVAAATCLTCVSSASSLITNGSGMATISVNYSTEGIDPRGATTWAAEVDAGVGVAEVEGSSAGLALALLAPQIETVRSSGFQQFFLIAGNLSLEVLEWAIEIIWPEIIAPMFISKRETRPKISLALSTVKPEVCDVGAKLEYERTLHT

SEQ ID NO: 187700 - protein, 245 aa, Glycine max
  Coding DNA Sequence Number=SeqID_70922
MVSGGIIPFEKHIAAVRTTSNNMLSKRKTLAEGSLLSSKSETQHDHRFTFTPYAPMDSVMSPTVATYPSAGGRRRAHGCVFQERKMHGVATNVYLRKTSEKPERCGLRTLIVKGSGVVFMHGEDRRTTKNERRTVKNLHEIAHGNVSEAEVGAAQLSQASRVASIRRHRLLLEHPRRSKWSSEGCMPPNNGPRMKLGYDTREAFLWLWPIQGRKGCNYFECHNPIASSRQKRIIVALMNKGNAIY

SEQ ID NO: 187701 - protein, 80 aa, Glycine max
  Coding DNA Sequence Number=SeqID_70923
TNTLRCSALDPSLFWDSTPLGFTSTRSHLCYVRFASKADGIAHIDKASEITSDSEMQDNMRFTGKRVGEGMTRCGKSNIP

SEQ ID NO: 187702 - protein, 99 aa, Glycine max
  Coding DNA Sequence Number=SeqID_70924
MSILTLGSKKKRRKGNFQSKRKKRRGKEIPNQRVGERKKKRKKIPNQRMGESKKEGKKAPDQGSKENRRNVQKGLWTRQYLNNTELSPNEQKEGKETTT

SEQ ID NO: 187703 - protein, 115 aa, Glycine max
  Coding DNA Sequence Number=SeqID_70925
MPISPCRCIGWDRTHKTPSGPKEVQQGPGVSSSGYGPLPVLQGARSPNEESHPQRHQMDPEKSNRALGFPALVTGLCSPTGCPFPPARSRHHRDRACKTPSGLKEVQQGLGVVKL

SEQ ID NO: 187704 - protein, 338 aa, Glycine max
  Coding DNA Sequence Number=SeqID_70926
  Gene Ontology: Mol. function=acyltransferase activity; Biological process=metabolic process
  Homolog annotation: Hit_ID=Q8UIE2; Match level="QueryCoverage=55%, HitCoverage=70%, E-value=2e-73, Identity=79%"; Hit description=1 -acyl-sn-glycerol-3-phosphate acyltransferase
MHPRIGDSDRLHIHQLARNLFSRSGSRAEQRGFDGEHAVAIRGGAFGEQDDNLAIGHAAGDLAHLRAGAALLLALNEDAFLQPGKPAENRPVTHLRLGDEHHVGNAAQNEDVFPRGVINRQHQRFRALHIPVDVNADAQNMAGDAVPEARNAAAKPPVEGKAQQLQRQQDERDDQENDRNIGCPQPHHDGNARLLTGVSVFAGLQWHAVKFQPVIHELEAVFAGDLFLQGLDLGRMKFDDHAVLQVDQMIVMLFGHGFITRAAIAKIVTLDDAGILEQLHRSINGGNRDARIHGGGTAVKLLDIGVVRRFLKDTGDDAALVGHPHAALGTKLLQRFRK

SEQ ID NO: 187705 - protein, 76 aa, Glycine max
  Coding DNA Sequence Number=SeqID_70927
  Gene Ontology: Mol. function=4 iron, 4 sulfur cluster binding; Biological process=metabolic process
  Homolog annotation: Hit_ID=Q1MMB6; Match level="QueryCoverage=100%, HitCoverage=16%, E-value=5e-24, Identity=73%"; Hit description =Putative MiaB protein
  Pfam annotation: Domain name=UPF0004; Domain location=23-76; Score =23.6; E_value=9.1e-08; Accession=PF00919.10; Description =Uncharacterized protein family UPF0004
MTQETLGLDATPMIAPEGSNNRKVFIKTYGCQMNVYDSVRMSDALAKDGYVQTEDMGEADLVLLNTCHIREKAAEK

SEQ ID NO: 187706 - protein, 686 aa, Glycine max
  Coding DNA Sequence Number=SeqID_70928
  Homolog annotation: Hit_ID=Q9FFK6; Match level="QueryCoverage=95%, HitCoverage=86%, E-value=0.0, Identity=55%"; Hit description =Arabidopsis thaliana genomic DNA, chromosome 5, P1 clone:MJJ3
MLGALSNTQERITPTMRITLEPSSEPSPSRSQTPKEELQWVPLPKHPLFTAHGGATTAADSRNLLAWDGASRLYLWDSNNRCLHRLSLRLGDPDPSSVLAASPSKVLQADAVLDFDVRKISINRNRTAILLFGSETLSVMYLYGRASKKDVNLICRTITVGSQMYSTGGNDIRVLQALWYPYSDTHLGILSSDSVFRLFNFAVDPLQPEQEYYLQPVEPGRSRNASSLCPVDFSFGGDHLWDRFSVFILFMGLSMYFAQLFHLEDISKFVTVFSAYPQSLQMRRPVFAKAHAYALFDAPLVLQGPLRRVGQGGNEDSVGRSAECEGRAVSFLYNLVSKDSILVTAWSGGKLQIDALADEIQPVWSVGSPPRLRVDSHDQILGLAMICESIASSSLWKLDHNAWLGNSPPLLRLAIVDLALPQRAESGYIISLFIDTLMPERIYSLHDGRIDSIVLHFLPFTSQTNGKDDTMKTPSVHPVLNTCQSGFTSEPSLCGFVSLSDSFGYSWIVAITLSLECVVLEMKSWNLLLPVSIDMEKKTISSEGEPKERDIPTIISKELLRGTREVLVPQASPSLQSVAADSIEGRSTLHQYFKLFHETYVEYAHKVYLELKHHAPQLKKIINDQHSRLGDAQKKLLKIEEQEAILPKRIDRAIQTQFFGRALATFKELTLCSQKTTVQSRATVSI

SEQ ID NO: 187707 - protein, 55 aa, Glycine max
  Coding DNA Sequence Number=SeqID_70929
  Subcellular localization annotation: CTP_CleavageSite=38; ConfidenceScore=5.02e-01
MTLPLFQFDLSLLQPCRGRSVPFFSFQNYQRRADALTLSAKGRQIRLLWRCSTAP

SEQ ID NO: 187708 - protein, 216 aa, Glycine max
  Coding DNA Sequence Number=SeqID_70930
  Gene Ontology: Mol. function=structural constituent of ribosome; Cellular component=ribonucleoprotein complex; Biological process =ribosome biogenesis and assembly
  Homolog annotation: Hit_ID=Q307Z8; Match level="QueryCoverage=99%, HitCoverage=67%, E-value=1e-92, Identity=80%"; Hit description=P0 ribosomal protein-like
  Pfam annotation: Domain name=Ribosomal_L10; Domain location=6-110; Score=154.9; E_value=2.1e-43; Accession=PF00466.10; Description =Ribosomal protein L10
MARKLTKAQKKIAYDAKLCKLLDNYTQILVVAADNVGSNQLQNIRHGLRGDSVILMGKNTMMKRTIKIHAQNTGNTTILNLIPLLVGNVGLIFTKGDVKEVKEVVSKYKVAAPARVGLVAPIDVVVPPGNTGLDPSQTSFFQVLNIPTKINKGTVEIITPVELIMKGDKVGSSEAALLSKLAIRPFSYGLAVVSVYENGSVFSPEVLDLTEDDLVV

SEQ ID NO: 187709 - protein, 279 aa, Glycine max
  Coding DNA Sequence Number=SeqID_70931
  Gene Ontology: Mol. function=structural constituent of ribosome; Cellular component=ribonucleoprotein complex; Biological process =ribosome biogenesis and assembly
  Homolog annotation: Hit_ID=Q307Z8; Match level="QueryCoverage=96%, HitCoverage=100%, E-value=8e-79, Identity=60%"; Hit description=P0 ribosomal protein-like
  Pfam annotation: Domain name=Ribosomal_L10; Domain location=6-89; Score=20.5; E_value=4.4e-05; Accession=PF00466.10; Description =Ribosomal protein L10
MAVIPTKAEKKVSYDVKLCQLLEDYTQILVVAADNVGSNQLENIRKDLRGDSVCNLKEVSEEVARMSLRLRMTKGTRILTNIFLVAPARVGLVAPIDVVVPPGNTGLDPSQTSFFQINKGTVEIITPVELIKKGDKVGSSEAVLLSKLAIRPFSYGLVVVSVYDNGSFFSPEVLDLTEDDLIDKFSVAAPHMFGNAYKNVLAVAVATEYSFPEADKVKEYLKDPKYLLWLLLPHLLLILALLQLLPPRRRKRRKNQQKNLTMTWVSVCLIKLFKVIELV

SEQ ID NO: 187710 - protein, 579 aa, Glycine max
  Coding DNA Sequence Number=SeqID_70932
  Gene Ontology: Mol. function=anthranilate synthase activity; Cellular component=chloroplast; Biological process=tryptophan biosynthetic process
  Homolog annotation: Hit_ID=Q5XLF3; Match level="QueryCoverage=91%, HitCoverage=98%, E-value=0.0, Identity=67%"; Hit description =Anthranilate synthase alpha 1
  Pfam annotation: Domain name=Anth_synt_I_N; Domain location=106-263; Score=150.5; E_value=4.5e-42; Accession=PF04715.3; Description =Anthranilate synthase component I, N terminal region
  Pfam annotation: Domain name=Chorismate_bind; Domain location=323 -569; Score=420.8; E_value=1.9e-123; Accession=PF00425.8; Description= chorismate binding enzyme
  Pfam module annotation: Pfam domain module=Anth_synt_I_N::Chorismate _bind; Domain location=106-263::323-569
MAENGMFLARIQTPTPLELEELEAVVLTEFTKMLSATLPMSLTSAKAFSSRMVPFGHRLSPATLTGVSLSRSPLTLRCSPLSSTPSYVEEGAKFVEASKNGNLIPLCQCIFSDQLTPILAYRILVKEDDRESPSFLFESAEPSYHASSVGRYSVVGAQPTMEVVAKENKVTIIDHESGNLTEKIVDDPMMIPRKVSEGWKPYLINELPDAFCGYFSYDTVRYVEKKKLPFSNAPEDDRNLADIHLGLYENVIVFDHVEKKAYVILWVRVDRYSSAESAYKDGMERLEKLVAKLQDGQPPRLAPGSVDLHTHHFGPSLKKSSMTSEAYKEAVLQAKEHIKAGDIFQIARGCILVASSPEILTRIKKNKIVNRPLAGTAKRGKTPEEDARLEAILLRDEKQCAEHVMLVDLGRNDVGKVAKSGSVKVEKLMNIERYSHVMHISSTVTGELQDHLTSWDALRAALPVGTVSGAPKVKAMELIDELEVKRRGPYSGGFGYISFLGEMDIALALRTMVFPTGTRYDTMYSYKDVDQRHEWIAYLQAGAGIVADSVPDDEHQECQNKAAGLARAIDLAEAAFVDK

SEQ ID NO: 187711 - protein, 247 aa, Glycine max
  Coding DNA Sequence Number=SeqID_70933
  Homolog annotation: Hit_ID=Q2QV87; Match level="QueryCoverage=42%, HitCoverage=8%, E-value=5e-09, Identity=39%"; Hit description =Expressed protein
  Subcellular localization annotation: CTP_CleavageSite=66; ConfidenceScore=5.54e-01
MRDAIVTRGSAIAARGSTPSAVDNNAFLRSVAAATRHFFFFRALSSIHVSSWRVHCVGNKLGYWLCCEVNEKQTRLGFAVWGFEEFRVRVVWVLGMNRSFRAQESQMLAALKQREQQFGGLRASVMKEKEEELALFLEMKKREKERNDLLLNSSEEFDAPLGSNGGANPIFNISSSTPAPVRKTGVDDFLNSENDKNDYDWLLTPPGTPLFPSLEMESRKTVMSQLGTPTTRPVALKSRVSIFNEAF

SEQ ID NO: 187712 - protein, 617 aa, Glycine max
  Coding DNA Sequence Number=SeqID_70934
  Gene Ontology: Mol. function=anthranilate synthase activity; Cellular component=chloroplast; Biological process=tryptophan biosynthetic process
  Homolog annotation: Hit_ID=Q5XLF3; Match level="QueryCoverage=93%, HitCoverage=99%, E-value=0.0, Identity=69%"; Hit description =Anthranilate synthase alpha 1
  Pfam annotation: Domain name=Anth_synt_I_N; Domain location=110-267; Score=147.9; E_value=2.7e-41; Accession=PF04715.3; Description =Anthranilate synthase component I, N terminal region
  Pfam annotation: Domain name=Chorismate_bind; Domain location=327 -607; Score=561.7; E_value=7.1e-166; Accession=PF00425.8; Description= chorismate binding enzyme
  Pfam module annotation: Pfam domain module=Anth_synt_I_N::Chorismate _bind; Domain location=110-267::327-607
MKCYVTEAALEFEELEAVVVTEFAKMLSATLPVSLTSAKGSSLAFSRRMVPSGHRLSPATLTGVSLSRAPLTLRCSSLSNTPSYGKNDNWVVEEGRKFVEASKNGNLIPLCQSIFADQLTPVLAYRILVKEDDWEAPSFLLESAEPSYHASSVGRYSVLGANPTMEVVAKENKVTIIDHESGNLTEEIVDDPMVIPRKISEGWKPYLIDELPDAFCGYFSYDTVRYVEKKKLPFSNAPEDDRNLADIHLGLYENVIVFDHVEKKAYVILWVRVDRYSSAESAYKDGMERLEKLVAKLQDGQPPRLAPGSVDLHTHHFGPSLKKSSMTSEAYKEAVLQAKEHIKAGDIFQIVLSQRFERRTFADPFEIYRALRVVNPSPYMAYLQARGCILVASSPEILTRVKKNKIMNRPLAGTARRGKTPEEDARFEAILLRDEKQCAEHVMLVDLGRNDVGKVAKSGSVKVEKLMNVERYSHVMHISSTVTGELQEHLTSWDALRAALPVGTVSGAPKVKAMELIDELEVTRRGPYSGGFGYISFSGEMDIALALRTMVFPSGTRYDTMYSYKDVDQRREWIAYLQAGAGIVADSVPDDEHQECQNKAAGLARAIDLAESAFVDK

SEQ ID NO: 187713 - protein, 135 aa, Glycine max
  Coding DNA Sequence Number=SeqID_70935
  Gene Ontology: Cellular component=nucleus
  Homolog annotation: Hit_ID=Q8LE51; Match level="QueryCoverage=59%, HitCoverage=63%, E-value=1e-34, Identity=82%"; Hit description =Yippee-like protein
  Pfam annotation: Domain name=Yippee; Domain location=5-114; Score =48.0; E_value=3.1e-11; Accession=PF03226.5; Description=Yippee putative zinc-binding protein
MAEWHSRFFANCHRQFVKGAYLCGRILAFCHPPLITMMTRQLHYCYQFYELSSVNVSIGEMEDRPMMTGLHTVADIFCVGCGSIVGWKYETAYEKNQKYKEGKSVLERYKVSGPDGSNYWISNEAHVGGSDADDA

SEQ ID NO: 187714 - protein, 54 aa, Glycine max
  Coding DNA Sequence Number=SeqID_70936
  Subcellular localization annotation: CTP_CleavageSite=38; ConfidenceScore=5.61e-01
MDIQLNKLVQQWLLCQLCQHSSSRSPPSSSPSSSSSSSSAAGSSASRRGATACR

SEQ ID NO: 187715 - protein, 208 aa, Glycine max
  Coding DNA Sequence Number=SeqID_70937
  Gene Ontology: Mol. function=oxidoreductase activity; Cellular component=integral to membrane; Biological process=electron transport
  Homolog annotation: Hit_ID=Q42569; Match level="QueryCoverage=99%, HitCoverage=35%, E-value=1e-49, Identity=64%"; Hit description =Cytochrome P450 90A1
QSRAVHRRARGAVRVDLHDARVRRGDGVLGGSGGEPVHSAERREAVGLQLPRFDIEPAGKTLSSVDERWSPQENALSDDELGQFLHHQGSSSSPHRPPRLPQLGRLVQPRLSYGPGKKACDCDVRDGNGDGDSDSMVRYNVSNFLAHEPLHHVNLNEKITFELTVKQLMSFDPDEWTENLRKEYVLVIEGFFTLPFPLFSTTYRRAIK

SEQ ID NO: 187716 - protein, 271 aa, Glycine max
  Coding DNA Sequence Number=SeqID_70938
  Gene Ontology: Mol. function=DNA binding
  Homolog annotation: Hit_ID=Q6K709; Match level="QueryCoverage=71%, HitCoverage=71%, E-value=2e-47, Identity=52%"; Hit description=DNA -binding protein-like
  Pfam annotation: Domain name=DUF296; Domain location=85-202; Score =195.9; E_value=9.3e-56; Accession=PF03479.5; Description=Domain of unknown function (DUF296)
MANRWWTGNVGMIREQELMENSNNNNATTTPTNSSNSHTNAEHKHDRGRGSEPGSSGRRPRGRPPGSKNKPKPPIVITKESPNALRSHVLEITSGSDVAESIAAFANRRHRGVSVLSGSGIVANVTLRQPAAPAGVITLHGRFEILSLSGAFLPSPSPPGATGLTVYLAGGQGQVVGGTVAGSLVASGPVMVIAATFANATYERLPLEDEQGEEGMQVQQQQQQQQQQQSQGLGEQVSMPMYNLPPNLLHNGQNMPHDVLWGAPPRPPPSF

SEQ ID NO: 187717 - protein, 53 aa, Glycine max
  Coding DNA Sequence Number=SeqID_70939
MAGREDREKKAVFVYGGVEWYWVVSLGMKLPLCPGTCLVGQYFVAWWLERRVG

SEQ ID NO: 187718 - protein, 264 aa, Glycine max
  Coding DNA Sequence Number=SeqID_70940
  Gene Ontology: Mol. function=nucleic acid binding; Cellular component= intracellular; Biological process=regulation of transcription, DNA -dependent
  Homolog annotation: Hit_ID=Q3YK12; Match level="QueryCoverage=33%, HitCoverage=39%, E-value=2e-26, Identity=60%"; Hit description =SUPERMAN-like zinc finger protein
  Pfam annotation: Domain name=zf-C2H2; Domain location=56-78; Score =22.2; E_value=0.0019; Accession=PF00096.16; Description=Zinc finger, C2H2 type
MEESQYLLWIRRKQMLKSHIQQPFGTNNNSSSWEERAFAEDAARILGGCIWPPRSYSCNFCKREFRSAQALGGHMNVHRRDRARLKQSLSHHHNELALQHHHKNDCTVATSKVSSSRPSTISIQENCYHHQPTMSSYSSSIGWGHHHHNMGSSDSEPKEQVTAREEFLKGLGCNDFFETSLSVGQSAVVFGQKLPTTTDHSCGDEGISYKRSKTSMAPLPAVFLKPCSNDRNLTFQSAEFVLGVKPGMEDLDLELRLGKPQKVI

SEQ ID NO: 187719 - protein, 119 aa, Glycine max
  Coding DNA Sequence Number=SeqID_70941
  Gene Ontology: Mol. function=receptor activity; Cellular component =integral to membrane; Biological process=red or far red light signaling pathway
  Homolog annotation: Hit_ID=Q6R8G7; Match level="QueryCoverage=92%, HitCoverage=15%, E-value=3e-43, Identity=68%"; Hit description=PHO1 -like protein
  Pfam annotation: Domain name=EXS; Domain location=2-93; Score=56.9; E_ value=6.8e-14; Accession=PF03124.5; Description=EXS family
MECAGVDFSIFAAVASTYWDLVIDWGLLQKESKNRWLRDKLAVPHKSVYFIAMTVLNFKFSFLHKQALTTIVACLEIIRRGIWNFFRVENEHLTNVGKYRAFKSVPLPFNYEEDEDKEE

SEQ ID NO: 187720 - protein, 60 aa, Glycine max
  Coding DNA Sequence Number=SeqID_70942
  Subcellular localization annotation: CTP_CleavageSite=26; ConfidenceScore=5.21e-01
MANVGNKSDSNSSYSLHHFDHPGMVPSTHVQPLGNGASQSVAPKANNVNFSSGFDDEDDD

SEQ ID NO: 187721 - protein, 308 aa, Glycine max
  Coding DNA Sequence Number=SeqID_70943
  Gene Ontology: Cellular component=integral to membrane; Biological process=red or far red light signaling pathway
  Homolog annotation: Hit_ID=Q6R8G5; Match level="QueryCoverage=97%, HitCoverage=37%, E-value=2e-64, Identity=46%"; Hit description=PHO1 -like protein
MEVIEESSTHHEQSDDDGSNDDQEEQVKQTVKPKVEVQKLKNITGTRPTPLEVLDRVQFNHTHETPRSTIKGVLNFPGHAELNFSRKNLNKVEEQLKRSFIEFYRKLRLLKSYSKYFLMQITSRDAAKAYMKMVDNSHLGSSDEVTKLMDRVEKTFTKHFYNSNRNKAMSILRPKAKRERHRVTFSTGFLAGCTAALILALILIVRTRHILQTPGSTKYMDTLFPLNRITGRKSRYGLSEHVPSNHVQLSFLQSVWICSSTLADQGIELGYNHVLLLGFGLAVLALGGVLVNLDMQIDPQDKRLPNIY

SEQ ID NO: 187722 - protein, 69 aa, Glycine max
  Coding DNA Sequence Number=SeqID_70944
MKGPALKYTECVSPLRGAIITIHHANEVFADAESLRQCLAALTECCGQVWWGTPSCPGPALLPFVVTIV

SEQ ID NO: 187723 - protein, 283 aa, Glycine max
  Coding DNA Sequence Number=SeqID_70945
  Gene Ontology: Mol. function=phospholipase D activity; Cellular component=membrane; Biological process=phosphatidylcholine metabolic process
  Homolog annotation: Hit_ID=Q9C888; Match level="QueryCoverage=87%, HitCoverage=32%, E-value=5e-72, Identity=56%"; Hit description =Phospholipase D epsilon
MLKILQCCSSLVLLIFFFDQNWSFTTLTKCICANGNPAYVTIKIDSQKFAKTSQESNRVWNQTFQIQCAHPADSCITITLKTSRSSVLGKFHIQAQQLLKKGGLINGFFPLLMDNGKPNPKLKLKFQLWFKPAELEPSWAKMLSNDWEFQGLREATFPLRSNCHVKLYHDAHHSSAFQPPFDLCGAPKKLWEDVYKAIEGAKYLVYIAGWSFNPMMVLVRDPHTEIPHARGIKLGELLKKKAEEGVAVRVMLWDDETSLPFVKNKGELNNQDEEAFAYSTTQK

SEQ ID NO: 187724 - protein, 480 aa, Glycine max
  Coding DNA Sequence Number=SeqID_70946
  Gene Ontology: Mol. function=nucleic acid binding
  Homolog annotation: Hit_ID=Q5VMK2; Match level="QueryCoverage=61%, HitCoverage=96%, E-value=1e-49, Identity=39%"; Hit description=RNA -binding protein-like
  Pfam annotation: Domain name=RRM_1; Domain location=217-291; Score =4.8; E_value=0.051; Accession=PF00076.12; Description=RNA recognition motif. (a.k.a. RRM, R
  Pfam annotation: Domain name=RRM_1; Domain location=405-475; Score =35.5; E_value=1.8e-07; Accession=PF00076.12; Description=RNA recognition motif. (a.k.a. RRM, R
  Pfam module annotation: Pfam domain module=RRM_1::RRM_1; Domain location=217-291::405-475
MDPCRGVMICRPYSLQADQGRAGDAAAVEGNVQLPVAEGSRRRLAGGTIADSDQCVVFPHELRNGGAADSVSEPLVAPDLADRVPRPHGGVAVPLLPPRRAARGAGPPRRRPPRAGRHGGAHGGAAAAHRCHREHPRGGGGRGGGGGGARRVQEDGGFILGRTSTVLRRSPPSSSLQSFPGDHNRHSPPQTTALMAQPPFDPFYLYQHDEQSNINTLFVSGLPDDVKAREIHNLFRRRPGFDSCQLKYTGRANQVPFLLVVAFATFFNHQSAMAALHALNVSTVRVRNLVHVWFAIGNAAAHGVKFDPQTGSVLHIELARSNSRRKRKPGSGAYVVIDKRSKGEPDLQGSSSEDGDSDPDEPSDSGDNQGDLAIMTSDETAVGSDNAVSVEQHGKGSTGGLCSTLFIANLGPNCTEDELKQAFSAYTGFNMVKMRSRGGMPVAFVDFEETHQAAKVMEELQGSLLPSSDRGGMHIEYLLT

SEQ ID NO: 187725 - protein, 178 aa, Glycine max
  Coding DNA Sequence Number=SeqID_70947
  Gene Ontology: Mol. function=protein binding; Cellular component =cytoplasm; Biological process=chromosome segregation
  Homolog annotation: Hit_ID=Q9FI69; Match level="QueryCoverage=92%, HitCoverage=63%, E-value=8e-49, Identity=61%"; Hit description =Arabidopsis thaliana genomic DNA, chromosome 5, TAC clone:K19E20
  Pfam annotation: Domain name=Sld5; Domain location=17-177; Score =105.1; E_value=2e-28; Accession=PF05916.2; Description=Synthetic lethal mutants of dpb11-1 five
MASSSAAEGVSMDDDYETLIATTDVELLKRAWRNEKAAPEILRYESKLVSRVNKVIQLMEEIVEEKSSGGTDPLSVSLYQMDLDRTLFLLRSYLRIRIQKIEKYVFHIQKTEELRNRLSKYEKDFAKMCENDLEQHLDESVLSKLPKDYKSVLRQSSMSEEDDMVKFALPENHQSVMR

SEQ ID NO: 187726 - protein, 171 aa, Glycine max
  Coding DNA Sequence Number=SeqID_70948
MRVCGGFLERIGLMIFMFCSTISASEDESGEPLSEKHDVQALYPIHDLVNKIDWKRSKNQRYWTDDCLNSVAYLFMGTKKKDTGEEEQDATPVSTKDATPHVVETPVSSPSITNPVINREPIPENQQRELLKWILEEKRKVKAKDAEEKRKIDEEKALLKKLIRSKSIPSV

SEQ ID NO: 187727 - protein, 300 aa, Glycine max
  Coding DNA Sequence Number=SeqID_70949
  Gene Ontology: Mol. function=oxidoreductase activity; Cellular component=endoplasmic reticulum; Biological process=electron transport
  Homolog annotation: Hit_ID=Q9M066; Match level="QueryCoverage=94%, HitCoverage=53%, E-value=4e-65, Identity=55%"; Hit description =Cytochrome P450 90C1
MELLKKHFQEFISGLMSLPIKLPGTKLYQSLQAKKKMVKLVKRIILAKRSSGFCKVPKDVVDVLLSDANEKLTDDLIADNIIDMMIPGEDSVPLLMTLATKYLSECPAALQQLTEENMKLKKIQDQVGESLSWSDYLSLPFTQTVITETLRMGNIIIGVMRKALKDVEIKGHLIPKGCLSDGLVNFRTKIRAVAISLLLEGDKGCALALTWPGWKLPSSYTTLSLNSDTSLTSDNGSFTISQQVHDYTDIDRKNLFSLEKWHAEKDAIVNFPTVRMKKRMPVKPLLPKGTEQQFYEKYKM

SEQ ID NO: 187728 - protein, 458 aa, Glycine max
  Coding DNA Sequence Number=SeqID_70950
  Gene Ontology: Mol. function=phospholipase D activity; Cellular component=membrane; Biological process=phosphatidylcholine metabolic process
  Homolog annotation: Hit_ID=Q9C888; Match level="QueryCoverage=99%, HitCoverage=60%, E-value=1e-171, Identity=63%"; Hit description =Phospholipase D epsilon
  Pfam annotation: Domain name=PLDc; Domain location=4-41; Score=26.0; E_value=0.00013; Accession=PF00614.12; Description=Phospholipase D. Active site motif
MFPTLFAHHQKTITVDTKAPKSVGDRELMSFLGGLDLCDGRYDTEQHSLFQTLIRESHCYDFYQTSIEGASLNKGGPREPWHDAHACVTGEAAWDVLTNFEQRWTKQCDPSFLVPSSTLANLMPRTSSSTLMERNWKVQVYRSIDHVSVSELSTKLNVERSIHEAYVEAIRRAERFIYIENQYFIGGCHWWKKDRHSGCTNLIPIEIALKVVSKIKAKERFAVYIVIPMWPEGEPESEPVQDILHWTRETMTMMYRLIGEAIQESGEPAHPRDYLNFFCLANREQKGQGEYLPLDSPQPETQYWNAQKNRRFMVYVHSNFMIANVNQRSMDGKRDTEIAIGCYQSQDGDDDTNQVNLDDIQAYRMSLWYEHTVSVDELFLEPQRLECVERMRSIGDEMWEIYSSEEIVDMEGVHLVTYPVRVTQEGYVKNLTDGVHFPDTNSLVKGKRSKILPPIFTT

SEQ ID NO: 187729 - protein, 225 aa, Glycine max
  Coding DNA Sequence Number=SeqID_70951
  Gene Ontology: Mol. function=transferase activity, transferring glycosyl groups; Cellular component=membrane
  Homolog annotation: Hit_ID=O80941; Match level="QueryCoverage=93%, HitCoverage=40%, E-value=2e-63, Identity=50%"; Hit description =Putative zinc finger protein
  Pfam annotation: Domain name=DUF604; Domain location=1-225; Score =383.7; E_value=2.9e-112; Accession=PF04646.3; Description=Protein of unknown function, DUF604
MAFGGGGFAISYALATQLAKIMDGCLSRYFFFYGSDQRVWACIHEIGVPLTRENGFHQFDIRGNPYGFLAAHPLVPLVSLHHLDQLSSLFPNQTQINSMKKLISAYHIDPARIVQQIICYDHKRGWSISISWGYTIQIYTALLIAADLQMPLQTFQTWRSSMNGPFIFNTRPMSSDPCQQPTMFFLDQATKVGKSGSITIYKRHEGNESKCLRSGTNNLALQRIR

SEQ ID NO: 187730 - protein, 394 aa, Glycine max
  Coding DNA Sequence Number=SeqID_70952
  Gene Ontology: Mol. function=ATP-dependent helicase activity; Cellular component=nucleus; Biological process=mRNA catabolic process, nonsense-mediated decay
  Homolog annotation: Hit_ID=Q9C718; Match level="QueryCoverage=88%, HitCoverage=62%, E-value=1e-141, Identity=73%"; Hit description=DEAD- box ATP-dependent RNA helicase 20
  Pfam annotation: Domain name=DEAD; Domain location=184-355; Score =249.2; E_value=8.8e-72; Accession=PF00270.19; Description=DEADDEAH box helicase
  Pfam annotation: Domain name=ResIII; Domain location=180-350; Score= -28.1; E_value=0.01; Accession=PF04851.6; Description=Type III restriction enzyme, res subunit
  Pfam module annotation: Pfam domain module=DEAD::ResIII; Domain location=184-355::180-350
MGNYDSQPEILRKLKMILRISFHISLYFTILNSMLSRTVEWSNPSDSGLGAPTGFGGSVQHSSSNRRDYDDGGSPKRNLSLDGLPHFEKNFYIESPAVRAMTDAEVNEYRQQREITVEGRDIPKPVKTFHDAGFPVFLCTFFSLKYMTLLFITLFCTKLCQELPWFNPEYVLQEITKAGFTEPTPIQSQGWPMALKGRDLIGIAETGSGKTLAYLLPAIVHVNAQPILNPGDGPIVLVLAPTRELAVQIQQETTKFGASSRIKSTCIYGGVPKGPQVRDLQKGVEIVIATPGRLIDMLESNHTNLQRVTYLVLDEADRMLDMGFDPQLRKIVSQIRPDRQTLYWSATWPKEVEQLARKFLYNPYKVIIGSSDLKANHAIRQYVDIVSEKQKYDK

SEQ ID NO: 187731 - protein, 1473 aa, Glycine max
  Coding DNA Sequence Number=SeqID_70953
  Gene Ontology: Mol. function=ARF guanyl-nucleotide exchange factor activity; Cellular component=intracellular; Biological process =regulation of ARF protein signal transduction
  Homolog annotation: Hit_ID=Q42510; Match level="QueryCoverage=97%, HitCoverage=98%, E-value=0.0, Identity=70%"; Hit description=Pattern formation protein EMB30
  Pfam annotation: Domain name=Sec7; Domain location=564-751; Score =377.2; E_value=2.6e-110; Accession=PF01369.11; Description=Sec7 domain
MGHLKMQMQTGLNPTEDEYMQCDAGYPNKTTIVCMINAEIGAVLAVMRRNVRWGVHYMSDDDQSEHFLVQSLKKLRRQVFSWQNQWHAINPALYLQPFLDVIRSDETSAPITGVALSSVYKILTLDVIDQHTVNVGDTMHLVVEAVTSCRFEVTDPGSEEVVLMKILQVLLACVKGKASVMLSNQHICTIVNISFRIVHQAGTKGELLQHIARYTMHELVRSIFSHLQNIDNTESAFINGTATLKQETNGLNNEHALASGQLENGRLNSARDAQPLSTGIASSTATDVTAVVIDENTAIASSGNEIDPQELQLLTEPYGVPCMVEIFHFLCSLLNVAEHMGVNPRSNTIAFDEDVPLFALNLVNTAIELGGPSFRCHPRLLSLIQDELFRNLMQFGLSMSPLVLSMVCSIVLNLYHHLRTELKLQLEAFFSCVILRLAQRKYGASYQQQEVVMEALVDFCRQKTFMVEMYANFDCDISCSNVFEDIANLLSKSAFPVNNPLSSIHVLALDGLIAVMQGMAERIGSRSLSSEQSPVNFVEYTPFWMEKCDSFGDPNDWVPFVRRRKYIKRRLMIGADHFNRDDKKGLEFLQGTHLLPIKLDPHSVACFLRYTAGLDKNLIGDFLGNHDELCVQVLHEFARTFDFRDMTLDTALRVFLETFRLPGESQKIHRVLEAFSERYYEQSPHILANKDAALVLSYSIILLNTDHHNMQVKKKMTKEDFIRNNRHINDGSDLPREFLSEIYHSICKNEIRTTPEPGFGFPEMTPSRWISLMHKSKKTAPFIVSDSRAYLDYDMFLLLSGPTIAAISVVFDNAENEEVYQTCMDGFLAVAKISAYYHLENVLDDLVVCLCKFITILDPLSVEESVLAFGDDTKARMATETVFTIANRYGDYIRTGWRNILECILIFHKLGLLPTWLASDAADESHVTTETGHGRSNSNSLSSTHLQYITPKRPFGLISRFSQLLYLGAEEAGSIPTEEQLVAHQQATQAIHKCHIDSVFTESKFLQAESLLHLAKALISAGAQHLKGSRISEDEVTSVFCLELLVTITLNNRDRVGLLWKDVYEHISNIVQSTVMPCALVERAIFGLLRICHRLLPYKENITDELLRSLLLVLKLDAQVADAYYEQITQEVNRLVKENASHIRSQSGWRTISSLLSITARHLEASGAGFDALIFIMSDGAHLLPANYVLCVDVARQFAESRVGLVDRSIVALDLMAGSVNCLEKWSNNAKKAVKEDEVEKMLQDIGEMWFRLVQGLRKVCLDQREEVRNHAVLSLQQCLTGAVGTHIPRKLWLTCFDQVIFTVLDDLLEIAQAHSQKDCRNIEGTLVISLTLLSKVFVQLLQELLQLEAFCKLWEGMLSRMEKCVKMKIRGRRSEKLQELVPDLLKNTLLVMKAGGILVHSSGSGDNSLWELTWQHTKNIGPSLQSEVFPEQDSEQLQIQHKQIEPVGSLGPDANISVPSNEKVGQDGAMIS

SEQ ID NO: 187732 - protein, 524 aa, Glycine max
  Coding DNA Sequence Number=SeqID_70954
  Gene Ontology: Mol. function=ARF guanyl-nucleotide exchange factor activity; Cellular component=intracellular; Biological process =regulation of ARF protein signal transduction
  Homolog annotation: Hit_ID=Q42510; Match level="QueryCoverage=99%, HitCoverage=35%, E-value=0.0, Identity=68%"; Hit description=Pattern formation protein EMB30
MGRLKLQAGINAIEEEEPEECDAAYPNKTTLACMINSEFGAVLAVMRRNVRWGGRYMSGDDQLEHSLIQSFKTVRRQIFLWHHHQWQAINPSLYLQPFLDVIRSDETGAPITGVALSSVYKILTLDVIDHNTVNVEDAMHLVVDAVTSCRFEVTDPSSEEVVLMKILQVLLACMKSKASIMLSNQHVCTIVNTCFRIVHQAGSKEVGNTDHALVNGSTNLKQELVGKKFIQRGIGAGERTILFITGGLDNEYAFGSRQLENGSMTSEYDNQSLSTNSAPNDASVVKATVMDKNTAITISGKEGGPYDMHLMTEPYGVPCMVEIFHFLCSLLNVVEHTGMGPRSNTLAFDEDVPLFALNLINSAIELAGPSICRHPRLLNLIQDELFHNLMQFGLSMSPLILSMVCSIVLNLYRHLRTELKLQLEAFFSCVILRLAQSRYGASYQQQEVAMEALVDFCRQKTFMVDMYANFDCDITCSNVFEDLANLLSKSAFPVNCPLSAMHILALDGLIAVIQGMAERIANGS

SEQ ID NO: 187733 - protein, 183 aa, Glycine max
  Coding DNA Sequence Number=SeqID_70955
  Gene Ontology: Mol. function=pyridoxal phosphate binding; Biological process=biosynthetic process
  Homolog annotation: Hit_ID=Q1S2I5; Match level="QueryCoverage=71%, HitCoverage=28%, E-value=4e-50, Identity=59%"; Hit description=MATH
  Pfam annotation: Domain name=MATH; Domain location=44-176; Score =12.6; E_value=0.0073; Accession=PF00917.16; Description=MATH domain
  Subcellular localization annotation: CTP_CleavageSite=58; ConfidenceScore=5.13e-01
MGTRLWLQGPTPSQRTVKVVATTVKDQDQANGLRLSSIGLSLCFPYFSFSLIGKLRVCASRVGDFRLANVLAWQIFYRLIVYPRGQSQPPCNLSMFLEVIDSRNTSSDWSCFVSHHLSVVNQRMEDKFDFKESQNRYSKAAKDWGWCEFVTLTSLFDQDLGFLVHDTVILSAEVLILKETSIM

SEQ ID NO: 187734 - protein, 55 aa, Glycine max
  Coding DNA Sequence Number=SeqID_70956
MANSSIYSTYYKKICTSMSKFGAPGHALWGIFWATVNMKAYCPIVRVEPLVLVSC

SEQ ID NO: 187735 - protein, 244 aa, Glycine max
  Coding DNA Sequence Number=SeqID_70957
  Gene Ontology: Mol. function=sequence-specific DNA binding; Cellular component=nucleus; Biological process=regulation of transcription, DNA-dependent
  Homolog annotation: Hit_ID=Q1S285; Match level="QueryCoverage=97%, HitCoverage=100%, E-value=6e-92, Identity=70%"; Hit description =Homeobox domain, putative
  Pfam annotation: Domain name=Homeobox; Domain location=95-156; Score =59.0; E_value=1.6e-14; Accession=PF00046.19; Description=Homeobox domain
MKVHQFARGFWEHEPSLTLGCKRLRPLAPKLSNTDDTISPPHHHPVTTLDLKSFIKPQSASRKLGIGSSSDDNNNNNNKRDPSSPHGQVETHIPGGTRWNPTQEQIGILEMLYRGGMRTPNAQQIEQITAQLSKYGKIEGKNVFYWFQNHKARERQKQKRNNLGLAHSLRTTPTTIVSHPFSCSVITTLDTTKRGEIVEREEEDSPLKKCRSWAFEYLEDQREEEHRTLELFPLHPEGRRRGLF

SEQ ID NO: 187736 - protein, 266 aa, Glycine max
  Coding DNA Sequence Number=SeqID_70958
MVRSLSATYTVQEIQQWREARKKNHPFNNNIQKKHSECPKDSKAINREVLQRELKEVLAKQAELGVEVAEIPSYYLKNSDNQGLQSEAKNKYTDKRKFQNKFNKKSDRKGRFAEKQKFADKDFSESPSLKKRKPTLLQKLLSSDVKRDKSHLLQVLRFMVMNSFFRHIPDKALRYPSVEVKEKGSEVSGEKKHLHTGKDVLNRGSEETVQKIVIFNNDNGHDCDDDENDSIVDNNLHKDPSSLVKRQCDGGEGIKKSDEEEGEILE

SEQ ID NO: 187737 - protein, 50 aa, Glycine max
  Coding DNA Sequence Number=SeqID_70959
MGDMGSHIEQSITIWKWCNAKRKGLWVKWSWWWWLGGGTMVALGGGNSGV

SEQ ID NO: 187738 - protein, 78 aa, Glycine max
  Coding DNA Sequence Number=SeqID_70960
  Homolog annotation: Hit_ID=Q9LJ20; Match level="QueryCoverage=73%, HitCoverage=7%, E-value=1e-09, Identity=53%"; Hit description =Putative subtilisin-like protein
MHSMFRSHYGKFVVQQDVMVPGTGILAAMIPKSSEQGSVPIGKKPSLFGIKSAASMACPHVTAAVALIKSDMKNGVLQ

SEQ ID NO: 187739 - protein, 1413 aa, Glycine max
  Coding DNA Sequence Number=SeqID_70961
  Gene Ontology: Mol. function=motor activity; Cellular component =myosin complex; Biological process=protein amino acid phosphorylation
  Homolog annotation: Hit_ID=Q84KJ4; Match level="QueryCoverage=98%, HitCoverage=93%, E-value=0.0, Identity=60%"; Hit description=Myosin XI
  Pfam annotation: Domain name=DIL; Domain location=1314-1408; Score =104.2; E_value=3.8e-28; Accession=PF01843.9; Description=DIL domain
  Pfam annotation: Domain name=IQ; Domain location=679-699; Score=23.3; E_value=0.00089; Accession=PF00612.17; Description=IQ calmodulin -binding motif
  Pfam annotation: Domain name=IQ; Domain location=702-722; Score=7.4; E_value=6.7; Accession=PF00612.17; Description=IQ calmodulin-binding motif
  Pfam annotation: Domain name=IQ; Domain location=727-747; Score=26.2; E_value=0.00011; Accession=PF00612.17; Description=IQ calmodulin -binding motif
  Pfam annotation: Domain name=IQ; Domain location=750-770; Score=19.9; E_value=0.0094; Accession=PF00612.17; Description=IQ calmodulin -binding motif
  Pfam annotation: Domain name=Myosin_head; Domain location=1-594; Score=847.9; E_value=5e-252; Accession=PF00063.11; Description =Myosin head (motor domain)
  Pfam module annotation: Pfam domain module=DIL::IQ::IQ::IQ::IQ::Myosin _head; Domain location=1314-1408::679-699::702-722::727-747::750 -770::1-594
MYVHSLTKIIICSKMINEETSQSILVSGESGAGKTESTKMLMHYLAFLGGRAATEGRSVEQQVLESNPVLEAFGNAKTVRNNNSSRFGKFVEIQFDQKGRISGAAIRTYLLERSRVCQVSDPERNYHCFYMLCAAPQEDVDKYKLGNPRKFHYLNQSNCIELDGLDDSKEYLATKRAMEVVGINSDEQDAIFRIVAAVLHLGNIEFVKGGEDETDSSQPKDEKSHFHLKIAAELLMCDEKSLEDSFCKRVMVTRGDTITKSLDPNAAALSRDALAKIVYSRLFDWIVDKINNSIGQDPDSTNLIGVLDIYGFESFKTNSFEQFCINLTNEKLQQHFNQHVFKMEQEEYTKEEIDWSYIEFVDNQDVLDLIEKKPGGIIALLDEACMFPRSTHETFAEKLYQTFKDNKRFSKPKLSRTDFTINHYAGDVTYQTDFFLDKNKDYVVPEHAALLSNSKCPFVSGLFPPLPEETTKSTKFSSIATQFKLQLQSLLETLNATEPHYIRCVKPNNLLKPGMFENNNVLQQLRCGGVMEAIRISCAGYPTRKNFDEFVQRFTILEPNVLKACPDEMTACKRLLDRANLKDYQIGKTKVFLRAGQMAELDACRAEVLGRSASIIQRKLSAIELQRVARGINYVNPLGMFMVVYYVINERLNSDCTCLFYEFTIGQLARHQYECMRREAASLIIQKNFRMHISRNAYKTIYAPAIYIQTGMRGMAARNDLRFRKRTQAAIVIQGHYRGYSARTYFKKLKKSAIAAQCSWRRTLARRELRKLKMAAKESKALEAAKNNLEIQVKELTSCLETEKRMREAKTQENEKLQHALQEMELQLQEIEEAKKQENEKLQHALQEMELQFQETKAALIQEREAAKKVAEQTPTTQENPVNVVDSELINKLTTENEQLKELVNSLEKKSVQEFPVNVTDNELINKLSSENEHLKELLNSSENKTIQEFPVNVTDNEVISKITTENEHLKDQVNSLERKIDEAERKYEECNRVSEERMNQIIETESKMIETKTNMQRLEEKLSDMETENQVLRQQALLSSSSRRMSGKLAPATTPPLENGHQALQGSVSSKTFGAEDKVRRSIMERHQESVDALFKCVTKDLGFSEGKPVAAFTLYNCLLHWKSFEAEKTSIFDRLIQLIGSELEIRVIHGSLIWSHKVFHLTFLQDPDNNDCMAYWLSNTSSLFFHLQRCLRVPTTRKPPTPTSFFGRMTQGFRSSNSLSSNAFDVEHQVDAKYPALLFKQQLAAYVEKIYGIIRESFKKDLSPPLSSCTKADKTSNDSSQPSGSWNSIIECLNRYLKILKENYVPPVLVQKLFSQIFQYINMKLFNSLLLHRECCTSKSGEQIRSGLAELELWCTEATEEYVGSSFNELKHAKQAVRFLVALKKEELSYDDLTNDLCPVDDAHEESRSVT

SEQ ID NO: 187740 - protein, 135 aa, Glycine max
  Coding DNA Sequence Number=SeqID_70962
  Homolog annotation: Hit_ID=Q8RYE8; Match level="QueryCoverage=66%, HitCoverage=5%, E-value=2e-17, Identity=52%"; Hit description =Putative myosin heavy chain
MEDISDLKDEEEEGTKREKNKPRARIKNTYKPIICKASGFNVLSAQQLYRICTLYSDDDDDNKQSVSTDVTTRLKLLMTDDADEDDKSFLLEDNTSHPIIVEEISTSALDKTIPKIKPPAELLENANFQFLHDYC

SEQ ID NO: 187741 - protein, 263 aa, Glycine max
  Coding DNA Sequence Number=SeqID_70963
  Gene Ontology: Biological process=cell wall catabolic process
  Homolog annotation: Hit_ID=Q9FN43; Match level="QueryCoverage=89%, HitCoverage=61%, E-value=1e-39, Identity=42%"; Hit description =Genomic DNA, chromosome 5, P1 clone:MYJ24
MCNLGLLDRLELKERHGNYDHSPPSQAHHDLLDSFESLRIKSSERKVSPAMNSLQGYYGLKGTPSPSEDGPFPRNLPMSDRRLSRHRKSRSLVNVILEEIMQKSDDAPAAETREINSNKWNDKLGQGHQKSVADFTRIPELLLREDNSSSGVLSSRIGKGLALRQKAANRTAATIDSEPIGLNPAVLGMGDTSLNDGSYGVRKSSSTSCLQDQDTSGSSSIWPTSMWSLKPDLQALSSAAIGKPIFDGLPKPITGRKNKAALD

SEQ ID NO: 187742 - protein, 111 aa, Glycine max
  Coding DNA Sequence Number=SeqID_70964
  Gene Ontology: Mol. function=transcription regulator activity; Cellular component=nucleus; Biological process=regulation of transcription
MKIEVGLGGVWNEEEKATVVEVLGRGAFDYLVANSISNENLLTAVGSGQNLKNKLSDFVERRTSVGTTSSSEMFFLASMYFSFPWGLGGLEVEARRGPEDWSEERPDLRDG

SEQ ID NO: 187743 - protein, 208 aa, Glycine max
  Coding DNA Sequence Number=SeqID_70965
  Homolog annotation: Hit_ID=Q9FMY4; Match level="QueryCoverage=31%, HitCoverage=27%, E-value=6e-08, Identity=45%"; Hit description =Arabidopsis thaliana genomic DNA, chromosome 5, P1 clone:MKD15
  Subcellular localization annotation: CTP_CleavageSite=41; ConfidenceScore=5.66e-01
MAKPKGSSKPKTSIFLCCFGSSSRSSKESSPTKGSYDPIISKMKKKSTSTSWFSWRRIRLINKNSATYKTVPLEASNISDNHAHYSKSKSKSTLHHKPQAPATNPPRPPSPQPAPVPAHRKGPVVGVSVVVVTLVIMLFWGRLCAILCISVWLYCTRRFRKNDEDLQRRKSKRVDLDLDLDSEEYKKKVIMEGLLGRNHRPILSTPIR

SEQ ID NO: 187744 - protein, 381 aa, Glycine max
  Coding DNA Sequence Number=SeqID_70966
  Gene Ontology: Mol. function=monooxygenase activity; Cellular component=membrane; Biological process=electron transport
  Homolog annotation: Hit_ID=Q1S8Q5; Match level="QueryCoverage=98%, HitCoverage=66%, E-value=1e-166, Identity=75%"; Hit description=E -class P450, group I
  Pfam annotation: Domain name=p450; Domain location=1-367; Score=23.1; E_value=5e-12; Accession=PF00067.12; Description=Cytochrome P450
MFRNLTAESLFELVHKRLLPLLESCVNKSRVIDLQDILLRLTFDNVCMIAFGVDPGCSQPHLPEIPFATAFEDATETSMRRFITPVWMWKFMRYLDVGAEKRLRESIEKVDEFAESVIRTRKKELALQHEKSDLLTVFMRLKDENGMAYSDRFLRDICVNFILAGRDTSSVALSWFFWLLHKNPKVEERILAEICRVVMRHREGLKKEEVAGNCIAFRPEEIKKMDYLHAALSEALRLYPSVPVDHKEVVEDVTFPDGTVLQKGTKVMYSIYTMGRMESIWGKDCKEFKPERWLRDNGHFMSESAYKFTAFNGGPRLCLGKDFAYYQMKYAAASIIFRYHVKVLENHPVVPKLALTLYMKHGLKVNLQRRDASEIEKYFKV

SEQ ID NO: 187745 - protein, 126 aa, Glycine max
  Coding DNA Sequence Number=SeqID_70967
MDETLEASNATIADEVEHNAIEPASKQSTTSNEATSKDTGELDVIIIYSTILGLAPLNYGQPTIVIGEQVLVMIGKFVVAPIPIPQHPPAHQPLEPPPPLEVGKQAQVHGLAHKANSPHGPQTKIF

SEQ ID NO: 187746 - protein, 201 aa, Glycine max
  Coding DNA Sequence Number=SeqID_70968
DIPHQWTQLYRAARRLIAAGMNDYIRLETMSSFPEAERWLELIGFEYEGTMRRAGPDGEDAKMYSIVRDRDAGYTAARNSNYNAALLDQQAASVALQTGSQTSQIRRQGSQALAGQSASFADNGTGSGGSNALIQRSTAIDTEMDATTADYNGRQQMAELQNQAAAQRAQAKAQRPGLVSLLGGVSSAAGSYYNTSALTKR

SEQ ID NO: 187747 - protein, 234 aa, Glycine max
  Coding DNA Sequence Number=SeqID_70969
  Homolog annotation: Hit_ID=Q1S062; Match level="QueryCoverage=95%, HitCoverage=80%, E-value=8e-16, Identity=27%"; Hit description =Arabidopsis conserved protein
  Pfam annotation: Domain name=DUF241; Domain location=4-231; Score =172.4; E_value=1.2e-48; Accession=PF03087.5; Description=Arabidopsis protein of unknown function
MAPLDFVALKDLHNSANNLLHSPIVQQAIVHQTEEKWFDDVSESSLRMLEVCGISKDVLLLVKEHLQELQFTFRRASIGDPGIEEKIAAYNCYRKKLKKETLKWLKWLKKGMKSQTATMHPPMFNEQKLVLVVDVLREVRMTSICIVESLLSLVSSPWLDTKSGKLRSFTSKLVRVSLHCCSDDMIYYDAMVLQSENKRLAGVRMAIEDLEVELECMFRRLIHTRVLLLNILTK

SEQ ID NO: 187748 - protein, 348 aa, Glycine max
  Coding DNA Sequence Number=SeqID_70970
  Gene Ontology: Mol. function=binding; Cellular component=nucleus; Biological process=mRNA editing
  Homolog annotation: Hit_ID=Q6K2P5; Match level="QueryCoverage=99%, HitCoverage=83%, E-value=5e-73, Identity=30%"; Hit description =Putative pentatricopeptide (PPR) repeat-containing protein
  Pfam annotation: Domain name=PPR; Domain location=174-208; Score =44.5; E_value=3.5e-10; Accession=PF01535.11; Description=PPR repeat
  Pfam annotation: Domain name=PPR; Domain location=209-242; Score=7.0; E_value=1.1; Accession=PF01535.11; Description=PPR repeat
  Pfam annotation: Domain name=PPR; Domain location=27-61; Score=32.7; E_value=1.3e-06; Accession=PF01535.11; Description=PPR repeat
  Pfam annotation: Domain name=PPR; Domain location=275-309; Score=8.0; E_value=0.84; Accession=PF01535.11; Description=PPR repeat
  Pfam annotation: Domain name=PPR; Domain location=89-123; Score=34.8; E_value=3e-07; Accession=PF01535.11; Description=PPR repeat
  Pfam module annotation: Pfam domain module=PPR::PPR::PPR::PPR::PPR; Domain location=174-208::209-242::27-61::275-309::89-123
MVAGLLKNGRVEDARALFDRMPVRNVVSWNAMIMGHAQNRRLHEALELFQGMPERDMHSWNTMITGFIQNGKLNYAEKLFGEMREKNAITWTAMMMGYVQHGLSEEALKVFNKMLANDGLKPNTGTFVTVLRACSDLAGLTEGQQIHQMISKTVFQDSTYVMFDDGLLSQRDLISWNGMIAGYAHHGYGKEAINLFNEMQELGVCANDVTFVGLLRACSHTGRLKEAFNIIEGLGKESPLTVWGVLLARCNVHGNVDIGKLVAKKILKIEPQNAGTHSLLSNMYASVGKWKEAANIRMKMNDKGLKKQPGYSWIEVGNTVQVFVVDDKSRSQYELLGHLLHGLRTEMK

SEQ ID NO: 187749 - protein, 148 aa, Glycine max
  Coding DNA Sequence Number=SeqID_70971
MGQLQRQAFRKAYGIRPPKASRKWGGRNTEKIFGAIDAFLAYHNHKESPVVAMLADLYDTFDRGCEKSSARIVCCALALYVWLVSHLFLQEGRPVYPLQGHRSCIEKGKANWDQLLASMEGRLLICSLARRKQESGFYLHAKDVQMFP

SEQ ID NO: 187750 - protein, 152 aa, Glycine max
  Coding DNA Sequence Number=SeqID_70972
MQPLPQGLLRSLLAVQVLKSQWPFALTWPIFQSPDHKLSSKLYKENSIESKKNPLTKKKQLSIECPASASDRHRLEGNIRTDNSLLSHNRTRKLIKLKFLIGISSTRIRQWIQLNRDPTKVLTNRLEGTITTTNKNHGCTAALQVEMKSYQK

SEQ ID NO: 187751 - protein, 57 aa, Glycine max
  Coding DNA Sequence Number=SeqID_70973
MESKVQVGVDSISGTEAANTGVSRNSGANSKPQGFCLKTTSEGAKLSWQYALIQIVL

SEQ ID NO: 187752 - protein, 585 aa, Glycine max
  Coding DNA Sequence Number=SeqID_70974
  Gene Ontology: Mol. function=transporter activity; Cellular component= integral to membrane; Biological process=transport
  Homolog annotation: Hit_ID=Q1SCJ5; Match level="QueryCoverage=99%, HitCoverage=100%, E-value=0.0, Identity=75%"; Hit description=Major facilitator superfamily MFS_1
  Pfam annotation: Domain name=MFS_1; Domain location=193-552; Score =208.7; E_value=1.4e-59; Accession=PF07690.6; Description=Major Facilitator Superfamily
  Pfam annotation: Domain name=Sugar_tr; Domain location=189-584; Score= -127.9; E_value=0.0072; Accession=PF00083.14; Description=Sugar (and other) transporter
  Pfam module annotation: Pfam domain module=MFS_1::Sugar_tr; Domain location=193-552::189-584
MALGGLVSNRNFTCFIGPGSVYQLGKDLSPQRGGISCAFVARYGGQIAKDPFSRCWHGMCFHAKEPLNEKVSKPIPTFHDEVQHCSPLSQKSIHCMNMKLKASRRCQYFLSSDPYSSSLIQQRAVYGLGLNKLGKANTARVHYKSEEHDITEAKVDPLESTEGTGESILLEGNVPQVSSWWQQFPKRWVIVLLCFAAFLLCNMDRVNMSIAILPMSQEFNWNSATVGLIQSSFFWGYLLTQILGGIWADKIGGKLVLGFGVVWWSMATVLTPIAARIGLPCLLIMRAFMGIGEGVAMPAMNNMLSKWIPVSERSRSLALVYSGMYLGSVVGLAFSPLLIQKFGWPSVFYSFGSLGSIWFALWLRKAYSSPKDDPDLGVEEKRLILEGNVSNAPVSSIPWKLILSKAPVWALIISHFCHNWGTFILLTWMPTYYNQVLKFNLMESGLLCVLPWLTMAAFANIGGWIADTLIMQSIGFLGPAFFLSQLSHVRTPAMAVLCMACSQGSDAFSQSGLYSNHQDIGPRYAGVLLGLSNTAGVLAGVFGTAATGFILQRGSWNDVFKVAVALYIIGTLVWNVFSTGEKVLD

SEQ ID NO: 187753 - protein, 391 aa, Glycine max
  Coding DNA Sequence Number=SeqID_70975
  Gene Ontology: Mol. function=nucleic acid binding; Cellular component= intracellular; Biological process=defense response signaling pathway, resistance gene-dependent
  Homolog annotation: Hit_ID=Q9C801; Match level="QueryCoverage=98%, HitCoverage=84%, E-value=2e-77, Identity=43%"; Hit description =Protein MOS2
  Pfam annotation: Domain name=G-patch; Domain location=90-134; Score =33.6; E_value=6.8e-07; Accession=PF01585.13; Description=G-patch domain
  Pfam annotation: Domain name=KOW; Domain location=154-186; Score =12.5; E_value=0.62; Accession=PF00467.19; Description=KOW motif
  Pfam annotation: Domain name=KOW; Domain location=331-364; Score =13.0; E_value=0.55; Accession=PF00467.19; Description=KOW motif
  Pfam module annotation: Pfam domain module=G-patch::KOW::KOW; Domain location=90-134::154-186::331-364
MKNLHLPTAADAESLAFELHTDGDQPESDISYGLNVRADKNPEGNNKDDSDGAAPRRRVPLEATALQKLKSDLERLPEDQGMEEFKDVAVEGYGAALLAGYGWKEGMGIGRNAKEDVKVVEIKRRTAKEGLGFVGDAPAALVLSNNEKDNKKKEKKEKVVRIVGGRDAGLKGSVVSRIGDDYLVLELSRSGEKVKVKVKVGDVAELGSKEEERCLRKLKELKTQREDKVSKSKRGRDEVEEKRGDVNRRKEKRVDVGRKEERRVVDHRKVSWLTSHIRVRVISRDLKGGRLYLKKGEVLDVVGPTTCDISMDENREIVQGVSQDVLETVIPKRGGPVLVLAGKYKGVYGSMAERDLDQETAIVRDADTHELLNVKLEQIAEYIGDPSLLGH

SEQ ID NO: 187754 - protein, 276 aa, Glycine max
  Coding DNA Sequence Number=SeqID_70976
  Homolog annotation: Hit_ID=Q10NZ3; Match level="QueryCoverage=69%, HitCoverage=72%, E-value=7e-28, Identity=31%"; Hit description =Expressed protein
MNMLLWLPAYPTIQPGWDLDDEIHATFFKCISWQVEETLDTVNCPYHYFCDKTYPSNYPLVVDILVLLFTAASYFVTLAILVMDMSSGRGRIFLCQSKRFLLPSGPISLPLIILAFAKGPQINTIFPLNCIGPAILLMVLISALSFDNAADKDFKKEALFVGGKLVRYRGWSMTTFFVVGVLCLRIVCKISGENYAGKFLFIKALMERFSWILITVDCVYLTLNSPPERVMLRVAAFGGIFLLIFLQLLKEACSQIYSMACVAEKLRWVSAPSHTI

SEQ ID NO: 187755 - protein, 250 aa, Glycine max
  Coding DNA Sequence Number=SeqID_70977
  Gene Ontology: Mol. function=sequence-specific DNA binding; Cellular component=nucleus; Biological process=regulation of transcription, DNA-dependent
  Homolog annotation: Hit_ID=Q9ATE5; Match level="QueryCoverage=98%, HitCoverage=98%, E-value=4e-45, Identity=41%"; Hit description=MADS -box protein FBP24
  Pfam annotation: Domain name=K-box; Domain location=71-174; Score =30.9; E_value=1.1e-06; Accession=PF01486.8; Description=K-box region
  Pfam annotation: Domain name=SRF-TF; Domain location=9-59; Score =101.7; E_value=2.2e-27; Accession=PF00319.9; Description=SRF-type transcription factor (DNA-binding and dimerisation domain)
  Pfam module annotation: Pfam domain module=K-box::SRF-TF; Domain location=71-174::9-59
MGRGKIEIKRIENTTTRQVTFSKRRGGLLKKTKELSVLCDAKIGIIIFSSTGKMREWCTEPFRMEQIIEQYQISKGTPIAERGHDHPREEFFHNMAMLRQQTIRLELEIQRYLGEDMRGLQYEDLTKLEQELENSVARIRNRQLAFQNELLQQQMENLRRKERILEEENNHFSNWEHHQAVLEFQKAAATVEASKPMYVMDHFSFFEEQPAGSILQLASPMLPHFHPYLQLAQPNIQDSVRGQSYNNGIN

SEQ ID NO: 187756 - protein, 361 aa, Glycine max
  Coding DNA Sequence Number=SeqID_70978
  Gene Ontology: Mol. function=nucleic acid binding; Cellular component= intracellular; Biological process=regulation of transcription
  Homolog annotation: Hit_ID=Q9FJS0; Match level="QueryCoverage=94%, HitCoverage=48%, E-value=1e-122, Identity=60%"; Hit description =Arabidopsis thaliana genomic DNA, chromosome 5, P1 clone:MQD22
  Pfam annotation: Domain name=JmjC; Domain location=168-291; Score =169.6; E_value=7.8e-48; Accession=PF02373.13; Description=JmjC domain
MGAPKASRCGRRTTTMTGICKIVSPIAASNPAAFVLMKEKKDFKFETNVQPLRLSKWIDEKDIISFSLRGRKYTYHEFEDLADKAFFSRFHSSGGLPSSYAEKEFWHEMGSGERETVEYGVNVEGSAFSCDPNDRLGTSKWNLKNFSRLPQSLLRLVDREIPGITDPMLYIGMLFSMFAWHVEDHYLYSINYHHSGANKTWYGVPGYAASQFEKTVLQHVYSNKILTKHGDDGAFKFLAQKTTMFPPNVMLQHDVAVYKAVQKPGEFIITFPRAYHAGFSHGFNCGEAVNFANGDWFQLGAAASRRYAHLRMMPLIPYEELLYKEAMLVYKSSRVRSYKKKPEDTASYQAIMLPFLHLMQS

SEQ ID NO: 187757 - protein, 75 aa, Glycine max
  Coding DNA Sequence Number=SeqID_70979
MDDSDFDGDAVTFTIIIDVGVALLTNGGSGVKAYLTPMRQSSKCEFEETKSGMFGRMTLFMRLKEKVGEGMVDDS

SEQ ID NO: 187758 - protein, 331 aa, Glycine max
  Coding DNA Sequence Number=SeqID_70980
  Gene Ontology: Mol. function=hydrolase activity; Cellular component =integral to membrane; Biological process=aromatic compound metabolic process
  Homolog annotation: Hit_ID=Q8PI61; Match level="QueryCoverage=92%, HitCoverage=91%, E-value=1e-123, Identity=70%"; Hit description =Hydrolase
  Pfam annotation: Domain name=Abhydrolase_1; Domain location=89-326; Score=72.1; E_value=1.8e-18; Accession=PF00561.10; Description =alphabeta hydrolase fold
MRVIAAALLACLPLPALAAPTYGPRLEGFDYGYPVKTFALESQRQPLEMAYLDIAPKKAPIGVVVLLHGKNFCAATWKESIKPLVAAGYRVIAPDQVGFCKSSKPERYQYSFAQLAANTHALLQQLQLGDVPVHLVGHSMGGMLAVRYALMFPQDLRSLSLVNPIGLEDWKALGVPWRSVDAWYAGEMNISYDSIRRYQLEVYYDGKWKPAYEPWARMQSGMYEGPGKQAVAWSQALASDMVFNQPVVYELKNLQVPTTLFIGQKDRTAIGRDLAPPAVKATLGNYPVLGKAAASAISGSNLVEFAELGHSPQVQDPKQFNSALLKALKSR

SEQ ID NO: 187759 - protein, 75 aa, Glycine max
  Coding DNA Sequence Number=SeqID_70981
MLKKYRVGLWGQSLILEANKADFQGFERGYLRKREFAKRNLQWLSARKNPEEDELSSSLSAPLQLIKRTTSSSLS

SEQ ID NO: 187760 - protein, 49 aa, Glycine max
  Coding DNA Sequence Number=SeqID_70982
MNLGIPRSCGSACHRTLGTRISFLNDHIEETLGPTKTGENHSKCINLTQ

SEQ ID NO: 187761 - protein, 259 aa, Glycine max
  Coding DNA Sequence Number=SeqID_70983
MGPDGCRETRGTGTREAAHKPRQDFSIQKSQNFSLLVAEYESHQGEEVEKCEILRAREAKFGVSVNWSLKTCGKAWAEQMRKMSDKENACALLVMGKVVHIGVWSLASGNRLPRIAMAAQLIHDRVEMECLKGVWETLEGNERCRFRGTIRLTTTSLVHPGKPTRTLHRTVEWILPTPTPYRLVEPVQVIEVSSSEEDPEEDPEELPLEPAVDALDFPEDDEDPLPDVDSPEDVMSASEADSMEESGPGGTANSGDSSS

SEQ ID NO: 187762 - protein, 394 aa, Glycine max
  Coding DNA Sequence Number=SeqID_70984
  Homolog annotation: Hit_ID=Q84S34; Match level="QueryCoverage=29%, HitCoverage=38%, E-value=3e-30, Identity=54%"; Hit description=Short chain alcohol dehydrogenase-like protein
  Pfam annotation: Domain name=adh_short; Domain location=24-140; Score= -45.7; E_value=0.0056; Accession=PF00106.15; Description=short chain dehydrogenase
MVAESQQSSSSSINRGARWSLNGMTALVTGGTRGIGHAIVNDLAAFGAAVHTCSRNQTELNKCLQEWQSQGFEVTGSVCDVSSPPQREKLIQEAASTFNGKLNIYVNHCPIVVKNKVYGWGSKPFRILNGWFQDRRFFEVVKEAWKKQDVEQGDLNEAQFKLKLQLQEDSWIVATFNESLLLQKSRGMYMDGMWLEEPIKVKEEVKNFFENRFMEDKYKRPKLDGVNFKRILNEDNGMLLEEFEEDEEFWEMMKLNIMIFLKEFHRHGVLPSGTNSSFTALIAKVALELLGWRAIERCANVLNCKVLTLPFIYLGLLIGANHRRDSLWGQVLTSKYGGWHGLMGNSALSWKSLWWKDLKKLCGSEVDNPWFDENILWKIGRGDKCRFWKDVWVM

SEQ ID NO: 187763 - protein, 214 aa, Glycine max
  Coding DNA Sequence Number=SeqID_70985
  Gene Ontology: Mol. function=molecular_function; Cellular component =chloroplast thylakoid lumen; Biological process=biological_process
  Homolog annotation: Hit_ID=O22160; Match level="QueryCoverage=86%, HitCoverage=83%, E-value=8e-62, Identity=67%"; Hit description =Thylakoid lumenal 15 kDa protein, chloroplast precursor
  Pfam annotation: Domain name=Pentapeptide; Domain location=136-175; Score=47.8; E_value=3.6e-11; Accession=PF00805.12; Description =Pentapeptide repeats (8 copies)
  Pfam annotation: Domain name=Pentapeptide; Domain location=96-135; Score=22.8; E_value=0.0013; Accession=PF00805.12; Description =Pentapeptide repeats (8 copies)
  Pfam module annotation: Pfam domain module=Pentapeptide::Pentapeptide; Domain location=136-175::96-135
  Subcellular localization annotation: CTP_CleavageSite=61; ConfidenceScore=5.74e-01
MALVLNVSLCSTCKPHLSLSTSNPNKASSTFPLPLPLLGLNIKKSLQPSQKLTFSLGESVSGATLVALLSASFIFVDPALAFKGGGPYGQEVTRGQDLTGKDFSGKTLIKQDFKTSILRQANFKGAKLIGASFFDADLTGADLSDADLRNADFSLANVTKANLSNANLEGALATGNTSFKGSNITGAGAIGLGFQSTYLGKLWERLIRGKEESI

SEQ ID NO: 187764 - protein, 296 aa, Glycine max
  Coding DNA Sequence Number=SeqID_70986
  Gene Ontology: Mol. function=oxidoreductase activity; Cellular component=mitochondrion; Biological process=metabolic process
  Homolog annotation: Hit_ID=Q8LFZ4; Match level="QueryCoverage=95%, HitCoverage=98%, E-value=8e-92, Identity=58%"; Hit description=Short chain alcohol dehydrogenase-like
  Pfam annotation: Domain name=KR; Domain location=17-187; Score=-78.9; E_value=0.0088; Accession=PF08659.1; Description=KR domain
  Pfam annotation: Domain name=adh_short; Domain location=17-185; Score= 99.4; E_value=1.1e-26; Accession=PF00106.15; Description=short chain dehydrogenase
  Pfam module annotation: Pfam domain module=KR::adh_short; Domain location=17-187::17-185
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACDWAKDNIRSNCVVPWATRTPVVEHTQPNLAELFSFSAWKLYAYYIETGAALFKDQKFVDDIMSRTPIKRIAEPEEVSSLVNFLCLPAASFITGQVICVDGGLTVNGFQPSMRIT

SEQ ID NO: 187765 - protein, 127 aa, Glycine max
  Coding DNA Sequence Number=SeqID_70987
  Homolog annotation: Hit_ID=Q9ZW04; Match level="QueryCoverage=39%, HitCoverage=19%, E-value=1e-10, Identity=56%"; Hit description =Putative tropinone reductase
MVLGPRYPAFKNHLKKQVQGIQIPNACLSESSSSSINRGEQDRGIGNQTELNKCLQEWQGQGFQVTGSVCDVSSPPQREKLIQEVSSTFNAELNVYVTTTPKSLCLRLCCALHCIYKLNICWERSTL

SEQ ID NO: 187766 - protein, 204 aa, Glycine max
  Coding DNA Sequence Number=SeqID_70988
  Gene Ontology: Mol. function=oxidoreductase activity; Cellular component=peroxisome; Biological process=metabolic process
  Homolog annotation: Hit_ID=Q8LFZ4; Match level="QueryCoverage=78%, HitCoverage=60%, E-value=1e-57, Identity=65%"; Hit description=Short chain alcohol dehydrogenase-like
  Pfam annotation: Domain name=adh_short; Domain location=19-194; Score= 41.1; E_value=3.7e-09; Accession=PF00106.15; Description=short chain dehydrogenase
MADAAKGTYRASRWSLNGMTALVTGGTRGIGHAIVEDLCGFGATVHTCSRNQAELDKCLTEWRSKGFLVSGSVCDVSSQPHREKFIQEVTSIFNGKLNIYVNNVGVNYRKPTIEYTAEVYSQIMAVNLDSAYHLCQLAYPLLKASGMGSIVFISSIAGVVSLGTGSVYAACKGKSPCYETCTSFLFECLHVGHVSDTDICSILV

SEQ ID NO: 187767 - protein, 172 aa, Glycine max
  Coding DNA Sequence Number=SeqID_70989
  Gene Ontology: Mol. function=oxidoreductase activity; Cellular component=mitochondrion; Biological process=metabolic process
  Homolog annotation: Hit_ID=Q8LFZ4; Match level="QueryCoverage=98%, HitCoverage=64%, E-value=2e-64, Identity=68%"; Hit description=Short chain alcohol dehydrogenase-like
VNNVGVNYRKPTIEYSAEEYSEMMTVNLNSAFHLCQLAYPLLKASGKGSIVFLSSVAGVTSMGTGSVYAASKAAINQLTKNLACEWAKDNIRSNCVVPWTTRTPLIEHLLQNQTFVEDVMSRTPLKRIAEPEEVSSLVAFLCLPAASYITGQVICADGGVTVNGFQPSMRIT

SEQ ID NO: 187768 - protein, 301 aa, Glycine max
  Coding DNA Sequence Number=SeqID_70990
  Homolog annotation: Hit_ID=Q8LRL4; Match level="QueryCoverage=45%, HitCoverage=38%, E-value=6e-13, Identity=44%"; Hit description=Nam -like protein 11
  Pfam annotation: Domain name=NAM; Domain location=9-108; Score=-10.1; E_value=1.5e-06; Accession=PF02365.6; Description=No apical meristem (NAM) protein
MEDHAHAALPPGYRFYPSEEVLVGYYLTKKNENREEGFYGSDLIRELDLYDHDPFELPDAAACFSYGYKGRKKHWFCYAKETKRKKQKKGEKRVLAPEGKGSGYFRPQRRRRRFGHEDAFRFLRRQFPEKRCQNRLDFASFVLCRVVNKPPHKNSPSEIGLSCCAEESVVAVVRHVGVQCDGCAESDVVEAKVCDEGFVNRENEIAENPISGEHGDPAAPVSVAQGSQPLSIANFCISNCLKNLFRIRVINTGNQSKCLLQVQERLSKLPSGSALFVGAMTSQQLMLSILEEDFIELDDIA

SEQ ID NO: 187769 - protein, 69 aa, Glycine max
  Coding DNA Sequence Number=SeqID_70991
  Gene Ontology: Mol. function=oxidoreductase activity; Biological process=metabolic process
  Homolog annotation: Hit_ID=Q8LFZ4; Match level="QueryCoverage=88%, HitCoverage=23%, E-value=4e-18, Identity=67%"; Hit description=Short chain alcohol dehydrogenase-like
MAKVMLLRNKKYVEEMLSRTPLGRIAEPEEVSALVAYLCLPAASYITGQVVLVDGGLSVNGFQTSMRIT

SEQ ID NO: 187770 - protein, 54 aa, Glycine max
  Coding DNA Sequence Number=SeqID_70992
MKSENRVLQALFTLPPVTVSVGTWRVLIGCDDAIVLATVERGVDGACRLFCDIA

SEQ ID NO: 187771 - protein, 83 aa, Glycine max
  Coding DNA Sequence Number=SeqID_70993
MQTSYEPFAFIIRGKGHVLLVVVLYTRNRNEISEKAKMETLLAKALKRGLVTPIISPLTPFSHLSVEESPIEFYAPCCHVYSE

SEQ ID NO: 187772 - protein, 231 aa, Glycine max
  Coding DNA Sequence Number=SeqID_70994
MYAETCDANINRFISNRARSINRKSVAELFVDFVGKFAKMDSMAVEMGICPYTGKWEQIEDNMIWLPKTYAIFVEDPFEQPQNTARSVSAGQLKKITETFARTHDLLTSTNQNQISLLSNLAPAHVIRCITRPYGGGYIHPTQPQVQRGVAYFHPTQPQVFRPTQPQVQRAIRPLQPQSQHHFQNASQGTSSNSSFSTGQIQARKGVSSNSSSSKGHTPVHRGQQMWRPKS

SEQ ID NO: 187773 - protein, 124 aa, Glycine max
  Coding DNA Sequence Number=SeqID_70995
  Gene Ontology: Mol. function=transferase activity; Cellular component= cytoplasm; Biological process=DNA replication checkpoint
  Homolog annotation: Hit_ID=Q011I4; Match level="QueryCoverage=79%, HitCoverage=12%, E-value=2e-16, Identity=46%"; Hit description=[D] KOG2277 S-M checkpoint control protein CID1 and related nucleotidyltransferases
MDSRATVEPYGSFVSNLFTRWGDLDISIELSNGGGSNLQFISNARVPILKFKSYRQGVSCDISINNLPGQMKSKILLWINKIDGRFRHMVLLVKEWAKAHKINNSKAGTFNSYSLSLLVIFYFQ

SEQ ID NO: 187774 - protein, 598 aa, Glycine max
  Coding DNA Sequence Number=SeqID_70996
  Gene Ontology: Mol. function=zinc ion binding; Cellular component =cellulose and pectin-containing cell wall; Biological process =metabolic process
  Homolog annotation: Hit_ID=O22285; Match level="QueryCoverage=99%, HitCoverage=85%, E-value=0.0, Identity=59%"; Hit description =Expressed protein
  Pfam annotation: Domain name=DUF248; Domain location=162-598; Score =769.5; E_value=2.1e-228; Accession=PF03141.7; Description=Putative methyltransferase
  Pfam annotation: Domain name=Methyltransf_11; Domain location=283 -371; Score=11.3; E_value=0.0042; Accession=PF08241.2; Description =Methyltransferase domain
  Pfam annotation: Domain name=Methyltransf_12; Domain location=283 -369; Score=9.1; E_value=0.066; Accession=PF08242.2; Description =Methyltransferase domain
  Pfam module annotation: Pfam domain module=DUF248::Methyltransf _11::Methyltransf_12; Domain location=162-598::283-371::283-369
  Subcellular localization annotation: CTP_CleavageSite=54; ConfidenceScore=5.12e-01
MTGDFLRTPLTLKIATFFFIAVTFFYFGKHWSDGYQQLVFFTQRSDSDPNSNPVVSTSPNYAKPFNVSALIENNSQPAPPENVPPPPPEEGSIEKLGVVNENGTMSDEFEVGDFDPGMVEQWVNETQVDESEGSSSSPSSTSDSDVGFGIKKFGLCPREMSEYIPCLDNEDAIRKLPSTEKGERFERHCPEQGRGLNCLVPAPNGYRTPIPWPRSRDEVWYNNVPHTRLVEDKGGQNWISRDKDKFKFPGGGTQFIHGANEYLDHISKMIPDITFGKHIRVVLDVGCGVASFGAYLLSRNVVTMSVAPKDVHENQIQFALERGVPAMAAAFATRRLLYPSQAFDLVHCSRCRINWTRDVNRMLRAGGYFVWAAQPVYKHEEVLEEQWEEMLNLTTRLCWNFLKKDGYIAVWQKPSDNSCYLDREEGTKPPMCDPSDDPDNVWYADLKACISELPKNMYGANVTEWPARLQSPPDRLQTIKLDAFTSRSELFRAESKYWNEIIASNVRVLHWKKIRLRNVMDMRAGFGGASPGAAVKLCLGDLLVMGSNPETASLHMQGFAAALIDQNLDSWVMNVVPVSGPNTLPVIYDRGLIGVMHD

SEQ ID NO: 187775 - protein, 119 aa, Glycine max
  Coding DNA Sequence Number=SeqID_70997
  Subcellular localization annotation: CTP_CleavageSite=67; ConfidenceScore=5.42e-01
MYTKLTLACVGNVSFDGILMMCFLSSHPVLFSTMSRAPRQSFTIFQCVGGFLTKFLCGGIEARELASASEKGFWVLRTSLQCVFESDKTMSANKANDDNGEAIGSDVRCWSGLLASPRC

SEQ ID NO: 187776 - protein, 135 aa, Glycine max
  Coding DNA Sequence Number=SeqID_70998
  Gene Ontology: Mol. function=transferase activity, transferring hexosyl groups; Biological process=carbohydrate biosynthetic process
  Homolog annotation: Hit_ID=Q1SD94; Match level="QueryCoverage=74%, HitCoverage=28%, E-value=3e-31, Identity=75%"; Hit description =Glycosyl transferase family 8, putative
MNNGCESKCLLSMQVLLHYVATSEMNNRATTQKTNQIGVEVYNPLDVGFEEVSEIIADVVEGLFEGLSDGGRDQVADDLWIEVIDLEVQLREGGFDEGLKVGFADEEVEDVLRAVGVLEDCGRRRWSRIGTPRQG

SEQ ID NO: 187777 - protein, 137 aa, Glycine max
  Coding DNA Sequence Number=SeqID_70999
  Pfam annotation: Domain name=zf-CCHC; Domain location=32-49; Score =8.3; E_value=0.042; Accession=PF00098.13; Description=Zinc knuckle
MHERQHSVTTSTSLDTNPFANVVSGKSTYLTRKCNHCGCLGHTSDICYQKQGNVVPKCEHCTCFGHTMDVCYAKFRYPLGHPKYLGRPRLPNKSGNFSSNNSGTVNNVASDGSSINLFGEERKDGYVPAPNPNITQA

SEQ ID NO: 187778 - protein, 376 aa, Glycine max
  Coding DNA Sequence Number=SeqID_71000
  Gene Ontology: Mol. function=protein binding; Cellular component =nucleus; Biological process=ubiquitin cycle
  Homolog annotation: Hit_ID=O22286; Match level="QueryCoverage=92%, HitCoverage=93%, E-value=1e-117, Identity=57%"; Hit description =Expressed protein
  Pfam annotation: Domain name=BTB; Domain location=151-270; Score =90.5; E_value=5.1e-24; Accession=PF00651.21; Description=BTBPOZ domain
  Pfam annotation: Domain name=MATH; Domain location=38-163; Score =23.3; E_value=0.00085; Accession=PF00917.16; Description=MATH domain
  Pfam module annotation: Pfam domain module=BTB::MATH; Domain location= 151-270::38-163
MAELEEERMGGDFKPFSEGSSCSRSISETVNGSHQFTIKGYSLAKGMGAGKYIMSDTFTVGGYDWAIYFYPDGKNPEDNSMYVSVFIALASDGTDVRALFKLTLVDQSEKGNDKVHSHFDRPLESGPYTLKYKGSMWLGVIVPQSDMGRDFKDLLESEVGCDIVFKVKSESFKAHKLILAARSPVFRAQFFGLVGDPTLEEVVVEDIEPFIFKAMLLFIYSDKLPGIYEVMDSMPLCSYTVMVQHLLAAADLYNLDRLKLLCESKLCEEINTDNVATTLALAEQHHCPQLKAICLKFIANPANLGAVMQSEAFVHLKESCPSMLLELLETFASVDDNSGQTLSRKRSGSSIYGQDLADGAAAESVNPNGRRVRRRT

SEQ ID NO: 187779 - protein, 346 aa, Glycine max
  Coding DNA Sequence Number=SeqID_71001
  Gene Ontology: Mol. function=carboxypeptidase activity; Cellular component=membrane; Biological process=auxin mediated signaling pathway
  Homolog annotation: Hit_ID=Q9LI65; Match level="QueryCoverage=85%, HitCoverage=92%, E-value=4e-74, Identity=42%"; Hit description =Nodulin-like protein
  Pfam annotation: Domain name=DUF6; Domain location=21-152; Score =59.4; E_value=1.1e-14; Accession=PF00892.11; Description=Integral membrane protein DUF6
MTLLKFHQVWKPALVMIIVNLALAFVNIFLKKVLNEGVDYLTILTYRQAISAIFLTPIACFYERKRKLEGHIICLLFLSALVGVTLTQCLYLIGLEYTSATFACAFLNMVPVFTFIMALPLGIEKVNMKNLSAKAKVLGTFVCIGGALMLILYKGVPLIKQQPEHLADKGTITSPASKLKKWIIGSLLLTAGCLLWSSWFLMQARISKKYPCQYSSTAILSSFAAIQSAILTLVIDRSNAKWILKGKLEIMTVVYAGLVGSGLCYVAMSCIAGSVLVISGTYILLWGKSKEEEQSAVKGTQESQEDEESKNNLGASPNVPSKLRPNGEQGFSELQVKQLAITVTKS

SEQ ID NO: 187780 - protein, 54 aa, Glycine max; identical to SEQ ID NO: 150778
  Coding DNA Sequence Number=SeqID_71002

SEQ ID NO: 187781 - protein, 68 aa, Glycine max
  Coding DNA Sequence Number=SeqID_71003
  Gene Ontology: Mol. function=sugar porter activity; Cellular component=integral to membrane; Biological process=carbohydrate transport
  Homolog annotation: Hit_ID=Q39228; Match level="QueryCoverage=78%, HitCoverage=10%, E-value=2e-12, Identity=57%"; Hit description=Sugar transport protein 4
MPCHLKFGLFFLFAGFVVIITIFIAMLLPETKNVPIEEMNRIWKAHWFWTKIVPADVDIDGSSKKAVA

SEQ ID NO: 187782 - protein, 199 aa, Glycine max
  Coding DNA Sequence Number=SeqID_71004
MHRPLKKSIVPRQFAPVLKNSEEMGEECRLHAAATLLCDFHRGGDKVEVEGIWVYNNANNGDNWAEKFVKAMVQMSSIEVLTGSNMEERYVRMGEGVDFTTKVCYKMYRYKEPTWMLGFGCIDLQIPKKVAFLIWRAMRNRLPTKDNLRMHGIIVEESEAADYKFRKGIVGWDVYSICGFGESIWPLESFVLVGSWWEA

SEQ ID NO: 187783 - protein, 155 aa, Glycine max
  Coding DNA Sequence Number=SeqID_71005
  Gene Ontology: Mol. function=peroxidase activity; Cellular component =vacuole; Biological process=response to oxidative stress
  Homolog annotation: Hit_ID=Q1RUM5; Match level="QueryCoverage=83%, HitCoverage=49%, E-value=1e-35, Identity=65%"; Hit description=Haem peroxidase, plant/fungal/bacterial
  Pfam annotation: Domain name=peroxidase; Domain location=35-149; Score=-4.2; E_value=2.2e-08; Accession=PF00141.13; Description =Peroxidase
MVSCLVLILGVSSLASAYLKVGFYSSACPSAEEIVRSTVNKAISDNAGIAAGLIRMHFHDCFVRGCDGSVLLASAPGNPIAERDNFVNNPSLHGFEVIEEAKTQLEAACPQTVMKCPRICLHQPPVQMKCKYYEGLINHRGARQSNHKGNGSKQC

SEQ ID NO: 187784 - protein, 93 aa, Glycine max
  Coding DNA Sequence Number=SeqID_71006
MLINLINKAAVHPYLTIGASLNRESYLSLHPIPSNPKSPPPPLCLLPGESHRGVLPPHGAYTLRPKSHPIQTTPKSQSARTTLTADLGMKANF

SEQ ID NO: 187785 - protein, 268 aa, Glycine max
  Coding DNA Sequence Number=SeqID_71007
  Gene Ontology: Biological process=regulation of transcription
  Homolog annotation: Hit_ID=Q1RWY7; Match level="QueryCoverage=75%, HitCoverage=91%, E-value=2e-55, Identity=57%"; Hit description=TCP transcription factor
MEREREKGGPGHMLVSKGEAAKANDIATTRLVVPPAGIPVAAAGQRGKQIEVAGEVIPEPGGRGLSHGGLLVVVVVVVVKQGILRRHRHEFGGGEAPDLAEVGAGREGPQGGRRGGNDERDGVVFGGVVVVGANAFAEDEGGGGREEGLVVGDGGEARRSGAGAGGGDDGGLGLTEEPLDGLAVGLMTELARELEDARGADDRHANAAAAAVDLAVAVLGRRFLDGEGGGGWLLVVVDNCVVVGVVGGGDGVSGSVRVGHVLLYGVAA

SEQ ID NO: 187786 - protein, 329 aa, Glycine max
  Coding DNA Sequence Number=SeqID_71008
  Gene Ontology: Mol. function=peroxidase activity; Cellular component =membrane; Biological process=response to oxidative stress
  Homolog annotation: Hit_ID=Q1RUM5; Match level="QueryCoverage=91%, HitCoverage=90%, E-value=1e-104, Identity=64%"; Hit description=Haem peroxidase, plant/fungal/bacterial
  Pfam annotation: Domain name=peroxidase; Domain location=44-293; Score=457.7; E_value=1.5e-134; Accession=PF00141.13; Description =Peroxidase
  Subcellular localization annotation: CTP_CleavageSite=25; ConfidenceScore=5.20e-01
MDNTPRLIQTVSSLVLILSISSLASASLKVGFYSSTCPSAEAIVKSTVEKAISANPGIAAGLIRMHFHDCFVRGCDGSVLLASTPGNPISERDNFVNNPSLRGFEVIEDAKNQIEAACPETVSCADILAFAARDSVSKVGGISYDVPSGRRDGRVSIGDEVLDNLPRPSLSADDLISNFERKGLSADEMVTLSGAHSIGVSHCGAFSNRLYSFSDTVTQDPSLDSSYAETLKTQCPPPPPTSDPTVSLEPSTPIRLDSKYYEGLINHRGLLTSDQTLYTSQSTRGMVQSNANNGASWADKFALAMLRMGSIEVLTGSDGEIRKQCSFVN

SEQ ID NO: 187787 - protein, 115 aa, Glycine max
  Coding DNA Sequence Number=SeqID_71009
MEDSRQWATTTERERIVCNLRKLNRWIKSSAVSTTTTRSRRFVTFTLRHFDYYSRFFVGTVYFGNRGKKFIALGKRCSSIGESVHMYKAKSEIKYAMKSYGNFISRLTLRLCLDC

SEQ ID NO: 187788 - protein, 578 aa, Glycine max
  Coding DNA Sequence Number=SeqID_71010
  Homolog annotation: Hit_ID=O23247; Match level="QueryCoverage=22%, HitCoverage=20%, E-value=2e-34, Identity=56%"; Hit description =Arginyl-tRNA synthetase
  Pfam annotation: Domain name=Arg_tRNA_synt_N; Domain location=87-179; Score=56.0; E_value=1.3e-13; Accession=PF03485.7; Description=Arginyl tRNA synthetase N terminal do
  Subcellular localization annotation: CTP_CleavageSite=29; ConfidenceScore=5.67e-01
MTMVFGKVGTSKTKKKKNKKNKKKRRNVRVRMLKPQSILSLPIHSLSTILSFRFALSATKTQQSSVTKPQSTSTAIIEIDNPASVKRQLAQLFDLSLRETVPDEPHVVPLVDACAVKGGAKFGDYQCNNAMGIWSRMKGKQTGFRGPPAIGQAIINNLPPSEMIDSCSVAGPGFVNVVLSKKWIAENFSPAPPRNATMSDPPVNTVPSSGDTGSTPIRQCATACSFFATLEDHNAGRISEAYLNWELQDQLLLSWLQATISSPVLKKLIGCSSSWQLWNKVHNYFHAHMTAKARQLRTELRQQTLEDPISVKEHIDVCRKNNKGNRIKHKRKYGFVRFKGVDDVHQLERKLDNIVLGGLKLYVNIPKFGRARLGMPQPATWGRAYARQYEEENRGTYPAMKQPVVPGLKQKWLSEAWVGRLKNLALFDRVEEDILWNLGANTSPKYIGDDMVLLLGLTDEKARQLMEDENERGDSMMRPGYKLTWVQCWGIPIIAWDSQQMKKIVAGISDLVDVDDDVEELRKMDRERILVKTPWKLLIQHTVNVHIQGQMFPVHITEENDSYSNTCHCRHNAEYGSS

SEQ ID NO: 187789 - protein, 98 aa, Glycine max
  Coding DNA Sequence Number=SeqID_71011
  Subcellular localization annotation: CTP_CleavageSite=35; ConfidenceScore=5.60e-01
MGPTSSIVRFTTSKSYMSVAIVTTTQSPWRGGSCSAPLLTSLTIARGLSRAHPSPRGVPTPHDLERGYQIYKKLLQAIEDFVVQIMRVVRNKVEHKGG

SEQ ID NO: 187790 - protein, 214 aa, Glycine max
  Coding DNA Sequence Number=SeqID_71012
  Gene Ontology: Mol. function=motor activity; Cellular component =myosin complex; Biological process=auditory receptor cell differentiation
  Homolog annotation: Hit_ID=Q9SNF0; Match level="QueryCoverage=66%, HitCoverage=12%, E-value=6e-54, Identity=78%"; Hit description=Myosin
  Pfam annotation: Domain name=Myosin_head; Domain location=1-214; Score=-359.3; E_value=0.0029; Accession=PF00063.11; Description =Myosin head (motor domain)
MYMFSGESGAGKTETAKIAMQYLAALGGGSGIEYEILKTNPILEAFGNAKTLRNDNSSRFGKLIEIHFSETGKISGANIQTFLLEKSRVVQCNEGERSYHIFYQLCAGAPPSLREIYGRSITRGLGFLLQHWYCESGRIDGQRWMVLWAAVTWCIWRHRNKCNFNNREFQGETVLNDAMFFIWLWMKALENGFNVPFQVWSSNARMNFVRGGVR

SEQ ID NO: 187791 - protein, 288 aa, Glycine max
  Coding DNA Sequence Number=SeqID_71013
  Gene Ontology: Mol. function=motor activity; Cellular component =myosin complex; Biological process=lysosome organization and biogenesis
  Homolog annotation: Hit_ID=O24515; Match level="QueryCoverage=84%, HitCoverage=21%, E-value=1e-117, Identity=83%"; Hit description =Unconventional myosin
  Pfam annotation: Domain name=Myosin_head; Domain location=1-285; Score=-223.4; E_value=1.5e-07; Accession=PF00063.11; Description =Myosin head (motor domain)
MEAIDARDALAKSIYACLFDWLVEQINKSLAVGKRRTGRSISILDIYGFESFNRNSFEQFCINYANERLQQHFNRHLFKLEQEEYIQDGIDWAKVEFEDNQDCLNLFEKRPLGLLSLLDEESTFPNGTDLTLANKLKQHLNSNSCFKGERDQAFTVHHYAGQVTYDTTGFLEKNRDLLHVDSIQLLSSCTCPLPQIFASHMLTQSDKPVVGPLHKSGGADSQKLSVATKFKKSMDEYPLSEKLKLPMNNEKIHSKQVKFRKLETHSLKISYHAVSHALNSDFKFSMPS

SEQ ID NO: 187792 - protein, 432 aa, Glycine max
  Coding DNA Sequence Number=SeqID_71014
  Gene Ontology: Mol. function=RNA binding
  Homolog annotation: Hit_ID=Q1T290; Match level="QueryCoverage=81%, HitCoverage=88%, E-value=4e-38, Identity=33%"; Hit description =Cyclin-like F-box
  Pfam annotation: Domain name=F-box; Domain location=22-69; Score =31.8; E_value=2.4e-06; Accession=PF00646.23; Description=F-box domain
MEEGKRKLAMKRKRESTGGGKDRLSELPDSVLVHIMELMETRNAVQTCVLSQRWKNLWRRMTRLSFNHPRTFSRYHNFVSHVLSGRDHSVSLIDLLFVVLHSTSATLLHDVISYAVSHNVQQLTIYIDTLDCINGATPSFQLSKTPFVPLLFPSPSLTSLKLSSVFIGYSLELPKSLLLPSLKTLHLTNVHFTASDHNNNFVEPFSTCHMLNTLVIQYCFMHTSAQVLSISNSNLSSLTLDTFQEHIVLSTPNLTSLTIRDGFHFTLLQLSSTCDLSLLKEADIETRVDIHYSVIITWLRLMTNVKMLTISSATLKAILNDLSDPAAATVQPPCFGRLESLKVKMHPHVNISKEECLLHFVITFLPDTLLQQMIDCYIVSMLEGNETLGKMKRKMEELQRTRTGSMISNFVVLHIMKFMNTKSAVHTFMSWL

SEQ ID NO: 187793 - protein, 455 aa, Glycine max
  Coding DNA Sequence Number=SeqID_71015
  Gene Ontology: Mol. function=motor activity; Cellular component =myosin complex; Biological process=negative regulation of actin filament polymerization
  Homolog annotation: Hit_ID=O24515; Match level="QueryCoverage=98%, HitCoverage=40%, E-value=0.0, Identity=75%"; Hit description =Unconventional myosin
  Pfam annotation: Domain name=IQ; Domain location=133-153; Score=21.9; E_value=0.0023; Accession=PF00612.17; Description=IQ calmodulin -binding motif
  Pfam annotation: Domain name=IQ; Domain location=156-176; Score=13.9; E_value=0.58; Accession=PF00612.17; Description=IQ calmodulin-binding motif
  Pfam annotation: Domain name=IQ; Domain location=182-202; Score=18.4; E_value=0.026; Accession=PF00612.17; Description=IQ calmodulin -binding motif
  Pfam annotation: Domain name=IQ; Domain location=205-225; Score=24.6; E_value=0.00035; Accession=PF00612.17; Description=IQ calmodulin -binding motif
  Pfam module annotation: Pfam domain module=IQ::IQ::IQ::IQ; Domain location=133-153::156-176::182-202::205-225
MISSVCVQGQLFQLMQRLESTTPHFIRCIKPNNLQSPESYEQGLVLQQLRCCGVLEVVRISRSGFPTRMSHQKFARRYGFLLDNVASQDPLSVSVAILHQFNILSEMYQVGYTKLFFRTGQIGVLEDTRNRTLHGILRVQSCFRGFQARRSLKDLRGGITTLQSFIRGDKTRKAYSALLKRHRAAVIIQKQIKAVFARNRMRTISDAAIVIQAVIRGWLVRRCSGNIGFLKSGDMKMKESDEVLVKSSFLAELQCRVLKAEAALREKEEENDILHQRLQQYESRWSEYELKMKSMEEVWQKQMRSLQSSLSIAKKSLAIDDSERNSDTSVNASDERDYSWDVGGNHRRQESNGARSTSAGLSVISRLAEEFEHRSQVFGDDAKFLVEVKSGQVEASLNPDQELRRLKQMFEAWKKDYGARLRETKVIINKLGSEDGALEKMKKKWWGRRNSTRIN

SEQ ID NO: 187794 - protein, 113 aa, Glycine max
  Coding DNA Sequence Number=SeqID_71016
MAFDLRSTTVHSTLLTLNHYQTEAAHHQMARSRSRETVAFRALGYGVEKENKENELQQNINTWCSQKLNRRTKNNNRPKLKGQKVKTSKSLGTKKIVNPKKQNDDGMQFSIQR

SEQ ID NO: 187795 - protein, 226 aa, Glycine max
  Coding DNA Sequence Number=SeqID_71017
  Gene Ontology: Mol. function=structural molecule activity; Cellular component=protein storage vacuole; Biological process=lipid transport
  Homolog annotation: Hit_ID=Q9SC83; Match level="QueryCoverage=92%, HitCoverage=82%, E-value=6e-76, Identity=70%"; Hit description=VAP27
  Pfam annotation: Domain name=Motile_Sperm; Domain location=11-130; Score=102.5; E_value=1.3e-27; Accession=PF00635.16; Description=MSP (Major sperm protein) domain
MGVGPVNMVMILNIEMTKLPFHSMLFELRKQISCSLQLSNKTDNYVAFKVKTTNPKKYCVRPNTGVVMPRSTCDVIVEFNRKPHVTMQAQKEAPPDMQCKDKFLLQSVVASPGATTKDITPEMFNKESGHDVEECKLRVVYVAPPQPPSPVREGSDEDSSPRASVSENGHSSAAEFTGASKAFNERGEHQDASFEARALISKVTEERNSIVEQNRRLQQELVWNSF

SEQ ID NO: 187796 - protein, 451 aa, Glycine max
  Coding DNA Sequence Number=SeqID_71018
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=95%, HitCoverage=66%, E-value=1e-132, Identity=54%"; Hit description =Putative wall-associated receptor kinase-like 20 precursor
  Pfam annotation: Domain name=Pkinase; Domain location=162-437; Score =138.5; E_value=1.8e-38; Accession=PF00069.15; Description=Protein kinase domain
  Pfam annotation: Domain name=Pkinase_Tyr; Domain location=162-437; Score=136.2; E_value=8.8e-38; Accession=PF07714.7; Description =Protein tyrosine kinase
  Pfam module annotation: Pfam domain module=Pkinase::Pkinase_Tyr; Domain location=162-437::162-437
YSSFVNLNPALPVNRWPEPGLEIQWLSPKETVCGSQQDCDSATSTCGPDASSALGIRRCFCNDGLVWDPIQGVCAKKITCQNPGGCDDSTSRTAIIAGSVCGVGAALILAVIAFLLYKRHRRIKEAQARLAKEREGILNASNGGRAAKLFSGKELKKATNDFSSDRLLGVGGYGEVYKGILQDGTVVAVKCAKLGNPKGTDQVLNEVRILCQVNHRNLVGLLGCCVELEQPIMVYEFIENGTLLDHLQGQMPKSRGLLTWTHRLQIARHTAEGLAYLHFMAVPPIYHRDVKSSNILLDIKMNAKVSDFGLSRLAQTDMSHISTCAQGTLGYLDPEYYRNYQLTDKSDVYSFGVVLLELLTAQKAIDFNRAADDVNLAIYVHRMVAEEKLMDVIDPVLKNGATTIELETMKAVAFLALGCLEEKRQNRPSMKEVAEEIEYIISIASAKVVEN

SEQ ID NO: 187797 - protein, 124 aa, Glycine max
  Coding DNA Sequence Number=SeqID_71019
  Gene Ontology: Mol. function=electron carrier activity; Biological process=electron transport
  Homolog annotation: Hit_ID=Q1SR66; Match level="QueryCoverage=55%, HitCoverage=43%, E-value=4e-12, Identity=55%"; Hit description=Blue (Type 1) copper domain
  Pfam annotation: Domain name=Cu_bind_like; Domain location=6-78; Score=10.7; E_value=4.7e-06; Accession=PF02298.8; Description =Plastocyanin-like domain
  Subcellular localization annotation: CTP_CleavageSite=76; ConfidenceScore=5.15e-01
MAKKFVVGFDYAAWAADKTFQVGDVLVSSMMLENTVFKVNGTAFQSCTTPPASEALSNGNDRIVLAIPSRKVLLVTAMLAKSLLLQFNPKHCLQLYHHHLHLVSIALILVDGCLLFFIKLHLLV

SEQ ID NO: 187798 - protein, 83 aa, Glycine max
  Coding DNA Sequence Number=SeqID_71020
MEALSKEKQLGIMEFLSLVKQMQGVYFKLLFGSQIWPYGSAYDSLHFSSTALSNFHLLLAKCRNYLRNFPNSFVRTSSTHVLK

SEQ ID NO: 187799 - protein, 69 aa, Glycine max
  Coding DNA Sequence Number=SeqID_71021
MVMELLTTLATSQQRRNHGVVAKHTGCDEITIEFCHDKVDKNRWCIKLRKNYVEQSGENDESNNELSII

SEQ ID NO: 187800 - protein, 72 aa, Glycine max
  Coding DNA Sequence Number=SeqID_71022
MGCGAQEEGVVVEFVVFEVEVALPERGAMAKGVLATDGARGLEGVMGDEVEDLRDGVVCPWKGVGVAIYKWV

SEQ ID NO: 187801 - protein, 206 aa, Glycine max
  Coding DNA Sequence Number=SeqID_71023
MEGSKLEIISEVRVEDNIDHKYVRIPIHRLRTRRLNLALRVKPKKTSSTSTKKKDQELVIAAFPWHEVFMFLNQQFLGALQVEYQNKTKSPFETHPIHMWTFLTSICFYSVILAFKINLKACSNDHFAFILKHVLLVLGSLSSASLLCIFQPGQHFWFLYVIGIYMPLMLAHHLLQNQVLKVLGTIMTSASQLRDYLNMFCGCIGQ

SEQ ID NO: 187802 - protein, 760 aa, Glycine max
  Coding DNA Sequence Number=SeqID_71024
  Gene Ontology: Mol. function=RNA-directed DNA polymerase activity; Cellular component=chromatin; Biological process=chromatin assembly or disassembly
  Pfam annotation: Domain name=Chromo; Domain location=657-707; Score =27.6; E_value=4.4e-05; Accession=PF00385.14; Description='chromo' (CHRromatin Organisation MOdifier
  Pfam annotation: Domain name=rve; Domain location=353-509; Score =91.8; E_value=2.1e-24; Accession=PF00665.16; Description=Integrase core domain
  Pfam annotation: Domain name=zf-H2C2; Domain location=294-335; Score =8.5; E_value=0.027; Accession=PF09337.1; Description=His(2)-Cys(2) zinc finger
  Pfam module annotation: Pfam domain module=Chromo::rve::zf-H2C2; Domain location=657-707::353-509::294-335
MAGQFSLKLSKCTFAQQQLEYLGHMWPTPRTPRALRGFLGLAGFYRRFIRGYAALVAPLTKLLCHWQFSWNQEADDAFQNLKNAFTATLFLALLDFSAPFVVETDASGSGMGAVLTQGGHPLAYFSKQFCPKLLNSSTYVCELAAITTTVRKWCQYLLGHHFIILTDHRSLRELMNQAIQTPEQHRYLALLLGFGYTIQYRVGRSNVVADALSRVMEGQAASLYLLSMPQFVFLDDLRKELASLATFLDLHDRIQEDPVAYTDYTLTEGLILHRGGIWLPSNSSFIKLLLEEFHQSPTGGHMGVQKTLHRLQDNFIWPSIKEDTRNFIAGCVTCQHTKYDNRKPAWLLFLLPIPTRLWEDLSMDFITGLPAYRDSTCIFVVVDRFSKGLHLGMLPTQHTAHMVALLFVDMVGRLHGMPKSIVSDRDPLFISKFWRELFTLSGTKLRLSSSYHPQSDEQTEVANRIVEQYLRAFMHEKPSTWGSYLPWAEWSYNTSCHSTTGMTPFEITFGQKPLTYPQYIFGTSNVEAVDEILSQREVVFEMLLRKLLKTQSRMKANADRHRCDQEFKVGDWVMVKLRPQRQISVTGTTYSKLGKRYYGHFQVTECMGKVAYKLQLPEYSRIHPVFHVSLLKPYIATTAAPTAVDLPPLTFDNHPVVTPLAIVASKVIPSEAGPKHMVLVQWRGLPPEETSWEEWSALKILHHLEDKVLLEGHGSVTRKNTEGVPLAREVQVETRTRPLRVRSTPAYLKEYERSHAEWGA

SEQ ID NO: 187803 - protein, 593 aa, Glycine max
  Coding DNA Sequence Number=SeqID_71025
  Gene Ontology: Mol. function=RNA-directed DNA polymerase activity; Cellular component=chromatin; Biological process=chromatin assembly or disassembly
  Pfam annotation: Domain name=RVP_2; Domain location=268-385; Score= -43.8; E_value=0.0026; Accession=PF08284.2; Description=Retroviral aspartyl protease
MQSGAHSWCDERRLASVILEGKNEKGNLSVKAFVSCSASVSYVRRFLGPRIPSITVVLSLIINGGLNALQSISDHLEDAIAKLTASQLTMNLKIDDLLHRMSQLEANQQKSQMPLIFKITQFFEYHSTPDQERLMIASFYMEGPALAWFQWMHRNAQLSSWSAFLHALHSRFATTIEVQVLQPISLAQAVSYTRLQEEKLLDARRPSSYRTPTSMAGSTTTRSSSTNATPSLLPTPIWTSTSIPFKRLTPEELAIFREKGLCFHCDEKFSRGYKVTTEITTGTAEPARVIRTHNFLHNRVVLNLGLKPIETMPLHVTVGNGEEIRYHQLCTAVQVHIQQHSFTIDFHVLPLCRVDVVLGVQWLKTLGPVLTDYDALTMKFIAGGKLIELQGDREKEVEQVSPSQLRRFVHTNPTSTFYHIRVESAAKLTPQTTHPLPEIDTLITKYASLFQPLMNLPPSCPTDHTINLLPNSTPVNVRPYKYPYFQKKEIEEQVATMLARGFIQPSSSPFSSPVLLVKKKDGSWRFCVDYRVLNAITVRDRFPIPTVDELLDELGGAHWFSKLDLMQGYHQILMNTTDISKTTFRTHQGNCEF

SEQ ID NO: 187804 - protein, 157 aa, Glycine max
  Coding DNA Sequence Number=SeqID_71026
  Gene Ontology: Mol. function=nucleotidyltransferase activity; Cellular component=cytoplasm; Biological process=biosynthetic process
  Homolog annotation: Hit_ID=Q9M2S0; Match level="QueryCoverage=88%, HitCoverage=38%, E-value=2e-34, Identity=51%"; Hit description =Mannose-1-phosphate guanylyltransferase-like protein
  Pfam annotation: Domain name=NTP_transferase; Domain location=1-157; Score=-94.4; E_value=0.01; Accession=PF00483.13; Description =Nucleotidyl transferase
MASPLETFISPWNFCILMAMLNFKNVSEAELGLKITLSEEAEPLDTTGPLALAKDLLLDASREPFLVLNAYITNDYPLKQIIDFHIEHDGEATELVSQATEPSKYCVAIMDHITGLVQSFQEIPQKFVGNRVNAGVYLMNPSVLNRIELTPTSMETK

SEQ ID NO: 187805 - protein, 96 aa, Glycine max
  Coding DNA Sequence Number=SeqID_71027
MQSTRVKKHSVISENITGWHSTVGEWASVYQCIIQEGALVGDDILVHGASISRLHPQLSRTSSEKCEIIVPIACYSSYFYLYLHNNQGWSTTTSSN

SEQ ID NO: 187806 - protein, 55 aa, Glycine max
  Coding DNA Sequence Number=SeqID_71028
MSLVELGALLLLLPLLILIATGSDVVDEVMAAGAEVVEMKTGVALTQGLRCYPAF

SEQ ID NO: 187807 - protein, 57 aa, Glycine max
  Coding DNA Sequence Number=SeqID_71029
MSLAFNENDKNGSIPAKGLSISGAMYKPESRSLQNKVHCIDSALEKQIFYTYRYAKQ

SEQ ID NO: 187808 - protein, 68 aa, Glycine max
  Coding DNA Sequence Number=SeqID_71030
MMLVSARQRARSPPVDERNCLCTDNTRGISIRHLTSWVRMTESAEDDVNLRVSTGSLAAIDKGCRRRR

SEQ ID NO: 187809 - protein, 91 aa, Glycine max
  Coding DNA Sequence Number=SeqID_71031
  Gene Ontology: Mol. function=DNA binding; Biological process=DNA integration
MNRAVEAANKNIKKIIQKMTVSYKDWHEMLPFALHEVSQALKDNRGKWAPNYEGPFIVKRAFSGGALVLANMDDEELPSPVNFDVVKRYYA

SEQ ID NO: 187810 - protein, 57 aa, Glycine max
  Coding DNA Sequence Number=SeqID_71032
MGGRPKDSVLGALSALGSLSTEKNALSETTMLSVLILEEVHRLSTPHAKPQPPYTWA

SEQ ID NO: 187811 - protein, 194 aa, Glycine max
  Coding DNA Sequence Number=SeqID_71033
  Homolog annotation: Hit_ID=Q1SKD7; Match level="QueryCoverage=77%, HitCoverage=38%, E-value=3e-08, Identity=26%"; Hit description =Ankyrin
NLQDSGTLKRIAWGLDVGTRATCPTLERNVELTPTMFDEFYGELQRQQWHRKLTRLPEKRIDVALVREFYANAYNLEDDSLKYCRVRGQIIRFGMKTLNNFLEAPVIIPEWEEYPTYSQYLHNYLNHQAIKAKLCTAGRQFILNANGAPWKLLRKDLTTLAQTWSILSCFNLAPTSHTSDLNMDRARLIYRLVS

SEQ ID NO: 187812 - protein, 150 aa, Glycine max
  Coding DNA Sequence Number=SeqID_71034
  Gene Ontology: Biological process=regulation of progression through cell cycle
  Homolog annotation: Hit_ID=Q9C5X2; Match level="QueryCoverage=57%, HitCoverage=37%, E-value=2e-25, Identity=62%"; Hit description =Cyclin J18
MTLRLARRKGRLVAMEYGCERLPMLEFLIQSAHVLNFEIGTTNIAFLFLEDLWIQFKKVAKVGELISIETCMEIMDLLYEKDEMSFLFRSPHSLSASILVASYVMAVPKQKWGFPVLAWVLTLYQPSNTSISMYRGTNKWIFVSKFCDLT

SEQ ID NO: 187813 - protein, 67 aa, Glycine max
  Coding DNA Sequence Number=SeqID_71035
MAISSRGTRAQQLASPSNLHGAIFDSREVLQDLSLYDRVHHCGSNAFQDYFDDAKESRVKQVPKNQE

SEQ ID NO: 187814 - protein, 101 aa, Glycine max
  Coding DNA Sequence Number=SeqID_71036
MTGTNLPLHRGVLIDLRQGKIIWRLGNEEKVFDPEINNFSSSPTCNFVQATNKMKTIVAKPYPCVGKEDLPRKKILPKDPGWSKKKGDRITIQALDYGVDQ

SEQ ID NO: 187815 - protein, 134 aa, Glycine max
  Coding DNA Sequence Number=SeqID_71037
  Gene Ontology: Mol. function=inositol or phosphatidylinositol phosphatase activity; Cellular component=intracellular; Biological process=abscisic acid mediated signaling
  Homolog annotation: Hit_ID=Q1RXP2; Match level="QueryCoverage=98%, HitCoverage=29%, E-value=4e-53, Identity=76%"; Hit description =Inositol polyphosphate related phosphatase
MKLTMELMRGNMLKGWHEGAIKFAPTYKYCPNSDMYYGCCYQGKNAAKKRAPAWCDRIIWFGNGLKQIQYARCESKLSDHRPVKTLFIAQVRVSSALKCFQSLFLSERFEQIKTHFGLLSNDEFVCKKQLSFRL

SEQ ID NO: 187816 - protein, 93 aa, Glycine max
  Coding DNA Sequence Number=SeqID_71038
MKNKKENLFKKEMDLGSSGLAIVSRSPSGCKAFYHHLMVLLESGILRIHAVEYHCLICVKASVDQGGARQMPKQAALDARAPPQSMSLVYLRQ

SEQ ID NO: 187817 - protein, 284 aa, Glycine max
  Coding DNA Sequence Number=SeqID_71039
  Gene Ontology: Mol. function=inositol or phosphatidylinositol phosphatase activity; Cellular component=Golgi-associated vesicle; Biological process=abscisic acid mediated signaling
  Homolog annotation: Hit_ID=Q1RXP2; Match level="QueryCoverage=99%, HitCoverage=62%, E-value=1e-108, Identity=70%"; Hit description =Inositol polyphosphate related phosphatase
MTGKLVEFMWPALVANKILNKRLGSSNFIADYPSNNTDIPLLGHDQSSLSSKSILNDHKDTDKYKIFVSTWNVGGIAPDEGLNMEDLLETSNNSCDIYVLGFQEIVPLKASNVLGYENNKISTKWNSIIGKALNKSTHHSFRDDKKEEDVKNNICCNNKEAGNNNNNPGQQCEAPQDFECIISKQMVGILISVWAKRELRPFIQHSSVSRVGCGIMGCLGNKGSVSVRFVLHETSFCFVCCHLASGGREGDEKHRNSNVAEIFSRSSFPRGPMLDLPRKILDHE

SEQ ID NO: 187818 - protein, 53 aa, Glycine max
  Coding DNA Sequence Number=SeqID_71040
MMIAIGPSGVVHALQLSKSIKPWAYGLTMALLVYHDPHELTTIMSLTWLLSGP

SEQ ID NO: 187819 - protein, 1065 aa, Glycine max
  Coding DNA Sequence Number=SeqID_71041
  Gene Ontology: Mol. function=RNA binding; Cellular component =spliceosome; Biological process=mRNA processing
  Homolog annotation: Hit_ID=Q1RXP4; Match level="QueryCoverage=92%, HitCoverage=65%, E-value=0.0, Identity=87%"; Hit description=AAA ATPase
  Pfam annotation: Domain name=ResIII; Domain location=388-510; Score= -31.7; E_value=0.021; Accession=PF04851.6; Description=Type III restriction enzyme, res subunit
MWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPSFEPLSTEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDLLETVDFKDTFVDADHLKESFLDYEVSFVNPDGSGNLNPRPPFKIKLPRTLKPNNGALTGHAISTSGATNEINVVDANYQKEALIIETYTPPDPGPYPQDQPKQNSVRFTPTQVEAIISGIQPGLTMVVGPPGTGKTDTAVQILNVLYHNCPSQRTLIITHSNQALNDLFEKIMQYITKCLFWGRGSSIIAPLCKRASLDTRRDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFCDTPHPVFTGESFEKDMRAAMGCFRHLKTMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPTIAKLYNWRYRDLGDLPSVKEEVIFNRANAGFAYDYQLVDVPDYLGKGETTPSPWFYQNEGEAEYVVSVYIYMRLLGYPANKISILTTYNGQKLLIRDVINRRCVPYDFIGPPSKVTTVDKFQGQQNDFILLSLVRTRFVGHLRDVRRLVVAMSRARLGLYVFCRRSLFEQCYELQPTFQLLLKRPDHLALNVNEITSYTERNVEDPGPGHHLHLVSGIEEMGSIIDRLYQEKLRHQFDQNGAYFSHLEPSANTDWVQSGQQTMDTDMPEQTEEATTVDNHVAVDMPPENSMEDVTMVDNGPRVATGNPSP

SEQ ID NO: 187820 - protein, 131 aa, Glycine max
  Coding DNA Sequence Number=SeqID_71042
MGICKTKDFDAQCVDRVEGSMKPGSSVCAPIARLTWRVDTRLRVPLSDVQGSCLDKWRAKSLSSPQVWTSVCSMSGVTCQAPEPRQVFFGLLLSSCPGGTCLWRVKSSLLAVPHQRILAEVPLTASPPLRR

SEQ ID NO: 187821 - protein, 161 aa, Glycine max
  Coding DNA Sequence Number=SeqID_71043
  Gene Ontology: Mol. function=phosphoribosylaminoimidazole carboxylase activity; Cellular component=phosphoribosylaminoimidazole carboxylase complex; Biological process='de novo' IMP biosynthetic process
  Homolog annotation: Hit_ID=P55195; Match level="QueryCoverage=47%, HitCoverage=13%, E-value=1e-24, Identity=74%"; Hit description =Phosphoribosylaminoimidazole carboxylase, chloroplast precursor
MPWSRVGGTKILGNDKVQGDLGFQLAHQLIKKALTIPGATVHWYDKPEMRKQRKMGHITIVGPSFSNIESNLAVLVEGKELDAKTAVGVPLDSFFYLGGPNIASEIYNKEYANARMCGEEKWRKTLVKFLRQPHYWSRKYIISILFTFDMEITKTLNSSFN

SEQ ID NO: 187822 - protein, 217 aa, Glycine max
  Coding DNA Sequence Number=SeqID_71044
  Homolog annotation: Hit_ID=Q6Z6P6; Match level="QueryCoverage=85%, HitCoverage=28%, E-value=2e-11, Identity=29%"; Hit description =Ankyrin repeat protein family-like protein
  Pfam annotation: Domain name=Ank; Domain location=136-166; Score =22.7; E_value=0.0013; Accession=PF00023.20; Description=Ankyrin repeat
  Pfam annotation: Domain name=Ank; Domain location=54-86; Score=9.1; E_ value=1.5; Accession=PF00023.20; Description=Ankyrin repeat
  Pfam annotation: Domain name=Ank; Domain location=88-122; Score=14.0; E_value=0.3; Accession=PF00023.20; Description=Ankyrin repeat
  Pfam module annotation: Pfam domain module=Ank::Ank::Ank; Domain location=136-166::54-86::88-122
MQFPSPDAASQVGLLHKEIVGKVMIYELYKAVEIGNVDNFVEVLKQQCIEITLAGDSLLHVAADLGKEEITELIAHHFPELLIRRNVRGDTPLHVAVRSKNFTSTIVKFILSHYATSKSKYDEMKDKEITRERNEHGDTPLHEAVYSGHVDLVKEIFGADMAAVHCLNKPKRSPQCAAVESGKVEILNLLLQIPFPADQPLSVSWKFSTPCSYTETK

SEQ ID NO: 187823 - protein, 137 aa, Glycine max
  Coding DNA Sequence Number=SeqID_71045
  Gene Ontology: Mol. function=metal ion binding
  Homolog annotation: Hit_ID=UPI000034EE49; Match level="QueryCoverage =92%, HitCoverage=27%, E-value=2e-17, Identity=37%"; Hit description =zinc ion binding
  Pfam annotation: Domain name=UIM; Domain location=76-93; Score=18.8; E_value=0.02; Accession=PF02809.10; Description=Ubiquitin interaction motif
MAPTSDINHLSHPCIYGDFVSSYTERKSGFMKWFGKIFNIGSSRGRGGGRHLQQPVEENMVWPAPARSLDDRARSRKEEEDLDHAIALSLGENFKRPTGYRWRTGTDEDYAKALQDRRFSSAHPPYAPVPFYPRGYG

SEQ ID NO: 187824 - protein, 422 aa, Glycine max
  Coding DNA Sequence Number=SeqID_71046
  Gene Ontology: Mol. function=nucleic acid binding; Cellular component= intracellular; Biological process=DNA integration
  Homolog annotation: Hit_ID=Q1S9T9; Match level="QueryCoverage=99%, HitCoverage=34%, E-value=1e-133, Identity=56%"; Hit description =Peptidase S8 and S53, subtilisin, kexin, sedolisin; Integrase, catalytic region; Zinc finger, CCHC-type
MNRTILKRVTCMLLGAGVHRSSALEYKTPMEVWSGSPVDYSNLRVFGALAYAYVKKDKLDARAVRCLFLGYVEGVKGYRLWRLDPKPSKLIINKDVTFNETRMRMYSENSECGKEKTHIKVEPFTDKETGHSVSNLRRSDHAINDYQLVRDRERRIPKPNRKLGQADLICYALTATEEIKGSAKPRNFKEAHESEERQLWLHAMKEELEVLRKNNTWRLVELPKGQKVVGGKSIFKRKGEILGVQKTRYKARLVAKGFTQVEGVNYNEIFAPVVKHYSIRILMSIGNQFKLHLEQLDAKTTFLHVDLEETIYMRQPKGFAVDDRVCLLQKSLYGLKQSPRQWYKKFDDFLIKMEFKRCSYDSCVYVLHQENYLYLLMYLDDILVASCNKCMINDLKSRMNSEFEMKDLGEARRILGVDIKRD

SEQ ID NO: 187825 - protein, 104 aa, Glycine max
  Coding DNA Sequence Number=SeqID_71047
  Gene Ontology: Mol. function=nucleic acid binding; Biological process= DNA integration
  Homolog annotation: Hit_ID=Q1S9T9; Match level="QueryCoverage=86%, HitCoverage=7%, E-value=7e-27, Identity=59%"; Hit description =Peptidase S8 and S53, subtilisin, kexin, sedolisin; Integrase, catalytic region; Zinc finger, CCHC-type
MKFSKSQGPISDDDRKKMDTVPCTSGVGSIMYGMVCTRPDLAHAVSVVSRFMVEPGQAHWEALKWILRYINGSLDSGLLYHKNSQGGTVIEGSETRSMAERDAT

SEQ ID NO: 187826 - protein, 337 aa, Glycine max
  Coding DNA Sequence Number=SeqID_71048
  Gene Ontology: Mol. function=zinc ion binding
  Homolog annotation: Hit_ID=UPI000034EE49; Match level="QueryCoverage =86%, HitCoverage=59%, E-value=1e-124, Identity=73%"; Hit description= zinc ion binding
MTIPINAAGLIEYRCHPYWNQKYCPSHEYDNTARCCSCERLESRGERYYRLEDGRILCFECMESAITDTGECQPLYHSIRDYYEGMNMKIDQQVPMLLVGREALNEAIVGEKNGFHHLPETRGLCLSEEQTVTSVYRWPRIGGHRLISMRSQAQRLPRKCEVTAILVLYGLPRLLTGAILAHELMHAWLRLKGYQNLSLEVEEGICQVLSYMWLDAEVMSCARTTPSTSSSASSSSYSNSSKKGVKSLVENKLGEFFMNQIANDSSPAYGGGFRAANQAVNKYGLRCTLEHIRLTVSNILIHNLVPCEGGVGWWHLGAAMVLGGGFGERQLRLLLGR

SEQ ID NO: 187827 - protein, 463 aa, Glycine max
  Coding DNA Sequence Number=SeqID_71049
  Gene Ontology: Mol. function=transporter activity; Cellular component= membrane; Biological process=oligopeptide transport
  Homolog annotation: Hit_ID=Q1SIG4; Match level="QueryCoverage=97%, HitCoverage=83%, E-value=1e-128, Identity=50%"; Hit description=TGF -beta receptor, type I/II extracellular region
  Pfam annotation: Domain name=MFS_1; Domain location=30-393; Score= -47.9; E_value=0.049; Accession=PF07690.6; Description=Major Facilitator Superfamily
  Pfam annotation: Domain name=PTR2; Domain location=1-377; Score =296.3; E_value=5.8e-86; Accession=PF00854.12; Description=POT family
  Pfam module annotation: Pfam domain module=MFS_1::PTR2; Domain location=30-393::1-377
MLTVSQFIPNLKPCHNDICDRPSKAHKLVFFLALYSIALGTGGFRPCLESFGADQFDDDHFDERKKKMSFFNWWSFTLSVSSMLATTVVVYVQDFVSWGDACLILTMFMALTSIAFYAGIPFYRYRMKPKGNPFMPILQVLIAAIRKRNLSCPSNPALLYEVPMSENSQGRLLSHTRRLRFLDKAAIVEEKYTEQKVSPWRLATVTRVEETKLILNVFPIWLTSLMTGVCIANGSTLFVKQAAAMNLKINNNFKIPPASMASVSSISIIISVPIYDRIIVPNLRKVTGNERGISILRRIGIGLAFSVIVMVVAAFVENMRLRMSGHENLMSVMWLIPQYLILGIGNSFYSIGLQEFFYDQVPDSMRSLGMALYLSVLGIGFFLSSFLIIVVDHVTAGKNGKSWIAEDVNSSRLDKFYWMLAVINALNFCLFLFLTKRHTYKTVQRKATEIDDGCHSDGVDTVA

SEQ ID NO: 187828 - protein, 73 aa, Glycine max
  Coding DNA Sequence Number=SeqID_71050
MANSEGKNGQEGNKLQTDNMTLKCENKIPGNGAKNLLTRWQVYQIVTSSKVLGSPSVESTGTLFVLRLMQTPI

SEQ ID NO: 187829 - protein, 474 aa, Glycine max
  Coding DNA Sequence Number=SeqID_71051
  Gene Ontology: Mol. function=nucleic acid binding; Cellular component= intracellular; Biological process=DNA integration
  Homolog annotation: Hit_ID=Q1RXN8; Match level="QueryCoverage=95%, HitCoverage=39%, E-value=1e-151, Identity=53%"; Hit description =Peptidase S8 and S53, subtilisin, kexin, sedolisin; Integrase, catalytic region; Zinc finger, CCHC-type
FLNQQVALSVEKNAKVNKIIQEMATKFDIKKFFGSNDFGLWKIKMEAILIQQGCDEVLKGELNMPPTLTHAKKKSIIDKARSAIILCLGDKALREVAKEKTAAGIWAKLESLYMTRSLAHRLCLKQQLYSFKMAETRTIEEQLAEFNKNIDDLENIGVKLEDEDKVIILLNALPKTFEHFRDALLYGKDQLNTLEEVVTSIQTKEFQKLQDSKITEEVGHIKKHCPKKGTKASRVTETADVAKAYEGYESAGVLVASSDDSQKSWVMDSRCTYHMCPVKDYFEDLEQKEYGTVLLGNNKACKVHGIGTVRLRMYNPELKRNLISISMFDLIGYITKVENGIMKVSTGASIIAKGRRSNGLYILEGSTVIGQASVASQTMEDKSKLWQLQLGHISDKSKLWHLLMGDKLHKLEFCDQYVLGKSHRVKFGTDLWGPFRIQTHGGGSYFLSIIHDYSRRVWVYILRNKAETSQKFKE

SEQ ID NO: 187830 - protein, 119 aa, Glycine max
  Coding DNA Sequence Number=SeqID_71052
  Gene Ontology: Mol. function=transporter activity; Cellular component= integral to membrane; Biological process=oligopeptide transport
  Homolog annotation: Hit_ID=Q852B2; Match level="QueryCoverage=85%, HitCoverage=19%, E-value=5e-25, Identity=48%"; Hit description =Putative peptide transport protein
MEQEMEKRKGGRIEESDEEKWVHDASVDYKERVPLRASTAIALSERITYFGISSNLIMYLTRVMHEDLKTATNNVNCWKGATTLLPLIGGFLGDAYIGRFRMVFFSSLVYFKVYSFFFL

SEQ ID NO: 187831 - protein, 101 aa, Glycine max
  Coding DNA Sequence Number=SeqID_71053
MELREPGNILSISRSFGAGFGFWLRIWICLRFIYTFLGLGVAFCVITCLGHVAAETANGCCLYLVSFSLIYHYISIYDARIQALLSDMFLIQCKDMTLLKT

SEQ ID NO: 187832 - protein, 169 aa, Glycine max
  Coding DNA Sequence Number=SeqID_71054
  Gene Ontology: Mol. function=N-acetyltransferase activity; Biological process=metabolic process
  Homolog annotation: Hit_ID=Q337G6; Match level="QueryCoverage=87%, HitCoverage=84%, E-value=4e-33, Identity=46%"; Hit description =Acetyltransferase, GNAT family protein, expressed
  Pfam annotation: Domain name=Acetyltransf_1; Domain location=50-144; Score=57.0; E_value=6.1e-14; Accession=PF00583.14; Description =Acetyltransferase (GNAT) family
MAKVAIVELNRNCANTVEEIVKMERKIFPKHESLASFFHDELRKKNSGLLYIHVNGVIAGYVMYSWPSSLYGSITKLAGSNPTSFSCLVLSHGIMEQWRGQGHGEALLKAGIEKCRTRKVSRIMLHVDPLRTPAVNLYKKHGFQIDTLVEGYYSSDRDAYRMYLDFDSS

SEQ ID NO: 187833 - protein, 580 aa, Glycine max
  Coding DNA Sequence Number=SeqID_71055
  Gene Ontology: Mol. function=transporter activity; Cellular component= integral to membrane; Biological process=oligopeptide transport
  Homolog annotation: Hit_ID=Q9M331; Match level="QueryCoverage=97%, HitCoverage=93%, E-value=1e-171, Identity=50%"; Hit description =Transporter-like protein
  Pfam annotation: Domain name=MFS_1; Domain location=45-510; Score =16.6; E_value=5.5e-05; Accession=PF07690.6; Description=Major Facilitator Superfamily
  Pfam annotation: Domain name=PTR2; Domain location=107-494; Score =309.2; E_value=7.7e-90; Accession=PF00854.12; Description=POT family
  Pfam module annotation: Pfam domain module=MFS_1::PTR2; Domain location=45-510::107-494
MEQEMEKRKEGTSEEEKWVHDASVDYKGRLPFRASTGVWKASLFVLIFEFSERISYFAMFSNLITYLTKVIHQDLSTAAKSVNYWAGTTTLMPLVGGFVADAYTGGFNMIIFSSLVYLMGLSLLILSQFIPSLKPNINNQPRVAHEVAFFLAIYCISLGTGGHKPCLQSFGADQFDEDHREERKKKMSFFNLWSFTVCFAMLLGATVVVYVQDFVSWGVASLIITILMALTTIAFYAGRPFYRYKQPAGNPFRPILQVLVAAIRKRNLSCPSNPALLYEIPELEKSQGRLLSHTSGLRFLDKAAIIEEKYVEQRDNAWRLATVTRVEETKLVLNVVPIWLTSLTTGVCWAQASTLFVKQATTMNLKMTESFTLPPASLVSVAAIGVLISLPIYDRVIVPILSKVTGNERGISILRRISIGMTFSVIVMVAAALVEAKRLRIVGQRTMSVMWLIPQYLILGIANSFSLVGLQEYFYDQVPDSMRSIGMALYLSVIGVGNFLSSFLIIIVNHVTGKNGKSWIGKDINSSRLDRFYWMLAVINALDLCAFLFLASSYTYKTVQRTTMDTDGCNKSDGVETVAK

SEQ ID NO: 187834 - protein, 67 aa, Glycine max
  Coding DNA Sequence Number=SeqID_71056
MEEAFLEHWLLAFLRLTRNFRAEVCTAKMNLSAAEVCIAITLNYATGLQRCGKSCKKNRPSLKFMPS

SEQ ID NO: 187835 - protein, 77 aa, Glycine max
  Coding DNA Sequence Number=SeqID_71057
MEMVFSSALKFSCKKKKMKVQVMLFGEKMVLQVTEPVVKPTSGAVCGDKIKKDGNNKVSVNFNVLKALERFSFQRLA

SEQ ID NO: 187836 - protein, 96 aa, Glycine max
  Coding DNA Sequence Number=SeqID_71058
MDTILGLTILYYLCELVHLPTSESKVVKGNMFPIIDNIMIVDWIADDLSTNYLIPSLGSAIRVNFLKLKEDVNKDEVLSAVKGILENFKKISVGRK

SEQ ID NO: 187837 - protein, 447 aa, Glycine max
  Coding DNA Sequence Number=SeqID_71059
  Gene Ontology: Mol. function=hydrolase activity; Cellular component =spliceosome; Biological process=mRNA processing
  Homolog annotation: Hit_ID=Q1RXP4; Match level="QueryCoverage=100%, HitCoverage=29%, E-value=0.0, Identity=76%"; Hit description=AAA ATPase
MTKVYGTGLYDFRRHRVAEYPVAAAPAESKTLVPKTGGGGGGVPSSITLSEIQRDRLTKIAEANWLKSGDAGRPKKDFDPELVRKIYETELLVKEGSKPVPLQRVMILEVSQYLENYLWPYFDPLTATSSMLCPSSSWSTRRSLSSSNNFRENVAAWTCFHERKDAFKGFLESVLRLKEGRELSIAEKTNYLVFMINAFQSLEDEVVSRTILRLANLKSWYSLSYGRFQMELCLNPGLIKKWKRMIKKEPVKGDGSHLDPSTTVEVMFVRNLIEEFLEILDSQVFPLKQLSGEDDELIDATGLGLVNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLSKKLSVLSPEELRDFVCCK

SEQ ID NO: 187838 - protein, 95 aa, Glycine max
  Coding DNA Sequence Number=SeqID_71060
  Homolog annotation: Hit_ID=O22265; Match level="QueryCoverage=90%, HitCoverage=27%, E-value=3e-07, Identity=33%"; Hit description =Signal recognition particle 43 kDa protein, chloroplast precursor
MVAGYVRPDVAKVFLDLSADPGVRKGDAGANLDHRDQSSVAHGSRILVRIPRKMEMQEILERRGKGENLEYLVRWKDGGANKRVKQILSIFNKYW

SEQ ID NO: 187839 - protein, 417 aa, Glycine max
  Coding DNA Sequence Number=SeqID_71061
  Gene Ontology: Mol. function=methyltransferase activity; Cellular component=cytoplasm; Biological process=metabolic process
  Homolog annotation: Hit_ID=Q1RXR5; Match level="QueryCoverage=64%, HitCoverage=52%, E-value=7e-92, Identity=61%"; Hit description=SAM (And some other nucleotide) binding motif
  Pfam annotation: Domain name=Methyltransf_11; Domain location=98-185; Score=12.7; E_value=0.003; Accession=PF08241.2; Description =Methyltransferase domain
  Pfam annotation: Domain name=Methyltransf_12; Domain location=98-183; Score=13.4; E_value=0.029; Accession=PF08242.2; Description =Methyltransferase domain
  Pfam module annotation: Pfam domain module=Methyltransf _11::Methyltransf_12; Domain location=98-185::98-183
MFPQENHSNGYQHQQGYSHRERVRRGTCRSRASTSSHSHSVRVYDQPRPPCTDFDVAYFHSYAHLGIHQEMIKDRVRTDTYRDAIMQHQSFIAGKVVVDVGCGTGILSIFCAQAGAKRANEVVKANNLSDVVVVLHGRVEDVEINEEVDVIISEWMGYMLLYESMLGSVINARDRWLKPGGLILPSSSTLYMAPVTHTDRYSDSVDFWRNVYGIDSEFSTWTKREREYPSPDQYDPRGKVSAMVSLAKQCAFEEPSVETITGENVLTWPHVGVEGRGGEWRKKGEKEGNGEGRGVAEGGEGGHTVAVAVSLASNRCLRKQIHGTLLSWGHNDERLLWTIGTIGSSKKLRDRLECASAAALVASKLGQDIAAFVYHDLTQQGTLFTGRCLRKAQFSDKRTTLFHAQKRKCFKRPCTTP

SEQ ID NO: 187840 - protein, 270 aa, Glycine max
  Coding DNA Sequence Number=SeqID_71062
  Gene Ontology: Mol. function=nucleic acid binding; Cellular component= intracellular
  Homolog annotation: Hit_ID=Q9FNN4; Match level="QueryCoverage=59%, HitCoverage=33%, E-value=8e-61, Identity=71%"; Hit description =Arabidopsis thaliana genomic DNA, chromosome 5, P1 clone:MAH20
  Subcellular localization annotation: CTP_CleavageSite=58; ConfidenceScore=5.88e-01
MASTSSSSCSLASQFLPPPRKLSVIPFHSTNCTHLSFPAVVTPRQQPLLLFSSTSTCLAAAAAAASNSNNIWNSNNNNKPASSKEKEVEVEVDEELPWIQEKALDLVEFTGSVTQAIPGPRVGPTSLPWILAIPLTYAGLTFVIAFVKTIRKFSSPKAKRRRQVSKNATLCKSLDDLFEKGRDQVKLDALKQIENKTGFDLEEILRKYIRYTLNEKPFNPDMVADLIHLRKASILNDSQVAEILNDISRRIVRDKGNPRSRKSNPNSDEL

SEQ ID NO: 187841 - protein, 224 aa, Glycine max
  Coding DNA Sequence Number=SeqID_71063
  Gene Ontology: Mol. function=metallopeptidase activity; Cellular component=cytoplasm; Biological process=amino acid metabolic process
  Homolog annotation: Hit_ID=Q1RXR3; Match level="QueryCoverage=86%, HitCoverage=38%, E-value=6e-81, Identity=77%"; Hit description =ArgE/dapE/ACY1/CPG2/yscS
MENLFKSIESIRRFRSSQFDLIKAGFKAEGDVVSVNMVFLKAGTPSPTGFVMNLQPSEAEAGFDIRVPPTADPESLERRIAEEWAPSSRNMSFTNKENKGQKTVENSISILAGTEFKQKAHTRDKSGKPILTKTDSSNPWWALLENAVQKAGGKLGKPEVFPAATDSRYFRERGLPAIGFSPMANTPVLLHDHNEGMLSGLFELGSILVGEGSARMLSLQNEEC

SEQ ID NO: 187842 - protein, 47 aa, Glycine max
  Coding DNA Sequence Number=SeqID_71064
MAWRQGEQKADVTILLSPLQIPLCLITLIMKVADPTCITARTCSGSV

SEQ ID NO: 187843 - protein, 182 aa, Glycine max
  Coding DNA Sequence Number=SeqID_71065
  Subcellular localization annotation: CTP_CleavageSite=6; ConfidenceScore=5.43e-01
MNLFPSAVHVSSTFECGAPRIDCLAKFANSPFSTFIRSPMNPLPNAVHVSSTFESGAPRIDRLALFANSPFSTFIRSPMNLLPSAVHVSSTFESGARRIDCLALFANSPFSTFIRSPKNLLPSVVHVSSTFESGAPRIDCLALFANSPFSTFIRSPMNSLPNAVHVSSTFESGAPRIDCLAL

SEQ ID NO: 187844 - protein, 302 aa, Glycine max
  Coding DNA Sequence Number=SeqID_71066
  Pfam annotation: Domain name=SAM_1; Domain location=207-275; Score =28.4; E_value=2.6e-05; Accession=PF00536.20; Description=SAM domain (Sterile alpha motif)
  Pfam annotation: Domain name=SAM_2; Domain location=203-270; Score =13.8; E_value=0.051; Accession=PF07647.7; Description=SAM domain (Sterile alpha motif)
  Pfam module annotation: Pfam domain module=SAM_1::SAM_2; Domain location=207-275::203-270
MYADRVEGGARRPVKERLNDVNGVSGSTRPQQQRQITGKRRRGRPRKILGEVVKRDLMAFLEESFNHGELVPPKLGMDRSRQDDKWEHDLFDNDEPRITSMDKIILICNYKLPLLLDANNRKVSAQDLRFKLQRKGLQPASQSGKSSAPNVLDLRERLSGTMAPQPTNYDLPKTKVIKPSSKSVGVEAPAVQIKRPADPAPKKSWKAGPSVDEFLRSLGLEKYLITFQAEEVDMTALNHMTDEDLKAMGIPMLGSFEWRVTVTFLRISIQIRCCFKLRLGIWLPYDLKHIGFRKVPHACRGI

SEQ ID NO: 187845 - protein, 78 aa, Glycine max
  Coding DNA Sequence Number=SeqID_71067
  Gene Ontology: Mol. function=chlorophyll binding; Cellular component =photosystem; Biological process=photosynthetic electron transport
  Homolog annotation: Hit_ID=Q95DZ4; Match level="QueryCoverage=54%, HitCoverage=19%, E-value=3e-12, Identity=91%"; Hit description =Photosystem II CP47 protein
MTVVGVVESDWREVYLIKDKKKVAEKEGSTRERHMSGHIWHGARTLFRDVFAGIYPDLEAQVEFGAFQNLEIQLQKDK

SEQ ID NO: 187846 - protein, 47 aa, Glycine max
  Coding DNA Sequence Number=SeqID_71068
MANVVERENNGDRVLVRELEFEGKEKCCLCGREIQFCLVRKAGKGTL

SEQ ID NO: 187847 - protein, 1279 aa, Glycine max
  Coding DNA Sequence Number=SeqID_71069
  Gene Ontology: Mol. function=RNA-directed DNA polymerase activity; Cellular component=chromatin; Biological process=chromatin assembly or disassembly
  Pfam annotation: Domain name=rve; Domain location=1045-1176; Score =48.8; E_value=1.9e-11; Accession=PF00665.16; Description=Integrase core domain
  Pfam module annotation: Pfam domain module=RVT_1::Retrotrans _gag::rve; Domain location=603-772::127-218::1045-1176
MADATRNRILEREIEDRMENRLSSKIDERFMEMAASMQQTLHDSLTQSLALSISQQMQDLLRNNSKGKTHSPTGGSPIRGARSSYSCGTRLARIDFPRFSGSDVKQWLIQCDTFFSIDNTPEEFKVRLAVVHFEGKALQWHSSYVKSVGLQNLPPWLEYTRILIERFGEVYDDPMAELMQLRQKGSIGEYHEAFDAIVARLDLSEEHRLSCFWGGLKQEVQMLVRMFQPNSVRRAFTLAKMHEAATVHGSVTKSWNKQSKPEVSSKPPLLPTPPKTISKTQDIPKIKQQASKTLTPAYMSDRRAKGLCYLCDEPFTPEHGLSHKTLQMHVMEVDELQEGAEEEVLLENSTGSSSIDPQIFVHALTGIANFHTMRVTGYYQKKPLHVLIDSGSTHNFLDIEVAKKLGCKINAFDSLSVVVADGFQWTIQQTKFTSDMLLIPLGCCDLVLGLEWLVSLGDIVWNFNKLQMEFYVKGRRHVLRGASTGLKTVKRQQLGKAMSTGVHLSILQVCDGQMGLLNSLTTQAVDKEVPPTLAKLLDEFSDLFQEPSGLPPHRPGHDHQIPLVQGVGPISKRPYRYAKQHKDVIDKLVQESLSTGIIQNSSSPFTSPVVLVGKKDGSWRLCVDYRDLNKHTVKNKFPIPLVDDLLDELAGSSIFSKIDLRSGYNQVRMDPADVYKTAFKTHVRHFEYLVMPFGLTNAPATFQGLMNSVFKEFLRKFLLVFFDDILVYSCSLEDHLLHLHKVLETMRANSLFAKRSKCYFGVSKVEYLGHFISKEGVSTNPAKVLAVEQWPLPQTLKQLRSFVGLAGYYKRFVKGYGGIAKPLTNMLKKDNFIWSDAAKLAFQQLKKKLTETPVLALPDCSKTFVVEVDASGLGIGAVLMQDHHPIAYISRHLNHQQKTCKRNLQDSGTLKRVAWGLDVGTRGHDNVAADALSRVEPIACQALAVHQVVSELVIKIKASWDSDPAVQRLISELQANSSSHKHYSWKNGELMRKGRLVVGRDDALRQDILLHFHASAAAGHSGRNATLQRLKYMVYWKGMSKDVRALVQQCSHLTMDFIEGLPSSFGKQVIFVVVDRLSKVAHFMALSHPYYATNVAQSFLDHDLMAFQGVQVQLSTAYHPQTDGQTEIVNRCLETYLRCMCADSPSQWSKWLPLAEWWYNTAFHSSIRATPYEVVYGQPSPVNPPYLAGASKIELMDRSLLKREEMLKLIKFHMKRAQDRMKQLANKHRSERQFNIGDMVYVKLHPYRKISVAARSNMKLSPKFYGPFQVLEQIGVVAY

SEQ ID NO: 187848 - protein, 604 aa, Glycine max
  Coding DNA Sequence Number=SeqID_71070
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=8e-56, Identity=28%"; Hit description= UPI00006A17C9 related cluster
GVHVLAFRGVHALTFRGLHVLAFRGLHVLAFRGLDVLIFRGLHVLVFIGLQALAFRGLHVLTFRGLHALTFHGQHFLTFRGLHVLTFVGLHVLAFIGLHVLAFGGLHTLAIRGLHVLTLRRLHALAFRGLHTLNFRGLHAFAFKGQHVLTFRELHVLAFRGLHALSFRGLHVLAIGGLSTTLVAFRGLHAVAFRGLHVLTFRGLHALTFKGLHVLGFRGLHVLAFTGLHVHTFRGLHALTFRGLHVLTLRGLHALVFSSECCTPSPSEDYTSSPSEACTGLHVLAFRGLHVLAFRGLHVVPSKEYRSSRLEGYTSLPLERTRPHLQRTTRPHHERTTHPRFQRATRPRLQRITRPPFKGLHVLAFRGLHVLAFRGYKPTPSEDYTGQHALAFRGLHVLAIRGVHALTFKGLHVLSFRGLNVLSFRGLHALTFRGLHILAFRGLHALTFRGLHVLAFRGLHVLAFRWHHALTFRRLHVLAFRGLHALTFNGLHVLAFRGLHVLAFRGLHGLTFRGLHVLTLRGLHALAFTGLHAVTFRGLHVLAFRGLHVLAFKGLLALPIRGLDALTFRGLHILAFRGLHMLAFRGLHVLAFRGLHVLAFRGLH

SEQ ID NO: 187849 - protein, 276 aa, Glycine max
  Coding DNA Sequence Number=SeqID_71071
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=3e-45, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VTLEDPRTTRLAFRGLHALAFRGLHVLAIGGLHVLTFRVLNVLAFRGLHILAFRGLHVLALRGLHVRTLRGLHVLAFRGLQYLAYRGLHVVAFRGLHVLTFRGLHALTFKGLHVLGFRGLHVLAFTGLHVHAFRGLHALTFRGLHVLTSRGLHALAFRGLHAVTFRVLHAVTFRGLHVFAFRGMHILAFKGVHALPIRGMHALTFRGLHVLAFKGLHVLAFRGLHVFAFRGLHVVAFRGLHVLPSKDYTSSRLEGYTSLPLEGTRPHLQRTTRPHV

SEQ ID NO: 187850 - protein, 66 aa, Glycine max
  Coding DNA Sequence Number=SeqID_71072
  Homolog annotation: Hit_ID=Q00M75; Match level="QueryCoverage=46%, HitCoverage=5%, E-value=1e-09, Identity=96%"; Hit description=PPR -repeat containing protein
MREGYCTQPYPCICKEAVSGFEPMTNKSPRHNFTAVPGLALRKNENIFTIPVVNFFEYPQWNAWGK

SEQ ID NO: 187851 - protein, 104 aa, Glycine max
  Coding DNA Sequence Number=SeqID_71073
MAPARALISRLTEEKNNAIQQNSKLCQELMWGKSVRSSQGATEEGRQQKSWWSLICHCRINWLAWHNYGVSHEDNLSISAIQSFTIVFDLSFFVPDYSSNYEES

SEQ ID NO: 187852 - protein, 90 aa, Glycine max
  Coding DNA Sequence Number=SeqID_71074
  Subcellular localization annotation: CTP_CleavageSite=56; ConfidenceScore=5.30e-01
PLGGMRLKWAPGLHTLVSRGAFVKRTRCGTCRTRPKWAPGLHTLVSREISKYMRMRASMRKLEIVAANGSSICTPVAGLTWRINTYRLGV

SEQ ID NO: 187853 - protein, 100 aa, Glycine max
  Coding DNA Sequence Number=SeqID_71075
MSKIPTVEVCAFEYRTTYPNFMKIQRLQCEGFSSKLRHNIEIPNGENARNWVANVVFKFHDGPTVNEPEIIVFLRQVWWAAGKRKGFERRRGKTKMRHLT

SEQ ID NO: 187854 - protein, 576 aa, Glycine max
  Coding DNA Sequence Number=SeqID_71076
  Gene Ontology: Mol. function=transporter activity; Cellular component= integral to membrane; Biological process=oligopeptide transport
  Homolog annotation: Hit_ID=Q9M331; Match level="QueryCoverage=95%, HitCoverage=91%, E-value=1e-172, Identity=51%"; Hit description =Transporter-like protein
  Pfam annotation: Domain name=MFS_1; Domain location=41-506; Score =17.2; E_value=5.2e-05; Accession=PF07690.6; Description=Major Facilitator Superfamily
  Pfam annotation: Domain name=PTR2; Domain location=103-490; Score =321.5; E_value=1.4e-93; Accession=PF00854.12; Description=POT family
  Pfam module annotation: Pfam domain module=MFS_1::PTR2; Domain location=41-506::103-490
MEKRKEGTSEEEKWVHDASVDYKGRLAFRASTGVWKASLFVLIFEFSERISYFAMFSNLITYLTKVIHQDLSTAAKSVNYWAGTTTLMPLVGGFVADAYTGGFNMIIFSSLVYLMGLSLLILSQFIPSLKPNNNNQPRVAHEVAFFLAIYCISLGTGGHKPCLQSFGADQFNDDHREERKKKTSFFNWWSFTVCFAMLLGATVVVYVQDFVSWGVASLIITILMALTTIAFYAGRPFYRYKQPAGNPFRPILQVLVAAIRKRNLSCPSNPALLYEIPELEKSQGRLLSHTSGLSFLDKAAIIEEKYVEQKDNAWRLATVTRVEETKLVLNVVPIWLTSLTTGVCWAQASTLFVKQATTMNLKMTESFTLPPASLVSVAAIGVLISLPIYDRVIVPILRKVTGNERGISILRRISIGMTFSVIVMVAAALVEAKRLRIVGQRTMSVMWLIPQYLILGIANSFSLVGLQEYFYDQVPDSMRSIGMALYLSVTGVGNFLSSFLIIIVNHVTGKNGKSWIGKDINSSRLDRFYWMLAVINALDLCAFLFLARSYTYKTVQRRTMDTDGCNKSDGVETVAK

SEQ ID NO: 187855 - protein, 480 aa, Glycine max
  Coding DNA Sequence Number=SeqID_71077
  Gene Ontology: Mol. function=pepsin A activity; Cellular component =cellulose and pectin-containing cell wall; Biological process =proteolysis
  Homolog annotation: Hit_ID=Q1SPA3; Match level="QueryCoverage=99%, HitCoverage=100%, E-value=0.0, Identity=71%"; Hit description =Peptidase aspartic, active site
  Pfam annotation: Domain name=Asp; Domain location=69-466; Score= -126.6; E_value=3.9e-06; Accession=PF00026.14; Description=Eukaryotic aspartyl protease
  Subcellular localization annotation: CTP_CleavageSite=51; ConfidenceScore=5.44e-01
MASTTMLLLVVFMILCISHPSFQMVLVPLTHTLSKAQFNSTHHLLKSTSTRSAKRFRRQLSLPLSPGSDYTLSFNLGPQAQAQPITLYMDTGSDLVWFPCAPFKCILCEGKPNEPNASPPTNITQSVAVSCKSPACSAAHNLAPPSDLCAAARCPLESIETSDCANFKCPPFYYAYGDGSLIARLYRDTLSLSSLFLRNFTFGCAHTTLAEPTGVAGFGRGLLSLPAQLATLSPQLGNRFSYCLVSHSFDSERVRKPSPLILGRYEEKEKEKIGGGVAEFVYTSMLENPKHPYFYTVSLIGIAVGKRTIPAPEMLRRVNNRGDGGVVVDSGTTFTMLPAGFYNSVVDEFDRRVGRDNKRARKIEEKTGLAPCYYLNSVADVPALTLRFAGGKNSSVVLPRKNYFYEFSDGSDGAKGKRKVGCLMLMNGGDEADLSGGPGATLGNYQQQGFEVEYDLEEKRVGFARRQCALLWERLNRDKN

SEQ ID NO: 187856 - protein, 213 aa, Glycine max
  Coding DNA Sequence Number=SeqID_71078
  Gene Ontology: Mol. function=transition metal ion binding; Cellular component=cytoplasm; Biological process=proteolysis
  Pfam annotation: Domain name=Transposase_21; Domain location=128-213; Score=-131.7; E_value=0.0023; Accession=PF02992.5; Description =Transposase family tnp2
MIRDLGQDYFQQACAPLYDKIESDSKKPLYSGCTTFTRLSTMLAFVNIKARFVWSHKSFTELLVLLKKMLPEENTLPKNHYEVKKILCPMGMEYQKIHACLNDFILYKNKFAEMCKRHTCGVPRYKLKDDECSNDATTNNSRPTDVCCQETQGLALLCMMIVGPRKPGNDIDVYLTPLIEDLRKLWEDRVDVWDGNRQHTFKLRVMELMKHWA

SEQ ID NO: 187857 - protein, 47 aa, Glycine max
  Coding DNA Sequence Number=SeqID_71079
MRPRHFRIASVIDSYIILHRSFFEFTLCTLKGPLLLFASSSSFFYHQ

SEQ ID NO: 187858 - protein, 134 aa, Glycine max
  Coding DNA Sequence Number=SeqID_71080
MPWELMVLMAISLGVCIRGQVRERKRVAMRVLGNTEIMGDQEGTRLLQRFSLGPKCTLPLSPEFASLIPQTVGTWITQFHAYIRIKEGGTYSNHITPTLVLLLHLFSLFKLPWYGFYYTHRHTNIAHYDRLLLI

SEQ ID NO: 187859 - protein, 104 aa, Glycine max
  Coding DNA Sequence Number=SeqID_71081
MDMMQKALHGMQMAEPVMVCSDIRPILHNGRQLIICIHTLWTRQETYVEAMPSKVILMMPKNQESSKIQRFKNQASSFKIQDSRIIKIKIQDSRFKNQEKTQSR

SEQ ID NO: 187860 - protein, 68 aa, Glycine max
  Coding DNA Sequence Number=SeqID_71082
  Gene Ontology: Cellular component=spliceosome; Biological process =nuclear mRNA splicing, via spliceosome
  Homolog annotation: Hit_ID=Q1SPA7; Match level="QueryCoverage=63%, HitCoverage=19%, E-value=6e-19, Identity=100%"; Hit description =Cwf15/Cwc15 cell cycle control protein
MTTAARPTWAPAKGGNEQGGTRIFGPSQKYSSRDIASHTTLKPRVQKGGRQLFTQTQYSCLHNKASYK

SEQ ID NO: 187861 - protein, 209 aa, Glycine max
  Coding DNA Sequence Number=SeqID_71083
  Gene Ontology: Mol. function=protein-arginine omega-N symmetric methyltransferase activity; Cellular component=cytoplasm; Biological process=regulation of protein binding
  Homolog annotation: Hit_ID=Q1SPA4; Match level="QueryCoverage=79%, HitCoverage=24%, E-value=1e-85, Identity=87%"; Hit description=SAM (And some other nucleotide) binding motif
MDLMVDLLLAEPFYVGHDGMLPWQNLRFWKDRTTLSDILSEDALIIPCKGILRACAVSLPDLWKSRCCLSNVEGFDHSVVNATLGACGHLPDLEEGPCLPFFVWQCGEFDVLSETFDVMEFDFSKQICQCQGKSQVKFTKTGVCHGFVLWINWVMDLQNSVVISTGPDERLNQDPRQNSYLIKDLEQYYELLLILSILRLHIGDIGNRE

SEQ ID NO: 187862 - protein, 584 aa, Glycine max
  Coding DNA Sequence Number=SeqID_71084
  Gene Ontology: Mol. function=transporter activity; Cellular component= integral to membrane; Biological process=oligopeptide transport
  Homolog annotation: Hit_ID=Q7XJQ3; Match level="QueryCoverage=94%, HitCoverage=96%, E-value=0.0, Identity=54%"; Hit description =Putative peptide/amino acid transporter
  Pfam annotation: Domain name=MFS_1; Domain location=47-516; Score =33.4; E_value=7.9e-07; Accession=PF07690.6; Description=Major Facilitator Superfamily
  Pfam annotation: Domain name=PTR2; Domain location=109-500; Score =303.0; E_value=5.6e-88; Accession=PF00854.12; Description=POT family
  Pfam module annotation: Pfam domain module=MFS_1::PTR2; Domain location=47-516::109-500
MEQEMEKRNEGRIEESEEKWVHDASVDYKGRVPLRASTGVWKASLFVLTIEFSERVSYFSIASNLISYLTKVMHEDLSTASKNVNYWSGTTTLMPLVGGFVADAYTGRFYMVLFSSFVYLMGLSLLIMSQFIPSLKPCNTKICQEPRKVHEVVFFLALYCISFGTGGYKPCLESFGADQFDDDHLEERKKKMSFFNWWNFALCFALLLGATVIVYVQDFVSWGVATLILAILMALTVVAFCVGKPFYRYRRAEGNPLTPIFQVLIAAIRKRNLSCPSNPSLLHEVPELERTQGRLLSHTNRLRFLDKAAIIEEKRVEQKYNPWRLATVSRVEETKLVLNIIPIWLTSLTIGVCVGQGQTLFVKQAAATNLEISDSFKIPPASMASVAAVGTLIAVPIYDRIVVPILRKVTGNERGINILRRIGIGMTLSVILMVVAALVEKKRLRLMVGHETMSVLWLIPQYLILGVGDSFSLVGLQEYFYDEVPDSMRSIGMALYLSVLGVGFFLSSFLIIIVEHVTGKTGKSWIGKDINSSRLDKFYWMLAVINAFVLCVFLLVSKRYTYKTVQRRAMETDSCKSDGVEMVA

SEQ ID NO: 187863 - protein, 45 aa, Glycine max
  Coding DNA Sequence Number=SeqID_71085
MSNPILDLVREKLRPEEDLGPRGQWCMRRRAVQLLSNADDREKNH

SEQ ID NO: 187864 - protein, 129 aa, Glycine max
  Coding DNA Sequence Number=SeqID_71086
MQYCGCDKGYAQRQHAQDDDMGSFHNSPKGMTEESNFRDNDKSYKRDMDHEIKDLKGRHVGQEKEEMKNLEQLRKNTNTIIGGFAEEGPPRHAKNISKLFVQSIWYPPTKCQRCCPFKDATYHIQRHGF

SEQ ID NO: 187865 - protein, 418 aa, Glycine max
  Coding DNA Sequence Number=SeqID_71087
MAWVIDRCMDSLSLNLYTMQRTDVGNVKNISKNGLRNRNDNAHWQMVVLCPKDNVVVWFCSVRRKPDVHIKIAINNAYKKLNTTADGKVPKTTPQWLELKTHVQRGGYECGYYVMHWMWNIIGTELKSDWTVWFGDGSALDSEVITTLRKKWAAYFLKLRTIQCRKLFMRPIVYINLYKTEKGMLCTMPLRWDFSSGYTGYVMTFEVGAVLEDANWQAPVNCFDENDKEKNIPILGSAVRGGSLGSYDVGSATWADLRKAPLQSAMEVTYICVHFVLKELVRKSISETEVSNVSAMSQQSSALESGSFHSLVDEKLILKPSEVSIFTLKVVVAHQEICASKGFVFSQIICYMYRSSLQGIKTFIYTILGTVTIQRRVPLSLVIDIIIEQGMMASGKTTVGRILSEALSYSSFYDRLVW

SEQ ID NO: 187866 - protein, 78 aa, Glycine max
  Coding DNA Sequence Number=SeqID_71088
  Gene Ontology: Mol. function=metal ion binding; Biological process =metal ion transport
  Homolog annotation: Hit_ID=Q9LF57; Match level="QueryCoverage=97%, HitCoverage=55%, E-value=4e-17, Identity=66%"; Hit description =Farnesylated protein ATFP6-like protein
MGALDYLSNFCTVTSTRTKQKAIDKSENGLRWLRKKSEKCSEFNKRSEIYGGEQKGEQGGSERICGSKEGAEEGKKNS

SEQ ID NO: 187867 - protein, 35 aa, Glycine max
  Coding DNA Sequence Number=SeqID_71089
MSEGVRRCAEGSGSDADANWERNTRCFKLNEGGSF

SEQ ID NO: 187868 - protein, 109 aa, Glycine max
  Coding DNA Sequence Number=SeqID_71090
MVPEAKVSNVSSLELINFPGALQNKRTKTWKILHSRTVASGDTTQKGTTLPMWRWWEQHEVRRKTAQCQSSARDIQAKQMMGAYTRFFRQKVFGGTRVQLPRNLTMVYF

SEQ ID NO: 187869 - protein, 48 aa, Glycine max
  Coding DNA Sequence Number=SeqID_71091
MGTQSIKFIPLWGSCANALMVKVANVEAHGRMMLAPTSCAIRGNIIRG

SEQ ID NO: 187870 - protein, 117 aa, Glycine max
  Coding DNA Sequence Number=SeqID_71092
MSSILSLVIDYPPLVIDYQRPPSTYYTKFTAGQPPQASLLCGLVFLLSVDCQELACLGTSQVLTDRLCPGWVGIGQAWFWAIAPHLTSPRSPDPRDISPGGGRAMVHNKFFTSTKRA

SEQ ID NO: 187871 - protein, 79 aa, Glycine max
  Coding DNA Sequence Number=SeqID_71093
VVGCTICGGAHESGCCTPNEDQIAHEVNYMGNQPRGNFNTSEFPGFQNNQQYQQQRQWQNHPSNQFNRDQGGSSTRPQQ

SEQ ID NO: 187872 - protein, 120 aa, Glycine max
  Coding DNA Sequence Number=SeqID_71094
MESSNVKNKSSGKRKMSSEDTRSYFAWNLEMERVLADVLRDQSNLANKGDGNWKAVAYSTVAQILSKYFGVHLMANNVKNHFKLRRTCHMKRPNDFDSKSFLIGVILLTYVQRIELLDWE

SEQ ID NO: 187873 - protein, 106 aa, Glycine max
  Coding DNA Sequence Number=SeqID_71095
  Subcellular localization annotation: CTP_CleavageSite=71; ConfidenceScore=5.09e-01
MQMADRGRGGGRRTFNRGTKRGTHNLRAPITTNPSPSSIHISTSESMIHVVAQTPNTLPTAQGQPNPTFVRESIPTTTTRKYTFNICYLEHSTSVLKPMLKVTMLN

SEQ ID NO: 187874 - protein, 98 aa, Glycine max
  Coding DNA Sequence Number=SeqID_71096
  Gene Ontology: Biological process=lipid transport
  Homolog annotation: Hit_ID=Q1T4I0; Match level="QueryCoverage=97%, HitCoverage=99%, E-value=1e-16, Identity=43%"; Hit description=Plant lipid transfer/seed storage/trypsin-alpha amylase inhibitor
  Pfam annotation: Domain name=Tryp_alpha_amyl; Domain location=10-97; Score=21.0; E_value=0.0007; Accession=PF00234.12; Description =Protease inhibitorseed storageLTP f
  Subcellular localization annotation: CTP_CleavageSite=61; ConfidenceScore=5.31e-01
MASKAALLLCLNVLFFTVVSSTYVPCNPPPKTPKHPPVPKPPSPKLASCPKDTIKFAAVCLCTALKANVLGINLNVPVNLSLLLNYCGKGVPKGFVCY

SEQ ID NO: 187875 - protein, 98 aa, Glycine max
  Coding DNA Sequence Number=SeqID_71097
  Gene Ontology: Biological process=lipid transport
  Homolog annotation: Hit_ID=Q1T4I0; Match level="QueryCoverage=98%, HitCoverage=100%, E-value=6e-21, Identity=48%"; Hit description =Plant lipid transfer/seed storage/trypsin-alpha amylase inhibitor
  Pfam annotation: Domain name=Tryp_alpha_amyl; Domain location=26-97; Score=22.4; E_value=0.00051; Accession=PF00234.12; Description =Protease inhibitorseed storageLTP f
  Subcellular localization annotation: CTP_CleavageSite=61; ConfidenceScore=5.26e-01
MASKGALLLCLNILFFTVVSSTYVPCNPPPKTPKHTPVPKPPSPKQPSCPKDTIKFAAVCLCTALKANVLGINLNVPVKLSLLLNYCGKGVPKGFVCA

SEQ ID NO: 187876 - protein, 62 aa, Glycine max
  Coding DNA Sequence Number=SeqID_71098
MNRSSKSDQFPLLNDPNKACIYVIKRRCQIEACNGAWAMIGFTTGLVIEGQTGKSILTQVKF

SEQ ID NO: 187877 - protein, 410 aa, Glycine max
  Coding DNA Sequence Number=SeqID_71099
  Gene Ontology: Mol. function=transferase activity, transferring hexosyl groups; Biological process=carbohydrate biosynthetic process
  Homolog annotation: Hit_ID=Q1SPA8; Match level="QueryCoverage=92%, HitCoverage=80%, E-value=0.0, Identity=85%"; Hit description =Glycosyl transferase, family 8
  Pfam annotation: Domain name=Glyco_transf_8; Domain location=1-212; Score=-27.2; E_value=9.7e-05; Accession=PF01501.10; Description =Glycosyl transferase family 8
MVFLGTLGLRVKFKSEECLTMVSTSLRNGMEDGAKVVRVENLDNPYKHQDNFDKRFKLSLNKLYAWSLVDYDRVVMLDADNLFLQNTDELFQCGQFCAVFINPCVFHTGLFVLKPSMAVFKDMVHELRNGRENPDGADQGFIASYFPELLDKPMFHPPPNATKLDGTYRLPLGYQMDASYYYLKLRWSIPCGPNSVITFPGAPWLKPWYWWSWPVLPLGLQWHEKRRQTLGYGAEMAVILIQSAIYLGIIAMKRFARPSLSKLCYRRSDKSINLVQNILKFVALWSILAAYTTPFFIIPPTVHPLLGWPLYLLGVFALCSITVNAFLLPMLPVLMPWLGIAGALIVMAFPWYSDGVVRALCVFGYAFCAAPFVWASMTRIMAGLHQSLEREAFLPRLGESSPPSWFNKLY

SEQ ID NO: 187878 - protein, 137 aa, Glycine max
  Coding DNA Sequence Number=SeqID_71100
  Gene Ontology: Mol. function=protein binding; Cellular component =peroxisome
  Homolog annotation: Hit_ID=Q1SPB0; Match level="QueryCoverage=73%, HitCoverage=42%, E-value=2e-27, Identity=66%"; Hit description=Pex19 protein
MADSSQDLDQLLDSALDDFQSFNLNPPPPSGEASANKKKESPSLASGVQGLGMGLPDLRTKKKGKQKAASKDSHVSEALNKLREQTKEAVKGLESISTPTADDLGKDALMEDWVKQFEQLAGSQLIVFCIFSWGLTV

SEQ ID NO: 187879 - protein, 522 aa, Glycine max
  Coding DNA Sequence Number=SeqID_71101
  Gene Ontology: Mol. function=asparagine-tRNA ligase activity; Cellular component=cytoplasm; Biological process=tRNA aminoacylation for protein translation
  Homolog annotation: Hit_ID=Q1SPB1; Match level="QueryCoverage=89%, HitCoverage=91%, E-value=0.0, Identity=73%"; Hit description =Aspartyl-tRNA synthetase, class IIb; tRNA synthetase, class II
  Pfam annotation: Domain name=tRNA-synt_2; Domain location=176-518; Score=226.3; E_value=6.8e-65; Accession=PF00152.11; Description=tRNA synthetases class II (D, K and N)
  Pfam annotation: Domain name=tRNA_anti; Domain location=73-161; Score= 26.8; E_value=7.7e-05; Accession=PF01336.15; Description=OB-fold nucleic acid binding domain
  Pfam module annotation: Pfam domain module=tRNA-synt_2::tRNA_anti; Domain location=176-518::73-161
  Subcellular localization annotation: CTP_CleavageSite=78; ConfidenceScore=5.27e-01
MAATIGVGAAKAISIAIAVRHLRTKPYAAATTTALALLSLHKPLFLPHSSPFSSRRAFCAATLRTSDNRVQQFRRKLRVSEIKEGDGADVLGRNLVVQGWINDGSCLSNMQCVLNSEAEGYDQVESGLVTTGASVWVQGVVVKSQGSKQKVELKVNKIVLIGKSDPSFPIQKKRASREFLRTKAHLRARTNTFGAVARVRNALAYATHKFFQENGFVWVSSPIITASDCEGAGEQFCVTTLIPSSHETNDSPVDAIPKTNDGLIDWSQDFFGKPAFLTVSGQLNGETYATALSDVYTFGPTFRAENSNTSRHLAEFWMIEPELAFADLNDDMACATAYLQFVIRHVLDNCKEDMEFFDAWINKGIIDRLSDVADKDVVQITYTEAIDLLSGANKKFEFPVKWGSDLQSEHERYITEEDIKAFYMRQNDDGRTVAAMDMLVPGIGELIGGSQREERLEYLEARLDDLKLNKDAYWWYLDLRRYGSVPHAGFGLGFERLVQFATGMDNIRDVIPFPRTPGSAEF

SEQ ID NO: 187880 - protein, 79 aa, Glycine max
  Coding DNA Sequence Number=SeqID_71102
MELVVLPLLFWYNNKKLIITKERQRNSSSRSRDEGNSQAGSSFFQEIHHKAGMEGELGIRVPRISNDGASGSSYTLLVR

SEQ ID NO: 187881 - protein, 138 aa, Glycine max
  Coding DNA Sequence Number=SeqID_71103
MSSRAQCIISSFSEKIVSFVLSARMALSQISLTRAKREDGVIPRFLEVEETSPLLCNLTYSFMLRDADVDLNAYSEHLINTIIDLLPHAECFLFRKQLKPYFKSLSGYALLNNPNIRYVHLQVNQDDTSYPGQSSKNH

SEQ ID NO: 187882 - protein, 161 aa, Glycine max
  Coding DNA Sequence Number=SeqID_71104
  Subcellular localization annotation: CTP_CleavageSite=80; ConfidenceScore=5.64e-01
MENNKKKVVGGGPSSSSFTNFDHLFGPKDPSTTSSSSTSIFGSIFPPPPSTVGGRDSTKQDMGCKNYGAPGNYSYKGESSASGVVSNSKNTTSTNYHHQNETVEPSYYSSSIYYGGQENYSPRTRTTESHHSLFKKDKKDDDDPNGNDSTVLQEGTGGKVG

SEQ ID NO: 187883 - protein, 290 aa, Glycine max
  Coding DNA Sequence Number=SeqID_71105
  Gene Ontology: Mol. function=nucleic acid binding; Cellular component= intracellular; Biological process=regulation of transcription
  Homolog annotation: Hit_ID=Q4U315; Match level="QueryCoverage=87%, HitCoverage=98%, E-value=3e-45, Identity=37%"; Hit description =Cys2/His2 zinc-finger transcription factor
  Pfam annotation: Domain name=zf-C2H2; Domain location=187-209; Score =10.2; E_value=0.81; Accession=PF00096.16; Description=Zinc finger, C2H2 type
  Pfam annotation: Domain name=zf-C2H2; Domain location=229-251; Score =16.8; E_value=0.08; Accession=PF00096.16; Description=Zinc finger, C2H2 type
  Pfam annotation: Domain name=zf-C2H2; Domain location=31-53; Score =20.0; E_value=0.0083; Accession=PF00096.16; Description=Zinc finger, C2H2 type
  Pfam module annotation: Pfam domain module=zf-C2H2::zf-C2H2::zf-C2H2; Domain location=187-209::229-251::31-53
MVLWRDLEAINGKKVIRIGQQVCKVLVMDRHKCKLCSRSFSNGRALGGHMKAHLASLPLPLPPKLHSCFSSSDSEQEQSLRENPKKTLRILDPEDRESETESNKNPTRQRSKRNWKSTMPKLSLGHPEAEPLSSVSDTSPEEDLAMCLMMLSRDTWQEHKLANAGPPKTRCSSGSEIKLKNKVRSKHLCHACHKSFRSSRALGSHRTLCSPRQEAQNNSIISNNNIKVFECPFCYKLFGSGQALGGHKRSHLIPSSSSTVNHSVKLKQSFIDLNLPAPAEDDDLSVVSDA

SEQ ID NO: 187884 - protein, 174 aa, Glycine max
  Coding DNA Sequence Number=SeqID_71106
  Gene Ontology: Mol. function=molecular_function; Cellular component =membrane; Biological process=auxin mediated signaling pathway
  Homolog annotation: Hit_ID=Q9FGL0; Match level="QueryCoverage=60%, HitCoverage=28%, E-value=2e-32, Identity=60%"; Hit description =Nodulin-like protein
MSILQSISTKTTSAKEGKIQLLSPPPNVMFGQTQDNRLSLSLGCNLHIVKQHCPTVQLVEDHEFKPGWPIVSVGDMIAYSLLAGAVSGICLSVNGWALEKRGPVLVSMFSPIGTVCSVLFSVVTLGQTINIGSFAGMFLMFTGFYFVLWAKGTEGYAKGGGLESEYDAEKPLLS

SEQ ID NO: 187885 - protein, 56 aa, Glycine max
  Coding DNA Sequence Number=SeqID_71107
MTQKHVMLVEEKVDVEMLMVEKIYAAKPRKLNGEQFNIESMSSALVLWQTNNIGHV

SEQ ID NO: 187886 - protein, 144 aa, Glycine max
  Coding DNA Sequence Number=SeqID_71108
  Homolog annotation: Hit_ID=Q1SSD9; Match level="QueryCoverage=51%, HitCoverage=18%, E-value=3e-13, Identity=51%"; Hit description =Hypothetical plant protein
MTGLDWSCCLELGNNGIDKKEVVGEKEILTWVDVNIPFLSPAFILCSSFSLSPENRLGMRNRGGSVAVDQPASVAPQRQTQLLEIHGASAAAATKVRFLVGDLRCNAIWAGPHLPLNGPRGISSRMVLSPTPPPRSLLHTGSYS

SEQ ID NO: 187887 - protein, 599 aa, Glycine max
  Coding DNA Sequence Number=SeqID_71109
  Gene Ontology: Mol. function=guanyl-nucleotide exchange factor activity
  Homolog annotation: Hit_ID=Q93ZY2; Match level="QueryCoverage=70%, HitCoverage=75%, E-value=1e-133, Identity=58%"; Hit description=Rop guanine nucleotide exchange factor 1
  Pfam annotation: Domain name=DUF315; Domain location=2-469; Score =819.2; E_value=2.2e-243; Accession=PF03759.4; Description=Domain of unknown function (DUF315)
  Subcellular localization annotation: CTP_CleavageSite=70; ConfidenceScore=5.34e-01
MDALSKKNENSSQKKSDGVVLSCLTTDYSSSDTSFCGSSSSVSTDEAKAKGSSSPAPLGWPILKATISKRSSSDEKENRHKSHLEDKKFTSIGLKLSELDMMKERFAKLLLGEDMSGSGKGVCTALAISNAITNLCATVFGQLWRLEPLPSEKKEMWQREMEWLVSVSDYIVELMPSWQTYPDGSKLEVMTCRPRADIFINLPALRKLDNMLLEILDSFTATEFWYVDQGIVAPDADGSASFRRTIQRQEEKWWLPVPRVPPAGLSEDSRKQLNHSRECANQILKAAMAINSIALAEMEVPESYLEVLPKNGRTCLGDFVYRYITSDQFSPECLLDCLDISSEHVALEIANRVEAAIYVWRRRAHSRSSPNPNRSTTKSSWEIVKDFMIDGDKRELLADRAENILVSLKQRFPGLSQTTLDTSKIQCNKVDVGKSVLESYSRVLESMAFNIVARIDDLLYVDDLTKHSERFALVPTTTVNMVSQQKKITRPPLSVSVSGTTPHKASIGTPSFSSAAVPLISPARGERTPFLHNINNSIKPHRRGFGVRRVLSNYLGVETKTTKICSNSTEVNCSNPSSKKTELQQQPEQQRQKFKNRTK

SEQ ID NO: 187888 - protein, 95 aa, Glycine max
  Coding DNA Sequence Number=SeqID_71110
  Homolog annotation: Hit_ID=Q9FI91; Match level="QueryCoverage=93%, HitCoverage=51%, E-value=1e-19, Identity=60%"; Hit description =Arabidopsis thaliana genomic DNA, chromosome 5, TAC clone:K18J17
  Subcellular localization annotation: CTP_CleavageSite=32; ConfidenceScore=5.39e-01
MSSSFTSLHITALDAIVNPQHRSGVVNRTALRAGMLVSVAGCGFLMLALVNVAQIKLETLVCGSSHTYAAVIPLLIFVPLALLIYFSFVLYAFTR

SEQ ID NO: 187889 - protein, 438 aa, Glycine max
  Coding DNA Sequence Number=SeqID_71111
  Gene Ontology: Mol. function=nucleotide binding
  Homolog annotation: Hit_ID=O23508; Match level="QueryCoverage=88%, HitCoverage=43%, E-value=1e-163, Identity=70%"; Hit description =Growth regulator like protein
  Pfam annotation: Domain name=DUF246; Domain location=25-358; Score =670.5; E_value=1.3e-198; Accession=PF03138.5; Description=Plant protein family
MLCHHLPAISNTSAVRERKSKGYLLIATSGGLNQQRTGITDAVVVARILNATLVVPELDHQSFWKDDSDFANIFDVNWFITYLAKDITIVKRVPDKIMRSMEKPPYTMRVPRKSEPEYYLDQVLPILSRRRVLQLTKFDYRLANNLDDELQKLRCRVNYHALRFTKPIRELGQRLVMRMQKMASRYIAVHLRFEPDMLAFSGCYFGGGEKERRELGEIRKRWTTLPDLSPDGEQKRGKCPLTPHEVGLMLRALGFTNDTYLYVASGEIYGGDGTMQPLKDLFPNIYTKEMLAQEEELKPFHPFSSRLAAIDYIVCDESNVFVTNNNGGIWVTKEPSDQMQEKLSALFMSRHEMDWDTFASKVKACQRGFMGEPDEMRPGRGEFHEYPSTCVCEKPFMDDISQDGLRPPKLAANNVTMNGGGNEESVVLQKRSGRRAST

SEQ ID NO: 187890 - protein, 104 aa, Glycine max
  Coding DNA Sequence Number=SeqID_71112
MHFLLEKTPFSFCLALPSKVFLEVQQYDILVECYCSNPRNLNLLTEQDNQTHEVTPKEVHFENTLYVPETIKSCFEVTPKLKSEEVRFEEINQNMDDWSIPEIP

SEQ ID NO: 187891 - protein, 65 aa, Glycine max
  Coding DNA Sequence Number=SeqID_71113
MEELMTLRRRQWFSIWTKRMAGRLTQPETMQLQGMVQDRKVMILIDSEASHNFISSQLIQILGLC

SEQ ID NO: 187892 - protein, 479 aa, Glycine max
  Coding DNA Sequence Number=SeqID_71114
  Gene Ontology: Mol. function=kinase activity; Cellular component =cytoplasm; Biological process=regulation of transcription, DNA -dependent
  Homolog annotation: Hit_ID=Q1SSD6; Match level="QueryCoverage=92%, HitCoverage=67%, E-value=1e-148, Identity=60%"; Hit description =Protein kinase PKN/PRK1, effector
  Pfam annotation: Domain name=DUF547; Domain location=387-472; Score =9.1; E_value=5.5e-07; Accession=PF04784.5; Description=Protein of unknown function, DUF547
MSEFRVFAEACGREDHGDSPHAKPQHRRSKSASERNLANARGGGASHPLEKDHNESLVSTSSVSASRLRSPLHDNLTRVNKNTSSNHRAFLEKDVEQLQLRLQRERSMRILLERAMGRASSTLSPGHRHFTAQTKDLIAEIELLEEEVINREQQVLSLYRSIFEQCVSRSTSQQSSAVASPAHTRQGSRKHPSIISSAFCSSKKFPLRTLQGLVSNNDSRNKIFGSNHGPLSRGKGNNYFKKTCSDSTKFTSWSSPIILLTQNLEHQKELVTVEVTSVQAHEKISTIQKTPILRTLKDHLYQCPSKLSEDMVRCMATVYCWLRSATSVNSENGRSPLLSRSSTNAIQPRNGIGDDLDWSCKSAVEISWISTHKRHSSHASYAIKNYRVLVEQLERVNVSQMDSDAQIAFWINVHNALVMHAYLAYGIPQGSLRRLALFHKGTRQWGWRVGHVAAPGGLASGVGELLSTWRPLGGSRHSY

SEQ ID NO: 187893 - protein, 87 aa, Glycine max
  Coding DNA Sequence Number=SeqID_71115
MDVEFTKRCLPRNLLEWTLNHSYFTQETPLKMICTWQKDFYVTSNCTFSSMVLLSFSRLFFTHHVEPIIEEVESDIDAASDSLVVQV

SEQ ID NO: 187894 - protein, 150 aa, Glycine max
  Coding DNA Sequence Number=SeqID_71116
MENSGKLTYQNEPFIVAEQAKHVFYVQDPCVERWSVVLHGKNIGLNLEDDDSTLDTFLTPFSTQMPNVNGEEVEYAHDYTTAPSLSTPKKTRKATQLILLATRLVRIERLVKQVPAAQRNLIWEDVQAEFDIPKASDQRTEKKILKTIEE

SEQ ID NO: 187895 - protein, 197 aa, Glycine max
  Coding DNA Sequence Number=SeqID_71117
  Gene Ontology: Mol. function=receptor activity
  Homolog annotation: Hit_ID=Q5S1T9; Match level="QueryCoverage=79%, HitCoverage=96%, E-value=1e-33, Identity=41%"; Hit description =Prenylated Rab acceptor protein 1
GGGGGRAAEEGEESGGLRVVLVVKKQILRHAERAVEADDGDAKHESGDENRSNAGEEDDEDEVEEGPGGEEADEEDERERIVGEVLADAEGGFGEGLGLRERGAVPELRPRAALVEAVSEGRGEVVDEGAEGRVVRRSLDGAAACGGGLGVGYGKDGSRGGGHDSFRERKPEREGFLWVFGSPFAGQSHVNAFVKGA

SEQ ID NO: 187896 - protein, 102 aa, Glycine max
  Coding DNA Sequence Number=SeqID_71118
MTRTKNFGEMTSEVAREIADRIPDTVPKLDPGAIQVVVLPPKLKAGPSITRDPKMGESEKCGLYVDDNPPCLVALGRVYEGSTTVHNVPLGNDQVKVNVEEV

SEQ ID NO: 187897 - protein, 393 aa, Glycine max
  Coding DNA Sequence Number=SeqID_71119
  Gene Ontology: Mol. function=RNA-directed DNA polymerase activity; Cellular component=intracellular; Biological process=RNA-dependent DNA replication
MAKIDVIEKLPPPVNVKGIRSFLGHAGFYRWFIKDFSKIAKPLSNFLNKDVVFKTDEECLPAFQTLKERLVSAPVMVALNWSQEFELLCDASDYAIGAVLGQQKNNVFPSIYYASKVLNDAQLNYATTKKELLAFVYTLEKLRSYLVGSKVIIFIDHAAIKHLLTKVDSKPRLIRWVLVLQEFDVVIKDKKSLENLVVDHLSRLVNEEVTLDEKKILDEFPDETLLSVGERPWFADIANYKQLESFQMISIGICERIFPEAKSILWYFHNSPYGGHYSRDQTSAKVLQSGFFWPSTFKDTHEHVLHCDQCHLPSSYSNEYILVVVDYVSKWVEVVAAQKNDVKTVIKFLKRNIFSRFGVSGFLSVVVTNGQAWVSNKELKKILEKIVASSRKD

SEQ ID NO: 187898 - protein, 200 aa, Glycine max
  Coding DNA Sequence Number=SeqID_71120
  Subcellular localization annotation: CTP_CleavageSite=71; ConfidenceScore=5.55e-01
MELSAQPSATPKTFSISWPQRSTELVPVSHKGRSPHGTPPDLSLRSPSIAIRTTFISETLFWRGTWSSLILSMMNSLRSWSEDVERLPGDADHHFGGGVADQFFPVSSHLPQPSNHYEEAVYAGWPVYNIECRRGSMKDFVEGLDHSRSNMECLMDMDLGSMIFSQITQIAQSNSSRLGSPALITTLWDTKGVISNTLTF

SEQ ID NO: 187899 - protein, 166 aa, Glycine max
  Coding DNA Sequence Number=SeqID_71121
  Gene Ontology: Mol. function=protein kinase activity; Cellular component=cellulose and pectin-containing cell wall; Biological process=protein amino acid phosphorylation
  Homolog annotation: Hit_ID=Q8L3Y5; Match level="QueryCoverage=57%, HitCoverage=11%, E-value=2e-31, Identity=65%"; Hit description =Receptor-like kinase RHG1
  Pfam annotation: Domain name=LRRNT_2; Domain location=78-120; Score =29.2; E_value=1.4e-05; Accession=PF08263.3; Description=Leucine rich repeat N-terminal domain
  Subcellular localization annotation: CTP_CleavageSite=38; ConfidenceScore=5.33e-01
MGHNNTCHHHVKGFHTDPFQHSLSFASNGGGDRRRKCRSNEKSGSGGFICLPFFLFLLASTSTIQHVSGHLWDGVVVTQADFQALRVIKNELIDFKGVLKSWNDSGVGACSGGWAGIKCVNGEVIAIQLPWRGLGGRISEKISQLPSLRKLSLHENALGGPVPLTL

SEQ ID NO: 187900 - protein, 121 aa, Glycine max
  Coding DNA Sequence Number=SeqID_71122
  Subcellular localization annotation: CTP_CleavageSite=48; ConfidenceScore=5.10e-01
MFFFHSDSTFAAQGSRSPLFHTLAQASLLGLWVNNLIHFYGCCKKIVNARKVFNEMPERTVVSWNSIMTACVESLSLGDEIGLDVYLRQQDIQLLIPHMPLPLKHHYHVIQKHHQSIKLDQ

SEQ ID NO: 187901 - protein, 456 aa, Glycine max
  Coding DNA Sequence Number=SeqID_71123
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=98%, HitCoverage=62%, E-value=4e-72, Identity=50%"; Hit description =Receptor-like kinase RHG1
  Pfam annotation: Domain name=LRR_1; Domain location=1-23; Score=15.9; E_value=0.15; Accession=PF00560.23; Description=Leucine Rich Repeat
  Pfam annotation: Domain name=LRR_1; Domain location=102-124; Score =13.8; E_value=0.61; Accession=PF00560.23; Description=Leucine Rich Repeat
  Pfam annotation: Domain name=LRR_1; Domain location=126-148; Score =19.2; E_value=0.015; Accession=PF00560.23; Description=Leucine Rich Repeat
  Pfam annotation: Domain name=LRR_1; Domain location=150-172; Score =12.8; E_value=1.1; Accession=PF00560.23; Description=Leucine Rich Repeat
  Pfam annotation: Domain name=LRR_1; Domain location=174-196; Score =8.2; E_value=8.2; Accession=PF00560.23; Description=Leucine Rich Repeat
  Pfam annotation: Domain name=LRR_1; Domain location=198-220; Score =12.8; E_value=1.1; Accession=PF00560.23; Description=Leucine Rich Repeat
  Pfam annotation: Domain name=LRR_1; Domain location=222-241; Score =8.9; E_value=6.2; Accession=PF00560.23; Description=Leucine Rich Repeat
  Pfam annotation: Domain name=LRR_1; Domain location=25-47; Score=9.1; E_value=5.6; Accession=PF00560.23; Description=Leucine Rich Repeat
  Pfam annotation: Domain name=LRR_1; Domain location=49-71; Score =12.3; E_value=1.4; Accession=PF00560.23; Description=Leucine Rich Repeat
  Pfam annotation: Domain name=LRR_1; Domain location=78-100; Score =16.2; E_value=0.12; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=1 -23::102-124::126-148::150-172::174-196::198-220::222-241::25-47::49 -71::78-100
  Subcellular localization annotation: CTP_CleavageSite=37; ConfidenceScore=5.69e-01
MLQSLDISNNSLSGKIPSSLARSTRIFRINLSFNSLSGSIPSSLTMSPSLTILALQHNNLSGSIPDSWGGTGKKKASQLQVLTLDHNLFSGTIPVSLGKLAFLENVSLSHNKIVGAIPSELGALSRLQILDLSNNVINGSLPASFSNLSSLVSLNLESNQLASHIPDSLDRLHNLSVLNLKNNKLDGQIPTTIGNISSISQIDLSENKLVGEIPDSLTKLTNLSSFNVSYNNLSGAVPSLLSKRFNASSFVGNLELCGFITSKPCSSPPPHNLPTQSPHAPSKPHHHKLSTKDIILIVAGILLLVLRRAASSRKSSKTAKAAASARGVEKGASAGEVESGGEAGGKLVHFDGPFVFTADDLLCATAEIMGKSAFGTAYKATLEDGNQVAVKRLREKTTKGQKEFETEVAALGKIRHPNLLALRAYYLGPKGEKLLVFDYMTKGSLASFLHGKYYGN

SEQ ID NO: 187902 - protein, 149 aa, Glycine max
  Coding DNA Sequence Number=SeqID_71124
  Gene Ontology: Mol. function=DNA binding; Cellular component =mitochondrion; Biological process=DNA integration
  Homolog annotation: Hit_ID=Q1S9T4; Match level="QueryCoverage=98%, HitCoverage=11%, E-value=7e-75, Identity=90%"; Hit description =Integrase, catalytic region
TRRSTSGYCVYLGDNSISWSAKRQHTLSRSSAEAEYRGVANVVSESCWLRNLLLELCCPVTKATLVYCDNISAVYLSDNPVQHQRTKHIEMDIHFVREKVACGQVRVLHIPSRFQIADIFTKGLPLQLFDDFRDSLNIRSPPVSTTGVY

SEQ ID NO: 187903 - protein, 71 aa, Glycine max
  Coding DNA Sequence Number=SeqID_71125
MGGNRGNSSPCRHGSGTRPRENRIESAPTLTDKNRVEWVRGRVWVFPDNPKRGAGAATAALNLSVKEKWRT

SEQ ID NO: 187904 - protein, 263 aa, Glycine max
  Coding DNA Sequence Number=SeqID_71126
  Gene Ontology: Mol. function=protein kinase activity; Cellular component=membrane; Biological process=protein amino acid phosphorylation
  Homolog annotation: Hit_ID=Q2QZ78; Match level="QueryCoverage=96%, HitCoverage=46%, E-value=1e-63, Identity=47%"; Hit description=AT hook motif-containing protein, putative
IRLTEKETIHLCLTKIENMLQANRRSLRDFTSMPYAIGYARNQHHNNLIHNEMTYDKEMLAEQYNTAYQLLTDEQKTIVDTIMSVVNTQSAAVYFLCGYGGTGKTFVWTTLSSGIRSNGGIVCTVASSGIVSLLLPGGRIAHSKFAMPVPATENSTCNIHQGSELAELLKVTKLMVWDEAPMCHKFAFEELDKSLKDIMQNNLPFGGKIMVFGGDFRQILPIVPKGNRSDIVHATINASYIWDHCQILKLTKNMRLLSTTPQQ

SEQ ID NO: 187905 - protein, 174 aa, Glycine max
  Coding DNA Sequence Number=SeqID_71127
MGYVGVRELSWRWATGDGGFMRALWMWKTCCAPSPNRHLVPHVMEWYLEICRGGQETLGTSGGVLLPKTKLDQSRPNPGIVGQLENGVRKLREPLIVMTAQLIRDRVEMECLKGAWETLEGNTRCRFRGTIRFTATSLVHPDEPARTLQRTVEWTTPWISLVYFLRVGVSRTDC

SEQ ID NO: 187906 - protein, 911 aa, Glycine max
  Coding DNA Sequence Number=SeqID_71128
  Gene Ontology: Mol. function=DNA binding; Cellular component =chromatin; Biological process=DNA integration
  Homolog annotation: Hit_ID=Q1RSZ9; Match level="QueryCoverage=97%, HitCoverage=66%, E-value=1e-158, Identity=52%"; Hit description =Polynucleotidyl transferase, Ribonuclease H fold
  Pfam annotation: Domain name=rve; Domain location=496-636; Score =12.8; E_value=0.00051; Accession=PF00665.16; Description=Integrase core domain
  Pfam module annotation: Pfam domain module=RVT_2::rve; Domain location=861-911::496-636
  Subcellular localization annotation: CTP_CleavageSite=35; ConfidenceScore=5.11e-01
MTTSADSSDPPPPSTPTPTHPALTVPNISNFIKITLSIEKGTYNTWSELFKIHARVFQVIDHIIPSEPAADPSLKTTNPQLWLRLDAVVLQWIYGTISDDLLNTIIEHNSTAATAWNRLFDIFYDNKNSRALYLEQEFSRTHMEQFSDASSYCQHLKSLSDQLANVGAPISNERLVLQLISGLTDAYAAVGSQIRHADSLPQFYKARSMIILEETALQKKVSNSVENSSFMASHNDAPVDSSTSRPNRGNNGNHNRGGRSHGRGQRGRGRGRNNGRGGGRAPQQQWPSPYYPHQQWAYPPYPNQYQQWSSPPWQPWATPPCPYPTARNPKEQPGILGPKPSHQAHVANAAPTSSYAPTDIQAAMHTLSLSTPDDQWYMDTGATSHMTANGGNLTSYFNLSNNITVGSGQNIPVIGCGHASLPNSLHPLKLPNVLHAPKLIKNLISVRKFTIDNDVSVEFDPFGFSVKDFQTGIPLMRCNSSGDLYPIATRPPNTTLPPSTFAALSTELWHNRLGHPGATILSSLHRDNFLQLTSGLHQFSVQRVIVTMCCFLTITQISYGLFQFIQNLRFSCPHTSSQNGKAERKIRTINNIIRTLLAHASLPPSMWHHALHMATYLHNILPNKKLSLQSPTKILYQKDPAYTHLRVFGCLCYPIIPSSSRNKLQARSTPCVFLGYPSNHRGYKCYDLSSRKIFISRHVIFDETKFPFSNLNVPTTVGYNFLDDDTPFLPSYSYSAPPSNHQNRTPPLTTPVQTNIYQPSPSSFNSPLSPSHNHTSPTTASAPSITSPPNPSLPTIISSPSPTPPPSQQKPPLSPQMTTRAQHGIVKPRKLFNLHTSTSTSISPLPTNPIDALNDQNWKMAMKDEYDALIENKTWDLVPRPSNANVIRSLWIFRHKKKSDGSFERYKARLV

SEQ ID NO: 187907 - protein, 84 aa, Glycine max
  Coding DNA Sequence Number=SeqID_71129
MTHSLNDVEAIHATPESICNPTNYNIGCDHVVNNQKNENETPPATQNSKPKRGRPFKTPPESIKNWYVIRKERKIANRFDTREN

SEQ ID NO: 187908 - protein, 294 aa, Glycine max
  Coding DNA Sequence Number=SeqID_71130
MSDLMKNHSRTLLHQTSQVLNFHKHLLIQLLQTLGAAPGLRPHHSAEPPNLKPLSAFVELPLVLGGLLHFSQNLVATFAHHHRGAVGPAVERRKVGIGAEGAVVAAEGGTDVDDVEGAGLEGEGRGAELEGAVLVGVDVGVVVVGGGGGEEEEDARRKKRGFGVWVLDLGGELGEGGEGGGDGEFAHGGAEGGAAAGGEPAEEGGIGEGGGEDGAGGIVEGGGGEEAGDGGEEGGGGGGSGGSVVVGEGERERGDVAEEEAVDGRGGGGEALDEGGECGARNRDLLQRRILHGQ

SEQ ID NO: 187909 - protein, 91 aa, Glycine max
  Coding DNA Sequence Number=SeqID_71131
MSKEVDMNVENEEGAGMKVEHVDCSDAFNTSQLFASRDEVLHWARLVACDIGFVAVLAKGVVSIGDVNLSRSGSFDTGYGDFDDATSSEGR

SEQ ID NO: 187910 - protein, 110 aa, Glycine max
  Coding DNA Sequence Number=SeqID_71132
MALMMEKQLRKKKMQQRIQNQMMMILMPPHDHQTFSFFCFLLLLAIGACPFEQLIVIADRRCCSELLPSRIFTSQQILLSPLQILLCLITLIMKVADPTCMTARTCSGSV

SEQ ID NO: 187911 - protein, 228 aa, Glycine max
  Coding DNA Sequence Number=SeqID_71133
  Gene Ontology: Mol. function=hydroxymethyl-, formyl- and related transferase activity; Cellular component=cytoplasm; Biological process='de novo' IMP biosynthetic process
  Homolog annotation: Hit_ID=Q1SAA7; Match level="QueryCoverage=99%, HitCoverage=69%, E-value=1e-116, Identity=90%"; Hit description =Formyl transferase, N-terminal
  Pfam annotation: Domain name=Formyl_trans_N; Domain location=28-209; Score=103.9; E_value=4.8e-28; Accession=PF00551.9; Description =Formyl transferase
MEEDFLKLSQTFNAIRSVVRVPALDPKYKIAVLASKQDHCLVDLLHGWQDGRLPVDITCVISNHHRGSNTHVIRFLERHGIPYHCLCTTKENKREGEILQLIQNTDFLVLASIDLYAKILSGNFLRSYGNDIINIHHGLLPSFKGGNPSKQAFEAGVKLIGATSHYVTEELDAGPIIEQMVERVSHRDNLQSFVQKSENLEKQCLSKAIRSYCELRVLPYEEKRTVVF

SEQ ID NO: 187912 - protein, 117 aa, Glycine max
  Coding DNA Sequence Number=SeqID_71134
  Gene Ontology: Mol. function=peptidase activity; Cellular component =chloroplast thylakoid membrane; Biological process=lipid transport
  Homolog annotation: Hit_ID=Q1T4I0; Match level="QueryCoverage=98%, HitCoverage=99%, E-value=2e-25, Identity=52%"; Hit description=Plant lipid transfer/seed storage/trypsin-alpha amylase inhibitor
  Pfam annotation: Domain name=Tryp_alpha_amyl; Domain location=49-116; Score=67.9; E_value=3.3e-17; Accession=PF00234.12; Description =Protease inhibitorseed storageLTP f
  Subcellular localization annotation: CTP_CleavageSite=64; ConfidenceScore=5.10e-01
MTSKGAILLCLNVLFFTVVSSTYVPCNPPPKTPKHPPVPKPPSPKQVSCPKDTVKFGKPPKTPCCSLIQGLADLEAAVCLCTALKANVLGINLNVPVNLSLLLNYCGKGVPKGFVCY

SEQ ID NO: 187913 - protein, 55 aa, Glycine max
  Coding DNA Sequence Number=SeqID_71135
MHLRNSLDVGKHKDGVVQQELDHVNDVVAVTKEEIKMIEDEQGGREKKRRKNYIL

SEQ ID NO: 187914 - protein, 232 aa, Glycine max
  Coding DNA Sequence Number=SeqID_71136
  Gene Ontology: Mol. function=protein serine/threonine kinase activity; Cellular component=membrane; Biological process=protein amino acid phosphorylation
  Homolog annotation: Hit_ID=Q8LES3; Match level="QueryCoverage=99%, HitCoverage=60%, E-value=1e-121, Identity=87%"; Hit description =Protein kinase
  Pfam annotation: Domain name=Pkinase; Domain location=2-203; Score =93.4; E_value=6.7e-25; Accession=PF00069.15; Description=Protein kinase domain
  Pfam annotation: Domain name=Pkinase_Tyr; Domain location=1-203; Score=122.4; E_value=1.2e-33; Accession=PF07714.7; Description =Protein tyrosine kinase
  Pfam module annotation: Pfam domain module=Pkinase::Pkinase_Tyr; Domain location=2-203::1-203
MGSSELQIQTDNGLISMPSNICCVVVEYLAGGTLKSFLIKNRRRKLAFKVVVQLALDLARGLSYLHSQKVVHRDVKTENMLLDKTRTVKIADFGVARVEASNPNDMTGETGTLGYMAPEVLNGNPYNRKCDVYSFGICLWEIYCCDMPYPDLSFSEITSAVVRQNLRPEIPRCCPSSLANVMKRCWDANPDKRPEMDEVVAMIEAIDTSKGGGMIPVDQQQGCFCFRKHRGP

SEQ ID NO: 187915 - protein, 879 aa, Glycine max
  Coding DNA Sequence Number=SeqID_71137
  Gene Ontology: Mol. function=nucleic acid binding; Cellular component= ubiquitin ligase complex; Biological process=protein ubiquitination
  Homolog annotation: Hit_ID=Q1T0N5; Match level="QueryCoverage=77%, HitCoverage=84%, E-value=1e-161, Identity=68%"; Hit description=Zinc finger, RING-type; Zinc finger, CCHC-type
  Pfam annotation: Domain name=Cytadhesin_P30; Domain location=330-600; Score=-153.8; E_value=0.091; Accession=PF07271.2; Description =Cytadhesin P30P32
  Pfam annotation: Domain name=DWNN; Domain location=3-78; Score=169.5; E_value=8.2e-48; Accession=PF08783.1; Description=DWNN domain
  Pfam annotation: Domain name=U-box; Domain location=316-391; Score= -14.1; E_value=0.017; Accession=PF04564.6; Description=U-box domain
  Pfam module annotation: Pfam domain module=Cytadhesin_P30::DWNN::U -box; Domain location=330-600::3-78::316-391
MAVYYKFKSARDYDSIPMDGPFISVGTLKEKIFESKHLGRGTDFDLVVTNAQTNEEYLDEEMLIPKNTSVLIRRVPGRPRLPIVTEIEQKVENKVVESEPENRSLPAEDPSAMKYPEDSDWDEFGNDLYSIPDQVPVQSSNLIPEAPPPNKADEDRIRSEWNCKIRGVREEEHKVKVQILALVEALEGVQGDGWVVDVVLLIAVFNTNMLITTDAEVWQGWSEKHLHKAMYATDARCLHCPTNGDPNYDMRKVKQPTGIPRSMLMVNPQGSYALPNGSVAVLKPNEHGVEFNLFLANRAAFEKEIEGMPSTRSVGELPPELRCPLCNDVMKDAVLTSKCCFKSFCDRCIRDYIISKSICVCGATNILADDLLPNKTLRDTINRILESGNSSAENAGSTFQAQDMESARCPQPKIPSPTSSAASKGDLKVSSVNEKTTNIQETADDRKAVSAPQQTSEQVRNPRAADISEATHESMSVKEPASQGSAQQVEEEVQQKLVPTEAGKKKKKKKVRLPPNDLQWKTPHDFGAENYMMNNMMPMVPPPGYNSYWNGMQPMDGFMAPYGNPMQMMGYGLGPLDMPFGGMPQDPFGMQGYMMPGFPPHRDLADFSMGMNVPPPVMSREEFEARKADMRRKRENDRRPERDFSKDRDFGREVSSVGDVSSMKSKTRSIPPSSGSDYHQPRFRSERHSPDRSPRDVEPPPPRPTKRKLEHHSDREREDRDRDYEHERHHRRHRSESSSRRSSEPVAKPSSNAAAAAAAAAAAAAAAAADRKQKASVFSRISFPAEEEPPKKRKVTASSTTEPAATAAAPSASSAHLKTVSNGYYEGRKSSGVADYESSDDERHFKRRPSRYEPSPPPQPAEWEEEGRHSRGTRERKHR

SEQ ID NO: 187916 - protein, 257 aa, Glycine max
  Coding DNA Sequence Number=SeqID_71138
  Gene Ontology: Mol. function=structural constituent of ribosome; Cellular component=intracellular; Biological process=translation
  Homolog annotation: Hit_ID=Q1S7P5; Match level="QueryCoverage=79%, HitCoverage=100%, E-value=5e-93, Identity=81%"; Hit description =Ribosomal protein L15e
  Pfam annotation: Domain name=Ribosomal_L15e; Domain location=55-246; Score=474.6; E_value=1.2e-139; Accession=PF00827.8; Description =Ribosomal L15
  Subcellular localization annotation: CTP_CleavageSite=50; ConfidenceScore=5.17e-01
MLDPVLTHLGHANLTDGSDLFIYRVKQGTASIKLRATLHRNPSSSLLRLRFSTMGAYKYVSELWRKKQSDVMRFLQRVRCWEYRQQPSIVRLTRSTRPDKARRLGFKAKQGYVIYRVRVRRGGRKRPVPKGIVYGKPTNQGVTQLKFQRSKRSVAEERAGRKLGGLRVLNSYWVNEDSTYKYFEVILVDVAHTAVRNDPRINWLCNPVHKHRELRGLTSAGKSNRGLRGRGHLYHKNRPSRRATWKRNNTLSLRRYR

SEQ ID NO: 187917 - protein, 103 aa, Glycine max
  Coding DNA Sequence Number=SeqID_71139
MPLRHKIPKQLHRIGLGGVFHADIGRWKFGFSTSKPLGNSLIAKLQAWKHGYHMLCWIGIGMSHKVADSLTRWGTTSSNYDQTWSLPPNGVLLALGRDALSST

SEQ ID NO: 187918 - protein, 212 aa, Glycine max
  Coding DNA Sequence Number=SeqID_71140
  Gene Ontology: Mol. function=oxidoreductase activity; Biological process=electron transport
  Homolog annotation: Hit_ID=Q2A9A9; Match level="QueryCoverage=98%, HitCoverage=57%, E-value=8e-86, Identity=67%"; Hit description =Oxidoreductase family protein
  Pfam annotation: Domain name=GFO_IDH_MocA; Domain location=7-135; Score=117.4; E_value=4e-32; Accession=PF01408.12; Description =Oxidoreductase family, NAD-binding Rossmann fold
MAGAIVVKYGIIGVGMMGREHLVNLYHLRTQGVAVVAIADPHLPSQQLALDLAHSFGWPLKVFSGHQELLDIGLCDVLVVSTPNMTHHRILMDIINHSKPHRVLVEKPLCTTISHCKEVVNAARKRPDILVQVRLEYRYMPPVAKLIEIVKGGNLGQVRKVAIREHQFPFLVKCCHFFDLMRLFVGANPVRVMASGAIDVNHKDEVYDGKVD

SEQ ID NO: 187919 - protein, 119 aa, Glycine max
  Coding DNA Sequence Number=SeqID_71141
MMIHLFRYRRREQKLLLGYTLTDKSASGNIFILCLVEMPIRSLVEVEPPSPLRYLIGAAVMMIGVVLPVGYMMFRNKRRIRDVLRPDDDGGGYDVRSLWFSGFGLINLEASADMPFVQL

SEQ ID NO: 187920 - protein, 48 aa, Glycine max
  Coding DNA Sequence Number=SeqID_71142
MTHPVFSHPKQMCFDLLVELGCVCSLEQALEAARGYKEGGGVRSGEEK

SEQ ID NO: 187921 - protein, 140 aa, Glycine max
  Coding DNA Sequence Number=SeqID_71143
  Gene Ontology: Mol. function=DNA binding
  Homolog annotation: Hit_ID=Q9LVR7; Match level="QueryCoverage=77%, HitCoverage=33%, E-value=3e-19, Identity=61%"; Hit description =Arabidopsis thaliana genomic DNA, chromosome 5, P1 clone:MQL5
GFLRQKLSGQGLAFILAGGSVVQKNLEIGEVLAVDVSSIVAVTSTVNVQIKYNGPARRTMFGGDNAVTALLTGPGIVFIQSLPFHRLSQRIARAVTSPNMRENPKFFIQIAVFFFLANVGEGVGGRFLVGRSFVPIKNSS

SEQ ID NO: 187922 - protein, 113 aa, Glycine max
  Coding DNA Sequence Number=SeqID_71144
MEAQQQAPKKFQPRAHASTVSSHTQKKKQREIEHRLFRTCNRLFRTCTYLASHHCKPETSRCSAGGSGGTATLACPARRNGGMALSSSRQPYQRYSLSLSYSACPAVRTGGLG

SEQ ID NO: 187923 - protein, 83 aa, Glycine max
  Coding DNA Sequence Number=SeqID_71145
  Subcellular localization annotation: CTP_CleavageSite=57; ConfidenceScore=5.07e-01
MGEIVREMNFNPLRCTLPSKVLIQFATGLSSSTSCLLQGVVLDKTNGVKSPLNSIALASLTEPAQKQFWKCQEGLAQLVEQRV

SEQ ID NO: 187924 - protein, 96 aa, Glycine max
  Coding DNA Sequence Number=SeqID_71146
MQELDCLPKLKTSSEEEAETPEESEEVQALKVELERAQTVKEKFKMTTIKPKHWNGKQRGSERKNEVETSFEGLRGAATASLSFGGPRETSRESKA

SEQ ID NO: 187925 - protein, 235 aa, Glycine max
  Coding DNA Sequence Number=SeqID_71147
  Gene Ontology: Mol. function=magnesium ion binding; Cellular component=membrane; Biological process=metabolic process
  Homolog annotation: Hit_ID=O23517; Match level="QueryCoverage=69%, HitCoverage=16%, E-value=5e-12, Identity=33%"; Hit description =Limonene cyclase like protein
  Subcellular localization annotation: CTP_CleavageSite=45; ConfidenceScore=5.48e-01
SSSKIVIACKRRLFSSPFVTFPSISSKIDQRRSLPDSDPSSELVRNEMKRAFRRTAFVLMRELSWRCFGHKIDWRRFFVLVAILTVSAFVFQTLVHAYLALPNRPLHSPHQSNSSLQGGRLQKVHLTLTDSVISPNASNKLIQSFSVQLENAELEAPIQRKNSVSARKKDKNLAGTTKVATSLSPPRHVPKQRHIQLLPPNKALVQAKKEIDRAPSVNEDPDIYAPIFRNISVFK

SEQ ID NO: 187926 - protein, 347 aa, Glycine max
  Coding DNA Sequence Number=SeqID_71148
  Gene Ontology: Mol. function=nucleic acid binding; Biological process= DNA integration
  Homolog annotation: Hit_ID=Q1S1G2; Match level="QueryCoverage=75%, HitCoverage=22%, E-value=2e-42, Identity=30%"; Hit description =Integrase, catalytic region; Zinc finger, CCHC-type; Peptidase aspartic, catalytic
  Pfam annotation: Domain name=zf-CCHC; Domain location=195-212; Score =11.5; E_value=0.012; Accession=PF00098.13; Description=Zinc knuckle
  Subcellular localization annotation: CTP_CleavageSite=4; ConfidenceScore=5.17e-01
MATSGSSGEDDSTPPPPPSFIDPSQNPASPFYIHPSENPTSVIVTPPLTANNFQSWSHSIYYSWERCNTLLISWLLNSLSPSIAQSVIFFEHAIDIWNDLRERFSQGDLLRVTKLQEEIYALKQASLFVTDYYTTLKSLWEELDNYRPLPPCLDERFAMVRSQILLLDPLPSANRAEATHNKGGPNQHKSNTTPPKCSHCDKLGHTSDVCYSKFGYPPGHPKYPGHPRLSNNKYTSGGGTTSSGGGAVNNAEVATPTHGGESKKESSTQDHGFHITMAQYQQLMNLLSKSSGPGGDMSTLRTIGLADLKEGIFHLIVGKDRSPSTNNITTTNTNNSQLWHFRLGHVS

SEQ ID NO: 187927 - protein, 391 aa, Glycine max
  Coding DNA Sequence Number=SeqID_71149
  Gene Ontology: Mol. function=DNA binding; Cellular component=beta -galactosidase complex; Biological process=DNA integration
  Homolog annotation: Hit_ID=Q1SDN3; Match level="QueryCoverage=99%, HitCoverage=31%, E-value=1e-149, Identity=65%"; Hit description =Polynucleotidyl transferase, Ribonuclease H fold
MKCEIKALQLNQTWDIVQTPSHLPDGSIERYKARLVAKGYSQIEGIYYFETFSPVVKMATVRVVLALASINRWHLHQLDVSNAFLHGDLREDVYMEIPPGLLGYTSSQSCKLKKSLYGLKQSSRKWYEKLSTLLMTCGYSHAHVDHSLFIKAHNSEFTALIVYVDDIVLIGNSLAEIERIKRTLHTNFHIKELGKLKYFLGLEVAHSDKGISLCQRKYCLDLLKDSGMLGCKPSSTPMDSSLRLHNDSSGFLDDPLSYRRLVGRLVYLTSTRPDIAFATQQLSQFMSKPTKAHHAAAVRVLRYLKGCPDQGLFFPRTCSPHLLVFSDADWATCIDSRRSITGYCFFIGNSLVSWKTKKQTTVSRSSSEAEYRALASTTCELQWLSYLLRDL

SEQ ID NO: 187928 - protein, 146 aa, Glycine max
  Coding DNA Sequence Number=SeqID_71150
MDRARLIYGLMMKMDMDIDNMILLQITKITQSSMSRFGFPALIIALYDAKGINSDTLSHSGCTTTSHPSSSHLIFRRPTFFSVGVALPHAVEPLAWPISLGPGRSSTMSPTGSDDTRGIPLLGCLAKSPTSFYRGVIPMLLVMMLP

SEQ ID NO: 187929 - protein, 36 aa, Glycine max
  Coding DNA Sequence Number=SeqID_71151
MILLRRVVQEALDKAYMTKKDLTAVVVTVGPGLSLY

SEQ ID NO: 187930 - protein, 82 aa, Glycine max
  Coding DNA Sequence Number=SeqID_71152
MERGEVEAKREGGGQKTYGISKEYDKISKVFIPKKTEKKGERFGFARIERVADSRVFALKLDEIFIGTYKLMVNAPRFSRGS

SEQ ID NO: 187931 - protein, 1017 aa, Glycine max
  Coding DNA Sequence Number=SeqID_71153
  Gene Ontology: Mol. function=transmembrane receptor activity; Cellular component=membrane; Biological process=defense response
  Homolog annotation: Hit_ID=Q1SI46; Match level="QueryCoverage=91%, HitCoverage=85%, E-value=0.0, Identity=56%"; Hit description=Leucine Rich Repeat, putative
  Pfam annotation: Domain name=DUF573; Domain location=211-287; Score= -27.9; E_value=0.045; Accession=PF04504.5; Description=Protein of unknown function, DUF573
  Pfam annotation: Domain name=LRR_1; Domain location=646-667; Score =2.6; E_value=93; Accession=PF00560.23; Description=Leucine Rich Repeat
  Pfam annotation: Domain name=LRR_1; Domain location=669-690; Score =9.8; E_value=4.2; Accession=PF00560.23; Description=Leucine Rich Repeat
  Pfam annotation: Domain name=LRR_1; Domain location=692-714; Score =7.5; E_value=11; Accession=PF00560.23; Description=Leucine Rich Repeat
  Pfam annotation: Domain name=LRR_1; Domain location=716-736; Score =2.6; E_value=91; Accession=PF00560.23; Description=Leucine Rich Repeat
  Pfam annotation: Domain name=LRR_1; Domain location=738-757; Score =5.0; E_value=33; Accession=PF00560.23; Description=Leucine Rich Repeat
  Pfam annotation: Domain name=LRR_1; Domain location=759-780; Score =5.5; E_value=27; Accession=PF00560.23; Description=Leucine Rich Repeat
  Pfam annotation: Domain name=LRR_1; Domain location=782-803; Score =16.8; E_value=0.079; Accession=PF00560.23; Description=Leucine Rich Repeat
  Pfam annotation: Domain name=LRR_1; Domain location=828-855; Score =4.4; E_value=43; Accession=PF00560.23; Description=Leucine Rich Repeat
  Pfam annotation: Domain name=LRR_3; Domain location=646-665; Score =17.7; E_value=0.042; Accession=PF07725.3; Description=Leucine Rich Repeat
  Pfam annotation: Domain name=NACHT; Domain location=280-397; Score= -37.6; E_value=0.049; Accession=PF05729.3; Description=NACHT domain
  Pfam annotation: Domain name=NB-ARC; Domain location=240-503; Score =61.8; E_value=2.2e-15; Accession=PF00931.13; Description=NB-ARC domain
  Pfam annotation: Domain name=TIR; Domain location=20-150; Score =165.2; E_value=1.7e-46; Accession=PF01582.10; Description=TIR domain
  Pfam module annotation: Pfam domain module=DUF573::LRR_1::LRR_1::LRR _1::LRR_1::LRR_1::LRR_1::LRR_1::LRR_1::LRR_3::NACHT::NB-ARC::TIR; Domain location=211-287::646-667::669-690::692-714::716-736::738 -757::759-780::...
  Pfam module annotation: Domain location=782-803::828-855::646 -665::280-397::240-503::20-150
MDVASEQMPADSVPQIKYDVFVNFRGEDIRHSFLGYLTEAFYQKQINAFVDDKLEKGDEIWPSLVGAIQGSSISLTIFSENYTSSRWCLDELVKILECREKYGQIVIPVFYGVNPTDVRHQKGSYGEALAQLGKKYNLTTVQNWRNALKKVADLSGIKSFDYNTDVVTCAFNIVSLLSNDVEIFDFYIVAYASTDLIKEKKLSLLLDDSRQLFQRLWTDEDEIELLQGTEVELLGEIINIVNLVLTSLDKFDPESSRLIGIDKQIQHLESLLHQESKYVRVIGIWGMGGIGKTTIAEEIFSKLRSEYDEDVEMDHMPRLSNYIKRKIGRMKVLIVLDDVNDSNLPEKLFENHDWFGRGSRIIITTRDKQVLIANKVDDIYQVGALNNSEALELFSLYAFNQNHFDMEYYKLSEMVVNYAKGIPLVLKVLGRLLCGKDKEVWESQLHKLENMPNTDIYHAMRLSFDDLDRKEQKILLDLACFFIGLNLKLDSIKVLLKDNERDDSVVAGLERLKDKALVTISEDNVISMHDIIQEMAWEIVRQESIEDPGNRSRLIDPNDVYEVLKYNKGTEAIRSIRANLPAIQNLQLSPHVFNKMSKLQFVYFRKNFDVFPLLPRGLQSFPAELRYLSWSHYPLISLPENFSAENLVIFDLSGSLVLKLWDGVQNLMNLKVLTVAGCLNLKELPDLSKATNLEFLEISSCSQLLSMNPSILSLKKLERLSAHHCSLNTLISDNHLTSLKYLNLRGCKALSQFSVTSENMIELDLSFTSVSAFPSTFGRQSNLKILSLVFNNIESLPSSFRNLTRLRYLSVESSRKLHTLSLTELPASLEVLDATDCKSLKTVYFPSIAEQFKENRREILFWNCLELDEHSLKAIGFNARINVMKSAYHNLSATGSSIPEWLEYKTTKDYLIIDLSSTPHSTLLGFVFSFVIAESKDHNRAVFLDYPFYITVSEGEGESEKGGIDIFVSHTVRVESGYNKGSGSKRFKTGSGVKRVWGHPNNLLSISEFHSRNKQLG

SEQ ID NO: 187932 - protein, 106 aa, Glycine max
  Coding DNA Sequence Number=SeqID_71154
  Gene Ontology: Mol. function=nucleic acid binding; Biological process= DNA integration
  Homolog annotation: Hit_ID=Q1SIY6; Match level="QueryCoverage=99%, HitCoverage=19%, E-value=2e-11, Identity=72%"; Hit description =Integrase, catalytic region; Zinc finger, CCHC-type
MDTKVNFSHVALHMFNGENYNLWAVRMENYLEALDVWEAVEGITMMKESETINEFSDKLLDIANKVSLFNNFGEHKGSIPNHFVKSFACFKGTRTKKAYEVGKIYG

SEQ ID NO: 187933 - protein, 91 aa, Glycine max
  Coding DNA Sequence Number=SeqID_71155
  Gene Ontology: Mol. function=transcriptional activator activity; Cellular component=transcription factor complex; Biological process =regulation of transcription, DNA-dependent
  Homolog annotation: Hit_ID=Q1SQ46; Match level="QueryCoverage=86%, HitCoverage=13%, E-value=9e-14, Identity=50%"; Hit description=IMP dehydrogenase/GMP reductase
MVYYSHRAKNVAGQRLDDGFLCCGSCGRVLEDYFFAEEPSFVKNAVGQSKLSGNYVRIVQSEYSESRQRTLDRGMSFLSLMTDFTLGMQLT

SEQ ID NO: 187934 - protein, 207 aa, Glycine max
  Coding DNA Sequence Number=SeqID_71156
  Gene Ontology: Mol. function=nucleic acid binding; Cellular component= chromatin; Biological process=DNA integration
  Homolog annotation: Hit_ID=Q1S6N9; Match level="QueryCoverage=95%, HitCoverage=15%, E-value=2e-62, Identity=61%"; Hit description =Integrase, catalytic region; Zinc finger, CCHC-type; Peptidase aspartic, catalytic
MGIGGMPNHKKDIRVKRVYWTKLNLDGFVNKYKARLVVKGYAQIFGVDFSETFAPVARLDTIRLLFALTTQNGWATHHMDVKSAFLNGYLEEEIFVEEPEGFVVQEREEKVYRLNKTLYGLKQAPRSWYNRIDEHLVNLGFVKSPSEFTFYVKKVDNNILVVSFYVDDLFVTESHNELIDKFKERMKDAFEMTDLGKMAFFLGIAKA

SEQ ID NO: 187935 - protein, 171 aa, Glycine max
  Coding DNA Sequence Number=SeqID_71157
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=98%, HitCoverage=51%, E-value=1e-34, Identity=48%"; Hit description=SAM dependent carboxyl methyltransferase
  Pfam annotation: Domain name=Methyltransf_7; Domain location=5-170; Score=-186.0; E_value=0.0007; Accession=PF03492.6; Description=SAM dependent carboxyl methyltransferase
MFISQEQALLQSMKHTSSIFEKGFQTFSKITLRVTKVAWYYEVISMVLNDKVQERQDWTSLIYVDIVIVLKKLDKWLKQKDLFTIETLKTIKIGWDANLQEDVDDFILNSKMRGELITKTIRAVFEPLLSAEFGEGIIDELFLRYAKLVAQLIEVETLEHTNVVVPMTKHS

SEQ ID NO: 187936 - protein, 41 aa, Glycine max
  Coding DNA Sequence Number=SeqID_71158
MGRPIIMSQKTKTMAVYGLGFRQKERKIKESDRTTSVFTLH

SEQ ID NO: 187937 - protein, 305 aa, Glycine max
  Coding DNA Sequence Number=SeqID_71159
  Gene Ontology: Mol. function=transferase activity; Cellular component= membrane; Biological process=metabolic process
  Homolog annotation: Hit_ID=Q657X7; Match level="QueryCoverage=98%, HitCoverage=54%, E-value=1e-131, Identity=70%"; Hit description =Pectin-glucuronyltransferase-like
  Pfam annotation: Domain name=Exostosin; Domain location=2-266; Score =259.9; E_value=5.3e-75; Accession=PF03016.6; Description=Exostosin family
MEENKQFVTKDPEKAHLFYLPYSARQMGLTLYVPGSHDLKPLSIFLRDYVNKIAAKYPFWNRTQGSDHFLVACHDWGPYTVTGHEELKRNTIKALCNADLSEGVFVAGRDVSLPETTIRAPRRPLRYLGGNRVSLRPILAFFAGSMHGRVRPTLLTYWGGGKDEDMKIYKRLPLRVSQRMTYIQHMKSSKYCVCPMGFEVNSPRIVEAIYYECVPVIIADNFVLPFSEVLDWSAFSVVVAEKDIPRLKEILLSIPLRKYLTMQNNVKMVQKHFLWNPRPIRYDLFHMILHSIWFNKLNQTQPSQI

SEQ ID NO: 187938 - protein, 197 aa, Glycine max
  Coding DNA Sequence Number=SeqID_71160
  Gene Ontology: Mol. function=DNA binding; Cellular component=nucleus; Biological process=regulation of transcription, DNA-dependent
  Homolog annotation: Hit_ID=Q52MQ4; Match level="QueryCoverage=68%, HitCoverage=67%, E-value=7e-53, Identity=74%"; Hit description=Myb family transcription factor 2
  Pfam annotation: Domain name=Myb_DNA-binding; Domain location=18-65; Score=58.5; E_value=2.2e-14; Accession=PF00249.21; Description=Myb -like DNA-binding domain
  Pfam annotation: Domain name=Myb_DNA-binding; Domain location=71-116; Score=50.7; E_value=4.8e-12; Accession=PF00249.21; Description=Myb -like DNA-binding domain
  Pfam module annotation: Pfam domain module=Myb_DNA-binding::Myb_DNA -binding; Domain location=18-65::71-116
MAPRVNDGTITSKRAMNRGAWTPEEDRKLAQCIEIHGAKRWKTVAIKSGLNRCGKSCRLRWLNYLRPNIKRGNISDEEEDLILRLHRLLGNRWSLIAGRLPGRTDNEIKNYWNSHLCKKVNQKVEKPESYTRHEIIGQNDAGDNRAMSENEVEINESSNLDVSSFDVNEFFNFSEESFGFDWLNKYLELDQIPQSTE

SEQ ID NO: 187939 - protein, 222 aa, Glycine max
  Coding DNA Sequence Number=SeqID_71161
  Homolog annotation: Hit_ID=Q9LVR8; Match level="QueryCoverage=41%, HitCoverage=75%, E-value=1e-11, Identity=42%"; Hit description =Arabidopsis thaliana genomic DNA, chromosome 5, P1 clone:MQL5
MLFILRAEAELQAISGDNLVPSLRCIDSLKAKLGCLFDGHAIIKSLSTCTEPMPHQQSRDEIFKPRRGAGNYAFADVKYKGDWMRRPISNDEIAWLAKILIRLSDWLNESLGLNQAESNQVSSTVSYVEVSADVAAHIWGPYKALKVFLCTIGSWFLFLGAASLGCMRKHGLRVNLSPLFCSLAVRVLQPLCTSYIAPHGQTSVQLIQKCNNSGSQGIDVII

SEQ ID NO: 187940 - protein, 71 aa, Glycine max
  Coding DNA Sequence Number=SeqID_71162
MATTKEQETPMMARVVVEDWPTVKERWESAETPVPEEVILVEELDGDNKKARKTDLMKRVLVFYTFQFMIG

SEQ ID NO: 187941 - protein, 68 aa, Glycine max
  Coding DNA Sequence Number=SeqID_71163
MIFPATARSALSPSLQHCSAKVDGYGEEIDWKEEGWSDGSVVETLRYGKVKEAVEWMNKGVRAGASCF

SEQ ID NO: 187942 - protein, 50 aa, Glycine max
  Coding DNA Sequence Number=SeqID_71164
MRLWLIRQIGKSVVFTFSLSQSVGLGAFAKRGTQWLSARKKPEEDKLSVR

SEQ ID NO: 187943 - protein, 555 aa, Glycine max
  Coding DNA Sequence Number=SeqID_71165
  Homolog annotation: Hit_ID=Q9LVR9; Match level="QueryCoverage=97%, HitCoverage=84%, E-value=1e-128, Identity=45%"; Hit description =Arabidopsis thaliana genomic DNA, chromosome 5, P1 clone:MQL5
  Subcellular localization annotation: CTP_CleavageSite=35; ConfidenceScore=5.33e-01
MPSHSSSTFDSLSKSQDLSSAIQSATTPSQISSACASIETFLHSHSPDQSRHFFSLAFPTLISKLFGFDDSSNAWILHRHSSADGDLSQTLFSLLSPSGNLAAAIAAVDRLSLVKYVFPAERLPHWTRSFLSDTDSRSLSDLCPSLFKPSPSPSQIQFNVFEYFFFWFAYYPVSKGKNDNNECVSVNKRVKKFRLEDWTNTWTSSIPGFSASSSSKRCSSEGKPQCDLYTRLLCAYLRAFVPSYDFHAHQPYRTSILHYGSGYDSSVSARAEFVVNALIHFWLVDNDFSPLPASVCRSLRVSFPAGETPPPPGLGEVVRLFVRYLNLSTVATFRENGGGGECGTPWWRALEGAKSKDLGSLSSVRSLGCWNFCLQRPLYRYLLRTFLFCPMAASVKNVSQVLSVWVGYLEPWTMNADEFSNMDGFNGEKKEDSVPASAGDGFSPQWQDYVLSNYLYYSSLVMHFIGFAHRFLHSDVEVVVQMVLKVLDTLTSSKELIDLLKTVDSLFHSKQVGSGKAMLNNLYRYVPIIHEQLQYYSLYDGVVYSSIFAAHHSVN

SEQ ID NO: 187944 - protein, 88 aa, Glycine max
  Coding DNA Sequence Number=SeqID_71166
  Subcellular localization annotation: CTP_CleavageSite=38; ConfidenceScore=5.21e-01
MYYMLFSFSPSSKLALNPKRLSCKIATAPTSCCDCFCRCSGVWERSNAREEDKNAGPCWYAVGKFFQVSGRRSLNQSTKVVGWWSLLQ

SEQ ID NO: 187945 - protein, 281 aa, Glycine max
  Coding DNA Sequence Number=SeqID_71167
MNSLSEHVALSEFINTHRICLPEKRKSIGARPTAQYDTRRFHSFEAWTRYTNNVLGRHILAERKVEIYHTELDEFKAELERRNFHKRLTNLADSSIDLALVKEFYANLYSPEGPSPKQVKIRGHLIKIDANSLNTFLETLVVLAKGESLPAYSRYYRMPTDIREIEAALCILGRRFVLNAEGHPGKILKKDLTTHAQVWSVLSYSNLALTSHTSDLTLDRARLIFGLVSQLDMNEGALISGQITSMAQSNSSRLRFLALITALCRSRGVASDSLVLEHLST

SEQ ID NO: 187946 - protein, 76 aa, Glycine max
  Coding DNA Sequence Number=SeqID_71168
MGKLAKLPIISPKTQYPRNSREKEVHPNLKFRSPTRRDALHDSENALLSRVGAEMMAKGWSFVGASMENGGEGKAT

SEQ ID NO: 187947 - protein, 182 aa, Glycine max
  Coding DNA Sequence Number=SeqID_71169
MAVGGLRKCERMNAIYDWICSHCVHPIQMGETTLQKHMRTAPPPYKAKEVNIFFFLLPTYTRRRKLVNNSGRYWLHAYQQQIRFMFWEKKFFKAFVSVFANCIRVDHIMARVVFQSMYVGAMFWPMSTNNVYWSTLAITIFGRCRLGFIWPMLVSAFLSKMTRVFSVDANKAFSNRHWLGYF

SEQ ID NO: 187948 - protein, 64 aa, Glycine max
  Coding DNA Sequence Number=SeqID_71170
MAPRREKTTMENGELPTMEKKEEEETNNGTADQLVGSHTVIKWAAAKRVEPVKSAAVGPAGQGL

SEQ ID NO: 187949 - protein, 112 aa, Glycine max
  Coding DNA Sequence Number=SeqID_71171
MVKTRGLGRAIGRVGARGLGRGRDGDDTDGAPQRQRPTASAHSPAIPEAEAAVVGDEPMVDVVAQATGVETDAQDTAAKTDGDEPVGFPDGPRDHQCLQSMLTMLQATYGLD

SEQ ID NO: 187950 - protein, 190 aa, Glycine max
  Coding DNA Sequence Number=SeqID_71172
  Gene Ontology: Cellular component=integral to membrane
  Homolog annotation: Hit_ID=Q8L4G8; Match level="QueryCoverage=82%, HitCoverage=36%, E-value=1e-47, Identity=48%"; Hit description=C4 -dicarboxylate transporter-like protein
  Pfam annotation: Domain name=C4dic_mal_tran; Domain location=4-155; Score=0.0; E_value=8.6e-08; Accession=PF03595.8; Description=C4 -dicarboxylate transportermalic acid transport protein
MNFILWLISIAIVAIVFTTYLFKIILYFEAVRREYHDPVHVNIFFATWIALLFLALGVPPSVAKDLHHVVWYILMIPLFCLKLKIYGKWMFKGQRMLSKMLPTNKAIPKDLHPVFFLFVAPSSVAAMAWAKIQGCSGQSFQRIQILTFMVGLHISDEHVVWEDIHEQRALNVFLVVGDCVLVGFQAAVEA

SEQ ID NO: 187951 - protein, 139 aa, Glycine max
  Coding DNA Sequence Number=SeqID_71173
  Homolog annotation: Hit_ID=Q9M1T3; Match level="QueryCoverage=46%, HitCoverage=5%, E-value=3e-12, Identity=66%"; Hit description =Structural maintenance of chromosomes (SMC)-like protein
  Subcellular localization annotation: CTP_CleavageSite=91; ConfidenceScore=5.11e-01
MIYNFNSYKGFQLISPIYDFTAIISPNDIDKSNLINAISFVLGSAPSSSVTLNSRTSSTPLTTVRWSRKSHNGDGFAIAASVPVGEDYFLVASNPKKWCREVCHLVYCGVRKRDSNKWVCEAREGFVEWESYKRVSDES

SEQ ID NO: 187952 - protein, 75 aa, Glycine max
  Coding DNA Sequence Number=SeqID_71174
MAINSSRAQKKAKTSKRKQELVKVFYTCACVDLEGNIFFTVNEVDMVIDATVWKEVVGLDMGGVRKFDETPYGYC

SEQ ID NO: 187953 - protein, 88 aa, Glycine max
  Coding DNA Sequence Number=SeqID_71175
MAWKFVGSQTFHSKLKDKESKTESIIENLQEIEHMKNDTAELKMEAEVTKVVLQDAETKLRVVVEEVEAANAAEASVVDQIKVSYFHL

SEQ ID NO: 187954 - protein, 109 aa, Glycine max
  Coding DNA Sequence Number=SeqID_71176
  Subcellular localization annotation: CTP_CleavageSite=23; ConfidenceScore=5.69e-01
MASSFVGTLLPNHFTQTKHSAVPASRSGAPRRRRVHLATTRVETMTTVIEKLGIKIERNPPESKLTQLGVRQWPKINNPEIVAATDNWFGDVKERMLLRNLRGSYFLAI

SEQ ID NO: 187955 - protein, 94 aa, Glycine max
  Coding DNA Sequence Number=SeqID_71177
MAPKKLSTNRSRWDATGEGSSAALEFDSHRFRSAEHQQRFEAIKGWKTNNVNSARGGARQTVSMRKPSPSCCAYRGRISPELLQGGGCGSCAPS

SEQ ID NO: 187956 - protein, 110 aa, Glycine max
  Coding DNA Sequence Number=SeqID_71178
MLQNLTDCATMLPFDFRHVTEPHELCNNASVATCPLAGERRQGSWVRFSKEERCAESPPTFICGKRRENRRKPVKMKILSSGIVFTFEEGRQKRCSCSYVPSIKEEIRPS

SEQ ID NO: 187957 - protein, 64 aa, Glycine max
  Coding DNA Sequence Number=SeqID_71179
MALDHMGSFTCHKKDVGSLNQGGDGSSGPTSEDLIMMKNVHRLGGQARPGFKRPEPSLRLIFEA

SEQ ID NO: 187958 - protein, 141 aa, Glycine max
  Coding DNA Sequence Number=SeqID_71180
  Homolog annotation: Hit_ID=Q9FGK0; Match level="QueryCoverage=76%, HitCoverage=87%, E-value=8e-39, Identity=72%"; Hit description =Arabidopsis thaliana genomic DNA, chromosome 5, P1 clone:MNJ7
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKTPFGPTNMGEMQYLEAEGTQKLGELPHPVLPGLELQL

SEQ ID NO: 187959 - protein, 173 aa, Glycine max
  Coding DNA Sequence Number=SeqID_71181
  Gene Ontology: Mol. function=aminoacyl-tRNA ligase activity
  Homolog annotation: Hit_ID=Q1SP92; Match level="QueryCoverage=84%, HitCoverage=67%, E-value=6e-45, Identity=68%"; Hit description =YbaK/prolyl-tRNA synthetase associated region
MLHNVTIVEAEHPARNENGGSPCGAGASPNPAPATHIETGAFASCITRFPERHRRRHCHRHRDSPLLHSAQQRRSQFFLQESPFRLLRLAPRSPVRRHSPPPPSTISAKASFSLTRKPPPTSSIAATARIPNTMSLSFSTPPASTLRLSRILYTRSTMEVSRKRNSTLLSDCL

SEQ ID NO: 187960 - protein, 105 aa, Glycine max
  Coding DNA Sequence Number=SeqID_71182
MARVGSVGGGEGGGRRRVGMEIGFEEMGMEGLGVGRGTEVGACFEENNALNSWVHNLDEQVSAFGCTGPSFSLPAVLSSPLVCGVAFAIVGQKGIQEFGTRRLFI

SEQ ID NO: 187961 - protein, 326 aa, Glycine max
  Coding DNA Sequence Number=SeqID_71183
  Gene Ontology: Cellular component=mitochondrion
  Homolog annotation: Hit_ID=Q1SP96; Match level="QueryCoverage=97%, HitCoverage=42%, E-value=1e-121, Identity=65%"; Hit description =Villin headpiece
MAIIGCSSDGHMDDTKFSKPMPWIGIYIAAASLACLIAMAADLIHGIRGRKLWFPCKFFCLNATSLAIIAVAVKLSVDLNTPMPHRHDQLSKLSSSALICTIMANSMPTLGITENKDTMMNFMAMAILVITMIVNICIQFVTGVIYLFWVEHAVIMLIMLILLMTMASSAISLPKMKHYFELKYKMNEEALKEGSKLLGEEGNQMVNRLRDQLMKIWMMAHTSSPQFVLGRSVTGTASGAFCLLSTLTLVEAMLRSYLMPWSFDFCTGDTDYKWSIILILIVQVAAVVVGTIAPAFRWFIAITYKCPNVRKKRCKRRFHVEGWGLC

SEQ ID NO: 187962 - protein, 99 aa, Glycine max
  Coding DNA Sequence Number=SeqID_71184
  Subcellular localization annotation: CTP_CleavageSite=39; ConfidenceScore=5.22e-01
GSNLARLGELGGNHLPRFVKKWASGTSGTPTVFRSWVASGSNPAHLGELGGNLLPLFPINRLKGAVLRIPDPPNDVSVSKSVKVFLRSSPFFIRSSLFN

SEQ ID NO: 187963 - protein, 48 aa, Glycine max
  Coding DNA Sequence Number=SeqID_71185
MVKYRAKSKTEMNRGTWGRARMDARPMIKRSLSRVQLRTIEKCYWEAA

SEQ ID NO: 187964 - protein, 76 aa, Glycine max
  Coding DNA Sequence Number=SeqID_71186
MKWSGSVEGRVMGCNEEERSSFPFHENYKVAYPSRGGDFASEPEPCLRSALMSRALAWSRIGIEDERKPRLRELWG

SEQ ID NO: 187965 - protein, 198 aa, Glycine max
  Coding DNA Sequence Number=SeqID_71187
MGDQEEIQEQMKVDMSALKKQMASMMDAMLGMRQLMENNMATATAVSSAAEADPTLPATAHHPLPNVIRRDRSTLGHISNPYLGYNRVAYPYGLPPNYMPPVMRADAGHVPSPILEREPPRQSDKVHEDRIEYAQGDIDFYPPVPVEGADTQHTALAQPHGRTLKPPSTANILVHRRTAPGSGRKKETRSHRREIESY

SEQ ID NO: 187966 - protein, 93 aa, Glycine max
  Coding DNA Sequence Number=SeqID_71188
MTMAQELSRSSFCGEWNGSSLSKSREEHEEASGAAMRMEESGYRKTGFKVPVFKKLHLFTKMPPLYLLHRFSYNRCKINVNKGTFSSSDYKKL

SEQ ID NO: 187967 - protein, 180 aa, Glycine max
  Coding DNA Sequence Number=SeqID_71189
  Homolog annotation: Hit_ID=Q2HVF5; Match level="QueryCoverage=59%, HitCoverage=25%, E-value=7e-22, Identity=48%"; Hit description =Cyclin-like F-box; F-box protein interaction domain; Galactose oxidase, central
MNVNFHNSKIDVWVMREYNRGDSWCKLFTLEESRELRSFKCVRPLGYSSDGNKVLLKHNWKRLCWYDLRKKEVTLVRIQGFPNLNEAMICLGTLVTPYFLPREICRKLRTLGCEHPSICTGKDFTLTFNYRLTCMVMVESNDGSATVAAPGESVTESLKTNCEMCLILIVIIPLTHEFYS

SEQ ID NO: 187968 - protein, 73 aa, Glycine max
  Coding DNA Sequence Number=SeqID_71190
MIIIGGDWGTTSNSGEGGFATGDCGSAGTGSTHAGTKVWELWTSGPIVVDGGAGVDGEGMSSTLALFLDAIYK

SEQ ID NO: 187969 - protein, 81 aa, Glycine max
  Coding DNA Sequence Number=SeqID_71191
MGSKERRRKKFLFIFIDLERQSLLPTYPNGIKIISKKKSLGKIRGRKGIEEIKELCKDKSKRAGSLKMTLDQVRVPFLGYG

SEQ ID NO: 187970 - protein, 232 aa, Glycine max
  Coding DNA Sequence Number=SeqID_71192
  Gene Ontology: Mol. function=RNA-directed DNA polymerase activity; Cellular component=chromatin; Biological process=chromatin assembly or disassembly
MDGENDTHCEKLVKKDGAEDDTGSSDSIVVKQLLQKLQGNTLDEFRQSVKKVELPMFNGDDPTGWIARAVVYFRVQGTQEELKVSLAQLCMDGPTIYFFKGFTDDNENMPWEKLKDALLERYGGLGDVSVFEQLSALHQEGSVEEYIQEFERLVAQVPWLPDKQYLGGARESPDKGSTRPGLKQETGVDRRSLGPRDSGVKHLSYQQLMERQKKGMCYCSLCRQVYRFAQVV

SEQ ID NO: 187971 - protein, 250 aa, Glycine max
  Coding DNA Sequence Number=SeqID_71193
MDRARLVYGLVMKMEMDVGSIISGQISQMAQSNSYRLGFPALITTLCTARGVVPNSLTFESLSPVINLDYIRKNCWNPDDSTITFTGTHKARARGPSNTSTSTLASTPAPASAPALALAPLATTAPSDPSTSTRDAIMPMFMEDFMAQVVWPGVQPYPMGGGEAPIAQDRQPDPKVTLDDTPEETSEDTSAATPMEVTKEGDGVADIDYVTDMIVAQGTWDPWPTPTQDTPLPAQDAPSSPQDDPTPAQE

SEQ ID NO: 187972 - protein, 62 aa, Glycine max
  Coding DNA Sequence Number=SeqID_71194
  Subcellular localization annotation: CTP_CleavageSite=32; ConfidenceScore=5.29e-01
MSHLAEIANQSKLHNLLSASTYALSPKTSWVSYFSNWAKRVGLAKRMSLNPENSNVTEYSLS

SEQ ID NO: 187973 - protein, 62 aa, Glycine max
  Coding DNA Sequence Number=SeqID_71195
MFMTPRLCISAILGEKTRFREEKSSQSASVTLPRCFCEQICEDFPSFFTVLRPFFFVLRSST

SEQ ID NO: 187974 - protein, 464 aa, Glycine max
  Coding DNA Sequence Number=SeqID_71196
  Gene Ontology: Mol. function=urea carboxylase activity; Cellular component=cytoplasm; Biological process=metabolic process
  Homolog annotation: Hit_ID=Q6D598; Match level="QueryCoverage=98%, HitCoverage=37%, E-value=1e-169, Identity=67%"; Hit description=Urea amidolyase
  Pfam annotation: Domain name=AHS1; Domain location=112-345; Score= -71.4; E_value=3.4e-05; Accession=PF02682.7; Description=Allophanate hydrolase subunit 1
DCEYAIGAVNFTGDFPVILTHDGPSLGGFVCPVTIAKAELWKVGQVKPGDRIRFHPISADEAVALEKAQAHSVTTLRSQHAPAFAVPSLAASDIGSATLLAALPATATTPAAVYRQAGDKYVLIEYGDNVLDLALRLRVHLLMQALRQRAEPGIEELSPGVRSLQVRYDSLVIGQQQLMTLLLELEAGLGDVSALKVPSRIVWLPMAFEDSATLGAVERYKETVRASAPWLPNNVDFIQRINGLASREAVRDTLFAASYLILGLGDVYLGAPCAVPIDPRHRLLSSKYSPARTFTAEGTVGIGGMYMCIYGMDSPGGYQLVGRTLPIWNKFLQNDQFTAGEPWLLRFFDQVRFYPVSEAELTQLRDDFRAGRARIRIEQSEFNFAAHQQFLADNAPEISAFRERQAAAFEQEVTLWAQEEQEAPLTSEETLVVADAEDDALAVCADMNGNLWKVLLRRAIQCRP

SEQ ID NO: 187975 - protein, 59 aa, Glycine max
  Coding DNA Sequence Number=SeqID_71197
  Subcellular localization annotation: CTP_CleavageSite=42; ConfidenceScore=5.09e-01
MYPSCVHDTGPGYIFHKKKAAKPVSYSFRCQTKEIGMASSSSANKGSNSVEERNYPTIW

SEQ ID NO: 187976 - protein, 65 aa, Glycine max
  Coding DNA Sequence Number=SeqID_71198
MGKSGSCENPNRLEVRKNRSLGDSIGLRLNLRRRRWWWRWRVRARGRNDKVEESENQRVRVSKRG

SEQ ID NO: 187977 - protein, 276 aa, Glycine max
  Coding DNA Sequence Number=SeqID_71199
  Gene Ontology: Mol. function=protein transporter activity; Cellular component=membrane; Biological process=protein secretion
  Homolog annotation: Hit_ID=Q1YHF8; Match level="QueryCoverage=95%, HitCoverage=70%, E-value=2e-24, Identity=28%"; Hit description =Putative efflux transporter, RND family
  Pfam annotation: Domain name=Biotin_lipoyl; Domain location=2-56; Score=-13.6; E_value=0.024; Accession=PF00364.12; Description=Biotin- requiring enzyme
  Pfam annotation: Domain name=HlyD; Domain location=1-256; Score=6.1; E_value=0.0017; Accession=PF00529.10; Description=HlyD family secretion protein
  Pfam module annotation: Pfam domain module=Biotin_lipoyl::HlyD; Domain location=2-56::1-256
MMQGRITKVLVDEGDHVKAGQQLAVVDTSLAKVQRVQSLAGKQRAIVGFSEAEAALEDAKKQLEQARAEKARGEKVAEDGLISKETLEQRVLAEQAAESKVNTARNQLRIALSDLLAANAQVDEADLKIKQAELIAPAAGRIIQKNAVVGQVLGQASQPQFLLAKDDTLEVDIQTTPEEATSLKNGMPVVIKVDGMSGTYRGTIRKKGVMVRDENQMVHIKVAFSKAPELMPGQSATVSAKLPHQDGIRLPDSAITAEGNQYFVYTVEQQHAKRIA

SEQ ID NO: 187978 - protein, 50 aa, Glycine max
  Coding DNA Sequence Number=SeqID_71200
MTLPNSSRLLLSGLLCMVCTVTDKTEEAERVVFELALKCQMMNITTAIAM

SEQ ID NO: 187979 - protein, 56 aa, Glycine max
  Coding DNA Sequence Number=SeqID_71201
MADSFTAATLVQGDKGYSYNGELHELTLRDTMVTTARAYGTQLNGCTKTDLHNNCH

SEQ ID NO: 187980 - protein, 70 aa, Glycine max
  Coding DNA Sequence Number=SeqID_71202
GQAVNLIAKFPDLNYGVKTRKTYNGDFQTQNDAKASSKIPLQLKDSSRCGVSTENNSSLWWLMVAMGDGE

SEQ ID NO: 187981 - protein, 67 aa, Glycine max
  Coding DNA Sequence Number=SeqID_71203
MKFGYVVRNSIAHNSTVGIFVIIFVEGEKGIAEDSTSGGFNLFSVSLTFGNSIGAVGGITEGISGNR

SEQ ID NO: 187982 - protein, 133 aa, Glycine max
  Coding DNA Sequence Number=SeqID_71204
  Homolog annotation: Hit_ID=UPI0000612705; Match level="QueryCoverage =69%, HitCoverage=93%, E-value=2e-07, Identity=30%"; Hit description =UPI0000612705 related cluster
CENKTTIGTSKPYTGAMRGIVHEPQVNIGADQKFSPVDGGPLGTSTLTLRGLHALAIRGLHVLTFRGLHVLAFRGLHALTFRGLHVLAFKGATRPYLQRTTRPPFQRATRPHLQMTTRPRLKRATRPRLQRIG

SEQ ID NO: 187983 - protein, 100 aa, Glycine max
  Coding DNA Sequence Number=SeqID_71205
MESAVRRRYLRVIHTFRLPGANEPVGAQRLTSPSAPFAIQGQLVRWQAEIPCGHPHLSSTEVNEFDGIKMMFLLSSSEDIQARRHTRFFSDGRGRSSSMA

SEQ ID NO: 187984 - protein, 139 aa, Glycine max
  Coding DNA Sequence Number=SeqID_71206
MVKEKCKEVSVSSKRLAKKESHFAINTNIKETSLLRQPQHLLLCKRTLVSIATPLGLEFIPQVLIWDTLGLSYFLVGVINMKIQKRDQGVPIDPKRIKVIPEWPTPPSIREIWGFHDLTNFYKRGLREEAQSFKEPFRV

SEQ ID NO: 187985 - protein, 42 aa, Glycine max
  Coding DNA Sequence Number=SeqID_71207
MEDVQLFELQEQGETQEEFVVGSSFCSVIAAFVATVNCCFAE

SEQ ID NO: 187986 - protein, 140 aa, Glycine max
  Coding DNA Sequence Number=SeqID_71208
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=5e-15, Identity=32%"; Hit description= UPI00006A17C9 related cluster
  Subcellular localization annotation: CTP_CleavageSite=67; ConfidenceScore=5.04e-01
MSSPLEDYTSSPSKDYTSSPSEGCTPSPLRAACPLLHRTTRPPLQRTTCPHLYRTTHPHLPRTTCPRLQRAPCPPLLRAACSLLHRTTRPRLQRTTRPRLQRAARPRLQSTTRPCLQRTTRPHLQRTSRRRLQRDTRPRL

SEQ ID NO: 187987 - protein, 259 aa, Glycine max
  Coding DNA Sequence Number=SeqID_71209
MILKEELAVCARSKRSLAQHLEATEQSMLAIIGQYKQELNQSVTHEQKLVEDFAQAYAEKEARGRVIDALHQEATMGMDRFALTLNGSKDLPRLLAKAKAITEEFTITKKAQRHPYNTRSRKMDNEEGMQEQMKANLSALKDQMASITEVMLKLQKTIEDNATATASNAFREAEPVLQPAINLGRDRSTTVTSWKFLPGIFVKRNARDWNQRNGMQTEVGFWHFKRSDFSLHVAEHESHQEKKWALLLHSNGDMWHSLK

SEQ ID NO: 187988 - protein, 64 aa, Glycine max
  Coding DNA Sequence Number=SeqID_71210
MMHAPDSTLRCNVSSSRPPDCACNCPPPIGDQPGAKKSSLPSDKPPQYKVHSATVILFPVSYEL

SEQ ID NO: 187989 - protein, 111 aa, Glycine max
  Coding DNA Sequence Number=SeqID_71211
  Homolog annotation: Hit_ID=Q9CA79; Match level="QueryCoverage=44%, HitCoverage=62%, E-value=6e-16, Identity=76%"; Hit description =Putative dolichyl-phosphate mannosyltransferase polypeptide 2; 4974- 4608
  Pfam annotation: Domain name=DPM2; Domain location=36-111; Score =87.8; E_value=3.3e-23; Accession=PF07297.2; Description=Dolichol phosphate-mannose biosynthesis regu
MPKRKVWLGLCWFTEHARHDLAGFTLRVSTNCLHNLFGSDADMLLDLVCKTVKNTTEFNYKPFVDDDHFAHKYFLPQEYAIMIPVSAGVALLCLLCIFIGFVMLKSKKKKA

SEQ ID NO: 187990 - protein, 228 aa, Glycine max
  Coding DNA Sequence Number=SeqID_71212
MDEKAKKKGRKDEVMNINVADDKEVQFLDDNQESKMKKRKKDDSSLNGIQELVFSKPSKKMMKDNRLKSNKGKDDDQGKLMMKKKLSAENQHVDHNEFKSNEDKDDGQYKKEEEEEKKKKKKKKKKKKLSEESKSKEYNEFESNDGGDDGKGKKMKKKKLCDKSKSKENCEFNSKQMMKQKKSDAENRHEGYNEFKSNEDKDDNQYKKEEKKRKKKKLSEESKSKDYN

SEQ ID NO: 187991 - protein, 244 aa, Glycine max
  Coding DNA Sequence Number=SeqID_71213
  Gene Ontology: Mol. function=amino acid-polyamine transporter activity; Cellular component=outer membrane-bounded periplasmic space; Biological process=amino acid transport
  Homolog annotation: Hit_ID=Q6D596; Match level="QueryCoverage=76%, HitCoverage=44%, E-value=2e-93, Identity=90%"; Hit description =Putative substrate-binding periplasmic transport protein
  Subcellular localization annotation: CTP_CleavageSite=65; ConfidenceScore=5.41e-01
AALCHSETFSLHPALQPLHSRFLHSGILFAPASLRHLFPRPRRNGRLRTAFFFRSENMHRRTLLKAFALSASVVAMGMSFGVQAADTIKVGIMHSLSGTMAISETPLKDVALMTIDEINAKGGVLGKKLEPVVVDPASNWPLFAEKARQLLSQDKVAVVFGCWTSVSRKSVLPVFEELNGLLFYPVQYEGEEMSPNVFYTGAAPNQQAIPAVEYLMSEDGGAAKRFFLLGTDYVYPRTTNKILR

SEQ ID NO: 187992 - protein, 113 aa, Glycine max
  Coding DNA Sequence Number=SeqID_71214
MIVNQQVKVPFSIGTYMDEVNCDIVPMEAKGKEKEEKDSSNKIVKKENHFATKGDIKRALLLKQSFYLLLSWETSLSTAIPLELEVIPQVKELLDEGLVHKSLNPCALLVPKI

SEQ ID NO: 187993 - protein, 93 aa, Glycine max
  Coding DNA Sequence Number=SeqID_71215
EKREVVVAQLAQAGELGCYHQKAAPSVGTPWKAQDICFLSVMSRNFTDYTAIPSLTSGMLWNFTDCATMLPFDFRMSRNFTDCLTMGVKYLEA

SEQ ID NO: 187994 - protein, 109 aa, Glycine max
  Coding DNA Sequence Number=SeqID_71216
RNSKEEDFKCFREKIDAKTGRKSLKKNWKNWKARLARKRPIEKSKGALSAKAHAKPEVSVKIKLPSAYIRRRKQKKNGRSLRTHALDLYLRGNPLSLFIFFHPPQAPKV

SEQ ID NO: 187995 - protein, 56 aa, Glycine max
  Coding DNA Sequence Number=SeqID_71217
MHEISVLSATVVFSQAQQLGYMHKEKTTFAENSKAHHSAYFGKRALEAARGAAFAE

SEQ ID NO: 187996 - protein, 87 aa, Glycine max
  Coding DNA Sequence Number=SeqID_71218
MDVHQQALLDDTNEYQLVALESILLNKIKLIEQEGKELDISIHAKYLKNYSILPCGKEVRLGGSEAGFLMHFGYYWLRLAIYIVVTV

SEQ ID NO: 187997 - protein, 66 aa, Glycine max
  Coding DNA Sequence Number=SeqID_71219
  Subcellular localization annotation: CTP_CleavageSite=53; ConfidenceScore=5.03e-01
MSRIAPPSRFAQTTIALSARPRYLCSARFFYHAKHAEVALSVECGLSPNGELSATATFSTSRLRLF

SEQ ID NO: 187998 - protein, 119 aa, Glycine max
  Coding DNA Sequence Number=SeqID_71220
MGERKGVQHQRESFNLTHISCEPVTYEYTTNKKRVKGFFSPLGDGTTTKFWHHNWIPDCGVFWDLAANSSLEAELEKSIFEYVGVNRCWLINSFKDYIPNHITIKIVSMLPPMVEVKRI

SEQ ID NO: 187999 - protein, 42 aa, Glycine max
  Coding DNA Sequence Number=SeqID_71221
MNEDENITQEEELKNTTKGDPPQRERSRKIGIKKKFKNIAQG

SEQ ID NO: 188000 - protein, 485 aa, Glycine max
  Coding DNA Sequence Number=SeqID_71222
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=45%, E-value=0.0, Identity=99%"; Hit description=DNA -directed RNA polymerase beta chain
  Pfam annotation: Domain name=RNA_pol_Rpb2_1; Domain location=98-266; Score=-61.0; E_value=0.0089; Accession=PF04563.6; Description=RNA polymerase beta subunit
  Pfam annotation: Domain name=RNA_pol_Rpb2_2; Domain location=22-209; Score=261.6; E_value=1.6e-75; Accession=PF04561.5; Description=RNA polymerase Rpb2, domain 2
  Pfam annotation: Domain name=RNA_pol_Rpb2_3; Domain location=270-339; Score=135.4; E_value=1.5e-37; Accession=PF04565.7; Description=RNA polymerase Rpb2, domain 3
  Pfam module annotation: Pfam domain module=RNA_pol_Rpb2_1::RNA_pol _Rpb2_2::RNA_pol_Rpb2_3; Domain location=98-266::22-209::270-339
MNSLGTSIVNGIYRIVINQILQSPGIYYRSELDPSGISVYTGTIISDWGGRLELEIDRKARIWARVSRKQKISILVLSSAMGSNLSEILENVCYPEIFVSFLNDKDKKKIGSKENAILEFYRQFACVGGDPVFSESLCKELQKKFFQQRCELGRIGRRNMNQKLNLDIPQNNTFLLPRDILTAADHLIGMKFGMGILDDINHLKNKRIRSVADLLQDQFGLALVRLENMVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIADTRETSFIPY

SEQ ID NO: 188001 - protein, 179 aa, Glycine max
  Coding DNA Sequence Number=SeqID_71223
MTTLTQIWMTLLLSNILPSDHNSDLPLPKCQLVYAILTQMSVHVAQLIFGAIYQFAGIASTRHPVDPEKSNKDLGFPALITGLYQFYRVPVAPSKGQAQAQGQAPQQPGDGHQQAVDDTPPLPPESTSTHLRRLERCIRHVADQQAANHRGQVRLNESFYQYTIRQQGQDSSPYTWPTP

SEQ ID NO: 188002 - protein, 139 aa, Glycine max
  Coding DNA Sequence Number=SeqID_71224
MSVHMPQVIADAIYLFAGIAPTRHPLDPEKSNRALGFPALITGLCQSYGVPITPNKAQGNAHQDAGAPPPPRQADSVGPLRVEWYIYHLVRQQAAKHHGQVQIHECLYRFSLSQQGQGSAPFVCRTPKQFGAEVTWPGD

SEQ ID NO: 188003 - protein, 295 aa, Glycine max
  Coding DNA Sequence Number=SeqID_71225
  Gene Ontology: Mol. function=DNA binding; Cellular component =chromatin; Biological process=DNA integration
MQKQIDYLGHIVSGNGIQPIPEKVQAIQRWLQPHKTRALRGFLGLLGFYRRFIRGYAAMAAPLSQLLTKADFVWSLEAEHAFQTLKDAVTKSLVLALTDFAKPFTVETDASGLATTSFLILSMPHFTFLEDLRKELQTHNEFVTLREKICTNSTSYPDHSLTPHFILHQGRIWLPSDCSFIKTLLTEFHQSPTWGHMGFRKTLNHVAENFTWSTMARLTVSIIGVIAVVGGPFNGLHSWAASLLRQHMHLRGCGSLLQGGSSRHASPSPHITRCGSAVHGDSGQTSRHAHKHYIR

SEQ ID NO: 188004 - protein, 319 aa, Glycine max
  Coding DNA Sequence Number=SeqID_71226
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=49%, HitCoverage=46%, E-value=2e-29, Identity=40%"; Hit description =Integrase, catalytic region
MGRPKLQTKSLSSAYERSSTDGQVDAVDDLLSQPESIFSLLRQKLQKTQNGMKAITDRHRRDHEFQVGEWVLVKLWPYRQSTISGTAQSKLSKHFYRPFQISVRMGTIAYKLALPEHSRIHPVFHCSILKPFIGPLDAVQVEDLPLVAVDNQPGLHPNETSWEEWTSLQNLHHLEEKVLFEARGNVTSSNNELQVAKPNANNSKELPTIRPKRQSHTPNHLKDFVDSAKWMLRLWQRISWIASIVRGHTRGAGFLDGACKGAVTGAIAALELLNIVACDEPLSKFHGVILLRLFFFATMSTKQAKPLKKPKSDKKDYDE

SEQ ID NO: 188005 - protein, 325 aa, Glycine max
  Coding DNA Sequence Number=SeqID_71227
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-31, Identity=30%"; Hit description= UPI00006A17C9 related cluster
GQHILAFRGLYILAFRGLHVLAFRGLHVLAFRGLHVLAFRGLHVLAFRGLHALAFRRLDILTFRGQDVLAFRGPHALAFRGQHGIAFRGLHALATCPRLQRATRPRHKRATRPHLQRRAACPHLHRAARPRLQRTTRPRLQRATRPRLQRAARPRLHKAASLAFIGLHTVTFKGLHALTFKGLDVLAFRGLHALAFRGLHVLAFKGLHALTFRGLHVLTFRGLHVLAFRGLPVLAFRGLHALTFRGLHVLTFRGLHVLAFRGLHVFTFRGLYVLAFKGLHIYAFKVLKVSGFDEETIAQLLCIPGQDFTQSLQGDECGSCAPTYG

SEQ ID NO: 188006 - protein, 92 aa, Glycine max
  Coding DNA Sequence Number=SeqID_71228
MSILLGVQRRCTAVFECDVVVDLRPIYDGSPSKTLSASGTTLKPSMSKGALYYVVASTMTAVECLANYVVAAVSNDVESYPLLCRFAGKDRR

SEQ ID NO: 188007 - protein, 404 aa, Glycine max
  Coding DNA Sequence Number=SeqID_71229
  Homolog annotation: Hit_ID=Q9FFU7; Match level="QueryCoverage=95%, HitCoverage=80%, E-value=6e-36, Identity=31%"; Hit description =Similarity to heat shock transcription factor HSF30
  Pfam annotation: Domain name=F-box; Domain location=6-53; Score=26.8; E_value=7.7e-05; Accession=PF00646.23; Description=F-box domain
MENNTDKLSSLPELLCLFIISLLPFKDAVRTSILSKHWLHIWKYSPKIEFSENFDGNCIDRFEPFSSIKARRSAFMKFIKLWLDFRKVGEVEKFSLKFSKPNNDHREIIEECVTFVTQHGVKELELDFSDPFWEEEVIPNKRKALFELPKLAYGNKPNIESLKLSSCSFRENYLSNWQALKEVTFGWMEVTLDAMTIVLSNCKMIESLVLHKCWNLSHFEIGSEALSLKRLVVDKCSFRNALFKVSAPNLCFFKYFGKLCFFEMKNTLAIEEAHLHFYLGYDNVGTGARVMYDLVKDLYNARVLTVSPYLIQVILTGEKRRMEHDMNARHLILRMNMLRCELRAVSFFLLSCPMLECLTFELGSEIILPDYQAMWIDSDEEQDDLPLWIDSDEDQDDQAKWMDN

SEQ ID NO: 188008 - protein, 123 aa, Glycine max
  Coding DNA Sequence Number=SeqID_71230
  Pfam annotation: Domain name=FBD; Domain location=38-86; Score=10.0; E_value=0.021; Accession=PF08387.1; Description=FBD
DFEDYDDDDEDNIDDEDNIYDDYCRDFINMVDNQIKGMKNLINYNCLESSLKLVEVKDFVGSKNGLVFLCYLIRYGKVLKNVSINVLKTELEGNSNVAFYRTIEEYLMTTPRASSNLQISICY

SEQ ID NO: 188009 - protein, 117 aa, Glycine max
  Coding DNA Sequence Number=SeqID_71231
MDVAEWVYHLLVLLASSVGVKPLSLTHVVAFAKLQEDKLRDHHLNYRPYFPLPSSPPSTSSNLKFQSKKLSTEEIAIRRDKVLCYFYDEKWVSNHRCQPQIHLILEDEPQETPLPPA

SEQ ID NO: 188010 - protein, 91 aa, Glycine max
  Coding DNA Sequence Number=SeqID_71232
  Gene Ontology: Mol. function=chromatin binding; Cellular component =chromatin; Biological process=chromatin assembly or disassembly
  Homolog annotation: Hit_ID=Q1SAV4; Match level="QueryCoverage=95%, HitCoverage=22%, E-value=9e-31, Identity=72%"; Hit description =Integrase, catalytic region
MVVGLQSLPIPAGVREDLSLDFITGLSPSHGYTCILVVVDRYSKGAHYGALPQHHSTFKVVTLFLDIVCKHHDFPCSLVSDRDPIFISSFW

SEQ ID NO: 188011 - protein, 77 aa, Glycine max
  Coding DNA Sequence Number=SeqID_71233
MGFFQEPPFSPSLGSMVRPCPIRHFLGRLGHFAFYLSPRGRGGHIELHLLVREVAATAHHAAEVLAGTEGLGHALHR

SEQ ID NO: 188012 - protein, 82 aa, Glycine max
  Coding DNA Sequence Number=SeqID_71234
MQVLLLRRVATVKDSNIVDTLPFNILSSHSVLHPRQQRFPYYHRSRVTPFYEEERLTCISVNVRAMTVHQNGSKLDDKTTHK

SEQ ID NO: 188013 - protein, 158 aa, Glycine max
  Coding DNA Sequence Number=SeqID_71235
MGTRGCINYKPVLAIRQLGYPMRGAPSEESIMPFIARDFSDPNARMFQRVQKAWSAVQRKDKDLRGSNNVIIGGYHKWLKARTQELDWLPKLKFSSEEEVETPEESEEVQALKVELERMQVIKEKLKTTTIKVRKECDKLRDVNVATAEALEQETKRA

SEQ ID NO: 188014 - protein, 111 aa, Glycine max
  Coding DNA Sequence Number=SeqID_71236
MAKIHHQAWPTKTYHPMKHTPHTYSQNNSKAPKFLKGRKGNIGSKGLSKELIQGRLIWLEAYKNKMPKSSPNMHVKQEVSTRVKPRLLCKQSMGQNTPNKINDDDSNSHQG

SEQ ID NO: 188015 - protein, 130 aa, Glycine max
  Coding DNA Sequence Number=SeqID_71237
CARQALFDHDHVACEVCSVNVKGCQKVQEDVQGLIDSKKLIITRKDKEVCVITPEFQQLEISYNSGRLATTPLVISLPRPVPYASLKAVPYKYNVTMLESGQEVPLPSLTPATYVDNIVSNSKVLRNGRV

SEQ ID NO: 188016 - protein, 68 aa, Glycine max
  Coding DNA Sequence Number=SeqID_71238
  Gene Ontology: Mol. function=5-methyltetrahydropteroyltriglutamate -homocysteine S-methyltransferase activity; Biological process =methionine biosynthetic process
  Homolog annotation: Hit_ID=O50008; Match level="QueryCoverage=79%, HitCoverage=7%, E-value=9e-22, Identity=92%"; Hit description=5 -methyltetrahydropteroyltriglutamate--homocysteine methyltransferase
MTDKLVVSTSCSLLHTAVDLVNETKLDNEIKSWLAFAAQKIVEVNALAKALSGQKDEVNSVPFILSYI

SEQ ID NO: 188017 - protein, 177 aa, Glycine max
  Coding DNA Sequence Number=SeqID_71239
MGVGSFRDYIFKFVSSVKLSPFSNLMQSYLARALDRRLQEDWARDAREDPRVLMSLRTHLLLEVASRFIFLLLHSTTIRPQEAKESIDEEDPRPTSSTWSYIRTVSSLTCVDNVDFALEMASPGCGIVIPLVRVDWHSLVPDLAFFGCLTQDMCPRRRTIQEHMAPNNYAEAASMFN

SEQ ID NO: 188018 - protein, 123 aa, Glycine max
  Coding DNA Sequence Number=SeqID_71240
MAFTPLSVVKVGLLYAQRDPPFLRPISKGIQRCLVRWLAQQWMQLNFHNWIHFVWHRMIRGRYYRHLMTPSALWTTLILKRKGRIQRDKRNKKNDTDLEPPSTQKERVYLLGNDKPGGLVEVV

SEQ ID NO: 188019 - protein, 438 aa, Glycine max
  Coding DNA Sequence Number=SeqID_71241
  Gene Ontology: Mol. function=nucleic acid binding; Cellular component= intracellular; Biological process=DNA integration
  Pfam annotation: Domain name=zf-CCHC; Domain location=71-88; Score =7.8; E_value=0.051; Accession=PF00098.13; Description=Zinc knuckle
  Pfam module annotation: Pfam domain module=RVT_2::zf-CCHC; Domain location=342-437::71-88
MLVYQVEVDGYHGKVALESILSQKGNVDLSMREGTPLKEHLDEQNFVLMELRDINKKKNKADKKNKADPKDIYNYCKESGHWKQDYPKKAKKDFVAALVQNDSSTESDLVMTVSEQLQQYSKQWVLDSVLIGDNASCKFVGIDSIQIVMHDGVVRTLTEVRHIPELKKILVYGVPWIQKVFLVGLKHYVYGKQHQTKFPKHYVYGKQHQTKFPKVVHTIKAILDNVSFDCWGPLRVPSLGGARYFLSIIDDYSRMTLAKTVSTTCDLMNRLLSIAIDFKTPIKVWSNKPSKYSMLKAMEMELKDFESGLHLKGHYSRDVVFDELSMMHSKSDEDLAVELAMVMNEEMESLQKNQTCDLVKPYEGRQVVGCKWIFKKKSGSFTEEEGLDYNEIFSLVVRHIYIRVLLALVATLDMELEQLDAKTAFLHGRLDEDMMQQP

SEQ ID NO: 188020 - protein, 162 aa, Glycine max
  Coding DNA Sequence Number=SeqID_71242
  Gene Ontology: Mol. function=nucleic acid binding; Cellular component= nucleus; Biological process=DNA integration
MGTSKVPMTRVYHSKVEDGSHIYLLLYVDNMLIASQNLWAIQKLKTYAKSICTPLTTSIRLSELNTTQSKSEKEYMSHVPYAGIVGSLMYATICIIPYLTQVVNLGTIDIGLVYHGHMFYALIGYFDFDYAADMNMQGNTSADNDFIHYTGRVHAAICLAKD

SEQ ID NO: 188021 - protein, 60 aa, Glycine max
  Coding DNA Sequence Number=SeqID_71243
MLGYRVYKVGLAGKDPAKPKVSRMDLRLAKNKLSEYGRSAQQMPQGISLGAGDPGLTQWA

SEQ ID NO: 188022 - protein, 44 aa, Glycine max
  Coding DNA Sequence Number=SeqID_71244
MGHATLSPSSCIYVQHGLTKCSVKCPNDVHHRRFKIGAQMQFQA

SEQ ID NO: 188023 - protein, 79 aa, Glycine max
  Coding DNA Sequence Number=SeqID_71245
MKNWMQNSKCDVYLGAYLNWPNNYLKGIINSVLKGLDDTPQPKSKVGARWIVVKLTFNTIFHYVFSVIDKKEALSVAIT

SEQ ID NO: 188024 - protein, 76 aa, Glycine max
  Coding DNA Sequence Number=SeqID_71246
MSCADETQSLCESKAAMETETQHGEGEQSLPRQCRHRSMKETEEEEEDTTTRSGYSCKTNSQTEILLLQLHLETAI

SEQ ID NO: 188025 - protein, 83 aa, Glycine max
  Coding DNA Sequence Number=SeqID_71247
  Homolog annotation: Hit_ID=Q1T1Y0; Match level="QueryCoverage=98%, HitCoverage=20%, E-value=3e-09, Identity=42%"; Hit description =Ankyrin
  Pfam annotation: Domain name=DUF1723; Domain location=17-66; Score =40.1; E_value=7.4e-09; Accession=PF08330.1; Description=Protein of unknown function (DUF1723)
MVARTRLSHLIACSVDTSDRGLISLFVERWHREISSFHLPVGEVLITLDDIASLLHLLIIGDLHVFQPLHIDVAVLMLVELLM

SEQ ID NO: 188026 - protein, 282 aa, Glycine max
  Coding DNA Sequence Number=SeqID_71248
  Subcellular localization annotation: CTP_CleavageSite=62; ConfidenceScore=5.03e-01
MAMTRMFNIIHPTGIQMWFIPRPLVTNMSYMLADVSNSFASTLGGQAVANDYTNQNLLHRGRANQVMNGGVTNGEILFVNNDVGLRPNVIDGKSTIEHIGRFTIQSSENWANMEMCFHDRFYRPLPEVTIVDLMNMRQMVDDSTIDIIERFKKEKLVAQEYGDLKSFEEEVEIMAADILCGKLYSCPDLKLGKGKSTGGDGKFEYNFDIFKMDKVLDHMIKDQQIWLKDGHKIPSPNELKGKKYSDRNVAKMVVDTNCFTKLDIDMVSYEQAASKWRKMKRV

SEQ ID NO: 188027 - protein, 49 aa, Glycine max
  Coding DNA Sequence Number=SeqID_71249
MSLENFTKAFVACTWGEGPFPKALGPFPTFGGDYFTKWVQVKPLATITT

SEQ ID NO: 188028 - protein, 168 aa, Glycine max
  Coding DNA Sequence Number=SeqID_71250
MKAFSVLLKVKDKIKFICKKEQQQAFDQIKHMNVKYKCNTVTLWDFYQSTKKLLQYFANVIIEHVYRDENDEVNELAQHASGYKKIKGETMDHFVEDLAIRTTRECYMASLKLSPLTKDEPCQVVHYVEIIVGVEGSEELELDLRTNDDNRVKPIEETCNFQLDIKEE

SEQ ID NO: 188029 - protein, 229 aa, Glycine max
  Coding DNA Sequence Number=SeqID_71251
KARLDMDQFKSFGYEDLAITAKSLLDYGCLESILIPPSDRFEGFNPSINEAINLIQAEMMDYIAIKITTCPSNFTAQNYPCHVMKLLPEDHRDYPCLFNDEYESWDVQGNTQYQYSLMRAQIQGYQWFFSEEDKREFDLIKETHDTKLFLPLYNGKFFIPFLVDLNNKLVQFFQKEKKDKEIYEASGCHGQQTPPFPSTDLSMEDSSDIFCFGNIQDEEDVTITKASKS

SEQ ID NO: 188030 - protein, 43 aa, Glycine max
  Coding DNA Sequence Number=SeqID_71252
  Homolog annotation: Hit_ID=UPI000034F188; Match level="QueryCoverage =65%, HitCoverage=4%, E-value=4e-07, Identity=82%"; Hit description =ATP binding
YWQQRLIGAHVSCADDGGGMNPNAIRKCMSLGYSSKKSKTTIG

SEQ ID NO: 188031 - protein, 75 aa, Glycine max
  Coding DNA Sequence Number=SeqID_71253
MLKKDSFSWSEECSQPTSVPDRTSSIKRPKWRRAKAQVEKDKAPEWRRMKAQVEKDEGPEAETLSRLLIVVEGPN

SEQ ID NO: 188032 - protein, 71 aa, Glycine max
  Coding DNA Sequence Number=SeqID_71254
MHACLYKTNEVKGPYICSTLHNRLISMVVGQAQPKYFLGGNQPYWVELMNPQVFQMISRKDGMESILYPKK

SEQ ID NO: 188033 - protein, 179 aa, Glycine max
  Coding DNA Sequence Number=SeqID_71255
  Pfam annotation: Domain name=bZIP_1; Domain location=47-107; Score =21.9; E_value=0.00061; Accession=PF00170.11; Description=bZIP transcription factor
  Pfam annotation: Domain name=bZIP_2; Domain location=48-101; Score =23.6; E_value=0.00069; Accession=PF07716.5; Description=Basic region leucine zipper
  Pfam module annotation: Pfam domain module=bZIP_1::bZIP_2; Domain location=47-107::48-101
MENPKENNKVENHHTVNAILSPTFVFSATKLADQFGYAEGNPTPEQQILDPKLRRIFSNRFAAQRSREKKKNHLADLEIQKKTFENEIAQKQQLQDLYENKRQTQIVEEEIMYQEIDILKNYSMFKDGEIEKDKGEVIRERELQVIEQQEELQAQLVNLNIGPQECPIIQPQFIMQTHI

SEQ ID NO: 188034 - protein, 106 aa, Glycine max
  Coding DNA Sequence Number=SeqID_71256
  Homolog annotation: Hit_ID=Q69FB5; Match level="QueryCoverage=42%, HitCoverage=6%, E-value=9e-12, Identity=80%"; Hit description =Stigma/style ABC transporter
MVVKVLQRIAQSGSIIIMSIRQLSYRILGLLNRKIFLSHGQTVCSGLKTCFFSHGTFSWIENVVSRGKTCLNIEVDKTLDIAFIIRDGNLTKIVKDKELEVSVKSL

SEQ ID NO: 188035 - protein, 48 aa, Glycine max
  Coding DNA Sequence Number=SeqID_71257
MRQLDDDVDLLCTASQDGDDDFILWGCIGDDGGLHLVANGPSNSPTKT

SEQ ID NO: 188036 - protein, 75 aa, Glycine max
  Coding DNA Sequence Number=SeqID_71258
MEDFMAQVAWLGVQPSPLGGGEASAAQKPQPEPQPKVACEAMPEMTPQVSPVTSPVVEVSKDEEGAEDIDYVADL

SEQ ID NO: 188037 - protein, 93 aa, Glycine max
  Coding DNA Sequence Number=SeqID_71259
MDGHIDVALVKEFYSNLYDPEDKSPKQVRVRGKLIKFDAASLNAFLEMPPVIQLGEQYPSYSFFSPSTSLPPPSVPAPVGTAAQSSDVTVPML

SEQ ID NO: 188038 - protein, 118 aa, Glycine max
  Coding DNA Sequence Number=SeqID_71260
  Homolog annotation: Hit_ID=Q1SWX1; Match level="QueryCoverage=73%, HitCoverage=17%, E-value=6e-10, Identity=35%"; Hit description=IMP dehydrogenase/GMP reductase
MGSSQAPWLKKRFYQVKIKSLGVASLKELGQLMGQLQRQAFCKAYGKIWDLTMVEVSTEAIASLAQYYDQSLRCFTFGDFQLTPTMEEFEEILGCPLGGRKPYLFLGFYPSLARISKL

SEQ ID NO: 188039 - protein, 647 aa, Glycine max
  Coding DNA Sequence Number=SeqID_71261
  Gene Ontology: Mol. function=transporter activity; Cellular component= outer membrane; Biological process=transport
  Homolog annotation: Hit_ID=Q5FRA3; Match level="QueryCoverage=41%, HitCoverage=27%, E-value=2e-46, Identity=38%"; Hit description=TonB -dependent outer membrane receptor
  Pfam annotation: Domain name=FecR; Domain location=22-115; Score =115.2; E_value=1.9e-31; Accession=PF04773.4; Description=FecR protein
  Pfam annotation: Domain name=Plug; Domain location=367-476; Score =45.5; E_value=1.8e-10; Accession=PF07715.5; Description=TonB -dependent Receptor Plug Domain
  Pfam annotation: Domain name=STN; Domain location=279-329; Score =16.1; E_value=0.1; Accession=PF07660.4; Description=Secretin and TonB N terminus short do
  Pfam module annotation: Pfam domain module=FecR::Plug::STN; Domain location=22-115::367-476::279-329
MAAAACTALLGVGLVPQLMPTAQLYSAGQGELRDLVLPDQTQVRLNADSRLRVRMGWLSRKVELLQGEATFDIARDRRPFEVEVNGLEIRDIGTVFDVARRLKSTRIGVVSGEVEIWSQGADARRLAQLGEGRVVQVDARSHAVESLDVPLSMLLDWQQRKVSFLDERLDEVAAAFNRHNQVQVRVLDEGAASARLSGSLDAHRIATAEPRSGRLLPSLFQGPVMRNTLYLSIILALSPCSVPLAVAATADGLEARVSAPIAAQPLARALEQLSRSSGVQFLYSAGGDARMAGAVPRGATVKQALDALLAGTGLGYTVVDGNVIAIDPAPVSNAPKPAAPKPREAEAVVAPTLDTVKVIAAHEVIDQKKSSPVIKDSVVYDEMDSYGDETLAESLMAAPGLSAVEDAGEPRYVTVRGVQANLNYTTIDGIAIASVGGSGSGERMNNLQLIPSDIGTRTDIYKSFSAEQAPDAIGGVIDIISRSAFDRSGKYVFADVAGIYSTAETNVERSAGGNHETLGHFGKSAKVVFSNQFGADQEFGIVAVARYEQRSRNSVKRWVESNYYYNDAGKYLTDGTTGPDEAKGWNGLRAPGNFSTGTYTNFITNFGGSAKLEWKPSDDPFYASLLLYSYRFYENSTMNKTDLYGNA

SEQ ID NO: 188040 - protein, 690 aa, Glycine max
  Coding DNA Sequence Number=SeqID_71262
  Gene Ontology: Mol. function=binding; Cellular component =intracellular; Biological process=metabolic process
  Homolog annotation: Hit_ID=Q1SL83; Match level="QueryCoverage=99%, HitCoverage=86%, E-value=1e-119, Identity=34%"; Hit description =Tetratricopeptide-like helical
  Pfam annotation: Domain name=PPR; Domain location=168-202; Score =20.6; E_value=0.0055; Accession=PF01535.11; Description=PPR repeat
  Pfam annotation: Domain name=PPR; Domain location=270-304; Score =31.7; E_value=2.6e-06; Accession=PF01535.11; Description=PPR repeat
  Pfam annotation: Domain name=PPR; Domain location=305-339; Score=6.7; E_value=1.2; Accession=PF01535.11; Description=PPR repeat
  Pfam annotation: Domain name=PPR; Domain location=371-405; Score =26.7; E_value=8.5e-05; Accession=PF01535.11; Description=PPR repeat
  Pfam annotation: Domain name=PPR; Domain location=472-506; Score =28.1; E_value=3e-05; Accession=PF01535.11; Description=PPR repeat
  Pfam annotation: Domain name=PPR; Domain location=508-542; Score =19.2; E_value=0.015; Accession=PF01535.11; Description=PPR repeat
  Pfam annotation: Domain name=PPR; Domain location=544-577; Score =15.4; E_value=0.11; Accession=PF01535.11; Description=PPR repeat
  Pfam annotation: Domain name=PPR; Domain location=610-644; Score=1.8; E_value=4.6; Accession=PF01535.11; Description=PPR repeat
  Pfam annotation: Domain name=PPR; Domain location=64-98; Score=16.3; E_value=0.088; Accession=PF01535.11; Description=PPR repeat
  Pfam module annotation: Pfam domain module=PPR::PPR::PPR::PPR::PPR::PP R::PPR::PPR::PPR; Domain location=168-202::270-304::305-339::371 -405::472-506::508-542::544-577::610-644::64-98
DLLVKLLETCCSKISIPQLHSQCLKVGLAHDSFVVTKLNVLYARYASLCHAHKLFEETPCKTVYLWNALLRSYFLEGKWVETLSLFHQMNADAITEERPDNYTVSIALKSCSGLQKLELGKMIHGFLKKKKIDNDMFVGSALIELYSKCGQMNDAVKVFTEYPKQDVVLWTSIITGYEQNGSPELALAFFSRMVVLEQVSPDPVTLVSAASACAQLSDFNLGRSVHGFVKRRGFDTKLCLANSILNLYGKTGSIRSAANLFREMPYKDIISWSSMVACYADNGAETNALNLFNEMIDKRIELNRVTVISALRACASSSNLEEGKHIHKLAVNYGFELDITVSTALMDMYMKCFSPKNAIDLFNRMPKKDVVSWAVLFSGYAEIGMAHKSLGVFCNMLSYGTRPDAIALVKILAASSELGIVQQALCLHAFVSKSGFDNNEFIGASLIELYAKCSSIDNANKVFKGMRRKDVVTWSSIIAAYGFHGQGEEALKLFYQMSNHSDVKPNDVTFVSILSACSHAGLIEEGIKMFHVMVNEYQLMPNTEHYGIMVDLLGRMGELDKALDMINEMPMQAGPHVWGALLGACRIHQNIKIGELAALNLFLLDPNHAGYYTLLSNIYCVDKNWHDAAKLRTLIKENRFKKIVGQSMVEIKNEVHSFIASDRFHGESDQIYGMLRKLDARMKEEGYDPP

SEQ ID NO: 188041 - protein, 129 aa, Glycine max
  Coding DNA Sequence Number=SeqID_71263
  Homolog annotation: Hit_ID=Q0KIN0; Match level="QueryCoverage=92%, HitCoverage=7%, E-value=8e-21, Identity=38%"; Hit description =Integrase core domain containing protein
MASSGPVLSFSGTPTITTAKLNWKNYLSWSASVELWFLGQGHHDHLENDAEAVPDDRRPEWENLDYHLCVVLWQSVEVDVLEILRSFKTCCSFWKKAREIFTNDIQSLFDATMKVTALKQTSHDMIAHI

SEQ ID NO: 188042 - protein, 55 aa, Glycine max
  Coding DNA Sequence Number=SeqID_71264
LQGILKKSKVELIIPIRHSEWSIRHSESSSLGHGAPAKFATVNVYIIKAKKRSKT

SEQ ID NO: 188043 - protein, 61 aa, Glycine max
  Coding DNA Sequence Number=SeqID_71265
MARSDECGHLLPLSKTQCLSAEATKVSPIIPKQASPIACGDRQARTKLVSYLYFPFISNKG

SEQ ID NO: 188044 - protein, 91 aa, Glycine max
  Coding DNA Sequence Number=SeqID_71266
  Homolog annotation: Hit_ID=Q1S3H4; Match level="QueryCoverage=45%, HitCoverage=7%, E-value=2e-11, Identity=76%"; Hit description =Integrase, catalytic region
TSFLDFLTFPRINVGGDSAHFPSFEDTPMSLASPSRQRVGCDIYYASKVLNDAQVNYATTEKEMLAIVYTLEKFISYLVGSKVLDKWPQIS

SEQ ID NO: 188045 - protein, 101 aa, Glycine max
  Coding DNA Sequence Number=SeqID_71267
MENPKENNKVENHHTVNAVLSLAFVFSATKLVNEFEDAEVEIDKNKGEVIRERELQVIEQQEELQARLVNLNIGPQEPVSNYPTSNYYANSYPVVPSCVVN

SEQ ID NO: 188046 - protein, 380 aa, Glycine max
  Coding DNA Sequence Number=SeqID_71268
  Gene Ontology: Mol. function=nucleoside-triphosphatase activity
  Homolog annotation: Hit_ID=Q1SKI7; Match level="QueryCoverage=27%, HitCoverage=26%, E-value=4e-48, Identity=94%"; Hit description=AAA ATPase; 26S proteasome subunit P45; Nucleic acid-binding, OB- fold
  Pfam annotation: Domain name=AAA; Domain location=1-176; Score=105.1; E_value=2e-28; Accession=PF00004.19; Description=ATPase family associated with various cellular activities (AAA)
  Pfam annotation: Domain name=AAA_2; Domain location=2-99; Score= -46.9; E_value=0.034; Accession=PF07724.4; Description=ATPase family associated with various
  Pfam annotation: Domain name=AAA_5; Domain location=1-116; Score= -6.5; E_value=0.0056; Accession=PF07728.4; Description=ATPase family associated with various
  Pfam module annotation: Pfam domain module=AAA::AAA_2::AAA_5; Domain location=1-176::2-99::1-116
GVLLYGPPGTGKTLLARAIASNIDANFLKVVSSAIIDKYIGESTRLIREMFGYARDHQSCIIFMDEIDAIVGCRFSEGTSADREIQRMLMELLNQLDGFDQLGKLCRREIHSIDYPLASIYTLWSLGLRVGWSWEKGVERWREDAKAIVMICGGEEQQLFFNDYNNVYKATIFPHNVGLGITRQCFETILIIWVHTCSLYLPDGNVYYSIFFGEQCSKYSHASRSIAIFMRLEAPKDLNSSFVSPVILQPFTSVPMNENATHAPDNITIPRFMNSDYSEAHSVTSEMSHLAYTDPLLGEMSIIENMNEDAFIDPLPIEMERIEKEKEEAFKIHEQKILQLQSDYEKEVEKNKVLAQVWTHNLDSCEGNGVQCTEQGTDHA

SEQ ID NO: 188047 - protein, 131 aa, Glycine max
  Coding DNA Sequence Number=SeqID_71269
  Gene Ontology: Mol. function=methyltransferase activity
MSGSGRFLMWLAKRTPKERNFLGLEIRERIVKRAESWAKDLALDNMYYPKSTYIDGGTFLVCKRDNFFQAVGRIISRALGLSFSIGCHLHFYSTKLVGPIEQPKAVQQEGECFQGQLRPLWSTARQEGLVD

SEQ ID NO: 188048 - protein, 338 aa, Glycine max
  Coding DNA Sequence Number=SeqID_71270
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-24, Identity=31%"; Hit description= UPI00006A17C9 related cluster
DYTSSPSEDYTSSPSEGCTPSPVLSFRGLHVLTLRGLHVLAFRGLHALAFRGLHVLTFKELHVLTFRGLHVLALRGLHVLVFRGLHALAFRGLHVLAFKGLHVLAFRGATRPRLQRTTCARLQRATRPLLQRATRPRLQRATRPRLLRTTRSHLQRTTNPHLERTAHPRLQIATCPRLQRGLHVLPFRGLHILAFRGLHALARPHLQRATCPHFQRTTCPHLEKVACPRLQRTKFLTFIGLHALAFRGLQVLAFRGLHVLAFKGLHILTFRGLHVLTFRGLHALTFRGLYVLAFRGLHAVTLRGLHVLTFRGLHALTFRGLYVLAFRGLHAVTFRGLH

SEQ ID NO: 188049 - protein, 60 aa, Glycine max
  Coding DNA Sequence Number=SeqID_71271
MKRCMMQSRNMPEWGLSATMHHKKRKTLDEASLSSSKSETQHDHKSTSTPYGSHRPGYRA

SEQ ID NO: 188050 - protein, 62 aa, Glycine max
  Coding DNA Sequence Number=SeqID_71272
MALLPWEIPLFLLLRARMEILILGQGLWWFEVLAQKACRTAGHDICQGVGLASACNMDTVDA

SEQ ID NO: 188051 - protein, 70 aa, Glycine max
  Coding DNA Sequence Number=SeqID_71273
MTHQDFQVQAIGQFAQATCAPEFGLPRPFNQRLLVLHIGGVAVKQRVKKFVFLEKRVVKNRMLDKWPQLS

SEQ ID NO: 188052 - protein, 271 aa, Glycine max
  Coding DNA Sequence Number=SeqID_71274
MASRKRKSICSRPTVQYETRRFSSLDAWTRCTYIVLGRNILPERKVEIYHFELDEFKAELERRNFNKRLTNLVDGSIDLALDHPPKQSRVRGHLVKIDADSLNTFLETPVVLAKGETLLAYSRYCRLPTDYREIEAALCIPNQGFILNSQGHPGKILKKDLTTLVQPDDLYSQSNTSRHRFPTLITILCRARGVVSDSLTFECLSLVINLAYIRKNCWNPEDLTVSIRGARRARARPAELPSTSAAPTPASTSAAPSVPAQTDSQCFEAML

SEQ ID NO: 188053 - protein, 290 aa, Glycine max
  Coding DNA Sequence Number=SeqID_71275
MAHAANRHAVSEDVFRQRQPQIAGIADMVQIRAGHFAHQRNLPHGLHVGTLLRGADRRHCQRALPLGISNQRRHFLLRHAGNGAGRRQQHDVRAVLHEQRDVLLADQLAAAFAHDTGPVHLAGHQHHLVAHLITDRFQRGGDRLIADAVVRVAGQHQHARAELIQLARILGSGGTPRRHLPEIVMFGGEGRIDGLQVHPDHPPGQALQRAQRLLRRHVGGQARDVRMVDVEQVQQQQVGALAGRQLGVGDVIEQRLSDRDGFADQDAPFAGADGVEQIGFADIGQIAGAA

SEQ ID NO: 188054 - protein, 166 aa, Glycine max
  Coding DNA Sequence Number=SeqID_71276
MTHSLNVGEPIHATPISFCIPTNYDIDRDDGVENPKNENETPPTTTQNSKSKRGRPFKSPPESIKNWYVIRKERKIGKRFDTTYIHKETRFRCRSLKEVKNYEKYGSLPRRHKVKTQDKEESDNKTKNETEEMIVAQRKAKAEVMRTFVEEFLSEAHHNQLHMFNP

SEQ ID NO: 188055 - protein, 104 aa, Glycine max
  Coding DNA Sequence Number=SeqID_71277
MDSKIVGQDSKVNAISSKMWKDIILKRQTNELCEKDKKITMSHACAIVEAKPSKFILMIPKTQVKNQESNKFQESKSHSIKNQDSSENSREDSRYARTSRKASR

SEQ ID NO: 188056 - protein, 109 aa, Glycine max
  Coding DNA Sequence Number=SeqID_71278
MHPCAIKAPLLPRFIYVYFQGVFTTYITCTSLAKLTYMHTQSILATKNCTRAHSENMCKRKMPHGLFPYENHALMPLRHFTEHLVGARLGINSKRTGTMWHVPLLQNAL

SEQ ID NO: 188057 - protein, 79 aa, Glycine max
  Coding DNA Sequence Number=SeqID_71279
MTKDMNRYLKALHWAMRGTVHEPQANLGADQKFSCGSLSAPLHLSKCTALVHPLSKKGALSQKSLTCTKRSIRVLSARA

SEQ ID NO: 188058 - protein, 166 aa, Glycine max
  Coding DNA Sequence Number=SeqID_71280
  Gene Ontology: Mol. function=methyltransferase activity; Cellular component=cytoplasm; Biological process=metabolic process
  Homolog annotation: Hit_ID=Q5GTU4; Match level="QueryCoverage=100%, HitCoverage=36%, E-value=2e-81, Identity=87%"; Hit description =Oxidoreductase
MVRTRTSNLQDLDRATGEIGRAAQHVEELVLGYQAGAREGGEQAARLDHAQRQLVHVQVLLQRGDDLVAVAGHLRRVQDHHVVLLAAVGGIVQPGEDVGLDELRAHVVQARIALGDLDDVFIDVDADHFRSTTRRRVHGKTAGVAAQVEHAIAFHQPAQPLTVLAL

SEQ ID NO: 188059 - protein, 186 aa, Glycine max
  Coding DNA Sequence Number=SeqID_71281
  Homolog annotation: Hit_ID=UPI0000397875; Match level="QueryCoverage =98%, HitCoverage=76%, E-value=6e-83, Identity=72%"; Hit description =COG1636: Uncharacterized protein conserved in bacteria
  Pfam annotation: Domain name=DUF208; Domain location=1-182; Score =386.6; E_value=3.7e-113; Accession=PF02677.5; Description =Uncharacterized BCR, COG1636
MEAMLASGIDYTIFFYNPNIHPLKEYELRKEENIRFAEQFGVPFVDADYDKDNWFERARGMEWEPERGVRCTMCFDMRFERTALYAHEHGFPVITSSLGISRWKNMQQINDCGVRAAARYPDMLYWEFNWRKGGGSSRMIEISKRERFYQQEYCGCIYSLRDTNRHRVASGRERIEIGVQYYSPDE

SEQ ID NO: 188060 - protein, 62 aa, Glycine max
  Coding DNA Sequence Number=SeqID_71282
MAARPSELRLTPEVTGSPRLAGSFTLKQLAKTKEVKPKKHEDIEVLLNIKQRTLKSCRAEDI

SEQ ID NO: 188061 - protein, 302 aa, Glycine max
  Coding DNA Sequence Number=SeqID_71283
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=49%, HitCoverage=9%, E-value=4e-13, Identity=39%"; Hit description =Putative retroelement
MRGGGCIVACPGKLLASSKSNLARPGELLNSAGESPNVGKRSSLNEIRVLLVRKKGNTWPFCVNYHALNAIMVKDMFSIPTVVELRDELHGAIVFSKLDLRILEGFELLMVVVSSRDEHKGFTFIDGVSYFQQCLFVPLESALCFQLLQDCHATLAGGHSSVKGMLICLAASFSWPHMCRDVKEYVQTYCLTKYTHFKTLPAKFSVASVAPMFLSDIYKLHDMPKLIVNDCDHWGDQSYPTKLKAFYETPSTTPPPLTTHVTETIMPLVPSAILESHMLRLGRGYIDQVLIQWEGLSPTTAT

SEQ ID NO: 188062 - protein, 227 aa, Glycine max
  Coding DNA Sequence Number=SeqID_71284
  Gene Ontology: Mol. function=nucleic acid binding; Biological process= DNA integration
  Homolog annotation: Hit_ID=Q2HSF6; Match level="QueryCoverage=83%, HitCoverage=14%, E-value=1e-22, Identity=32%"; Hit description =Glycoside hydrolase, family 1; Zinc finger, CCHC-type; Polynucleotidyl transferase, Ribonuclease H fold
MARNQLAFVEGASINKNPMFYGVNYPFWKVRMKIFMESVNRGIWQAVVNGYTIPTQVVNNETIEKLHESWSIEEIRRSEYDSKAMNIIYSSLNSDEFFRVSACTIAKEMRDLIKVTHEGTLEIRRAWKNSLIQKYETFKMKQVNHLKGLGKIFEEINVKILKSLNRTWQPKVTSNFESKSLASMTHAELFGKLREYEMDLTRMTKEEVIDKKKKRLGLEDKHSIKRR

SEQ ID NO: 188063 - protein, 172 aa, Glycine max
  Coding DNA Sequence Number=SeqID_71285
  Homolog annotation: Hit_ID=Q47522; Match level="QueryCoverage=30%, HitCoverage=64%, E-value=5e-24, Identity=100%"; Hit description=LacZ protein
METHKMMQGTKVYASAINRHVRLMGLSTGPLMLGVDAIKISYNSFITYGPLQILFFFHRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 188064 - protein, 58 aa, Glycine max
  Coding DNA Sequence Number=SeqID_71286
MALGFPTLVTGLCQSYRVPVPPARSRHREIGKDRTRKTPSGPKEVQQGPRVSSSDYGP

SEQ ID NO: 188065 - protein, 144 aa, Glycine max
  Coding DNA Sequence Number=SeqID_71287
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-15, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GQHALTLKGLHALAFQGLHTLTFRGLLILAFKGLHVLNFRGLHVLTLRVLHTLTFRGLHVPAFRGIHVLSFRGLHVLTFRRLHVLAFIGLDALTFRVLLVLAIRGHHALAFVGLHALPFRGLHALTFRGLHVPAFRGLHVVTFR

SEQ ID NO: 188066 - protein, 100 aa, Glycine max
  Coding DNA Sequence Number=SeqID_71288
MEAMKEQMATMMEAIMSMKKIMEANAATVAATRAPQPNKSSNLSYGRQGFGKYEWPHDVQIQNEHAFTPYGLPSNYTPPNVVYTPNENVNNSAPILIESQ

SEQ ID NO: 188067 - protein, 102 aa, Glycine max
  Coding DNA Sequence Number=SeqID_71289
  Subcellular localization annotation: CTP_CleavageSite=52; ConfidenceScore=5.26e-01
MIHDSIQRASTLLFSSSLSPCIFPSVPSIANPLTLPPEWGSSPRRAGCLRMKAFHGPGKLDAGLGKLRPRNIQKWPFCPFSLWFLFPNLTIKHQLEQSLDLE

SEQ ID NO: 188068 - protein, 82 aa, Glycine max
  Coding DNA Sequence Number=SeqID_71290
  Homolog annotation: Hit_ID=Q1T159; Match level="QueryCoverage=79%, HitCoverage=54%, E-value=3e-08, Identity=52%"; Hit description=Beta tubulin
  Pfam annotation: Domain name=DUF1723; Domain location=1-44; Score =19.8; E_value=0.0023; Accession=PF08330.1; Description=Protein of unknown function (DUF1723)
MFAFVERKHKETSSFHLPVREVTITLGDVASLLHLPIVGAFHSFEQLHVDDAVDMLVELLEVSAAKARAETIQCHGSYVRLS

SEQ ID NO: 188069 - protein, 100 aa, Glycine max
  Coding DNA Sequence Number=SeqID_71291
TLASIATPLGLEVIPQVKKLLDEGLVHKSLNPYALLVPKIGVPMDPKRIKVIPDWPTPPSVEGRSPEYEEPWDLRSNPFHGGGDDAILPPKGWISDPMGQ

SEQ ID NO: 188070 - protein, 547 aa, Glycine max
  Coding DNA Sequence Number=SeqID_71292
  Gene Ontology: Mol. function=nucleic acid binding; Cellular component= oxygen evolving complex; Biological process=DNA integration
MEPDSFILQDLKTLRRIGTAKQKQGLLEFWNFMLCISTLLSTRHKFNPRATTTVFIGYPHGYKGYKLLDLTTLKTFISRDVKFYEHIFPFQDKDSTTRSTYPLSPHITPNLITLGICDDPDPIHTQYLPGNQPGIQNNPQPNPFSEYQLRRSTRQCGKPRYLTDYHCYNRYKQAIKFPQWKQVIQDELTAMDLNNTWTITHLPPNKKPITCKWLFKLKLNSNGTVAKHKARLLARGFTQQYGLDFQETFSHVAKITTLRLILSLAASQHWHLAQLDMNNAFLNDSLDEEIYMHIPQGYNHEPPSRSSAPLVYKLNKSIYGLKQASRSWFNKFRTTLTSQDYIQSKYDYTLFTKGTGSSSIAILVYVDDIVIASLDKTAIHSTKIMLQQYFKLKDLGDLKFFLGLKLSRSQVGIFIIPMEADLKLNAESGSQLPDPETYRRLIGRLLYLTISRPDICYTVHKLSQFVSDPRSGHMNATNIMLRYFKHIAGQEVLFKAKSDTSLHAYVDANWGSCIDSRKSTTGYCIFLGNSLISCKAKKQKTISKSST

SEQ ID NO: 188071 - protein, 170 aa, Glycine max
  Coding DNA Sequence Number=SeqID_71293
  Gene Ontology: Mol. function=sequence-specific DNA binding; Cellular component=nucleus; Biological process=regulation of transcription, DNA-dependent
  Homolog annotation: Hit_ID=Q56NI2; Match level="QueryCoverage=82%, HitCoverage=57%, E-value=3e-65, Identity=91%"; Hit description=MADS box protein M8
  Pfam annotation: Domain name=K-box; Domain location=15-115; Score =139.7; E_value=7.8e-39; Accession=PF01486.8; Description=K-box region
METQLSIAYYIIFLLHNIFVTLTRSTYQYQFYQQESSKLRRQIRDIQNLNRHILGEALGSLSLKELKNLEGRLEKGLSRVRSRKHETLFADVEFMQKREIELQNHNNYLRAKIAEHERAQQQQSNMNMSGTLCESLPSQSYDRNFFPVNLIASDDQQQYSRQDHTALQLV

SEQ ID NO: 188072 - protein, 141 aa, Glycine max
  Coding DNA Sequence Number=SeqID_71294
  Gene Ontology: Mol. function=RNA-directed DNA polymerase activity; Biological process=DNA integration
  Homolog annotation: Hit_ID=Q1SS72; Match level="QueryCoverage=91%, HitCoverage=8%, E-value=3e-26, Identity=44%"; Hit description =Integrase, catalytic region
MATSTTDPSQDPTNPLHLHHSNGPDLVLTSQPLDHKNCTTWSRAMKVALSIKNKTTFIDGTFLKPKEEAPTYAAWTHANNVVISWLYNSISKDIITSILFANTAKEIWDDLKTRFSRENGPRIFQLKCQLMSLQQGTDDIS

SEQ ID NO: 188073 - protein, 96 aa, Glycine max
  Coding DNA Sequence Number=SeqID_71295
  Gene Ontology: Mol. function=sequence-specific DNA binding; Cellular component=nucleus; Biological process=regulation of transcription, DNA-dependent
  Homolog annotation: Hit_ID=Q0GPY8; Match level="QueryCoverage=98%, HitCoverage=39%, E-value=2e-35, Identity=76%"; Hit description =SHATTERPROOF-like
  Pfam annotation: Domain name=SRF-TF; Domain location=24-74; Score =117.7; E_value=3.4e-32; Accession=PF00319.9; Description=SRF-type transcription factor (DNA-binding and dimerisation domain)
MEDPNQAPEASSQKKMGRGKIEIKRIENTTNRQVTFCKRRNGLLKKAYELSVLCDAEVALVVFSTRGRLYEYANNRLQICVVRDRNRCQGDTRSST

SEQ ID NO: 188074 - protein, 197 aa, Glycine max
  Coding DNA Sequence Number=SeqID_71296
  Gene Ontology: Mol. function=helicase activity
  Homolog annotation: Hit_ID=Q6YTQ6; Match level="QueryCoverage=70%, HitCoverage=9%, E-value=2e-28, Identity=42%"; Hit description =Helicase-like protein
MTQENIDIEYSLNDPTIDDFDDYDEQTFLSASSTYQNTGGTYIDIGDPVWECPHCKAMMWYDERINKDKQTNKPRFSLCCSDGKIQLPLLHEPPHPLNHLLFNNQDPKAKNFQQYIRIYNLMFAFTSPDIKFDKSYTTGKGPPTFRIHGQTHHLIGSLLPMPNNPPKFAQLYIYDTDNEVINRLSQNPLVFILMSHM

SEQ ID NO: 188075 - protein, 54 aa, Glycine max
  Coding DNA Sequence Number=SeqID_71297
QLRHEIVYPDVDMLFFKGGRHGNILSISGSFAMTKDIRIWLGMFCIGWAIEIAK

SEQ ID NO: 188076 - protein, 329 aa, Glycine max
  Coding DNA Sequence Number=SeqID_71298
  Homolog annotation: Hit_ID=Q4IYW2; Match level="QueryCoverage=44%, HitCoverage=24%, E-value=4e-41, Identity=58%"; Hit description =Protein kinase
  Subcellular localization annotation: CTP_CleavageSite=27; ConfidenceScore=5.52e-01
TSPCPAAAISVPGGMKTAVRCLSLRTRSSIAQPRAGWKCPAAMTLLSDGKTRSQTVTFLQGYPIADLTLTRTPLEVVAVNKQRMIVTRPDASDSWLVLPFDAQQHVWRFSGTLLIKMDKNTGTDSEAVKSRVDSLRGIWSPQFMPQQKVTVLLIDTLHADLADPAIGAWQLTMSANENHTPNALPAGYRFNEFEIKEVIGGGGFGIVYRAWDHQLERTIAIKEYMPVSLAVRGADLALELRGERFQKLFNAGRNSFIQEARLLARFNHPGLLHVLRFWEENGTAYMGTLYYSGMTLKEWQLTSPDSIDEAWIRRLLPPLFGAINTIHTA

SEQ ID NO: 188077 - protein, 203 aa, Glycine max
  Coding DNA Sequence Number=SeqID_71299
  Gene Ontology: Mol. function=RNA-directed DNA polymerase activity; Cellular component=extracellular region; Biological process=RNA -dependent DNA replication
MIGRNKKTYFSFIKDRMWKRINHWSSKHLSRVGAVIREGHEWRIENGEKINVWGQPWLQSKGNTFVSSTVPHGLELMKVSSLIDHASLSWRLDIMSQILNTNDINHIQNIPLLNVDMEDEKIWKFIAHGLYTVKSSHGDPILRQQFQSRRAMESGWSLRVSPKIKHLSWRILRDYLPSRQNLIRKGVIYQPNCTFCENGLENE

SEQ ID NO: 188078 - protein, 171 aa, Glycine max
  Coding DNA Sequence Number=SeqID_71300
  Gene Ontology: Mol. function=calcium ion binding; Cellular component =flagellin-based flagellum; Biological process=ciliary or flagellar motility
  Homolog annotation: Hit_ID=Q93YA8; Match level="QueryCoverage=80%, HitCoverage=84%, E-value=6e-41, Identity=58%"; Hit description =Calcium binding protein
MDGVIRGVAAILGGRHHRLELLEVDTTIRDTAFIDETVEVEAIEREVELRGRDEAIFVAVVEIEGITELAGSTVDGGIGAAEGDELHEVDEVVAVSVEVFHDMAEVLWRDVGSERPEHAVELVSGDLAVTVGVEAVEDCLEFVHVFEIRKELVFKNLKFTFLKIEFKILFF

SEQ ID NO: 188079 - protein, 48 aa, Glycine max
  Coding DNA Sequence Number=SeqID_71301
MSKTPGQKEEVSIGWQTPLEGWVALNSDGSWRRHAVWFSYVWWLLTEF

SEQ ID NO: 188080 - protein, 97 aa, Glycine max
  Coding DNA Sequence Number=SeqID_71302
  Subcellular localization annotation: CTP_CleavageSite=80; ConfidenceScore=5.18e-01
MVPDVIGPAFSGLQKAQKMMLVSVCYHALSLGDSKRKFESAGPNGSRMSSGPPPLDDKRRRRRHSKRKFESARPNGSAPKMSSGPPPLDDKRRRGRR

SEQ ID NO: 188081 - protein, 251 aa, Glycine max
  Coding DNA Sequence Number=SeqID_71303
LDWLSKLKIINEENFEAPEEDEEVQALKSELGKARLAKEKFKLVATDIRKECAGLREENAATEGAFERETKRDRKIQEELAACSRSKRSLAQNLEATERSMLAIIGQYKEELNQSLSHEHKLVEDFTQAYAEKEARGRVIDALHQEATIPQAYPYGSPPDFTPRTTPDELSEAPTFEGQLPPHADYPLQEDDEGDAHLGPLLPLKEPAPHELTKPNIVHHDPSPSAPVKELAESDRRPRQLSVLGFSGSVS

SEQ ID NO: 188082 - protein, 53 aa, Glycine max
  Coding DNA Sequence Number=SeqID_71304
MAHHQIYQGNPCGVYPDLSSLTGSGVIQNFVTYIKRFVPSKDHIKSAQGSYSI

SEQ ID NO: 188083 - protein, 40 aa, Glycine max
  Coding DNA Sequence Number=SeqID_71305
MTTVIERRPKTFDEGVGQRRRYQRWRWLVLTEGMRLGSHD

SEQ ID NO: 188084 - protein, 66 aa, Glycine max
  Coding DNA Sequence Number=SeqID_71306
VVITNFYKESGGGPTALRILGPPKLPKWIPQEIIPTIGPVPTWKAHPEFDATQAKQLLPKRANENK

SEQ ID NO: 188085 - protein, 288 aa, Glycine max
  Coding DNA Sequence Number=SeqID_71307
  Gene Ontology: Mol. function=protein dimerization activity; Cellular component=endoplasmic reticulum; Biological process=proteolysis
  Homolog annotation: Hit_ID=Q6D580; Match level="QueryCoverage=92%, HitCoverage=69%, E-value=3e-73, Identity=50%"; Hit description =Putative peptidase
  Pfam annotation: Domain name=Peptidase_M20; Domain location=1-273; Score=127.2; E_value=4.4e-35; Accession=PF01546.18; Description =Peptidase family M20M25M40
MHACGHDVHSAVILGATLQLKAQEAQLPGRVRILFQPAEEIAQGARQFIDAGVLDQVQAIFGMHNEPGLPTGTFATRSGAFYANADKFVVRVHSTRTDVNSILVASQIIQALQSLTSRSFNTLDSLVLSVTRIDAHRHDGQQTAEAEFGGTVRTHDKQVRAQLEQRAREVVVNIAAASGATATFSWHPGPPVLENDAHWAQFASQVAQQVGYQVQQAELHLGGEDFAYYLQQLPGAFVSIGSASEFGLHHGGFNPDEALIAPAAHYFSQLAQQALQQLNARCRDAILN

SEQ ID NO: 188086 - protein, 399 aa, Glycine max
  Coding DNA Sequence Number=SeqID_71308
  Gene Ontology: Mol. function=monooxygenase activity; Cellular component=intracellular
  Homolog annotation: Hit_ID=UPI00006DAAC0; Match level="QueryCoverage =90%, HitCoverage=88%, E-value=1e-151, Identity=70%"; Hit description= COG2141: Coenzyme F420-dependent N5,N10-methylene tetrahydromethanopte rin ...
  Homolog annotation: Hit description=reductase and related flavin -dependent oxidoreductases
MTARQLRLGTILHGASGNMSAWRHPAAQADASISFDYARRIARKAEAGKLDFLFVADGLFINEKSIPHFLNRFEPLTLLSALAGVTEHLGLVGTVSTSYSEPFTVARQFASLDHLSGGRAGWNVVTSPLEGSAKNFSRQQHPEHALRYRIADEYLQVVKGLWDSWEEGAFVRNKASGQFYAPDKLHTLNHHGDFFQVQGPLNIERTPQGRPIIFQAGASEDGRKLAARHADAIFTHQPTREEAQAFYRDVKQQLVANGREPGDLHIFQGVSVIVGENDADVERQYQTTAALVSIEDALNYLGRFFDHHDFSQYPLDQPFPDIGDIGQNSFRSTTDEIKRKAREHGHTLRQAALEAATPRPLFHGTPQQVADGLQLWFETEATDGFIIQGGTPGHLRAFC

SEQ ID NO: 188087 - protein, 73 aa, Glycine max
  Coding DNA Sequence Number=SeqID_71309
MLSGTEASRVLQTSSHRSQRSDIGKLSCEAANQILRRSNGKRRLGCVFTKTAHVASSRSFIKRLPQEASSWLL

SEQ ID NO: 188088 - protein, 185 aa, Glycine max
  Coding DNA Sequence Number=SeqID_71310
  Gene Ontology: Mol. function=nucleotide binding; Cellular component =intracellular; Biological process=small GTPase mediated signal transduction
  Homolog annotation: Hit_ID=Q84LH2; Match level="QueryCoverage=98%, HitCoverage=60%, E-value=6e-75, Identity=73%"; Hit description =Putative Septum-promoting GTP-binding protein 1
  Pfam annotation: Domain name=Miro; Domain location=1-112; Score=99.4; E_value=1.1e-26; Accession=PF08477.3; Description=Miro-like protein
  Pfam annotation: Domain name=Ras; Domain location=3-167; Score=-23.9; E_value=1.7e-07; Accession=PF00071.12; Description=Ras family
  Pfam module annotation: Pfam domain module=Miro::Ras; Domain location= 1-112::3-167
MAVGVCHIGKTRFVIKYVGDEQEKRSLQMKGLNLMDKTLFVQGARISFSIWDVAGDPGSICQIPMACKDSVAILIMFDLTSRCTLNSVVGWYSKARKWNQTAIPILIGTKFDDFVKLPPDVQWTIVTQCIQARAYARAMKATLFFSSASHNINVNKIFKFIMAKLFNLPWKVERNLTLGEPTIDF

SEQ ID NO: 188089 - protein, 128 aa, Glycine max
  Coding DNA Sequence Number=SeqID_71311
MVEMDSAIGIGRQARDKVAKSASRPLEVVLEHLVPQGDKLTSIVPNLSKKFLLAKDLPIGPTPEWNDETVLAMNTRTQGGCRHLQELCLKKLLSYHSKDLLPVFQKIINCFKIEGPSDVLRDSKGFLA

SEQ ID NO: 188090 - protein, 204 aa, Glycine max
  Coding DNA Sequence Number=SeqID_71312
MAYHASSKANHNAIQKQEIQCAKVFFEDYQGKPESQFYYQNKAERSFNLDILLIQFKDTIGSFQRAFKSAEIKVEERHEDHEGSIILGQPCLPFASCVFDMGKEISEQEMELTTLAMVLQTPGEKEFEYVIECLVNEDGGRMVACIEKLGDPDDESIGHVMFEELENNRPKEKPKVELKTLPAHLKYVFLEDNETKPVIISSSL

SEQ ID NO: 188091 - protein, 87 aa, Glycine max
  Coding DNA Sequence Number=SeqID_71313
  Homolog annotation: Hit_ID=Q00V79; Match level="QueryCoverage=79%, HitCoverage=45%, E-value=6e-19, Identity=62%"; Hit description =Homology to unknown gene
MVENRLRWFEHVERRPYFNYMGMLAVEGTYDKMEALLSQNIHPVDILLLLAASEGDKPKIEELLRAGAKYDVKDADGRTALDRAGRN

SEQ ID NO: 188092 - protein, 81 aa, Glycine max
  Coding DNA Sequence Number=SeqID_71314
  Gene Ontology: Mol. function=beta-galactosidase activity; Cellular component=beta-galactosidase complex; Biological process =carbohydrate metabolic process
  Homolog annotation: Hit_ID=Q5CCP8; Match level="QueryCoverage=95%, HitCoverage=9%, E-value=2e-15, Identity=53%"; Hit description=Beta-D- galactosidase
MWLPFMRKLVTFSILHISFLLSPNGSMPSLKNLIENEYGAQSKLQGAAGQNYVNWAAKMAVEMGTGVSWVMCKEDDAPDLV

SEQ ID NO: 188093 - protein, 90 aa, Glycine max
  Coding DNA Sequence Number=SeqID_71315
MYIIWKEFERSQILHLILHFTYLETDSKPSDLRSHFSLLREQSCARKRGPERKVVGGGTMVVRGEALRGRACGSHGEALGVATGVSEGGA

SEQ ID NO: 188094 - protein, 198 aa, Glycine max
  Coding DNA Sequence Number=SeqID_71316
  Gene Ontology: Mol. function=RNA-directed DNA polymerase activity; Cellular component=chromatin; Biological process=one-carbon compound metabolic process
  Subcellular localization annotation: CTP_CleavageSite=26; ConfidenceScore=5.00e-01
VEGVTDSMLQKGLIQPSTSPFSSSVLLVKKNDGAWRFCVDYRALNALTMRERFPIPTIDELLDELGGARFFSKLDLLQEYHQIRMHFEDIPKTAFRTHHGHYEFKVMPFGLCNVPSFFQATMNMIFHPYLRRFIIVFFDDILIYSASMDEHLDHLELTFQVLLDNQFVLKLSKCSFGQSQVEYLGHLVLHRICYATLV

SEQ ID NO: 188095 - protein, 93 aa, Glycine max
  Coding DNA Sequence Number=SeqID_71317
  Gene Ontology: Mol. function=oxidoreductase activity; Biological process=auxin mediated signaling pathway
  Homolog annotation: Hit_ID=Q338B1; Match level="QueryCoverage=76%, HitCoverage=26%, E-value=4e-21, Identity=56%"; Hit description=Auxin- induced protein PCNT115, putative, expressed
MGELKKLVEEDKGKYIGLSVQMAWSLWTRDIEDDTVPLCRELGIGIVPYSPLGRGFFGGKGIVENFIANSFLIFLIVVIFSRILFGSLELRTL

SEQ ID NO: 188096 - protein, 233 aa, Glycine max
  Coding DNA Sequence Number=SeqID_71318
  Gene Ontology: Mol. function=chitin binding; Cellular component =extracellular region; Biological process=chitin metabolic process
  Homolog annotation: Hit_ID=UPI000044A8F0; Match level="QueryCoverage =57%, HitCoverage=99%, E-value=3e-16, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGETHEIPHHNLADFEPCIGCATEGQAIGGVPLSNTLEGPRFCPQPQPFYFAVGRVPPAMAENGKLDQIEERLRAVEGGEDYAFADMEDLCLVPDKAKGLHVLTFRGLHILTFKGLHALAFIGLHTLAFRGLHVLIIRGLHILAIRGLHILAFRGLHDLTFKGLHVLAFRRLRVLTFKGLHALAFIGLHLLALRALHALAFIRLHTFAFRGLHILAFRGLNALAFIELHALTF

SEQ ID NO: 188097 - protein, 111 aa, Glycine max
  Coding DNA Sequence Number=SeqID_71319
MRSSSSLSEVEELALSGMLLLPYQIWNLAGERVHGNRGGSHCHAQHTHSEMITKDDDKGDDKKLKGQSKNEFKIFKKESRTLQDSRGKLISRIKNQDSRDQAVISGNDALW

SEQ ID NO: 188098 - protein, 396 aa, Glycine max
  Coding DNA Sequence Number=SeqID_71320
  Gene Ontology: Mol. function=RNA-directed DNA polymerase activity; Cellular component=chromatin; Biological process=chromatin assembly or disassembly
  Subcellular localization annotation: CTP_CleavageSite=45; ConfidenceScore=5.28e-01
MPTPTPFSSSAPRSFPNPALQTRFAPSQYEDPTRALFNLTQKGSVATYLAEFEDLANYIVGLPLPFLLSCFISGLTLEIHHEVQAHQPLTLTQAAGLAKLQEEKIFDSRPPTTLARPRPPLPSLTFLPPRPNSISPLLPPSPRPTLMPSTSPQPAPPPPFKRLASEEIASRRERGLCFSYDEKYHRGYRCASRVFLLLAEEEDPPDLLIIDTLNPNPDPVPDPPATHDPYPAHLSLNSLADHLAPETLRFVATVVGRDVVLLGTEFRVDLYVLPISGANIILGVQWLKSLGPMLTDYNTLAMKFFYEGRLITLQGNLDVSLSSLSEFRRLGRTHRDALYYHITLLPDTDSSTQELPLAIRTLLTKFAALFHPPDSLPPARETDHHIHLLPNAAPVN

SEQ ID NO: 188099 - protein, 97 aa, Glycine max
  Coding DNA Sequence Number=SeqID_71321
  Subcellular localization annotation: CTP_CleavageSite=80; ConfidenceScore=5.66e-01
MSQRASSIKKLGSRQICPKFGGDTSAKRISRTKWTLWAQRTSTAKCNFSALSMTRESGRAQESRSCAKREISSLRKTFVSCQAQRTAGAKPKSTYSR

SEQ ID NO: 188100 - protein, 346 aa, Glycine max
  Coding DNA Sequence Number=SeqID_71322
  Gene Ontology: Mol. function=RNA-directed DNA polymerase activity; Biological process=RNA-dependent DNA replication
MVGQGGEALGSMSGSHFVQVQNKHSFRPYGLPPNYTPLNVAHTTDENVDNSAPIPIESQQPQSDHAHVSQTMGETHEEPRDHNLANFKPHLIYATEGQACCCVPLPNTLGGPQHHPQPQPLHFAVGRVPPTMVEREKFDHIKERLRVIEGSRNYAFVDMAELCLVPGVVIPPKFKVSDFNKYKGTTFPKNHLKMYCMKMGAYTKDEKLLMHLVQESLTGAAVTWQYQYNSDMALDRIQLQNMCKKEHESSKEYAQWWRDLAAQVVPPMMEREMITMIVDTLPVFYYEKMVGYMPLSFANLVFACKRIKVGLRRGKFDYPALMNRKPGENGENKKEGETHVVTAVPT

SEQ ID NO: 188101 - protein, 116 aa, Glycine max
  Coding DNA Sequence Number=SeqID_71323
  Gene Ontology: Mol. function=transporter activity; Cellular component= integral to membrane; Biological process=transport
  Homolog annotation: Hit_ID=Q6J1S8; Match level="QueryCoverage=68%, HitCoverage=25%, E-value=3e-33, Identity=82%"; Hit description =Nodulin 26-like protein
  Pfam annotation: Domain name=MIP; Domain location=6-116; Score=-74.2; E_value=5.8e-05; Accession=PF00230.10; Description=Major intrinsic protein
VTNYLEINRERNGHYSYKKGHISGAHLNPAVTISFAALKYIPWKNVPVYIGAQVLASVSAAFALKALFHPYMSGGVTVPSVGYGQAFAIEFIVSFMLMFVVTAVATRTRVVSILFY

SEQ ID NO: 188102 - protein, 154 aa, Glycine max
  Coding DNA Sequence Number=SeqID_71324
SNKTESIRFIHHITAKPSLAFTTQTLEANVFQERVRAEVVECGCVIELPELKILSGKEILYCLNSRTLMCFIPTLGVHSVISLILAFILDRAAHHHKNNLETYFNEVRSLVAVRFKALRIQWTQYYLKKTDVNDNTINVGTFNIGLKTDVESHK

SEQ ID NO: 188103 - protein, 102 aa, Glycine max
  Coding DNA Sequence Number=SeqID_71325
SRLFRFFRRFPQINVGGDSARIPFVEHASRESRVALPPKVERKDIELVDEEEAQIGADRSRSVCIMRMCVVVMLDPVSVMERRERFLQGLGLADSTNQLSCA

SEQ ID NO: 188104 - protein, 96 aa, Glycine max
  Coding DNA Sequence Number=SeqID_71326
MVVEDVQGIEIMGEGRGLQLQTSSASVTYANKGLGYFNIFLLFKEIDIVCGWRGSDRGQHRAMLHGVVGDGARWLTRAIAVGEMHHAWRTNPYTNG

SEQ ID NO: 188105 - protein, 135 aa, Glycine max
  Coding DNA Sequence Number=SeqID_71327
MYLKGWVVARAKMMGLKMKSVGDLLTFCRVSVHLQRVPRHELPKYSCDQPGNLFDETVNETSIRGEIRGVFVDVFEELEQKRHLRVKNGVVELRDIERCVVFEGRLSMGEKVVEGGYKRGFSIRKVEMGGRRRRR

SEQ ID NO: 188106 - protein, 192 aa, Glycine max
  Coding DNA Sequence Number=SeqID_71328
MKKKNTESRRDEDENIQSKNGPLRVYRMNSKLQNQKLTSSRSTNDEERTKNGKECLILDGVFKDTIASEGEGFFHGLHVAFQVEPRGLNLERLMGDGGGRLLFTRMVELFGVEEQGGLTSLLEASSPCLPPSWNFNYEEEFHPLSHSDTSCRSKLHDDEPSNFDDAKDSSQESRVKQVSRIKESLSQESRFK

SEQ ID NO: 188107 - protein, 230 aa, Glycine max
  Coding DNA Sequence Number=SeqID_71329
  Gene Ontology: Mol. function=RNA-directed DNA polymerase activity; Cellular component=chromatin; Biological process=chromatin assembly or disassembly
  Pfam annotation: Domain name=rve; Domain location=16-172; Score =125.4; E_value=1.6e-34; Accession=PF00665.16; Description=Integrase core domain
KYDTAASLGLLQPLPILEHVWQHITMDFIEGLPFSFGKQVIFIVVDRLSKAVHFMALSHPYTAADVAQCFLDNVFKLHGFPDTITSDRDPVFVSHFWKEFMSLQGIQVQLSTAYHPLTDGQSEMVNRCLETYLRCMCSDSPAQWSKCLPLAEWWYNSTYHSTIKASPYEIVYGQAPLVHLPYLSGESQIALVDRSLQKREEMLKLLKFHMKRAQDKMKQLADRGRSDRSF

SEQ ID NO: 188108 - protein, 127 aa, Glycine max
  Coding DNA Sequence Number=SeqID_71330
  Homolog annotation: Hit_ID=Q1RWT2; Match level="QueryCoverage=25%, HitCoverage=16%, E-value=6e-11, Identity=96%"; Hit description=PAP fibrillin
MRYDGIASGGKTLNFTQTHTMMQFTTLMINGCYFLDINSYETFDTVYLDDDLRVVKDIRGDYLVVNRASYNWKECMESSSSFCLLNVCMPKKVLNCLYFTSYCSWHRWLKTQPVCILFSRVKPGGAH

SEQ ID NO: 188109 - protein, 248 aa, Glycine max
  Coding DNA Sequence Number=SeqID_71331
MVVNSGLWLSFPLTKHSSGDFFPSAIYQDGTLQGFVQVVQADVLCQQFPVFCIEELELQGQGGDIGLGRTSNPIAEFLVLLHQLVSEPVPSLVIKQWQRTHTIKLPFVKWKNVSTAECNQDLSSSLLPCNKQYTECFNRGNKILQPQAIHLEVRDPVPILVALDWLGWTFQDSMVDNTPDEFKVRLAVVHFKGKALQWHSAYIKSVGLENLPSWNEYQILLLDRFGDVCEDPMADLMKLRQTGSIRVS

SEQ ID NO: 188110 - protein, 448 aa, Glycine max
  Coding DNA Sequence Number=SeqID_71332
  Gene Ontology: Mol. function=RNA-directed DNA polymerase activity; Cellular component=chromatin; Biological process=chromatin assembly or disassembly
MKKEGPGPQQLDANVVTEPDLEPLISGNALTGVANFRTMRVTEAMDIVSVTVADGNKVQISSKEPSSLPPCRVGHDHKIPLMQGANPVNKRPCRNLNKATLKNKFPIPLIEDLLDELHGSTIFSKIDLRADYNQVRMDAADIHKTAFRTHAGHLEYLVMPFGLTNAPATFQGLMNSVFQYYLRRTHCLYAKKSKCYFAIDKVEYLGHFITKEGVSTDPSKIAAVQDWALPQNLKQLRSFLGLAAKEAFQELKQRLVASPVLALPDFSKEFVVEVDASSLGLGAVLMQNHHPIAFTSRSLNTQQQSLSTYEKELLTVVFAVQKWRHYLLPKKFIIRTDHRSLKYILEQRLSTAFQQKWLVKLMKFDFNIEYKEGRENVAADALSRLDSPEIMALQLRRKGRLGIGSDSQLRQDILSWIHASACGGHSGRDATLQKMKNVVYWRGMSKAV

SEQ ID NO: 188111 - protein, 76 aa, Glycine max
  Coding DNA Sequence Number=SeqID_71333
MKIHADKLVARGIIGHALTHTKEHGWSDSNKRHVVAHQRSSGRTISQTSKSGHARVDSNGDEVIACADNGKSDFPS

SEQ ID NO: 188112 - protein, 173 aa, Glycine max
  Coding DNA Sequence Number=SeqID_71334
MCAPNQAVAYPPSLHISKATNILMVPNRCFPRLPLKYEGRKKGFEMGHESRKKKSICGSTLSLRKPVVMIIEAPKVTESTSAPTIEKPKEKNDEALEPTSNEATWKNIIDVIVHTTTFEPTPINFAPPKVVTKTEVKEMIGLAMDKFPKKKMAENEEFRCTMQQAIATQFSSL

SEQ ID NO: 188113 - protein, 73 aa, Glycine max
  Coding DNA Sequence Number=SeqID_71335
MWDTLAITYEGSNQVHEYELQQDIGIKKEKYLALKVQKTKKSSVLNEATSRIGLKKALNVDKSSDDESGEDDH

SEQ ID NO: 188114 - protein, 130 aa, Glycine max
  Coding DNA Sequence Number=SeqID_71336
  Homolog annotation: Hit_ID=A0EJL8; Match level="QueryCoverage=41%, HitCoverage=14%, E-value=8e-24, Identity=94%"; Hit description=GDP-D- mannose-3',5'-epimerase
MILLKSVLIFNPGMDFLYSSVYSQEQPFVTNFILKIEDSIAWFNVPMLSDNYVWLYVNFPKEKPGPEGVRGRKSDNTLIKEKLGWAPTMRLKDGLRITYFWIKEQIEKEKAQGIDIFVLLRWFFKALRGA

SEQ ID NO: 188115 - protein, 65 aa, Glycine max
  Coding DNA Sequence Number=SeqID_71337
MAEIGTAVASTIIECVVDSNVELEKTLQHIKERERAKETSTNAEKIVQPVEEWLNDVERVQKNVI

SEQ ID NO: 188116 - protein, 145 aa, Glycine max
  Coding DNA Sequence Number=SeqID_71338
MAPTPRTHVEILGPIPGSIPYRYNVLSKNMISLETCRNLPYDGSAGEKPKERLPKRKMCGSCHQHLFKENVRKTKKRSANIEKKGFRVVYAWGSLWLVWAPKELRGEVTSSPGRPRLLQVEATARLGELQINQVPSFPINRCQEG

SEQ ID NO: 188117 - protein, 106 aa, Glycine max
  Coding DNA Sequence Number=SeqID_71339
MVFDTSCNTKPRITQCFDQEYKRIPRKGAKGSPRLASSSPGPPNSFMVKKLARLDELTASGFQGSEVEGIERREKEEEMRPGHYRIATAIIPYVAFLFCVLRATVG

SEQ ID NO: 188118 - protein, 45 aa, Glycine max
  Coding DNA Sequence Number=SeqID_71340
MKLTSSGSHRQLRLVAVVAQAEGERRKYDKVLASGRMKRIISNWA

SEQ ID NO: 188119 - protein, 222 aa, Glycine max
  Coding DNA Sequence Number=SeqID_71341
  Homolog annotation: Hit_ID=Q1T493; Match level="QueryCoverage=90%, HitCoverage=32%, E-value=2e-07, Identity=25%"; Hit description =Nucleic acid-binding, OB-fold, subgroup
MWQRQRLTCTKVIDSLLNWYRVEVMVNHKGEQTKFLLWDRECAELIGQSADEVNRLKIEDGDVDLNAFPQALDRLLGCFLAFKVKVQPRFMNAVVLKYSDESNLINVVLDMLPGSEPCCKIESSILESTDPIELESQSVSVTADDDHSMLDSTEPIELESISCRCPCVFLLQFVSVTTDHDPLLRIPLTPTKHVSSDELDDEPKNFEISPAQVSSNKLAKHF

SEQ ID NO: 188120 - protein, 68 aa, Glycine max
  Coding DNA Sequence Number=SeqID_71342
MEELISKYECRLGVMRDVEAPREGSEVGNKKEKEEEEVRKAKPMHYRIAIVIIPYIVLLFCVPRTTVN

SEQ ID NO: 188121 - protein, 182 aa, Glycine max
  Coding DNA Sequence Number=SeqID_71343
  Homolog annotation: Hit_ID=Q1T493; Match level="QueryCoverage=96%, HitCoverage=38%, E-value=1e-24, Identity=31%"; Hit description =Nucleic acid-binding, OB-fold, subgroup
  Pfam annotation: Domain name=DUF223; Domain location=1-95; Score= -7.5; E_value=0.014; Accession=PF02721.5; Description=Domain of unknown function DUF223
MVVVDSDGDEIHVVCKQDQLKSRKADLKENLTYVMHNFKVMKNDGKFKICDHEYKLCFTGVTVVRQSDMEHLPFRKFRFVDFSSVIAGHFQTGLLVDADILIYLLLFPSDSGQFLSYLNEVEDERPIVILLTHARIKEAQGSYPPSVSNSFKASKLMINELVLEIQEFRERLLDLGIKVRSV

SEQ ID NO: 188122 - protein, 209 aa, Glycine max
  Coding DNA Sequence Number=SeqID_71344
  Gene Ontology: Mol. function=ATP-dependent helicase activity
  Homolog annotation: Hit_ID=Q1S5T4; Match level="QueryCoverage=56%, HitCoverage=16%, E-value=1e-29, Identity=58%"; Hit description =Helicase, C-terminal
MLRSLTIIKSNSQKISLMYPIKDIPMVEKGMEGKKKKNPSKNLRQKEATMSPSFVFDPPSVEEIEHEEHKEEEESVGEPQSESESEEHARKSTTSVDEKISKALKQRSTPLVAELDHSFESEPDEQEEDEEEGNDGDSKSFFASSNGTSFHVDSFLQFNLSRPLLRACEAFGYSKPTPIQAACIPLALSGRDICGSAITGSGKKSADID

SEQ ID NO: 188123 - protein, 107 aa, Glycine max
  Coding DNA Sequence Number=SeqID_71345
RAAVEDLRRFLVADSLEEVNRKLDKFYMVLILRSLHLDFDHVRDQVLVGDQVPSMDSLITRLLRVPHALKDENLTDVVETSAMVAPRGRGGGRNSRGCRNGRSGRPQ

SEQ ID NO: 188124 - protein, 247 aa, Glycine max
  Coding DNA Sequence Number=SeqID_71346
  Homolog annotation: Hit_ID=Q8H184; Match level="QueryCoverage=54%, HitCoverage=33%, E-value=2e-31, Identity=52%"; Hit description =Integral membrane protein, putative
MVQSELDSENIDFTVIDDVGSESLGPGIRRELSFSRWCDDDGRIHLDQQLGNEDVSVEDDSDFELPFPEKNEPQGRSLDRERFFHQKFQHRSMQMNGIGTMDDDSVHRRGNGSEKYVSFDIEDKSERGTNSLDSYISVGGDGSLGKISQNPIHAANILKTLILILMWYTSSLFLTLYNKSLLGDHMGKFPAPFLMNTIHFTMQAVLSKFITWFWSHKFEANVVISWRDYFLREWHQLYLHSASSDLK

SEQ ID NO: 188125 - protein, 324 aa, Glycine max
  Coding DNA Sequence Number=SeqID_71347
  Gene Ontology: Mol. function=peptidase activity
  Homolog annotation: Hit_ID=UPI00005F903F; Match level="QueryCoverage =78%, HitCoverage=48%, E-value=1e-105, Identity=76%"; Hit description= COG1120: ABC-type cobalamin/Fe3+-siderophores transport systems, ATPase components
MKISAHSRISCTMSLRFSMRFLLRAERQREGDRLPPFCGRLGRRLAGARRGAGGAGGRNLPAPLGHTFDFRNDIDVLMPHHPVAEGFIHRQAEDEPQRGIQIVDAAGGEKQHQPPLHHGHHVAEAPQVAQGHRLFGAQTGGRPQRHHHAFAVLGQQRVAHQRKHRLAERFRPHIAFKLQRAQTGQQRIDVGGHMAREALPLDALEHGQKTRQRRDVRHDQVGAAGQQQPLVAVAQAGAHLAHRDFQAVAAAAAQGVDLVRQVIDLVALVQRENQRRRESQHAVLRQFVVAVQQLPVGGQRRRAFQDAALGQIQAFIAAQGGGGR

SEQ ID NO: 188126 - protein, 70 aa, Glycine max
  Coding DNA Sequence Number=SeqID_71348
MNSLSEHDALSEFINIHWIYAFPDELAKGTYRAMRVHLVRMNFHPPVEIPVAKRVIGMEKEKDEWRRHIK

SEQ ID NO: 188127 - protein, 49 aa, Glycine max
  Coding DNA Sequence Number=SeqID_71349
MKMNPPLTTPEAFIQQVVWPGVRESMAGAEDYIIVDLTTADWGPWPDLG

SEQ ID NO: 188128 - protein, 130 aa, Glycine max
  Coding DNA Sequence Number=SeqID_71350
  Gene Ontology: Mol. function=ribonuclease H activity; Biological process=DNA integration
MSHGRLYQQRIKNAFDKKVRPHKLNEGDLVLKKISHAVKDNRGKWAPNYEGPFVVKRAFSGGALVLTNIDGEELPSPGQNRLRQRSDVETKLKGRMQVEARVTTDGSSSLAQLWTNGKHCRKAAQYPLNS

SEQ ID NO: 188129 - protein, 67 aa, Glycine max
  Coding DNA Sequence Number=SeqID_71351
MPKDRGTCLDFRYCHHQKGGDCRQRIKLNVLMMRKDYMNHMLLKDLFKTKIFKMNDQDSLRVLGRVY

SEQ ID NO: 188130 - protein, 73 aa, Glycine max
  Coding DNA Sequence Number=SeqID_71352
MKFKFQKRLLNSHYQFVLNISDVDRRSALYLKNLFTLRNFKRTLTPQFQQGFSELTENCNPIKDNNAASGMYS

SEQ ID NO: 188131 - protein, 130 aa, Glycine max
  Coding DNA Sequence Number=SeqID_71353
  Homolog annotation: Hit_ID=Q5XM22; Match level="QueryCoverage=51%, HitCoverage=38%, E-value=2e-22, Identity=73%"; Hit description =Resistance-like protein HAAS-2
  Pfam annotation: Domain name=DUF1723; Domain location=2-46; Score =37.8; E_value=3.7e-08; Accession=PF08330.1; Description=Protein of unknown function (DUF1723)
VTDDPRLIYALVERWHGETNNFHLPVGELTITLDDVEEVEEVIILLMELLEVLGQEARAETAQARGTYVRLSWVWDIYLSRCEARRWIVVARAYLLHLVGCTLFANKSATHVHVVHLEAFRDLGESGRYA

SEQ ID NO: 188132 - protein, 263 aa, Glycine max
  Coding DNA Sequence Number=SeqID_71354
RRRTGTVALKMNTRHLAEEKRNAKHLEEEDECEELAEEEDEQKKLRKKKMNRRTPPPLLLWAVTLPATTLPPPHAATGATAAASLRLYETSTSIPAARLKKGQSEREREPRENERNHGDGSRGRGSEREAGERREKKRTENDESNGRSNKSEKRTEYEDGGGRSSKSDKKMEYEDGGGRSSKSEKRMENDDGGGRSNKSLRSRHERSPERDRNGRSRHRSQSPPRHHASAADAKPRDEDEDVVWEMVGRLNVDTWLLERGVIA

SEQ ID NO: 188133 - protein, 159 aa, Glycine max
  Coding DNA Sequence Number=SeqID_71355
  Gene Ontology: Mol. function=protein binding; Cellular component =nucleus; Biological process=regulation of transcription, DNA -dependent
  Homolog annotation: Hit_ID=Q9LJU3; Match level="QueryCoverage=84%, HitCoverage=27%, E-value=5e-48, Identity=64%"; Hit description =Arabidopsis thaliana genomic DNA, chromosome 3, TAC clone: K10D20
  Pfam annotation: Domain name=FHA; Domain location=61-156; Score=42.2; E_value=1.8e-09; Accession=PF00498.16; Description=FHA domain
QKPSFELSGKLAGETNRVRGVTLLFNEPPEARKPDIKWRLYVFKAGEVLNEPLYIHRQSCYLFGRERRVADIPTDHPSCSKQHAVIQFRQVEKEQPDGTLLKQLKVPQCANPNMHMICARPYVMDLGSTNKTFINDSPIEPQRYYELKEKDTIKFGNSR

SEQ ID NO: 188134 - protein, 102 aa, Glycine max
  Coding DNA Sequence Number=SeqID_71356
MSHHSSSVNGEGTSHKDPQSRILDELSSLKLYMEIKKLKRKEKGKERVESVKGRSPEYQEPQDLRSNPFQGGGDDAILSMMIFHHGDAAEDKGEEVRGGAIH

SEQ ID NO: 188135 - protein, 60 aa, Glycine max
  Coding DNA Sequence Number=SeqID_71357
MDAARRTGDKGVPSLQMARSMMSWRVPPVTQARHADVKHATNKNSGTKVTGKENNVKRSY

SEQ ID NO: 188136 - protein, 175 aa, Glycine max
  Coding DNA Sequence Number=SeqID_71358
MHLVHRQMKKDKEFFLEKLSCGISILRHNNRIVRLRPIDLPDEIPCNGHETYDESLPSVPYKDLFNVDVFPKSTLEVDELNQIQSRPYEEEGCSNITTNTNEKTCQTMDGTEINSNQMIDKIERDEQGQDQEQLQSMPHETEEDTTIVIKNDQTTAREIGDQPNQDEEKTNNFLN

SEQ ID NO: 188137 - protein, 86 aa, Glycine max
  Coding DNA Sequence Number=SeqID_71359
  Gene Ontology: Mol. function=tryptophan synthase activity; Cellular component=chloroplast; Biological process=aromatic amino acid family biosynthetic process
  Homolog annotation: Hit_ID=P25269; Match level="QueryCoverage=72%, HitCoverage=16%, E-value=3e-21, Identity=74%"; Hit description =Tryptophan synthase beta chain 2, chloroplast precursor
MGLWPWKSGIARNLPVQGKLNHTRAHKINNAVAQALLAKRLGKKCIIAETGAGQHGVATATDMERQALNVFRMRLLGAEEIGSFHE

SEQ ID NO: 188138 - protein, 97 aa, Glycine max
  Coding DNA Sequence Number=SeqID_71360
MATTAKNVVVIQDASKTLNLRVFYWIINGLSLKPEDVVTLVAILHEVYHPMGYRITVDNKLLGVNQRIIEQELANKKQDYLMDEGLAQIVKHYASNK

SEQ ID NO: 188139 - protein, 132 aa, Glycine max
  Coding DNA Sequence Number=SeqID_71361
  Subcellular localization annotation: CTP_CleavageSite=84; ConfidenceScore=5.81e-01
MLATPGIPRRLLLGASSAPSRIAGAPSNSTASSALSSSPVYPANFACFLPLSSSSSSVLPVQTFQISFLAHLVEDEVLSREEPSSARVKVDENVAYGRRFFSREDFVFNLQHQNITMSSILRPFTRFKHIGG

SEQ ID NO: 188140 - protein, 282 aa, Glycine max
  Coding DNA Sequence Number=SeqID_71362
MSRDHDEGVSWGNESSSSTGMMPEILRVILDTSHQFDYNKDYEVEDDCEWNSMLGGIETSNVDLEDDICQLSLKNLTDEEVKLMQFVSLTWHEFYCWFAKFNGFTVRKGKVLINTKEEDENVPIILGCQFLNTCDMVIKTKDPTNALVEASFTSVGIENPLEIVLIAEDLDSDSSNDEEEILMFLQAQSDVKPMRNERFEESKMSNEPKPKPSIEKPPMSELKPMSSNLKYVFLDELLLLQEAFGWTIHDIKDIDPTVAPIGFTWRKGKHPSGCLIGDYRNK

SEQ ID NO: 188141 - protein, 294 aa, Glycine max
  Coding DNA Sequence Number=SeqID_71363
  Gene Ontology: Mol. function=N-methyltransferase activity; Biological process=DNA methylation
  Homolog annotation: Hit_ID=Q33VW4; Match level="QueryCoverage=92%, HitCoverage=37%, E-value=1e-119, Identity=76%"; Hit description=DNA methylase N-4/N-6
MTGRDEYGYPVYQAKKSSVAWPRTIWNKRSHNASVYGSTLLRSLIPGRKFPFPKSLYAVEDTLRFFVMNKPDAIILDFFSGSGTTVHAVMRLNKQDGGCRQCISVTNNEVAADEQKTLRMKGLRPGDAKWELHGICDYITKPRVAAAITGKTPNGDLIKGAYKFTDEFPIAEGLEENAEFFTLSYESPVSVSYNLAFERISPLLWLRAGARGSRIDKLPSDGWAIADTYGLLNNVDVTSTFIKALAGVAGIRIAYIVTDDDRRFQAIAKRLPDSIEPVRLYESYLTNFSFTNGE

SEQ ID NO: 188142 - protein, 40 aa, Glycine max
  Coding DNA Sequence Number=SeqID_71364
EPPRHPDMIHENPRERAQGDVDSYSPFPTKGPVPNALPQP

SEQ ID NO: 188143 - protein, 154 aa, Glycine max
  Coding DNA Sequence Number=SeqID_71365
  Gene Ontology: Mol. function=tetrahydrofolylpolyglutamate synthase activity; Biological process=folic acid and derivative biosynthetic process
  Homolog annotation: Hit_ID=Q1T2H8; Match level="QueryCoverage=85%, HitCoverage=90%, E-value=2e-49, Identity=77%"; Hit description =Putative folylpolyglutamate synthase-related
MASDKDHVGFAREILSGVHVETVLLTEAAIAGGVTRTTPASLLRDSWIKASDELGIGIVHDGMAEYSELLKEQPVGSESNLGDGKTVLATVPCLKGCLRSANQILSRRGDEKRVIVFTGSLHIAASVLASLAVPMRQLSTGILDVNNQHSTVIY

SEQ ID NO: 188144 - protein, 94 aa, Glycine max
  Coding DNA Sequence Number=SeqID_71366
  Homolog annotation: Hit_ID=Q5QMW7; Match level="QueryCoverage=54%, HitCoverage=7%, E-value=2e-12, Identity=69%"; Hit description =Putative plastin 3
LMRYSILQLLENLRFQYHGKEITDAGILRWANSKVSSSGSHSRMDSFKNEFLEGQYSQGSDHEILVRTGKLLCDANMTTSTVHRSIKCDDLVAW

SEQ ID NO: 188145 - protein, 88 aa, Glycine max
  Coding DNA Sequence Number=SeqID_71367
  Homolog annotation: Hit_ID=Q67XH3; Match level="QueryCoverage=73%, HitCoverage=10%, E-value=3e-19, Identity=72%"; Hit description =Fimbrin 2
MMNATYIISIARKLGCSIFLLPEDITEVNQNMILTLTASIMYWFLKHPLEERTVGNSDSESGSQLETTSNSTLDDSASDSSAEEKGSM

SEQ ID NO: 188146 - protein, 105 aa, Glycine max
  Coding DNA Sequence Number=SeqID_71368
MFGKALEKLRAFTMDDLGSNVLEEATCLGGGSNDSDRGGSCSDDNGCDNDNGGSGCDDGNSSDDGGIDDNSGSCGGDNDSDGGGCGGDNGSGGGGCCGDNGSEWW

SEQ ID NO: 188147 - protein, 90 aa, Glycine max
  Coding DNA Sequence Number=SeqID_71369
MRTHFLRWILPRKSCRHLRQTLRRIVARGRWRSAEALHPSGQLFGLVLYTFEGLMYRNLMIVYMWLKPPLWTPLLWMTLYFVKLPYFEQL

SEQ ID NO: 188148 - protein, 80 aa, Glycine max
  Coding DNA Sequence Number=SeqID_71370
MNRERQKRKAKGSEILFLSSFEEIKVHRREVPIKKGTSLPMEKDISLFMEKGFKILLFPIIDSLGYPLRIFTDKVWLPYV

SEQ ID NO: 188149 - protein, 101 aa, Glycine max
  Coding DNA Sequence Number=SeqID_71371
MGVQIATRPTWALQKIPPEGGCFWRKPPCSPGRAGGRSEEEFRSALLVIQESLEISEKKLVPRRKSEPRRFRSVSVGIFAKIFIRSSTFFVRSSSFFGLQP

SEQ ID NO: 188150 - protein, 63 aa, Glycine max
  Coding DNA Sequence Number=SeqID_71372
  Subcellular localization annotation: CTP_CleavageSite=38; ConfidenceScore=5.05e-01
MAESLKKRKGSSSTTTAAGQRRHNTSSDPPVHQIPIVVDQSLFYSLTKLSSQGVPFEGILVDD

SEQ ID NO: 188151 - protein, 121 aa, Glycine max
  Coding DNA Sequence Number=SeqID_71373
MRPWINKDQGGPSNQPPNQGPNLNEQTTKLEDTLTQFMQVSMSNHKSRQSAIKNLEVQVGQLAKQLAKKSIGIFMANTEKTPKEESKAVVNRSHGTKRVEKREENTGGEVENEKEKEGENE

SEQ ID NO: 188152 - protein, 69 aa, Glycine max
  Coding DNA Sequence Number=SeqID_71374
MASVWRSLKGVSISEIGSSTFLFQFFHNVDIHSVLKGQNIAKFLGQFLDYDDKNNPNLWRPFMSVKMKS

SEQ ID NO: 188153 - protein, 201 aa, Glycine max
  Coding DNA Sequence Number=SeqID_71375
MDVDAMISSQISQIAQSNSSRLGFLTLITTLCEAWGVVSDSLTFEFLSSTINLAYIRKNCWNPVDPSITFPGSLKATTRAPVEAPPVAPPPPKSLASSFSSTPPDQLVPMLQSIHHGQCVVIQSIHHFSEQQPVISLQDFLEQVAWPTIQTSLVGVGDVVSAEIAQNPAGEVDYVDVGDADPEMDADYVANVTATQGAWDP

SEQ ID NO: 188154 - protein, 78 aa, Glycine max
  Coding DNA Sequence Number=SeqID_71376
MENRVRECGVERDGLGGVEGLPKELWQWWPIVVVEDDETSLTILPFGEVSKNFNWVWGAIRETGEMSVWNLEREKSHI

SEQ ID NO: 188155 - protein, 59 aa, Glycine max
  Coding DNA Sequence Number=SeqID_71377
MGCLALHGHEGLKCTKGSQVSGWELSMPCALSTPSPDYRFSMLLLCAKQKPSRLATTTC

SEQ ID NO: 188156 - protein, 57 aa, Glycine max
  Coding DNA Sequence Number=SeqID_71378
  Homolog annotation: Hit_ID=Q1S365; Match level="QueryCoverage=70%, HitCoverage=3%, E-value=7e-12, Identity=75%"; Hit description =Lissencephaly type-1-like homology motif; CTLH, C-terminal to LisH motif; WD40-like; ...
  Homolog annotation: Hit description=Quinonprotein alcohol dehydrogenase-like
MRYFEDMVRNREWDKVDKYLSGFMKLDDNKYSMKIFFEIRKAGRISLSSKISLMRTH

SEQ ID NO: 188157 - protein, 145 aa, Glycine max
  Coding DNA Sequence Number=SeqID_71379
  Subcellular localization annotation: CTP_CleavageSite=59; ConfidenceScore=5.26e-01
MPSPLSHNSLGRAAARLGKFPCNNWLSSINSHALLRRNGSSSLQMPEKTQKKKEKRKSEAEALQSCDHGSLPSSLPFDIIYMITKDDDKGDDKKLKGQSKNEFKMFKIESRTLQDSRGKLNSRIKNPDSRDQGSRLKIQESRKGY

SEQ ID NO: 188158 - protein, 68 aa, Glycine max
  Coding DNA Sequence Number=SeqID_71380
MFLQKVVVSGESNLARLGELGGKLLPHFPINRGRSDGEKRSALPVSWDHLKLVKKIVSVKKIDAETLP

SEQ ID NO: 188159 - protein, 153 aa, Glycine max
  Coding DNA Sequence Number=SeqID_71381
  Homolog annotation: Hit_ID=Q1SMF0; Match level="QueryCoverage=50%, HitCoverage=14%, E-value=1e-07, Identity=39%"; Hit description =Tetratricopeptide-like helical
  Subcellular localization annotation: CTP_CleavageSite=17; ConfidenceScore=5.11e-01
MGVATLSAAVKVKFSASSFAVVGGGKRGTQMVFVRHGRTDDFRIKLIHEWMYEIMSERADMDYENAESCGANEPQVDCSDAFKTSQVFECREDVLRWARSVAHENGFVAVILRSDTNTGSRGRSTFVLIGCERSGEYKCRKKEFIRRDTGTRK

SEQ ID NO: 188160 - protein, 312 aa, Glycine max
  Coding DNA Sequence Number=SeqID_71382
  Gene Ontology: Mol. function=catalytic activity; Cellular component =nucleus; Biological process=spermidine biosynthetic process
  Homolog annotation: Hit_ID=Q70AG5; Match level="QueryCoverage=97%, HitCoverage=87%, E-value=1e-142, Identity=77%"; Hit description =Putative spermine synthase
  Pfam annotation: Domain name=Spermine_synth; Domain location=8-249; Score=233.3; E_value=5.2e-67; Accession=PF01564.7; Description =Sperminespermidine synthase
NDQNHDSSWYEEIIDDDLKWSFKLNSVLHKAISEYQDIALLDTKRFGKALVLDGKMQSAETDEFVYHECLIHPPLLCHPNPKTVFIMGGGEGSAAREALKHRSMDRVIMCDIDKEVVNFCRKYLIVNKEAFSHKKLDLVINDAKAELEKRKEKFDIIVGDLADPLEDGPCYQLYTKSFYEKILKPKLNDNGIFVTQAGPAGIFTHKEVFTSIYNTIKQVFKYVIAYTTHVPSFADTWGWVMASDQPLSICANEMDRRIEARIDGELLYLNGAWFHSSTTMNKTVYQSLQNETHVYTEESARFIPGHGMAFHL

SEQ ID NO: 188161 - protein, 145 aa, Glycine max
  Coding DNA Sequence Number=SeqID_71383
  Pfam annotation: Domain name=CBM_19; Domain location=30-87; Score= -3.7; E_value=0.066; Accession=PF03427.4; Description=Carbohydrate binding domain (family 19)
  Subcellular localization annotation: CTP_CleavageSite=33; ConfidenceScore=5.62e-01
MRQQPRPHRRHNHHGHMLTTQGTTTAAVRVTVNATTTSTSSKVKGKRKFQSCSVMREICDADFFMAICDSRWVVGCEGSFTCMATKKIGSGGGGVKKDSGGVEEDGEGVYGDNEGFAGVESIVGKRERGQRRDMVVRVYYNRCCL

SEQ ID NO: 188162 - protein, 165 aa, Glycine max
  Coding DNA Sequence Number=SeqID_71384
  Homolog annotation: Hit_ID=Q84XG6; Match level="QueryCoverage=64%, HitCoverage=82%, E-value=3e-45, Identity=80%"; Hit description =Erwinia induced protein 2
MPLVLGDINLVAQKENGALETKPNDNKLDREALCHKKENTKFISEGLINRLICKGEISIAILQAFETLVQVVDPDDEVGDGVEEPVEEECGGDEEGVALALHDRFLVAKVLGRGAGISLTARPGFVLPIYVHEKEQAERHHREERLQKVPGHRDQTLSESFQARD

SEQ ID NO: 188163 - protein, 263 aa, Glycine max
  Coding DNA Sequence Number=SeqID_71385
  Homolog annotation: Hit_ID=Q9ZU93; Match level="QueryCoverage=85%, HitCoverage=38%, E-value=4e-40, Identity=43%"; Hit description =Expressed protein
MNNPRLKSCCDVAGGVELLSFVGFELREENGETWAVMEFPSEEQIKFIQRAIVLLESQLVQQGPPKRDDLPSATSTEMGPKAETKPVDRQGAYQIIGSFGQWSRVVWTIRHCENCDRFGQNTSARVDNQGWHMLVKVFFAVPESVAAKIELPDSFYKLSAEEVRREAELRRKKIADSQLLIPKSLKEKQAKVSRKRYTKTIIRIQFPDGVVLQGVFAPWETTIALYEIDVTQHETSHKNNEADFAISMCNLIAFNKGFWEFCQ

SEQ ID NO: 188164 - protein, 118 aa, Glycine max
  Coding DNA Sequence Number=SeqID_71386
  Gene Ontology: Biological process=response to biotic stimulus
  Homolog annotation: Hit_ID=Q53HY7; Match level="QueryCoverage=62%, HitCoverage=38%, E-value=9e-15, Identity=54%"; Hit description =Hypothetical protein c17
MVSTKMRMSSVVLSTENHAETDDVTLDVDGDEEVGDHMDLTEGLNVVVVEDDMTALDKVLVGLQVVEAPHDKPHYRDQGVHLLHHDRAPLCKDTTWVWWQATVLRVILEEKQKERLVK

SEQ ID NO: 188165 - protein, 253 aa, Glycine max
  Coding DNA Sequence Number=SeqID_71387
  Gene Ontology: Mol. function=argininosuccinate synthase activity; Cellular component=chloroplast; Biological process=amino acid biosynthetic process
  Homolog annotation: Hit_ID=Q9SZX3; Match level="QueryCoverage=98%, HitCoverage=61%, E-value=1e-101, Identity=64%"; Hit description =Argininosuccinate synthase, chloroplast precursor
  Pfam annotation: Domain name=Arginosuc_synth; Domain location=1-249; Score=199.4; E_value=8.2e-57; Accession=PF00764.9; Description =Arginosuccinate synthase
MPRPVIAKAMVDAAEEVGADAVSHGCTGKGNDQACLAIREWDITGRELAIEYAKKHNISVPVTKKSIYSRDRNLWHLSHESDILEDPANEPKKDMYMMPVDPEDAPDQAEYVEIEIEWGLPVSVNGKRLWPAYLLTELNEIGGRHGIGRIDMVENRLVGMKSRGVYDTPGGTILFAAARELEFLTLDRETIQVKDSLALKYAELVYAGRWFDPLRESMDALMQKITETTTDAAGFIRLYVLPMRVRAMLEQGI

SEQ ID NO: 188166 - protein, 146 aa, Glycine max
  Coding DNA Sequence Number=SeqID_71388
  Gene Ontology: Mol. function=microtubule motor activity; Cellular component=microtubule associated complex; Biological process =microtubule-based process
  Homolog annotation: Hit_ID=Q6EP41; Match level="QueryCoverage=73%, HitCoverage=46%, E-value=6e-27, Identity=60%"; Hit description =Putative dynein light chain 2
  Pfam annotation: Domain name=Dynein_light; Domain location=34-139; Score=55.2; E_value=2.1e-13; Accession=PF01221.9; Description=Dynein light chain type 1
MEGAQEELERRSKFLKSLIQKKKTIEQQEQHDHLQHNNVRVRACDMPLPLQNRAFRCARDLLDSMPSKKLDTTDLVKNGLILRAIIQYTNEAWIEFDTSYGPAWHCIVGTSFGSYVTHSFGGFVYFSIDKVYVLLFKTAVEPLDHS

SEQ ID NO: 188167 - protein, 220 aa, Glycine max
  Coding DNA Sequence Number=SeqID_71389
  Gene Ontology: Mol. function=zinc ion binding
  Homolog annotation: Hit_ID=Q7EY67; Match level="QueryCoverage=89%, HitCoverage=30%, E-value=3e-33, Identity=36%"; Hit description=F-box protein family-like protein
  Pfam annotation: Domain name=F-box; Domain location=16-63; Score =18.1; E_value=0.033; Accession=PF00646.23; Description=F-box domain
MEESSKSKAVEVEQEASEAKAPHEAMFLVLAYLPVYEVVVMSQVCTSLRDAVNNDILPWLNVFVQRPLSWRLNDDILIKITSKANGSLKTLALINCMHVTDEGLQRVVQQNPLINKKEHLDMLIVNLGKNQPLEEQQEPVYYHKRCNFSVFKQEESRRLIDLEICPSVKTVVDALNPEKWKRETVKISFALNVGYRFPSAVSVTNHIVSNTLIALLQTLH

SEQ ID NO: 188168 - protein, 480 aa, Glycine max
  Coding DNA Sequence Number=SeqID_71390
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94EN5; Match level="QueryCoverage=87%, HitCoverage=85%, E-value=1e-175, Identity=69%"; Hit description=Beta- 1,3-glucanase
  Pfam annotation: Domain name=Glyco_hydro_17; Domain location=58-379; Score=333.2; E_value=4.5e-97; Accession=PF00332.9; Description =Glycosyl hydrolases family 17
  Pfam annotation: Domain name=X8; Domain location=394-476; Score =158.1; E_value=2.3e-44; Accession=PF07983.3; Description=X8 domain
  Pfam module annotation: Pfam domain module=Glyco_hydro_17::X8; Domain location=58-379::394-476
MVTQKNNKESSLMSPEKASGTVGGGLSTAANYYSRLCLFTRQRNLGPRKGYAHGDAFIGVNIGSDISDMPGSTEIVSLLKAQSIQHVRLYDADRALLLALANTGIRVTVSVPNDQLLGIGQSNATAANWVTRNVIAHVPATNITAICVGSEVLTTLPNAAPIIVSAINFIHSALVAANLDQQIKISSPHSSSIILDSFPPSQAFFNRTWNPVMVPMLKFLQSTGSYLMLNVYPYYDYQQSNGVIPLDYALFRPLPPNKEAVDSNTLLHYTNVFDAVVDAAYFAMSDLNFTNIPIMVTESGWPSKGDSSESDATVDNANTYNSNLIRHVLNNTGTPKHPGIAVSTYIYELYNEDLRSGPVSEKNWGLFYANGEPVYTLHLTGAGIIFANDTTNQTFCVTKSNADPKMLQAALDWACGPGKVDCSPLLQGQPCYEPDNVVAHSTYAFNAYYQKMDKSPGSCDFKGVATVTTTDPSMAIHTPT

SEQ ID NO: 188169 - protein, 291 aa, Glycine max
  Coding DNA Sequence Number=SeqID_71391
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q5K6L5; Match level="QueryCoverage=86%, HitCoverage=45%, E-value=1e-112, Identity=78%"; Hit description=Endo- 1,4-beta-glucanase isoform 01
  Pfam annotation: Domain name=Glyco_hydro_9; Domain location=1-276; Score=20.0; E_value=9.1e-15; Accession=PF00759.9; Description =Glycosyl hydrolase family 9
VQVFQFADKHRGAYSNSLHRAVCPFYCDVNGYQDELLWAAAWLHKASRRRQYREYIVRNEVVLRAGDTINEFGWDNKHAGINVLISKEVLMGRADYFASFKQNADGFICSTLPGISHPQVQYSPDPSKAVNYALLTKGKAFDCVFACIGGLIFKAGGSNMQHVTSLSFLLLAYSNYLSHANKVVPCGETSATPALLKHLAKRQVDYILGDNPLGMSYMVGYGARYPQRIHHRASSLPSVAAHPAHIGCKAGSRPHINGRAMEEISEHCNLPWILYLEERIPVGERLHRAMK

SEQ ID NO: 188170 - protein, 206 aa, Glycine max
  Coding DNA Sequence Number=SeqID_71392
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9CAC1; Match level="QueryCoverage=88%, HitCoverage=36%, E-value=4e-81, Identity=80%"; Hit description =Endoglucanase 8 precursor
  Pfam annotation: Domain name=Glyco_hydro_9; Domain location=27-206; Score=17.2; E_value=1.2e-14; Accession=PF00759.9; Description =Glycosyl hydrolase family 9
MAPNALFLFSFLAMLLLLLRSTAAGHNYRDALRKSILFFEGQRSGKLPADQRLRWRHDSALHDGATAGVDLSGGYYDAGDNIKFGFPMAFTTTMLSWSVIDFEKSMGAELGNALKAVRWGTDYLLKATAKIGSGVVFVQVGDPYSDHNCWERPEDMDTLRTVFKIDGSHPGSDVAGETAAALAAASIVFRSRDPSYSTMLLNRAVA

SEQ ID NO: 188171 - protein, 243 aa, Glycine max
  Coding DNA Sequence Number=SeqID_71393
  Gene Ontology: Mol. function=GTP binding; Cellular component=nucleus; Biological process=SRP-dependent cotranslational protein targeting to membrane
  Homolog annotation: Hit_ID=Q208U9; Match level="QueryCoverage=83%, HitCoverage=60%, E-value=8e-75, Identity=67%"; Hit description=CFM6
  Pfam annotation: Domain name=CRS1_YhbY; Domain location=125-209; Score=117.9; E_value=2.9e-32; Accession=PF01985.11; Description=CRS1 YhbY domain
MDRSNIFGIHDILGNWLPARYISNESVELKTDNNVVRFSLDKSDDINYGKKSQLNKRVKMSRKAKLNELRFYRLKAKKKMISPNPEVRITYKLEKAKRKETWLVEKLRKFDVPKSPPETFDPEILTEEERHYLKRTGEKKKHYVPVGRRGVFGGVVLNMHLHWKNHETVKVICKPCKPGQVHEYAEELARLSKGIVIDIKPNNTIIFYRGKNYVQPEVMSPPNTLSKVKGSRGDAQNNMIFVL

SEQ ID NO: 188172 - protein, 184 aa, Glycine max
  Coding DNA Sequence Number=SeqID_71394
  Gene Ontology: Mol. function=enzyme inhibitor activity
  Homolog annotation: Hit_ID=Q1PFE5; Match level="QueryCoverage=63%, HitCoverage=81%, E-value=4e-14, Identity=33%"; Hit description =Invertase/pectin methylesterase inhibitor family protein
MYKIGRHSLVSVGVDERQGIAGELLDVGDAIAYIRFQRDSPLRPGSRPYRFLRREGGARGAVVVGVAREVGDVGGGAVDLGEAHGDGNARQLAGVLLHRTGVAREGGEAHVRVERGVAASAYEIGVAVAVAWGGCAFVSGGGRRVKAGECGCEEEEGEKEMVKTLGSHCLFLSVMVCAVSSVCP

SEQ ID NO: 188173 - protein, 88 aa, Glycine max
  Coding DNA Sequence Number=SeqID_71395
TKNKVAFSKSGTERKKKEEILKQAQSNRGAQRASGAKRATNWRRWAWQKPLRALSQPGAQRPIQQKHRPSVHGAPSARSERAKREVWR

SEQ ID NO: 188174 - protein, 81 aa, Glycine max
  Coding DNA Sequence Number=SeqID_71396
MSWKFHKLPNDGSQAPHEETKEWSNSVIEQRSRGSRLEVLGNKVIGLRKKSGEWRIGEQRYAITSRGSRLEGGGHMNSARQ

SEQ ID NO: 188175 - protein, 50 aa, Glycine max
  Coding DNA Sequence Number=SeqID_71397
PLDPEDNVSATNRENVEGGGRGGGKLEIFSNPGLNKIVGAPFVDEHCDTG

SEQ ID NO: 188176 - protein, 38 aa, Glycine max
  Coding DNA Sequence Number=SeqID_71398
MATAIVTKMTAILVARVTFFKNPFFPLNNGALKRCTLT

SEQ ID NO: 188177 - protein, 126 aa, Glycine max
  Coding DNA Sequence Number=SeqID_71399
MEVDEPWLGLWLPLNYQVDMGASQPRILELGIGRVVGGFCGVILGMAFVDNWMVGKEKTHIDPFTGKDQIRKALKVPLELPGSPPLGVFFERSEWTREGSKLVYQMVLGASNPLVLVKVQHLELGR

SEQ ID NO: 188178 - protein, 381 aa, Glycine max
  Coding DNA Sequence Number=SeqID_71400
  Gene Ontology: Mol. function=signal transducer activity; Cellular component=membrane; Biological process=signal transduction
  Homolog annotation: Hit_ID=Q5PFG0; Match level="QueryCoverage=94%, HitCoverage=89%, E-value=4e-53, Identity=34%"; Hit description =Putative membrane protein
  Pfam annotation: Domain name=GGDEF; Domain location=243-381; Score =120.3; E_value=5.5e-33; Accession=PF00990.12; Description=GGDEF domain
  Pfam annotation: Domain name=HAMP; Domain location=161-231; Score =25.8; E_value=0.00016; Accession=PF00672.15; Description=HAMP domain
  Pfam module annotation: Pfam domain module=GGDEF::HAMP; Domain location=243-381::161-231
MKFDSIKKDKSSIRNKLRRISTVNAAVILLLCWLLLTSTSLLFIKRYEKRNLELIAATLSTSLTAATVFEDSYDARNKIALLGNEGMFASAKLVTAGNTVLVDWHDRQQESGWYETLLRRWIYQQPLAVEINHAETQVGHLMLAGTVSGAADFIRYSVMILSIGMLCVLVISCLLSEFLHRGILRSLRNITSAIHYVIRSGDFSTRVPQNPTKEFQLFSEDLNSLLSEMQTLKASLLRDNRSLAAKALEDPLTGLANRSAFVGRLSQLLDQQLAHENFVLLFLDGDRFKSINDNWGHAAGDEVLKAIAARLSALAYQDDLVARLGGDEFAMLITSRTSEADLQQLTEDIRTAIAQSIVISEGTQITTSVTIGYAWSQHGDS

SEQ ID NO: 188179 - protein, 139 aa, Glycine max
  Coding DNA Sequence Number=SeqID_71401
  Gene Ontology: Mol. function=structural molecule activity; Cellular component=extracellular region; Biological process=keratinization
  Homolog annotation: Hit_ID=UPI0000612705; Match level="QueryCoverage =93%, HitCoverage=91%, E-value=1e-19, Identity=29%"; Hit description =UPI0000612705 related cluster
DYTSSPLEGCTPSPSEWLHALTLIGLHALTFRGLHALAFRGLHALAFRGLHALAFRGLHALTFRGLHVLTFRGLHALAFRGLHALVFRGLHALAFRGLHALAFRWLHAFAFRGLHVLAFRGIHALTVRGLHALVFRGLC

SEQ ID NO: 188180 - protein, 824 aa, Glycine max
  Coding DNA Sequence Number=SeqID_71402
  Gene Ontology: Mol. function=RNA-directed DNA polymerase activity; Cellular component=nucleus; Biological process=RNA-dependent DNA replication
MAETCDSNNKVIREYHSDDSFMSRCDIFTDVTEYQLCLASARESGQGKFEPKWDTKIVTPHLIEQFKLNCAASNLPVKVFVSIGGKDPFKVVAGGADDWVLNATTTLHHMINEYHIDGIDVKYARILCNKDMFVNCIKDLIRGLREALCTTGFVASLAPNAATNEAFYLPLYRSIDNSWIGTVVFQCFVDFEPKDPNRSVEILVRQVEKIVEEYDYYDSKILLGYSAIKEDWNKVSPPLFFLALNRLVHSWPRVKGASVKVLSDNFAFIPPTWIPKLLSLAVSDEIGSRLLELRPTITILIETRVKQVKARNIRNKVRLQAIYALNKLDQRRTLWTDIECIHGNQHGPWVLLGDFNNVLKAKDRMGGNLVTESEYEDLTKMMRNTGTFEKDSTGDYYTWSNKQTDGMIYSRIDRVVGNVEWFQDNMDTMLQILPPSVSEHALLCLADPGNTAGRQFHFKFSNCLTDLEEYHSTVSNSWNEPLNGRPMYVLWEKLKRLKPALNKINRPLHHIQSRIMEARQNLQHAQKSLVEDRWNSSKIDTVKRYTEEVINWNSLEEKTLQQKSKIDWLRLGDGNNSYFHATIKAKKSSKRLNLLHKDDGTVITSHDEIQDEVLNFYEGLMGTKDGNVRHINIMAMRGGPQLSMEQREQLVAPITDQEIRKALNGIGDTKSPGIDGFGAKFFKTSWNIIGKDVVAAVRDFFENDRIYKAFNCTLVTLIPKNEEAKTIKEYRPIAGVMDSIVGKNQAAFVPGQKIHNHILLAYELIKGYSRKGGTPRCMMQIDLQKAYDMVNWDALECILKEIGVPQQFIRWIMIAVTTVSYRFN

SEQ ID NO: 188181 - protein, 286 aa, Glycine max
  Coding DNA Sequence Number=SeqID_71403
  Gene Ontology: Mol. function=aspartate-tRNA ligase activity; Cellular component=cytoplasm; Biological process=tRNA aminoacylation for protein translation
  Homolog annotation: Hit_ID=O81892; Match level="QueryCoverage=91%, HitCoverage=41%, E-value=7e-77, Identity=57%"; Hit description =Putative aspartate--tRNA ligase
  Pfam annotation: Domain name=tRNA-synt_2; Domain location=196-286; Score=-210.8; E_value=0.082; Accession=PF00152.11; Description=tRNA synthetases class II (D, K and N)
  Pfam annotation: Domain name=tRNA_anti; Domain location=89-174; Score= 88.5; E_value=2.1e-23; Accession=PF01336.15; Description=OB-fold nucleic acid binding domain
  Pfam module annotation: Pfam domain module=tRNA-synt_2::tRNA_anti; Domain location=196-286::89-174
  Subcellular localization annotation: CTP_CleavageSite=46; ConfidenceScore=5.77e-01
MSLFLKALPLMAFRTRPCLVFLCRVSNTIPLSLSRTSTRTRTVFSNSASASETLTSNAKPPLALSEPLEWVNRTAFCGKLSSNDVGKSVQLCGWVALHRVHGGLTFLNLRDHTGIIQVTTLPDEFPDAHSAINDLRLEYVVAIEGVVRSRPNESINKKMQTGFIEVAANRVQVLNSVNSKLPFLVTTADDAKDSLKEEIRLRYRCLDLRRQQMNFNILLRHKVVKLIRRYLEDIHGFVEIETPILSRSTPEGARDYLVPSRIQKQCWWQTLDSDSMSANFLPVSKR

SEQ ID NO: 188182 - protein, 395 aa, Glycine max
  Coding DNA Sequence Number=SeqID_71404
  Gene Ontology: Mol. function=aspartate-tRNA ligase activity; Cellular component=cytoplasm; Biological process=tRNA aminoacylation for protein translation
  Homolog annotation: Hit_ID=Q8GWM7; Match level="QueryCoverage=99%, HitCoverage=75%, E-value=1e-177, Identity=75%"; Hit description =Putative aspartate--tRNA ligase
  Pfam annotation: Domain name=GAD; Domain location=127-226; Score =89.1; E_value=1.3e-23; Accession=PF02938.5; Description=GAD domain
  Pfam annotation: Domain name=tRNA-synt_2; Domain location=1-371; Score=406.2; E_value=4.7e-119; Accession=PF00152.11; Description =tRNA synthetases class II (D, K and N)
  Pfam module annotation: Pfam domain module=GAD::tRNA-synt_2; Domain location=127-226::1-371
MKPGTFYALPQSPQLFKQMLMVAGFDKYYQIARCFRDEDLRADRQPEFTQLDMEMAFTPYEDMLTLNEELIRKVFLEIKGVELPNPFPRLTYAEAMSRYGSDRPDTRFDLDLKDVSDIFSGSSFKVFSDSLENGGVIKVLCVPSGTKKYSNSALKKGDIYNEALKSGAKGLPFLKVLDDGNIEGISVLVSSMDPTTRGNLLRRCSAGPSDLILFAVGHHASVNKTLDRLRVYVAHDLGLVDHGRHSVLWITDFPMFEWNDPEQRLEALHHPFTAPNPKDMNDLASARALAYDMVYNGVEIGGGSLRIYKRDIQQKVLEVVGISMEQDLDKKGVQLLANRESCIAYGLDRLVMLLAGANSIRDAIAFPKTTTAHCALTRSPSEVDPQQLKDLSITT

SEQ ID NO: 188183 - protein, 392 aa, Glycine max
  Coding DNA Sequence Number=SeqID_71405
  Gene Ontology: Mol. function=enzyme inhibitor activity; Cellular component=cell wall; Biological process=cell wall modification
  Homolog annotation: Hit_ID=Q1SUX5; Match level="QueryCoverage=83%, HitCoverage=69%, E-value=1e-129, Identity=71%"; Hit description =Pectinesterase; Pectinesterase inhibitor
  Pfam annotation: Domain name=PMEI; Domain location=16-167; Score =91.6; E_value=2.3e-24; Accession=PF04043.6; Description=Plant invertasepectin methylesterase inhibitor
  Pfam annotation: Domain name=Pectinesterase; Domain location=215-391; Score=270.1; E_value=4.4e-78; Accession=PF01095.10; Description =Pectinesterase
  Pfam module annotation: Pfam domain module=PMEI::Pectinesterase; Domain location=16-167::215-391
MDKLFFNHCFIGYCLLYSLLLVHGKQLSCNETPYPSVCKHYIETTKTLSALDASPSSFHDMALKVTMVQAMEAYKLVSNMDLNNFKDKRAKSAWEDCLELYENTLYQLKRSMNSNNLNDRMTWQSASIANHQTCQNGFTDFNLPSHLNYFPSMLSNLSGLLSNSLSISKAMTLRSLSSSPTTKQSGGRKLLSDGFPYWLSRSDRKLLQETASKADVVVAQDGSGNYKTISEGVAAASRLSGKGRVVVHVKAGVYKENIDIKRTVKNLMIVGDGMGATIVTGNHNAIDGSTTFRSATFAVDGDGFIARDITFENTAGPQKHQAVALRSGADHSVFYRCSFRGYQDTLYVYANRQFYRDCDIYGTVDFIFGDAVAVLQNCNIYVRKPMSNQQNT

SEQ ID NO: 188184 - protein, 463 aa, Glycine max
  Coding DNA Sequence Number=SeqID_71406
  Gene Ontology: Mol. function=sequence-specific DNA binding; Cellular component=intracellular; Biological process=regulation of transcription, DNA-dependent
  Homolog annotation: Hit_ID=Q26PW0; Match level="QueryCoverage=42%, HitCoverage=87%, E-value=2e-41, Identity=45%"; Hit description =Regulatory protein GntR, HTH
  Pfam annotation: Domain name=FCD; Domain location=331-455; Score =89.4; E_value=1.1e-23; Accession=PF07729.2; Description=FCD domain
  Pfam annotation: Domain name=GntR; Domain location=259-321; Score =53.7; E_value=6.2e-13; Accession=PF00392.11; Description=Bacterial regulatory proteins, gntR f
  Pfam module annotation: Pfam domain module=FCD::GntR; Domain location= 331-455::259-321
ARSACCVAALAVRSPARSCWLACHKVVIRASSGNHRQRAGDIVVFQRAIQQRIVQRHAELAGRTDAADRAQPRQQIPRREQRVERALLISHPVAVDFDPRAQLQPIPVRLNLCHTPRMTGDRLNAGLLRQCHAEGFQVTVGVIGNQRHPVFAAMEKHKRLGFAGGLLAHHFQRAVLRQLLGGYAIKQRDCTRCGHAQRLQLPDMVQHRRLVAANPSGNDQLLNVDIQHRGGFTPIRICVMSDSIAENVKSQAGQKSVSLNEQAYLAFRHRLITLRYKPGEYLNTAQVMEDLAMGRTPVNQAVHRLATEGLLQIIPRKGVMVAPLSIDDALELIEVRLVNEALCLRLATQRVNPAQIAQLKALNQRIAAASVARDREQMMLLDREFHQVLADIAGNGRLSDILSIIHAQAQRFWATTLSSAQHMQEVIAEHDAIIAALAQGDVTRAEDAARVHIYSFKQALLNA

SEQ ID NO: 188185 - protein, 261 aa, Glycine max
  Coding DNA Sequence Number=SeqID_71407
  Gene Ontology: Mol. function=transcription factor activity; Cellular component=intracellular; Biological process=regulation of transcription, DNA-dependent
  Homolog annotation: Hit_ID=P24242; Match level="QueryCoverage=96%, HitCoverage=75%, E-value=5e-84, Identity=59%"; Hit description=HTH -type transcriptional regulator ascG
  Pfam annotation: Domain name=Peripla_BP_1; Domain location=2-246; Score=-8.2; E_value=3.5e-06; Accession=PF00532.11; Description =Periplasmic binding proteins and sugar b
MMQHSARILEQQGRQLLLVDGKHSAEEERAAIQFLLDLRCDGVIIYPRFLTIDEMDSIIAQHRHPILVINRRLRQHDSYCIYSDQQRTSAEAVAQLIALGHRDIAFITGSLDSPTGRERLAGYHAALAQHQLVADDALVVEGKWQAQHGAAAVETLLARGKPFSALVASNDEMAVGALKALAAHNIRVPQQVAVLGFDDIPLAPYTIPALASVRMPVTGMIEETIERLVSMLDGGEMRNRKTFAGELIMRESVGPGPFYPG

SEQ ID NO: 188186 - protein, 423 aa, Glycine max
  Coding DNA Sequence Number=SeqID_71408
  Gene Ontology: Mol. function=signal transducer activity; Biological process=regulation of transcription, DNA-dependent
  Homolog annotation: Hit_ID=UPI00005F9389; Match level="QueryCoverage =89%, HitCoverage=47%, E-value=3e-44, Identity=33%"; Hit description =COG2200: FOG: EAL domain
  Pfam annotation: Domain name=CHASE4; Domain location=73-231; Score =38.4; E_value=2.5e-08; Accession=PF05228.3; Description=CHASE4 domain
  Pfam annotation: Domain name=PAS; Domain location=315-422; Score=9.7; E_value=0.049; Accession=PF00989.14; Description=PAS domain
  Pfam module annotation: Pfam domain module=CHASE4::PAS; Domain location=73-231::315-422
MTKPEIIKNNCTPTQPNASSGICWVVAAYGNIYDGETFTDGFPDRWSDARTDAPADAADGAADFSLLYGGAGDAVLYRQRSQSAGGAAKPPAAGEGVADASGSDANLGESLFQTFAYEGVFVIAPRGDTVYSVIDGQLQQRDFTDWLGRQQLPALRQQLQHNDGKALSRFVVVNQQLVLLCAAWITTGGDNSVPQEPGAPSLMIFADRLTPQKLQQLGHEYGINALRVEFAAPRAPVAESLRLAAHGHDATLRWTSSNPGGKLLTALLPLLMIAMLITLYGAIMLMRNALRKAQLNDENTLLLAQSQRALSASERRFRDIAEITTDWIWEMDEQLRFSWVSGRFPVVTGFTSEEWLQRTLLDFLLCDEHQRARLLQLADSGGQLTLNGCRYLSAQHQPRYCNLTLKRVSLAHGVSGFRGSASD

SEQ ID NO: 188187 - protein, 496 aa, Glycine max
  Coding DNA Sequence Number=SeqID_71409
  Gene Ontology: Mol. function=transporter activity; Cellular component= integral to membrane; Biological process=transport
  Homolog annotation: Hit_ID=Q1BJ60; Match level="QueryCoverage=47%, HitCoverage=54%, E-value=9e-92, Identity=64%"; Hit description=Major facilitator superfamily MFS_1
MLVAQQLPQRDMTNRFTLCILFSQFAAQPVALFAGQPVGIFRTVAEQEESQHTQHNRREPFDDKQPVPAAQAEPAVHRQDCARDRRANKVGCRDRHHKSRNHARAIFRRNPVSQIKDHAGKEAGFGGAQQKAQHVQHFRTADERGAHRDNAPGHHDARNPDFGANLLHREVAWHLKQKIANKKQAACQAKHRFAQPEIFIHLQGRHADVAAIDNGDQIADDQERQNAPDDAFYGLLLNIGHSGRAGYLHGKIPAFIPPGDSGITLQHLAIFPLRHSAGVVDGLYYPFYMEWTRHAYMREALCIDIEEEFSQGKIYMVLEYTLRFRKSLVKGDKVEVTCALEQNEKRNRVNFVQQIKVDGVVYAEATGNARARSVTLEYVAAACFMPAATLQPASPPAVPPAARAPAPRPDRPTAHRSRPRRAQQQQPPGLYPAHRPADSRESPPALRHGTIHKMRCARSAPDARRSPPSLPCHARQLPAARDDRPHWPPIRDTAQT

SEQ ID NO: 188188 - protein, 192 aa, Glycine max; identical to SEQ ID NO: 170323
  Coding DNA Sequence Number=SeqID_71410
  Gene Ontology: Mol. function=transporter activity; Cellular component= integral to membrane; Biological process=transport
  Homolog annotation: Hit_ID=Q1BJ60; Match level="QueryCoverage=91%, HitCoverage=40%, E-value=4e-36, Identity=45%"; Hit description=Major facilitator superfamily MFS_1
  Subcellular localization annotation: CTP_CleavageSite=53; ConfidenceScore=5.18e-01

SEQ ID NO: 188189 - protein, 419 aa, Glycine max
  Coding DNA Sequence Number=SeqID_71411
  Gene Ontology: Mol. function=transporter activity; Cellular component= membrane; Biological process=transport
  Homolog annotation: Hit_ID=Q9FGR5; Match level="QueryCoverage=99%, HitCoverage=65%, E-value=2e-94, Identity=45%"; Hit description =Transmembrane transport protein-like
  Pfam annotation: Domain name=Xan_ur_permease; Domain location=1-406; Score=-103.5; E_value=0.00029; Accession=PF00860.11; Description =Permease family
MGSNAYFAYTVVGFHGSGNVSYQSALAAVFIEGAIFLLVSAIGLRAKLAKLVPKPVRISSSAGIGLFLAFIGLQSNQGIGLIGYSASTLVTLGACPTSSRASLAPVLTAANGTVSLLPGGTVSGDILCLKDRMESPTLWLGLVGFIIIAYCLAKNIKGAMIYGIVFVTVVSWFRGTKVTAFPNTDAGNSAHEYFKKVVDVHTIKTTAGALSFKNIGKGYFWEAVVTFLYVDILDTTGTLYSMARFAGFTDDKGGFEGQYFAFMSDATSIVVGNHGVDGAGFTDDKGGFEGQYFAFMSDATSIVVGSLLGTSPVTAFIESSTGIREGGRTGITALTVAAYFFLAFFFTPLLASIPAWAVGPPLILVGVLMMRSVVEIDWEDMREAIPAFVTLILMPLTYSIAYGLIGGIGTYIVLNLWDW

SEQ ID NO: 188190 - protein, 87 aa, Glycine max
  Coding DNA Sequence Number=SeqID_71412
  Subcellular localization annotation: CTP_CleavageSite=58; ConfidenceScore=5.23e-01
MDRVTSLLRLLPNTFRAVDVPVTSSFTLTKESALRSPYRTCARARVMGKAEEVQEKVKADMEAMKEKMATMMEAIDKHEEDTGSQCG

SEQ ID NO: 188191 - protein, 69 aa, Glycine max
  Coding DNA Sequence Number=SeqID_71413
MVTSILQLDSMNLFVKARAWFNPITQGMAILIANTSSKIHRDAKLGNMHAMHGKCNYEIEMPEETSFLS

SEQ ID NO: 188192 - protein, 108 aa, Glycine max
  Coding DNA Sequence Number=SeqID_71414
  Gene Ontology: Mol. function=transporter activity; Cellular component= membrane; Biological process=oligopeptide transport
  Homolog annotation: Hit_ID=O22305; Match level="QueryCoverage=98%, HitCoverage=18%, E-value=1e-39, Identity=71%"; Hit description =Peptide transporter
MEHKGYTLDDTVDLSGRPVLSSTTGKRKACIFILAYQAFERFAYFGVSANLVIYMTSELHKDLVSAVTSVNNWSGTAWITPIVGAYIADSHLGRFWTITFALLIYAMA

SEQ ID NO: 188193 - protein, 83 aa, Glycine max
  Coding DNA Sequence Number=SeqID_71415
DQPSSSGGGGASAADELDTEEPLAPAHVEEETTPDQTPQPCPAPAHIPEDAAPVAESEQLIQDSSAAPTLDLNEDQPQEEKDV

SEQ ID NO: 188194 - protein, 79 aa, Glycine max
  Coding DNA Sequence Number=SeqID_71416
MASRKRVRTDDIPSSSIPPPHLRELAQNRTIVPLEYFLEKVVWSEAQLPLVRPNEVAPPEPAPAQVELMSAEPQTPVVN

SEQ ID NO: 188195 - protein, 188 aa, Glycine max
  Coding DNA Sequence Number=SeqID_71417
MSLYSSSSVTGKGSTPKDPFSRNSCKSLSEELRDYYEGRHRAHLRPHSHWREKERKPQEANINLQYFHGNDNVEANLDWEIRVEQQLKRKSTSKSYGSHSYPKKDQGQGILGVTPSKPKDDKGKTIEKQPLNNINPIHQTNANRIIIVITNDVQSVKVQSNALEIVQSNQFLNFLGSQIRLENPANNL

SEQ ID NO: 188196 - protein, 116 aa, Glycine max
  Coding DNA Sequence Number=SeqID_71418
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=54%, HitCoverage=16%, E-value=1e-28, Identity=89%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=15-114; Score=-67.4; E_value=4.1e-08; Accession=PF00346.9; Description =Respiratory-chain NADH dehydrogenase,
MARDLLWQILVHKPPSSYIFRERELIYDLFEAATGPMLRASGIQWDLRKVDNYECYEEFDWEVQWQKEGDSLARYLVRIGEMMESIKIIQQALEGFPADHMKFRIRCLIEKRARME

SEQ ID NO: 188197 - protein, 71 aa, Glycine max
  Coding DNA Sequence Number=SeqID_71419
MAGTFFLLKQQNSLEIMSAEPPRNISNLHGDEDDDDYLVSNSYVEESLDEDDSVDGISDTDDEVTDMIQPV

SEQ ID NO: 188198 - protein, 120 aa, Glycine max
  Coding DNA Sequence Number=SeqID_71420
SDDSAAVRNGVSRLVDLIFRGQYIPKGALVIFDGLNKELCVGIHLVVIRIVHLGRKSGWLFCAFYFKQAASSLMMAYGGDEFVHPDNAVPVSLTRSGYPRIIPSHHRRMILKKDEKADML

SEQ ID NO: 188199 - protein, 41 aa, Glycine max
  Coding DNA Sequence Number=SeqID_71421
MTKTMTSPTRWWTPITSRISSFQYDWVLPRHDHVVVLSEEL

SEQ ID NO: 188200 - protein, 76 aa, Glycine max
  Coding DNA Sequence Number=SeqID_71422
MTPSPLDRKTKANEAEPRWRDRLVLTKEPYVSHIGTPRFLSETHQGEGGLAYSYSITQGSRMEQLGVTRKPPGWGW

SEQ ID NO: 188201 - protein, 85 aa, Glycine max
  Coding DNA Sequence Number=SeqID_71423
MAPSFQVLERINNNAYRLDLPEEYGVNITFNISDLILFAGGADSEEEEPTNLRSNPLQGGENDAILPRKGPSHQSHEQEALRGLG

SEQ ID NO: 188202 - protein, 297 aa, Glycine max
  Coding DNA Sequence Number=SeqID_71424
  Gene Ontology: Cellular component=periplasmic space; Biological process=polysaccharide biosynthetic process
  Homolog annotation: Hit_ID=Q46636; Match level="QueryCoverage=99%, HitCoverage=40%, E-value=9e-43, Identity=36%"; Hit description =Amylovoran biosynthesis protein amsF precursor
MPRVTQGIMRNVWIEHTRNPGDLSDGAWSIDTLNIEDCGTPFNLNNARVIMRQIGLQSGAKISNDMAGTRWLSTFDYGYRREEHHGTLITGSFRAGYYSGHKVTNNTDTDNWYRLGQLFFPTANQQWVMELIGKADATQPTGTAASPVNLAGTGKTWINLQRLETVWADACHMGQPAVLDIRYSRVGTTYAVVWVKLRANSGDTLINLKTTGPTRFEAGSCSLFQPDFSVVTDTTKMGTLKPAARFGLHNGVAGIGANEKGVLTVATAAGTPTNKTTPTGFVLVNINGVDRKLPYYD

SEQ ID NO: 188203 - protein, 56 aa, Glycine max
  Coding DNA Sequence Number=SeqID_71425
MAPENPCPDVEMNTHYLHYLVSVSIIKGTMLGGLCGDPDIRYLGVMIRFRRSVADV

SEQ ID NO: 188204 - protein, 107 aa, Glycine max
  Coding DNA Sequence Number=SeqID_71426
MHGPQAHGPELDQGGMVDVPRRLAKCEDETTRQPWRIKSLQEAGVVPLGGHKGDPCLMHPGAPHDMETCSAVEELLQRMIDQGQLEIGDEDEKEQHVYMQSVDKESP

SEQ ID NO: 188205 - protein, 180 aa, Glycine max
  Coding DNA Sequence Number=SeqID_71427
  Gene Ontology: Mol. function=nucleic acid binding; Biological process= RNA-dependent DNA replication
  Homolog annotation: Hit_ID=Q6L424; Match level="QueryCoverage=77%, HitCoverage=27%, E-value=2e-12, Identity=31%"; Hit description=Zinc knuckle family protein
MRTRQTSKLINVIDKDSDKTSEQASEEGLMFEKKINPINTKHWKTPSKLYYQKPTAPNLLLEERGFSGQLKGWWNNYLTNDEKSRIYSAIKMDLNRKVITNDDNEGIPDTVNTLIFTIAQHFIPSLWKDRSAELLSNLKCRTLVDFRWYRDIFLTRVYTREDNQQPFWKEKFLASKISRR

SEQ ID NO: 188206 - protein, 159 aa, Glycine max
  Coding DNA Sequence Number=SeqID_71428
MAEEVAIDKKNRGLALKTSIPSSDKSEDDNVEGSKAQNLNLLVRRFNKFLKKKKNYGNITFQPKKNYLPRMDSLASSAKRQKQQGDKTNKSSFKRKKKAYISWDDNESTTSSDNSEEEEANLCLTTNNEAENKVTISDLEDNGNYDQLLDAFNEMHQEA

SEQ ID NO: 188207 - protein, 164 aa, Glycine max
  Coding DNA Sequence Number=SeqID_71429
MKGTYYTDLVKVFYTTTHIDAKGKQHFGTGPLMLEHRFLAYDVGWSITPRESNHTQLTEKDLLLIRLMQRNLKINWVNIIVGIMLNTKRIGFFKCPYAILIYGILDYFGVDTQEEVFGFVEAEFKVKTKVLKQMGYIKSEEARIGWKEKSREDQTKQEEVEEKP

SEQ ID NO: 188208 - protein, 102 aa, Glycine max
  Coding DNA Sequence Number=SeqID_71430
MKDKYIVLSLLKNLEKIKIKLVRTSFVCMISTRQDVVYTNEHILKAYSAQWWPLGNEAAIPPSNDAWTLIPDPTTIRAKGWPKSTRIRNEMDWVEPSEHRQK

SEQ ID NO: 188209 - protein, 170 aa, Glycine max
  Coding DNA Sequence Number=SeqID_71431
KTDLTPSCMLHSARGDIAQLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPGSRTDHRTLFKKRNALAIRSQYDESCELCSGGSYVIVAYGRSVGLRRGLPCADT

SEQ ID NO: 188210 - protein, 217 aa, Glycine max
  Coding DNA Sequence Number=SeqID_71432
  Gene Ontology: Mol. function=RNA-directed DNA polymerase activity; Cellular component=intracellular; Biological process=RNA-dependent DNA replication
MAPEDMKKTMFVTFWGTLCYKVMSFWLKNAGATYQQAMVALFHDMMHREIEVYVDDMIANSKTKGEHLVNLWKLFERLRKYKLRLNPTKCTFGVKTGKLLGFDMKGDRSGPREGSYHNSRPPVSHSSSSYARTNPFVGMMTVKRHLEVSYPNFVQGPLLDDMRPLFGPWVQIATRPTWALQKIPPEGCCFWRKQPGSPGRAELAWASWAATISPILL

SEQ ID NO: 188211 - protein, 143 aa, Glycine max
  Coding DNA Sequence Number=SeqID_71433
MRGAPLEESLMPFTARGFRNPNMRILQGVHKAWEALQRMDKELRGSSNGIIDGYRKWLKAYTQGLDMLPKLRAAREAESETSKEREEVQALKAELERTRAAKERFKLTAVKTKKEYDELRDVNTATAKALEQETKRDRMEEDS

SEQ ID NO: 188212 - protein, 74 aa, Glycine max
  Coding DNA Sequence Number=SeqID_71434
  Subcellular localization annotation: CTP_CleavageSite=38; ConfidenceScore=5.31e-01
MVLCLPLPAPFGVVGVQCPGSGCIKQVSPLLPLRGTTPASYRASKINPLQATTSSKCLGRSDPHTSTAFTVGPP

SEQ ID NO: 188213 - protein, 116 aa, Glycine max
  Coding DNA Sequence Number=SeqID_71435
  Pfam annotation: Domain name=G-patch; Domain location=4-45; Score =18.6; E_value=0.001; Accession=PF01585.13; Description=G-patch domain
MAFMVAHVMLEHGYEPNMGLGKNNDSRPDLVNIKENYGKCGLGYKPARANQKKSGGGRRNWGTSPPLRPQVKEAPPCHLKESFVSVGLRCKEEVAMIHDGPLQERPGWVQPCLPGF

SEQ ID NO: 188214 - protein, 156 aa, Glycine max
  Coding DNA Sequence Number=SeqID_71436
  Gene Ontology: Mol. function=RNA-directed DNA polymerase activity; Cellular component=intracellular; Biological process=RNA-dependent DNA replication
  Subcellular localization annotation: CTP_CleavageSite=33; ConfidenceScore=5.15e-01
MAKVLIDNGSSLNVMPKSMLEKLPFNAFHLRPSSMVVRAFDGSRREVRGEIDLLVQVGPHTLVVVPSTLHQKLKFVVRRLLVIVSREEDLLVSCPSSIPYVEVAEESLETTFQSFKVVSNVMQSYPLRVLDRRLQEAWDRATKEGPRVLMNLRVDF

SEQ ID NO: 188215 - protein, 89 aa, Glycine max
  Coding DNA Sequence Number=SeqID_71437
MVLKDELKACLQSKRGLSQQLSKTKECWPSSEAKGRVIDSLHQEATMWMDHFAFALNGSQDLPRPLAKAKAMVDVCSPLEEISSSRAKE

SEQ ID NO: 188216 - protein, 94 aa, Glycine max
  Coding DNA Sequence Number=SeqID_71438
MHEGMLMWCMMQRRLANTRARNIVSSYLKHLRAELPPPMCVQLRRLNRQVCENADFELLAKPICRLSKPSTKRNTPVAERKEEFGRRMSCTCML

SEQ ID NO: 188217 - protein, 102 aa, Glycine max
  Coding DNA Sequence Number=SeqID_71439
YKRLNPLIQLLCKLEAIVFVEELMNLAVGYPKMILLKSKEEISIKIKGKDGGHIQGINSTKIKDLTCIKGPPTKQIAENSSGGFGAKTEKNPYEECKVVENE

SEQ ID NO: 188218 - protein, 127 aa, Glycine max
  Coding DNA Sequence Number=SeqID_71440
  Gene Ontology: Mol. function=RNA-directed DNA polymerase activity; Cellular component=intracellular; Biological process=RNA-dependent DNA replication
  Homolog annotation: Hit_ID=Q1S7B8; Match level="QueryCoverage=89%, HitCoverage=17%, E-value=9e-13, Identity=40%"; Hit description=RNA -directed DNA polymerase
MADTFPHEVGHIRIHPHSRDDWVWKLDSSGQYSAKSAYHALRGHITEGEEVADFEELWKLRIPSKAGVFVWRLLRDRLPTKENGRGCNTFILPLQQDYTPLVGSFVLGQNPQCIPAAPKATLLPTYG

SEQ ID NO: 188219 - protein, 315 aa, Glycine max
  Coding DNA Sequence Number=SeqID_71441
  Gene Ontology: Mol. function=nucleic acid binding
  Homolog annotation: Hit_ID=Q8LHL0; Match level="QueryCoverage=35%, HitCoverage=44%, E-value=8e-07, Identity=33%"; Hit description =Putative splicing factor, arginine/serine-rich 2
  Pfam annotation: Domain name=RRM_1; Domain location=62-132; Score =32.1; E_value=2e-06; Accession=PF00076.12; Description=RNA recognition motif. (a.k.a. RRM, R
MERKSRERNSGWERVRIRKERRVSARLRTREGSRLTTERITTGQRQSYRRANWRDHKDVISFYFTRIPEDATAEELWSHFKQKGDVREVFIPRKRNNQGRRYDFVRYKGVRDMHQLQQQLDNMVFGGLKMNVNVPKYGRTKKGEQQTVERGRAETRQTQKGSREMYLGRISGRKMGVQRRSYAEVLNWNIRTPAQTRIPDTLEYTSSKSTSEVSLDIPIMGKQWLNKAWVGRLKNLAVFDSIEEDIWWDNGQNISPKYVGDDMVLLLGLTEEKAERMLNEEDEGWGNLFYSIEKWNPNRRPGFRLTWLQCWGIPL

SEQ ID NO: 188220 - protein, 54 aa, Glycine max
  Coding DNA Sequence Number=SeqID_71442
  Subcellular localization annotation: CTP_CleavageSite=31; ConfidenceScore=5.05e-01
MGIFKFCHFSPMVLPGTLSYPNQFSSLVEPNLMRVFVHSPTLQHSPLEKALILV

SEQ ID NO: 188221 - protein, 174 aa, Glycine max
  Coding DNA Sequence Number=SeqID_71443
  Gene Ontology: Mol. function=RNA-directed DNA polymerase activity; Biological process=RNA-dependent DNA replication
  Homolog annotation: Hit_ID=Q2HTK5; Match level="QueryCoverage=85%, HitCoverage=68%, E-value=1e-09, Identity=27%"; Hit description=H+ -transporting two-sector ATPase, alpha/beta subunit, central region
MGAHTNTRWERDFIWRRSLFDNEIDMADSFLRDVEGNPIQSLRRDDWIWKADPSGQYSTQSAYNLLMGETIGETHDGASKELWKLKIPSKTSIFAWRNKEEDATHLFFHCSKILPIWWESLSWVNILGAFPQKPRQHFLQHVEVLVDGSDMHHMTAEEQHSVLQRHLQWQQTVG

SEQ ID NO: 188222 - protein, 52 aa, Glycine max
  Coding DNA Sequence Number=SeqID_71444
IFRVSEKIENINDQYCALRAEELSTYMLERRSMGLSLNEWEWGLLLQQNNEK

SEQ ID NO: 188223 - protein, 248 aa, Glycine max
  Coding DNA Sequence Number=SeqID_71445
  Gene Ontology: Mol. function=ubiquitin thiolesterase activity; Biological process=ubiquitin-dependent protein catabolic process
  Homolog annotation: Hit_ID=Q2R2A3; Match level="QueryCoverage=51%, HitCoverage=8%, E-value=5e-51, Identity=76%"; Hit description =Ubiquitin carboxyl-terminal hydrolase family protein, expressed
MHGSRERYLQAVDRIFQYLKTSLGKGLLFKSEGTLPLKVYVDANYAGSVVDKDPTLNTEWLLNLVVAEFRAMTHGMRERLWIKIILDNLEVLEEEKNLGPHDRLIHVYHFLKDTTQNQQQVQNFGHPFLLVIHEGETLTEVKLRIQKKLQVPDEEFSKWKFAFLSFGRPEYLQDSDIVSARFQRRDIYGAWEQYLGLEHTDNASKRSNAANQLHLKRSEGENGEATNLLKGSLLKTIIFLAEMVGGGV

SEQ ID NO: 188224 - protein, 580 aa, Glycine max
  Coding DNA Sequence Number=SeqID_71446
  Subcellular localization annotation: CTP_CleavageSite=29; ConfidenceScore=5.12e-01
MPGTGMDNNNALIGQTEGIRMTSHPSTSRDSQKMQLRRTCGTSSKSGGIEMARKVAPEDKAKGFDERHDNEANRRRQPQQTMNPVSYAAVVERNNRNLGQMWTPHNQHYSREGSHSSVHLDIPMDEKKWFSNAWVGRLKNLTLFDRVEDDLLWDIGAEITPKYIGDDLVLLLDLTNARAEQMIQEEITSGASLFHSLEKWSPRLRTRYRLTWVQCWGIPLLAWDTTQIQKIVTAIGDMVEVDDDVEEVRRMDRTRVLIKTPWRPAIQHTVNVQIGGEVYGVHVVEENGYSTGTCNFRRRSVWGSSEEIESDESDNETPVPEMLCALEKEDELQDKEVPVNHALQRTTSNLNAGGSWVQRFSQKGSRADTTMGSNEEQVERRWMVTADSFRDEGTRNNEWEKVIHENGNHDLRRCYDVSGAHILNGKQPRDPRVAEGGFKNCLGFSIHTPEEATQQSGLSPQNNKKEPIRAWQVYLRNRRCQKQMKMGSANDEYPAILTKPPIKGSQQQHNVDKDQDRSGNSDTNVHMEGPSTHNEAENANSQRPVGRGNISMEYGKRIGGNMWVRAGKNYWQDKGNGGKR

SEQ ID NO: 188225 - protein, 125 aa, Glycine max
  Coding DNA Sequence Number=SeqID_71447
MALCVITQYRESHTSNIRVLLGAPSIFAGAVKVKVRCGGRRRQTRYAEGGGYVADMDDDEWMYEIMFEQTDMDYENEEACGANEPHVDCSDAFNTSQMNGSGMEKEEREETPLQGEDESRRSSPP

SEQ ID NO: 188226 - protein, 91 aa, Glycine max
  Coding DNA Sequence Number=SeqID_71448
MGQALKLAMLFLSTNGSLVERLADLHEASIHQLPTTLIYTIDQKTQAIDQRNKSSKVGSLTGVIAILAITSKHSNIVATPTINALQFTHVN

SEQ ID NO: 188227 - protein, 312 aa, Glycine max
  Coding DNA Sequence Number=SeqID_71449
MQSGSQSKPFDVEIGDGLEDMICDLGQESFQQAHAPVYEGLQSDSKKPLYTGYLLEVAAAQKHKAKRVESVNADAEAFGDHRESSDCSMHSEAEALEHMKKRDRGHQSVSLENKTGDSTMVKMSQKNNNADVDNCMILEDHEGEEHCCGKGTNARSVSFLPRSQEKIGDSAKVMIKQDMKGGEHKYGFNNNKREKPKKVRVVDDETGDKHELYEVLRMPSRCSWSLALLGEDMKHISYIFIVLKFQTLGAYLSQAGNSFTQDIGYGWERLHDCYWHLWLVKKIPVVGLLLWCDYRGNEQGRKSVRTTFWVGH

SEQ ID NO: 188228 - protein, 164 aa, Glycine max
  Coding DNA Sequence Number=SeqID_71450
  Homolog annotation: Hit_ID=Q9XGX0; Match level="QueryCoverage=77%, HitCoverage=40%, E-value=3e-24, Identity=43%"; Hit description =Putative zinc finger protein SHI
  Pfam annotation: Domain name=DUF702; Domain location=109-164; Score =18.3; E_value=5.9e-11; Accession=PF05142.3; Description=Domain of unknown function (DUF702)
MWDNVGVEGAIFGKFQAGGEREERFQEGGQREEGGQDTLFWYNNKNDDVSSDHRGGGFELWNQQQLIGQGPPPQPQPLFHQDLYSALGVGPSKTISDDQSWSRSRFMLGSVVGGGISCQDCGNQAKKDCPHMRCRTCCKSRDFDCQTHIKSTWVPASRRHERLQ

SEQ ID NO: 188229 - protein, 76 aa, Glycine max
  Coding DNA Sequence Number=SeqID_71451
MKKKKTETVGDVRESRVNAGRRSKKPVRKNRRKPQEEEKETQAGRERERVSVLSTYRAENDGFDAQVEGKENIEVV

SEQ ID NO: 188230 - protein, 35 aa, Glycine max
  Coding DNA Sequence Number=SeqID_71452
  Homolog annotation: Hit_ID=Q5ZBH8; Match level="QueryCoverage=89%, HitCoverage=9%, E-value=4e-08, Identity=78%"; Hit description =Putative auxin-induced protein
MENGPVARVASNALVSATVISIIITVLTPLYPLKT

SEQ ID NO: 188231 - protein, 75 aa, Glycine max
  Coding DNA Sequence Number=SeqID_71453
MNALLELKLLHPRKTMICLQPNLITSQEKSFGFNLCVCDCAKMKNKKVVMAGVSLSEACAFSENHPLSEALSLLS

SEQ ID NO: 188232 - protein, 134 aa, Glycine max
  Coding DNA Sequence Number=SeqID_71454
  Pfam annotation: Domain name=zf-CCHC; Domain location=114-131; Score =13.7; E_value=0.0053; Accession=PF00098.13; Description=Zinc knuckle
MKKIQGLQAPHGATSALRKYTKDEGFRREKSLALSSQKNKKASSPKEQVLRSSSKALKVEDEFDDESEEDSDEDELSFISHKIFKMWRNKGGSKWRKPSRKTPREKKEKDNSSIVCYECKKSGHWMSRYGEKSR

SEQ ID NO: 188233 - protein, 70 aa, Glycine max
  Coding DNA Sequence Number=SeqID_71455
  Gene Ontology: Mol. function=ribonuclease H activity; Biological process=DNA integration
MSHRRLYQSRMKNTFDRRVHLRKFSKGDLVLMKVSQVQKDHRGGALLLMNMGDEELPSPVNSDIVKQYYA

SEQ ID NO: 188234 - protein, 68 aa, Glycine max
  Coding DNA Sequence Number=SeqID_71456
  Homolog annotation: Hit_ID=Q5ENY4; Match level="QueryCoverage=64%, HitCoverage=8%, E-value=2e-09, Identity=75%"; Hit description =Respiratory burst oxidase 1
MAQEANCPSYILYNIFFILALFDQCLGLNKESEAFAEKLFDTLARQRGLIKMQMAESPRKKLKRYNTK

SEQ ID NO: 188235 - protein, 141 aa, Glycine max
  Coding DNA Sequence Number=SeqID_71457
QLILDAIYHFVGIAPPRHPVDPEKSNRALGFPALILGLCQSYGVLGQDQQQQSVADLPSPPPHQPPSLESISAHIQMMELYMQHLANHPYLWPTLEQFRATVAWPWDRPNFSARGGPTEVLGDKDGAEEDEDMVDVMDFFL

SEQ ID NO: 188236 - protein, 49 aa, Glycine max
  Coding DNA Sequence Number=SeqID_71458
MEIVDNNYSQDLKKNEGFQERLVRSMDLGFLGSWHPEPVIQSEKLKWHV

SEQ ID NO: 188237 - protein, 533 aa, Glycine max
  Coding DNA Sequence Number=SeqID_71459
  Gene Ontology: Mol. function=protein serine/threonine kinase activity; Cellular component=membrane; Biological process=protein amino acid phosphorylation
  Homolog annotation: Hit_ID=Q1SHR4; Match level="QueryCoverage=99%, HitCoverage=63%, E-value=0.0, Identity=63%"; Hit description=Protein kinase
MTDYWRNIGFFICVLSIFPLVCFCATFVPVDNYLIDCGATASTSVGTRNFIADNNKDLLSTQEDILATTSLKSVTSSSDDLPLYQTARVFTGSSKYTFKIKQKGRHWIRLYFFPSTYEKYNLSAADFTVSTQNHVLFRSLNMQKDPVMKEYSVNVTSDTLVLTFTPSGNSTAFVNAIEVVSVPDDLIVDDGFALDPSVTSSGLVTQALETVWRVNMGGPTLTPINDTLQRTWVPDQSFLLEPNLASNFSNIKGVKYENRGQATENTAPPTVYGTLTQMNSSNDPRSIFNVTWQFDVSPGFQYLVRLHFCDVVSKALNVLIFNAYVDSKLAASSADPSTTSNNALGVPYYRDLVTAVAVSKTLRVGIGPSDLNKDYPNAILNGLEIMKMNNSMGNLIPGAGSVAITSGSSSKKTGMIVGVSVGVVGAVVLAGLFFVLCRKRRRLVQRQSKTWVPLSINDGTTSHTMGSKYSNGTTLSAASNFEYRVPFVAVQEATNNFDESWVIGIGGFGKVYKGELSDGTKVAVKRGNPRSQQ

SEQ ID NO: 188238 - protein, 139 aa, Glycine max
  Coding DNA Sequence Number=SeqID_71460
  Gene Ontology: Mol. function=transcription regulator activity; Cellular component=nucleus; Biological process=regulation of transcription
  Homolog annotation: Hit_ID=Q8GZ37; Match level="QueryCoverage=87%, HitCoverage=30%, E-value=2e-33, Identity=56%"; Hit description =Putative VIP2 protein
  Subcellular localization annotation: CTP_CleavageSite=6; ConfidenceScore=5.65e-01
MSSLLNSSLNGSASNLPDGAGRSFATSFSGSIQGLHNIHGSFNVPNMPSTLTSRNSTINSVRTGGGVQQPSASLSSGRFASNNLPVALSQLSHGGSHGHSGVNNRGGISVVGNPGFNSNTNGVAGPIPGILPTSAAIVN

SEQ ID NO: 188239 - protein, 51 aa, Glycine max
  Coding DNA Sequence Number=SeqID_71461
MDEPNNRRESRARAFRCEREEEQKITISRKTSSLHQLRATDASPKEENLTQ

SEQ ID NO: 188240 - protein, 170 aa, Glycine max
  Coding DNA Sequence Number=SeqID_71462
CGSNDFQDYFDDSKESRVKQVPKNRASRIKSQRIKIQEQLSFKIQEQSRSRFKTQDSRFKIQEKLISRFKRRNREATVKTSQGKTNRLRILSLNTLEDTSFVAQVKGISTWVVILRTREGTSLVDQFKWRIHPLGCSKRTREDTSLGSLVCKGFYKVERNLKNRWLLGDW

SEQ ID NO: 188241 - protein, 149 aa, Glycine max
  Coding DNA Sequence Number=SeqID_71463
MSLKEKGANVQVLLCCSPFSGRVIEHRRQVGVEMSVEASFMIQEQFKNQEKFDFKIQEKMKSSFKRRNHEDFTREGTSFVVQLEGTSTWVVVTENKRGYISCGSVLLKGISTRLFKENKGGYIPCGSLLVKDFTRLKRNLKDCRSLGDW

SEQ ID NO: 188242 - protein, 239 aa, Glycine max
  Coding DNA Sequence Number=SeqID_71464
  Homolog annotation: Hit_ID=Q2HUH8; Match level="QueryCoverage=24%, HitCoverage=14%, E-value=4e-07, Identity=47%"; Hit description =Histidine triad (HIT) protein; Homeodomain-like
MVVARGSTLNGGSRADGGCMRKGSRCWGHKGGVVIVVARGKGRNGGSRGDSGCARDGLQWWLEGQRWLCEGRAVMVVHGVDQTSKQYWARIKIAYNNDDVCQSEKFFERSWTQMKYWRNRIYPPIQKFNKILGKKFEVEHAWLLLKDQPKFNAEFMSKCSKRTNVSASGNYSLSSNPETPIEVKEYDTSSPMSRPIGQKAAKRKSKEKEASNTLDLSDMESVMKDKNVNTSKLIQVKEA

SEQ ID NO: 188243 - protein, 203 aa, Glycine max
  Coding DNA Sequence Number=SeqID_71465
MIGDALRKLSGKLLITRDWHEVTEDWQQLANWVFLDLVEELKRKLVDMYCGVPVEKSGNGAGMESIKVMASVDLSLTLPDKKIVVQKEPVPPGKKISPELQEEICPYGTCKVVSVELCPDVVVREYLLAPKQANRALWMEELQKHLVCLGWKIEWSNKNNVKRYGYDVPDKKGRKLYLSLIEVCRVMEKDLNMNVNVLLAAPK

SEQ ID NO: 188244 - protein, 130 aa, Glycine max
  Coding DNA Sequence Number=SeqID_71466
  Gene Ontology: Mol. function=transferase activity
  Homolog annotation: Hit_ID=Q1SP37; Match level="QueryCoverage=54%, HitCoverage=21%, E-value=4e-15, Identity=47%"; Hit description =Bacterial adhesion
MDPNIDLDEVLNQMIDEELEDNPDKEIIILILESQQQLHGNTTRCRQRRRVVHRNREKDTLNNHDEYFQMRVDALCRKGLSPLQKCTAALHILAYGSSADNVNEYVQIGETTAVECLSRFVSSIYTIFGN

SEQ ID NO: 188245 - protein, 69 aa, Glycine max
  Coding DNA Sequence Number=SeqID_71467
  Homolog annotation: Hit_ID=Q1RWZ0; Match level="QueryCoverage=98%, HitCoverage=78%, E-value=1e-07, Identity=38%"; Hit description=HMG-I and HMG-Y, DNA-binding
MAWTGKSRSLEAPMRRVHCMVFSPVEKGRGRPKTLEKVVKGDLMVNNISEDLVFNQAEWHHVIHIVDLT

SEQ ID NO: 188246 - protein, 99 aa, Glycine max
  Coding DNA Sequence Number=SeqID_71468
MNTRRAKSDKKRQKDQDHTRESILQDGVNGIKNLLLCHLVEKLLPREATEEGSSAVANNNSERTFLCGFMRKTFFREMAQKKVLPLLLFSTAEEPSSVS

SEQ ID NO: 188247 - protein, 47 aa, Glycine max
  Coding DNA Sequence Number=SeqID_71469
MEQHNQKENTQSPGEEHFHHAANNGEEARTTPPGTIEVAEARTTRKK

SEQ ID NO: 188248 - protein, 545 aa, Glycine max
  Coding DNA Sequence Number=SeqID_71470
  Gene Ontology: Mol. function=calcium channel activity; Cellular component=integral to membrane; Biological process=calcium ion transport
  Homolog annotation: Hit_ID=Q1SHR1; Match level="QueryCoverage=99%, HitCoverage=99%, E-value=0.0, Identity=76%"; Hit description=Ankyrin
  Pfam annotation: Domain name=Ank; Domain location=132-164; Score =27.8; E_value=3.7e-05; Accession=PF00023.20; Description=Ankyrin repeat
  Pfam annotation: Domain name=Ank; Domain location=166-198; Score =34.7; E_value=3.1e-07; Accession=PF00023.20; Description=Ankyrin repeat
  Pfam annotation: Domain name=Ank; Domain location=200-230; Score =26.0; E_value=0.00013; Accession=PF00023.20; Description=Ankyrin repeat
  Pfam annotation: Domain name=Ank; Domain location=234-266; Score =32.8; E_value=1.2e-06; Accession=PF00023.20; Description=Ankyrin repeat
  Pfam annotation: Domain name=Ank; Domain location=24-55; Score=10.8; E_value=0.86; Accession=PF00023.20; Description=Ankyrin repeat
  Pfam annotation: Domain name=Ank; Domain location=268-300; Score=4.3; E_value=7.4; Accession=PF00023.20; Description=Ankyrin repeat
  Pfam annotation: Domain name=Ank; Domain location=63-95; Score=24.5; E_value=0.00037; Accession=PF00023.20; Description=Ankyrin repeat
  Pfam annotation: Domain name=Ank; Domain location=98-130; Score=23.0; E_value=0.0011; Accession=PF00023.20; Description=Ankyrin repeat
  Pfam module annotation: Pfam domain module=Ank::Ank::Ank::Ank::Ank::An k::Ank::Ank; Domain location=132-164::166-198::200-230::234-266::24 -55::268-300::63-95::98-130
MATPAMQAVNTPRKKMTKQLTGKRDDTPLHSAARAGKLAVLKDIILGTDETELHELLAKQNQDGETPLYIAAEYGYVDVVREMIQYYDLVDAGIKARNGFDALHIAAKQGDLDVLKILMEGHPELSMTVDPSNTTALHTAAIQGHTEIVKFLLEAGSSLATIARSNGKTALHSAARNGHLEVVKALLEKEPGVATRTDKKGQTALHMAVKGQKIEVVEELIKADPSLINMLDSKGNTALHIATRKGRAQIVKLLLEQKENVTSAVNRCGETAVDTAEKTGNHEVQAILLEHGVQSARTIKPPQGTTATTARELKQTVSDIKHEVHHQLEHTRQTRKRVQGIAKRINKMHAEGLNNAINSTTVVAVLIATVAFAAIFTVPGQFVDDPNNIPPGMSLGEANIAPQAPFIIFFVFDSIALFISLAVVVVQTSVVVIESKAKKQMMAVINKLMWLACVLISVAFLALSFVVVGKEEKWLAIGVTIIGTTIMATTLGTMCYWVIRHRIEASNLRNIRKSSLQSKSKSFSVSAFSDSELLNSEYYKKMYAI

SEQ ID NO: 188249 - protein, 166 aa, Glycine max
  Coding DNA Sequence Number=SeqID_71471
MGDPSYMSILVHMVLRSYFQNNCPQIDCFFVKVVELTCYNKTLDDSPDLVLILISMFQNNNHFGIVVALGGCGGGVGCVGHEVLGEKQLGSWLTAKMCQELLGAPNKIAVNVTVKEPSFVPSHGRTSSVGSHKRRFFRSCKLQQRKKFLWKNFFCEMARKKVLPQL

SEQ ID NO: 188250 - protein, 57 aa, Glycine max
  Coding DNA Sequence Number=SeqID_71472
MRWRKLGMENGGGEDKDNCCVDENIGDDGVSGSVFGQEMTFLLNLIEWRGTEEETVG

SEQ ID NO: 188251 - protein, 273 aa, Glycine max
  Coding DNA Sequence Number=SeqID_71473
MGGGRVYVAGVWANESTIAKGTSNHGFKEASKVGSGSIARKKGIESAREMKRHLQVHVQRANKVGSKGMRKWVLNDVDGALEIWWALEAYPHDYDGDGKCDPNHGGCSYAHSKDSESCKAVCDSSGCKRNLVDAIGMLLKDERGVVEHIVEVAIIYHDDSDNGCDFIGVSFAANFFSKDIGGMMMDEEFPRYRTSLAIGSRCSKNQPHSIELDVHKKNMGAEAKGMGHTVLRGCNGDCGGHQGERWEAATRGKQGSGLTKAPLSREELFYRYS

SEQ ID NO: 188252 - protein, 170 aa, Glycine max
  Coding DNA Sequence Number=SeqID_71474
  Gene Ontology: Mol. function=glutamyl-tRNA reductase activity; Biological process=tetrapyrrole biosynthetic process
  Homolog annotation: Hit_ID=Q2QM36; Match level="QueryCoverage=99%, HitCoverage=54%, E-value=5e-57, Identity=65%"; Hit description =Expressed protein
MTSSAISINGRRHSGANFLAKRYSGVQMRVPVPAPGPVDPGQCKPATPIRILHGQKGGKIMLFGVTRFFCDTRKPKLVPKLYITHHRARVAASEDEELRPHAEGGEGYFWEHRVFATRGVAVEEVGFVGENLNEAFMWVSGVFEEKVVSELEGVKRDAVLGEKGEVVVEG

SEQ ID NO: 188253 - protein, 194 aa, Glycine max
  Coding DNA Sequence Number=SeqID_71475
  Gene Ontology: Mol. function=electron carrier activity; Cellular component=membrane of vacuole with cell cycle-correlated morphology; Biological process=electron transport
  Homolog annotation: Hit_ID=Q6ZC71; Match level="QueryCoverage=83%, HitCoverage=45%, E-value=9e-64, Identity=67%"; Hit description=Sac domain-containing inositol phosphatase 3-like
MRARASSGDLVRIGNSNEMLNSVSGVLRTNCIDCLDRTNVAQYAYGLQALGRQLHAMGLTDVPKVDPDSSIAVALLDMYQSMGDALAQQYGGSDAHNTVFPERQGKWKATTQSREFLKSIKRYYSNAYTDGYFQPHEGKPALWELDSDYYIHESGIGDDLIPEKCSEPNISPSGRGGMVFMPIPACRDDFSRIK

SEQ ID NO: 188254 - protein, 221 aa, Glycine max
  Coding DNA Sequence Number=SeqID_71476
  Homolog annotation: Hit_ID=Q69TU8; Match level="QueryCoverage=31%, HitCoverage=15%, E-value=5e-20, Identity=68%"; Hit description=Sac domain-containing inositol phosphatase-like
  Pfam annotation: Domain name=Syja_N; Domain location=8-219; Score= -139.8; E_value=0.0037; Accession=PF02383.9; Description=SacI homology domain
MMYERVVVVMLLSLLHFASGAELVKELHSALTTGFHNDVVCLWKKSLVAIWVLLWWRWEHYHWDINTTIALVEMETEDINEGGERKDFGFECVEGSQELDEGLCSSQNYTLPFSDVLRWESFSVQVDVSDIPRLKEVLSAFPESEYLKRGVNDRGRVGNDVETEQIVLDEESGSCKGKMSSVVQIRGSIALFWSQEASTFSPKPDIICMKTVEINIYPVHY

SEQ ID NO: 188255 - protein, 122 aa, Glycine max
  Coding DNA Sequence Number=SeqID_71477
  Homolog annotation: Hit_ID=Q8L5Y9; Match level="QueryCoverage=31%, HitCoverage=4%, E-value=2e-07, Identity=64%"; Hit description =Pantothenate kinase 2
MELDSIDEVDDFDAFKQRMLGTGDKKPPPHRRALLFVDNAEKKIYVGAYDSNDVVGHAFNGDRCRCNNVVKGEAATSAVKSSSSQELRPSKKVFRDRRRLAGVYDDVAFKDGCAPSLNTDKD

SEQ ID NO: 188256 - protein, 199 aa, Glycine max
  Coding DNA Sequence Number=SeqID_71478
  Homolog annotation: Hit_ID=O23826; Match level="QueryCoverage=36%, HitCoverage=7%, E-value=1e-25, Identity=76%"; Hit description=125 kDa kinesin-related protein
MHYALRPRSRGCDGDAGKWQRSRRGHGWLKNNVIDIQNFNDGVFKSTVLTYLLRNLQRQAPRSTLLNVSRAMHMAHKMAFVSEYVVWQGDVGNGTLLAAVAEAAFLIGLERNSPFSQQRDLYEQAITPIVSEVLEGFDCTIFAYCQTGTRKTYTMERECKKAKSGPNGELPLGAGVIHRVVKQIFEKKYILKRFFENLF

SEQ ID NO: 188257 - protein, 145 aa, Glycine max
  Coding DNA Sequence Number=SeqID_71479
MLEHSHTSIVDHYMNEWSNGLGHRSVYGFLEPQSIHNAKDRHGQCEEYIEKWLKESQRQLYIGAYLNDAYKKLNTSADGKVPKTGPQWLELKTHVQRGSYECGYYVMHWMWNIIGAELKSDWSVWFGDGSALDPEAITTLHKKWA

SEQ ID NO: 188258 - protein, 177 aa, Glycine max
  Coding DNA Sequence Number=SeqID_71480
  Gene Ontology: Mol. function=hydrolase activity, acting on glycosyl bonds; Biological process=L-arabinose metabolic process
  Homolog annotation: Hit_ID=Q8VZR2; Match level="QueryCoverage=67%, HitCoverage=18%, E-value=4e-38, Identity=62%"; Hit description =Putative arabinosidase
MEEGPIEGLALNFVKDQQRTIGFSSRNLILNNCFMKSMNILVCFNAFKKLFNLSHEINHAGARGLWAELVRNSGFEAGGSSDPLNIYPWSIIGDDSTIFVSTDCTSCFERNKVALSMKVLCNESNPCPSGGVGISNPSYWGMKYKVVFYAKADGAINLEVSFVGSEKGEKLASNNIR

SEQ ID NO: 188259 - protein, 164 aa, Glycine max
  Coding DNA Sequence Number=SeqID_71481
MTKSKDKDPLEGLGRPMTRARARKAKEALQQVLSILFEYKPKFQGEKSKVLRHQPLGDQMVIGSMAFGVTFGCHNFSYTQPLSSFNSLGYWIITKSKWIVIAFNETYVKSDVGLSQVQMQALTQHLERLMKKRDDALHERLDQMENRDHNEEERRRKGNDGVPR

SEQ ID NO: 188260 - protein, 133 aa, Glycine max
  Coding DNA Sequence Number=SeqID_71482
MEYKCGYTSSIEVESLPYVVVRRAPVIDTGQSRSSCSSSLLFHIDPSVRNLDVLIRERGFLNYVGGGLIGCGVEWSMDESSETGLEKRVWTLHASSLFVAPWQQSLLPHLTIGLLLGLDLAFLLPRDPFDLIG

SEQ ID NO: 188261 - protein, 189 aa, Glycine max
  Coding DNA Sequence Number=SeqID_71483
MGLKVKEVMENIIVDLEWGVVVVIGMVVGGLAVVGKGCKSGWNTYWWLRLDGWKQHWSSSNSTEQMHLGLLEVHKERFTKTIELSSDSLLHEKFSIASLIISLTLVLVTTSRGAKLIGVGPEVMEWIVTTIVSLNVASCEVGSIGVSSTLSFDFSATMIGMELTTSSALATTTIGLETSLLGLVFSASA

SEQ ID NO: 188262 - protein, 113 aa, Glycine max
  Coding DNA Sequence Number=SeqID_71484
MPDQATAYPFGLHINKCTTIKMMPNRIAQGYSFVIREEEGLQGSSNSKNMPATNQRDSIQVLGPTKVYHFDDVNTCFMKNVEDDILKHLKKLPIIFSHHIFDLSKISMEELEA

SEQ ID NO: 188263 - protein, 163 aa, Glycine max
  Coding DNA Sequence Number=SeqID_71485
  Subcellular localization annotation: CTP_CleavageSite=96; ConfidenceScore=5.21e-01
GSHPQRHPVDLKKSNRALGFPALVTGLCRPYRAPVPPSKFMSSWHWDRARKTSSGPEEVQQGPRVSSSNYGPLSFLQSAHRPQQGTSSRNTAPPPQAQQGQAPQQPGDDQQQAGGQPQGAPPEQFEVAITWPEDWPNFSSGTSGEGDSAQKDEDMADMLDFLL

SEQ ID NO: 188264 - protein, 248 aa, Glycine max
  Coding DNA Sequence Number=SeqID_71486
MLSSIPFVEDSMFVDRDYFSLPFIIQRQSSLMTHRGQCGHLLPLSKLLPAKRLSSLATDTWGANTFLLTYGAERQLQCKARNHLVFRSGRQKISRKEGKRVFSLLFLDPSSPRLASSSPGPPNDFKVKKLAHLGKLQLPQVGCNNIQQKRQKKLAKTIASEEKALETFGLANKIKRIPREQKGKVQTKKQANSKMRKKRLLPRSNEQRRSMKRPDPLFQSSLRRLVHRPLQSGEIKDKFLSKPPRLRS

SEQ ID NO: 188265 - protein, 206 aa, Glycine max
  Coding DNA Sequence Number=SeqID_71487
MAMADTMVAIFSGHEVTSARERKSRGEKVFDKNAQFKDQKTIMSKVFGKKKVAYEEQVPRALYKEKSAEYAGTKKQLPFNLPRIVFINILMNLKTLGGRDDIFYATLVNKLLWEQGVYHITSDEDKSLHTFGIAECVNRIMKEQAIKRRTRKQAQQIEQEEELLDKEKRTKKRHEELVVSTLSRPLPTTEKLKTTPSRKSPRKLVE

SEQ ID NO: 188266 - protein, 101 aa, Glycine max
  Coding DNA Sequence Number=SeqID_71488
MAPRKLLAKRSRKDTTGEGSSTAPQADMDFDRHRFRSVEHQQRFETIKGWSFLRERRVQLRDDEFPDFQGEIARRHWAPLGNETPESAPGRQPKVLNLDPS

SEQ ID NO: 188267 - protein, 135 aa, Glycine max
  Coding DNA Sequence Number=SeqID_71489
  Homolog annotation: Hit_ID=Q6K3R8; Match level="QueryCoverage=31%, HitCoverage=7%, E-value=2e-11, Identity=74%"; Hit description =Putative chaperonin containing TCP1, subunit 3
MSFYTLILRVVFIDPARQSPVVIIQRNRGINFVAIDLNKPLPEQGQFGDLIADLAIEATTTVGVEIDQEGPRWAAGVFESSQGSHDKKKDVVSPGKMSKRLLTHASFFLILPLSTKRVKTKQMPNCSKKKTGFSY

SEQ ID NO: 188268 - protein, 95 aa, Glycine max
  Coding DNA Sequence Number=SeqID_71490
MRKQIGAAAYIECSSKNQQCLTLQLRLFWNLQGGNKWHGRKVIEGLVAHLWTIIQWRSKRDPSLSDDVVNTTTVTNRPDVDCHNSTTFIIRPTLT

SEQ ID NO: 188269 - protein, 132 aa, Glycine max
  Coding DNA Sequence Number=SeqID_71491
MKELERVQFIVEHATELMSLYAAERQAQMEAFTVPEDMDPNNLPYIGSREPVFEVFPARRIVQPNPNYLIFEHRLNERKVYPPEAIIWMSNELEPEDMSFSTPLDLQQLLALMHALNIILPWDHNKPSVTFQ

SEQ ID NO: 188270 - protein, 96 aa, Glycine max
  Coding DNA Sequence Number=SeqID_71492
TCKGFLQVSGTLKRVAWGLDISTRKREITFLLTLRRRRSPGKKGRMIRNQHSFSTHAPETPYCALYHSKNIPKFTALEVPNRSRPLWLLPMKGPMG

SEQ ID NO: 188271 - protein, 149 aa, Glycine max
  Coding DNA Sequence Number=SeqID_71493
  Homolog annotation: Hit_ID=Q1T493; Match level="QueryCoverage=95%, HitCoverage=26%, E-value=1e-17, Identity=32%"; Hit description =Nucleic acid-binding, OB-fold, subgroup
MVIILTHARIKDVQGSYPASVSNSFKASKLLINDPILEIQEFKERLLDLGVEVSPVLLPGDQAISQVSGGSQLSSKDSFLSKAEVKTISEINGISEDVVCVTVGTISKIVMDNNSWCYLAYLQCHRKTDIQTGPFTCGCGKDNDQPVLR

SEQ ID NO: 188272 - protein, 84 aa, Glycine max
  Coding DNA Sequence Number=SeqID_71494
  Homolog annotation: Hit_ID=Q9LT50; Match level="QueryCoverage=89%, HitCoverage=21%, E-value=1e-18, Identity=61%"; Hit description =Arabidopsis thaliana genomic DNA, chromosome 3, P1 clone: MOE17
VGFPPALNVTAAKVGKLEITLPSVSNVQIEPIIVQIDRLNLVLEENFDFEPSETQPSCSPSSATTKGSGYGFADKVDSFISKCK

SEQ ID NO: 188273 - protein, 88 aa, Glycine max
  Coding DNA Sequence Number=SeqID_71495
MQGSLKIMKLVGVKFHEMWKLKKLECKFDENPKTTQIQSPMTRSRTKQSVNTLQQMVAEILNEAQMENDESSKAETLLRISIVAEGQD

SEQ ID NO: 188274 - protein, 95 aa, Glycine max
  Coding DNA Sequence Number=SeqID_71496
MLAIVTKYQEELNLVTAHELRVVDEYAQVYAEKEARGRVIDSLHQEATMWMEELPRLLAKAKAMADTYSTPEEIHGLLSYCQHMIDLMAHIIRNR

SEQ ID NO: 188275 - protein, 136 aa, Glycine max
  Coding DNA Sequence Number=SeqID_71497
DAARKRNGLWSLGVASTVTAVAASMLVTTATEMRLDGGLPRDGFGRRETKCDRKVTGRREEGNKRKQRVAKLPAVDGERGEGLEKVERRGVAYGGWVVALGIGLGSAARICGDVGEVVGKFASMNKVMVGEDGGKR

SEQ ID NO: 188276 - protein, 378 aa, Glycine max
  Coding DNA Sequence Number=SeqID_71498
MGYEIIFKHLRWPNYSHFGMLSCACFPAVEPGGTYISQRFDCKSLKENLDRLRRNSFSFKVRSASQSAPLFVDNKRDSSEKLRQMRQTLSRKFNSYVLPTPVDGKSSISLRSSNQVPSKIKTNLNEPVKNLWHSSPLEKKKYENIFGDGGFSGPDVRTAQSVLKESNSNTAYSRLPPPLIDGNLSSNHDYITAYSKKIKRHAFSGPLVSNAWPTKPPVSVKSVQLFSGPLLRTSIPQPPSSSPKVSPSASPPLSSSPKINELHELPRPPTISPSNSKFLGLVGHSGPLVSRGQQLSAPNYFATSNAASPLPMPPSAMARSFSIPNIGDKVTELHESRPEEAPNKSTISEDIDSPPLMQIALSTSHPSSDGSDTVAQAV

SEQ ID NO: 188277 - protein, 253 aa, Glycine max
  Coding DNA Sequence Number=SeqID_71499
  Homolog annotation: Hit_ID=Q67UP1; Match level="QueryCoverage=85%, HitCoverage=37%, E-value=5e-45, Identity=48%"; Hit description =Hydroxyproline-rich glycoprotein-like
MKRSLRKLGVLAVEKHERDRRNIMPLSQLEELAQATQNSQSPWEIWALAFWRKPPCMTTKKARSHITQTITIPSDSLLNELRIVEEMKQQCDEKREVYESMLTRYRERGRSRSGKAESISLQQLQIARDEYDVEATLFVFRLKSLKQGQSWSLLTQAARHHAAQLCFFKKAVKSLETAEPHVKSVTDQHHIDYHFIGIEGEDEDEDEDGDVDHDDESHDENDDGELSFDYAQNECEQDVSTFENSMKVTDYLL

SEQ ID NO: 188278 - protein, 188 aa, Glycine max
  Coding DNA Sequence Number=SeqID_71500
YPMRGAPSEEIIAPFIAWGFNEGNAKILQRIRKLPKPKSLSWKEAEVPEESEEVQALKVELEKIRAVKEKLKTTITRVKKECDELRNVNMTTIEALERETKRARKEEWSRNKFRRALWGSSNELKLRRAERDESRVENMEKVNLAAIHGQRLEDEHAKVRSHSEWGSRASKVISQSQRQWADVYSTPD

SEQ ID NO: 188279 - protein, 572 aa, Glycine max
  Coding DNA Sequence Number=SeqID_71501
  Gene Ontology: Mol. function=drug transporter activity; Cellular component=membrane; Biological process=multidrug transport
  Homolog annotation: Hit_ID=Q1SB90; Match level="QueryCoverage=83%, HitCoverage=88%, E-value=1e-168, Identity=63%"; Hit description =Multi antimicrobial extrusion protein MatE
  Pfam annotation: Domain name=MatE; Domain location=104-264; Score =138.6; E_value=1.7e-38; Accession=PF01554.9; Description=MatE
  Pfam annotation: Domain name=MatE; Domain location=325-488; Score =150.6; E_value=4e-42; Accession=PF01554.9; Description=MatE
  Pfam module annotation: Pfam domain module=MatE::MatE; Domain location=104-264::325-488
MCHPTLDVTSNCKCCSTSPPDCPISIKDPLISKNQNNNTSSLPPPPPPQQHNNTTTTTTKTKTPPPPPPPSTTTTKTKATTTSKPHNFPESIKEVFSISKIAIPMILTGLLLYCRSMISMLFLGHLGELALAGGSLAVGFANITGYSILSGLAVGMEPICGQAFGAKRFTLLGLCLQRTILLLLFTSLPITLLWLYMKQILLLCGQDEAIATQAQQYLVYSIPDLIAQSFLHPLRIYLRTQSITLPLTLCASFSILLHIPINYFLVAHLKLGIKGVALGGVWTNFNLVASLILYIVFSSTHKKTWGGFSFECFTQWKSLLNLAIPSCVSVCLEWWWYEIMILLCGLLVNPKATVASMGILIQTTSLLYIFPSSLSFSVSTRVGNKLGAQKPSKARLSAIVGLSCSFMSGVLALFFALMVRNTWASMFTKDKEIITLTSMVLPIIGLCELGNCPQTTGCGVLRGTARPKVGANINLGCFYLVGMPVSIWLAFFTGYDFQGLWLGLLAAQGSCAVTMLVVLCRTDWEFEAQRAKKLTGMGVDHNHHEVDDPEKPLKHESKEDSLLLADSDENEQ

SEQ ID NO: 188280 - protein, 85 aa, Glycine max
  Coding DNA Sequence Number=SeqID_71502
MDKGFLGEEEDDDYKDLYNDIDVGEGLLQSLHKNNGSRFQNDDVKENKPLLSLPIPNAAGVSILGISGGVEGVDGGGGSRVVESR

SEQ ID NO: 188281 - protein, 445 aa, Glycine max
  Coding DNA Sequence Number=SeqID_71503
  Gene Ontology: Mol. function=methyltransferase activity; Biological process=metabolic process
  Homolog annotation: Hit_ID=UPI0000E68C83; Match level="QueryCoverage =54%, HitCoverage=34%, E-value=1e-100, Identity=71%"; Hit description= generic methyltransferase
MKELGVAHQHFAGFERFQLSCKAAVFVIPAVGVIGFTLRDASAWHRHQCIGRYRGTIVARLRTRRPVRLRFYPLKRQLADQHAGGFKVNTLMLNAHQNHPRRAVPVNRQIQRHGADEFTYHGFHFAAVVAHLGHVRPAVMAVVEIVPAHLIHADRHHRLDAIVNALLQITARHQLINVESSGMAKVEDQRMAQGDGFIKVRALIGEAVEQAFIQLPGLGEIGQQFGAFGVAAAAGKPDGAGGRRQLIVKMSGCHSELPFPAAQQAAFQAGIEAPDVIENAQNAGFAVRRHRHGVEALLMVTLALFNGADDVVRQTLGDKIGNDHRIGFLPLTALHTRDHRRQAGGQIGAAAKTLAEKTDCLLDAVISGQLIANHFVSKQHDVAAPPVGQRHLQQRQTKRFGAAFIETAHRTRGIHADDERAARLSFVLLMAGRAQRHFLVPGIAL

SEQ ID NO: 188282 - protein, 171 aa, Glycine max
  Coding DNA Sequence Number=SeqID_71504
MMKPLADAIRIIEDMCSNSYNNYGDGRIMKRKIEKLTSLSRRKRLVQLSRRLLGSGGGSRSSSRCLELLGGDELRKVLSVVTQQIKRVHGCHISEFFVFPTPKRHRRFPNTRPQLTLATKHGTYPSEIKEKKKVEGMERLKVKNPNPSRNKREESECVREQTGPPNLLFRT

SEQ ID NO: 188283 - protein, 64 aa, Glycine max
  Coding DNA Sequence Number=SeqID_71505
  Gene Ontology: Mol. function=protein serine/threonine kinase activity; Cellular component=beta-catenin destruction complex; Biological process=protein amino acid phosphorylation
  Homolog annotation: Hit_ID=P51139; Match level="QueryCoverage=80%, HitCoverage=12%, E-value=1e-20, Identity=92%"; Hit description =Glycogen synthase kinase-3 homolog MsK-3
MRKPGTNVYRAPELIFGATEYTTTIDIWLAGCVLGELLLGQPLFPGESGVDQLVEITKVVCRHP

SEQ ID NO: 188284 - protein, 165 aa, Glycine max
  Coding DNA Sequence Number=SeqID_71506
  Gene Ontology: Mol. function=binding; Biological process=protein transport
  Homolog annotation: Hit_ID=Q1RZH8; Match level="QueryCoverage=66%, HitCoverage=13%, E-value=8e-20, Identity=55%"; Hit description =Adaptin, N-terminal
  Subcellular localization annotation: CTP_CleavageSite=65; ConfidenceScore=5.79e-01
MASSLVLSHKARGTLSPTHGGHNPRSKLSGFSTKRLKQTLTMSGYLSKTLKTTAIAFFLTKTLVVESNLKTKRGQIGSKVESGDLEVLVELVGDEEHWSVVVLTDPLVCVEGDDGVSNNGVLVRRWGLEEELVGKGEEEPGVVEPVEGGGDKGVTEEGAGGRRRR

SEQ ID NO: 188285 - protein, 170 aa, Glycine max
  Coding DNA Sequence Number=SeqID_71507
  Homolog annotation: Hit_ID=Q84VH5; Match level="QueryCoverage=83%, HitCoverage=25%, E-value=8e-64, Identity=76%"; Hit description =Envelope-like protein
KLSAGKLSVKYAILHRIGTANWVPTNHTSIVATESFAVKLPIAFPTVLCGIMLSQHPNILNNIDSVKKRESPLSLHYKLFEGTHVPDIVSTLGKAAASGAVSKDDLIAELKDTCKVLEATIKANTEKKMELERLVKRLSDNGVDDGEAAEEEEDAAEDTESDDDDSDATP

SEQ ID NO: 188286 - protein, 109 aa, Glycine max
  Coding DNA Sequence Number=SeqID_71508
MSQNVTFFTSFLIFLSFLLWFFNGQIKIGCTIENGEHGCWVECIEHGEHGGNDDAQRKSALEELRAHGSAGEDDRELGTEIDGVGAAADNKGTVLKEALRKVLDLVESC

SEQ ID NO: 188287 - protein, 514 aa, Glycine max
  Coding DNA Sequence Number=SeqID_71509
  Gene Ontology: Mol. function=receptor activity; Cellular component =cellulose and pectin-containing cell wall; Biological process =protein amino acid phosphorylation
  Homolog annotation: Hit_ID=Q9LZR8; Match level="QueryCoverage=86%, HitCoverage=92%, E-value=1e-123, Identity=52%"; Hit description=S -receptor kinase-like protein
  Pfam annotation: Domain name=B_lectin; Domain location=91-196; Score =33.2; E_value=8.9e-07; Accession=PF01453.15; Description=D-mannose binding lectin
  Pfam annotation: Domain name=PAN_1; Domain location=348-421; Score =16.1; E_value=0.004; Accession=PF00024.16; Description=PAN domain
  Pfam annotation: Domain name=S_locus_glycop; Domain location=231-328; Score=-32.8; E_value=0.0094; Accession=PF00954.11; Description=S -locus glycoprotein family
  Pfam module annotation: Pfam domain module=B_lectin::PAN_1::S_locus _glycop; Domain location=91-196::348-421::231-328
MRRTVMLNMLQTRHPQFLAIIPFLFLYTLTCSETATTTSIPQELHIGFSATAESSTTPFQAVLSDHSGNFSLGFLRVNQNQLALAVLHVASSEPFWVANPTHAASWSDTTRLFFNGSLVLSDPETRVSWSTATNNGDRVVLLNTSNLQVHDKGGTPLWQSFHFPANTLVQDQNFTSNMTLLSSNGIYSMRLGNDFMGLYENHDSLYWKRTPLGAKAEVKEGQGPIYARVNPEGYLGMYQTSDEKPADVQKFNTFQLTSSFLLLRLEPDGNLKGYYWDGSRWMLNYQAITEACELPRSCGSYGLCTPGGSGCSCLDNRTRFEPGGCFNDASSGDADLCSSEGIGGKSSYWVLRRTGVEAAHKELLRHVTTSSLAECEGLCQNNCSCWGALYSNETGFCYLLEYTIQTLLGTGDGSKVGYFKVKKEERRTKRVWIRVGVVVTVLVGVGVIIIGVGFCVTRWKKKRGVKEEDWGSPGPYKNLESASFRSIEMSNSTGLCWFSHQPGAQLSQVAVSKT

SEQ ID NO: 188288 - protein, 165 aa, Glycine max
  Coding DNA Sequence Number=SeqID_71510
  Gene Ontology: Mol. function=metal ion binding; Cellular component =integral to membrane; Biological process=ubiquitin cycle
  Homolog annotation: Hit_ID=Q655W3; Match level="QueryCoverage=64%, HitCoverage=56%, E-value=3e-21, Identity=46%"; Hit description=RING zinc finger protein-like
  Subcellular localization annotation: CTP_CleavageSite=60; ConfidenceScore=5.17e-01
MAETHSFTHTPLITPTISPTRSKPCNPPEHSINLMVVLAVIVCAFLCALGLNTMLQCVFQCANRVLTEPLQWIASRRLNSGLKKREMVALPTSTYTHSCASPSSPSNNICAICLTEFSDGDRIRLLKLKMILIPETHQDLDESQGFKRTYILPMINKDSHLDNKN

SEQ ID NO: 188289 - protein, 421 aa, Glycine max
  Coding DNA Sequence Number=SeqID_71511
SGRVVYPVEYGADPTGAQESSEAILKAVGDAFGILSELELVAGVKDLGGVVIDLQGGNYTISKPITFPSSGGGNILVKGGTLRASDSFPTGRHLVELWAPNSQKLPKTSVLNSIKLQQPNGIYYEDITFRDILFDSSYKGGGIFIVDSVRTRINNCFFLHFTTEGILVQGGHETFITSSFLGQHSTVGGDPGERDFSGTAIDLASNDNAITDVAIFSAAIGIVLRGQANMLTGVHCYNKATGFGGIGILVKLAGNSQTRIDNCYMDYTGIVMEDPVQVHVTNGFFLGDANIVLKSIKGQVSGLNIVNNMFTGNPNNKVPIVTLDGQFSNIDQVAIDRNNVIGMSLRSTVGKLTVTGNGTQWVADFSNVLLFPNRISNFQYSFYAQGEPKFLAHSVTNVTNNVIVVESEKSAQGVVSFFVEQ

SEQ ID NO: 188290 - protein, 140 aa, Glycine max
  Coding DNA Sequence Number=SeqID_71512
  Gene Ontology: Mol. function=methyltransferase activity; Biological process=metabolic process
  Homolog annotation: Hit_ID=A0E2S4; Match level="QueryCoverage=100%, HitCoverage=53%, E-value=9e-15, Identity=36%"; Hit description =Chromosome undetermined scaffold_75, whole genome shotgun sequence
MDARDMSDFESGSFGAVIDKGTLDSILVSVVMVMLIGMLCGNNSRQNATKMLEEIWRVLKDKGVYVLVTYGAPLYRLRLLRESCSWTIKLHVIEKLASEEKSDNPVWELTKPVPLNDDGSSVEEALGQNPDVHYIYICTK

SEQ ID NO: 188291 - protein, 118 aa, Glycine max
  Coding DNA Sequence Number=SeqID_71513
  Homolog annotation: Hit_ID=Q1ZY13; Match level="QueryCoverage=41%, HitCoverage=12%, E-value=2e-09, Identity=67%"; Hit description =Fgenesh protein 89
  Subcellular localization annotation: CTP_CleavageSite=36; ConfidenceScore=5.28e-01
MAYVSKKRSSAMNSWRLGQYHATAFAEPSTCNAYSKANTGSSACIGQSGFFRSTVIPESTLKLTGPTICKIHIKGVLVNIMASIKNQMLEKFCSARLESSYQKSTDRTSWRTRPREAG

SEQ ID NO: 188292 - protein, 164 aa, Glycine max
  Coding DNA Sequence Number=SeqID_71514
  Gene Ontology: Cellular component=chloroplast envelope
  Homolog annotation: Hit_ID=O80503; Match level="QueryCoverage=51%, HitCoverage=19%, E-value=7e-09, Identity=38%"; Hit description =Expressed protein
MGGVKEGSEVKLPVIRKGEGEKTVEREAVGFGAGGNERGVHETVHELELSGSGKPCPSRERQGKRVSRDGTCQPIKGLGSGNVQIPEPSSVHYPSQFSRSHHTSIQWKWNGINQSINQLFLLLLLLLLLLLLLLLLLLLLLLLLLLLHSLFYYLFSHSLFSLQS

SEQ ID NO: 188293 - protein, 273 aa, Glycine max
  Coding DNA Sequence Number=SeqID_71515
  Pfam annotation: Domain name=TP2; Domain location=101-224; Score= -54.5; E_value=0.096; Accession=PF01254.8; Description=Nuclear transition protein 2
MVRIRQNAKVRKRKWKGSNPMHALWKRMKLLIMFQRSRTKRISHENHAQNTASGMPERYPSRFGDKSTGMSNKSSDVMPENKVENVVELHPNSMQCSLSKMSTQVISVTGIIHKYFSSFNGIDNFSSSSNSDITSKSIHSEIEVHSNTREHSCSKRQSDSLPQFTPKTPPHVLHAPFHVESVSIKSGCKNRKSNFGKHLKSGGKNRKSKVGKHLLSGDEKRESKIGNCLLAASRSLGVSITKHDPALSFCRFKDRKLLQDKSQMKEGFDIFYQ

SEQ ID NO: 188294 - protein, 314 aa, Glycine max
  Coding DNA Sequence Number=SeqID_71516
  Gene Ontology: Cellular component=chloroplast envelope
  Homolog annotation: Hit_ID=Q1ZY13; Match level="QueryCoverage=89%, HitCoverage=72%, E-value=5e-74, Identity=52%"; Hit description =Fgenesh protein 89
MVADIQVRFLQRFFSSVKSSKEKPKELSSWLKTFGRHLQDKSLYALGISSEFQLGMDDTLLFGLDAYEDTEKPRGKAVFHHKFPDHDLTVEAVYPGLFVDTTGNYWDLPFSMAVDLASVTTSDSSTAYHLCARYTSGSPKQFENVQNQNDRVPPPTLLPGLAFKSAFSYRKKVDIWRSEAKKLKLVQPYDIFLSNPHVSASGIIGAAATTAFGDNSARAQVEDGSPGFFLQASGIKSSFLADIFASVSFTAQHGNFQRLFLDLTRFQARLDFPSGFKFLSAATGLTQDLLNSQKPSMDAVQAIIPNATLSLQQQ

SEQ ID NO: 188295 - protein, 111 aa, Glycine max
  Coding DNA Sequence Number=SeqID_71517
  Homolog annotation: Hit_ID=Q8S2G4; Match level="QueryCoverage=64%, HitCoverage=20%, E-value=2e-22, Identity=68%"; Hit description=Mucin- like protein
MDGARAGLPSLIYMAVGKNLPRYSDMAPPFNKTVWKEVEMAGEVKCHKYSRRRPSDGWTFTVEKLGHQGKRGGGGGWKFASMPDGSSRPLNDMEKMYVKRETPRRRRRILP

SEQ ID NO: 188296 - protein, 234 aa, Glycine max
  Coding DNA Sequence Number=SeqID_71518
  Pfam annotation: Domain name=VQ; Domain location=82-112; Score=36.8; E_value=7.6e-08; Accession=PF05678.4; Description=VQ motif
MAAITDQWMQFYQQPLMDSHGHDHHALAPISTELGFSDATVTTTTSSPTPTMPSSESNSILSQLSPKGNVSKPIRRRSRASKKTPTTLLNANTTNFRALVQQFTGCHSTTMPTLGVQKGPITLNFQQGNSSGQKVTTTQVVGNSNYNQVHQVPSPFPNGQKQEDEEQRQLPQQSGYSFDYVKNSGFLPSSGNSIRPTTTSMDHVSDGLLLDNDFNLADLTVNCFPNDTFYKSEL

SEQ ID NO: 188297 - protein, 58 aa, Glycine max
  Coding DNA Sequence Number=SeqID_71519
MEREAADSDPVVHEKDQNLNAEKWSHVCVQMWPKVKPPMEDSRVCLADACIVSPMLPF

SEQ ID NO: 188298 - protein, 580 aa, Glycine max
  Coding DNA Sequence Number=SeqID_71520
  Gene Ontology: Mol. function=DNA binding; Cellular component=nucleus; Biological process=regulation of transcription
  Homolog annotation: Hit_ID=Q6Q6T0; Match level="QueryCoverage=97%, HitCoverage=98%, E-value=1e-113, Identity=42%"; Hit description =Trihelix transcription factor
MEDHHRHHHQYGITDLRQLVNGPRPTHFPTMPPPPKAELFPGDSNLQAATQQHYEMMMFGRQVADIMPPRCLHDFASTDSATNIAVATPTTTPSASTPPLSCLEAETAGCIGGDASTGRWPRQETLTLLEIRSRLDSKFKEANQKGPLWDEVSRNMSEEHGYQRSGKKCREKFENLYKYYKKTKEGKAGRQDGKHYRFFRQLEALYGENSNQASVPETNFGSGSLRFHTSSHNNNPSQTNQEMFQSQKHCDSLSLTNSTDLDTSSSDDNDQNSTGRELNKDNDSMEKRRKRVSGRSWKVKIKDFIDSQMRKLVEKQEEWLDKLTKTLEQKEKERVLREEEWRRQESVRLEREHKFWAKERAWIEARDAALMEALHKLTRNEIMKSTHSHEGLMVTGIQIHSENQNEDGSEILNSTAARGAESWPESEIARLQQLRAEMETRYMQSGFSEEVMWEEIATKMACFGYERSALVFKEKWESISSNYARSAKDGSKKRKEDSRSCFYFDNSDQSSLYNQGGAYCDINDQRHETGRLQTNDGSSPSNSNVGNAVAGDNCFPFLMTEGGNLWENYSLKVNKACQNQ

SEQ ID NO: 188299 - protein, 105 aa, Glycine max
  Coding DNA Sequence Number=SeqID_71521
MAERPTSSFGANTEKNPKEECMTTKKERKRKKIRRKKRNKVLTSKTKSQLARVARKEEPSAPLKEPPYPLVQGAKDNHAIWGSLAVDATLRQIHEGHLHQEGDVH

SEQ ID NO: 188300 - protein, 97 aa, Glycine max
  Coding DNA Sequence Number=SeqID_71522
MSATPSVKPQKRKDGALKKREGGEKSSLHVVSLVREHWVRHYRGRLGETKCKIAVCIVLATRVDSALEDFKIEYGTLSLLLSATMASSLLKARALHP

SEQ ID NO: 188301 - protein, 337 aa, Glycine max
  Coding DNA Sequence Number=SeqID_71523
  Homolog annotation: Hit_ID=Q1S296; Match level="QueryCoverage=25%, HitCoverage=12%, E-value=4e-11, Identity=41%"; Hit description=Zinc finger, C3HC4 type (RING finger), putative
  Pfam annotation: Domain name=zf-C3HC4; Domain location=266-307; Score= 32.0; E_value=2.1e-06; Accession=PF00097.15; Description=Zinc finger, C3HC4 type (RING finger)
MNPQGDSDGQTNTNNRSNNENEMMPLSPFETLELLPLFPLSPENAGQVEDMPGADDMAPLLGQESTMFRQVGTSVGTPSFNLPQRLNHLEPRQLVSGYEDDNGRVRNEAVVYHLLNDQAGPSTLRPSQSQRLNYSGGASSSRTHNYHNQVQVLGTGVPPYVQHGPSLSPLPSYPSAEERRRLSSYVHSILEALRSGPSAVMFDIDFDTMEFRSIDHALVSQYGFQNPEEFDALPQGLTVETIVQHLESETYVIVNKDAPEEDKEKCPICLEEFEEGNLIGKLHSCIHKYHRHCIRQWLLCRNFCPVCKRVGLETNNNVKSEATAAEVNINENDNDNV

SEQ ID NO: 188302 - protein, 159 aa, Glycine max
  Coding DNA Sequence Number=SeqID_71524
  Homolog annotation: Hit_ID=Q1T493; Match level="QueryCoverage=93%, HitCoverage=27%, E-value=4e-15, Identity=33%"; Hit description =Nucleic acid-binding, OB-fold, subgroup
VIGVVEEVVFRQVSGKGRRVVFKLKDLSQQLLSCTLWDDYCLQFLKFLDDYEGDGPIRVLLTHGRIKEAQGSYPPSVSNSFKASKLIINQPVMEIQEFNERLAELGIEARSGFKSHGEGSTQLSGSIQLSSKESFFGKAEAKTIADINTISEVIILYRF

SEQ ID NO: 188303 - protein, 74 aa, Glycine max
  Coding DNA Sequence Number=SeqID_71525
MWIYIREKEYTYRALYNKRTCSIYIAHSKKQQQQLAAQTLPNWWDELKQNALQLQPSYPTHTTKLSYTLILHTP

SEQ ID NO: 188304 - protein, 122 aa, Glycine max
  Coding DNA Sequence Number=SeqID_71526
MLFKPSETGKCEFLVKLKEEASYEGSTKLILPRPAMPVTPSVKPQKRKEDSFYLGESNFKFILLQPTLRREGEVRLKSASSKGKRVGVTTNVCLRKTLEKPKRGSVNFKNKGSGVIYAWGRY

SEQ ID NO: 188305 - protein, 149 aa, Glycine max
  Coding DNA Sequence Number=SeqID_71527
MEAMKEEMATMMEAMMSMKKIMEVNATAVAAISVVSGVDPTPPSCLNLINHPTADTGDPHFVQAQNKQVFPPYGLPPNYTPPNENVNNFTSIPIESQQPQSDHAHVSQPMGEPHEMRHHNLADFQPCFRYATEGQAVGGIPLQNTLEGP

SEQ ID NO: 188306 - protein, 108 aa, Glycine max
  Coding DNA Sequence Number=SeqID_71528
MQNNDRASESHAAHTGEYAASTSTNWYNFSSNIPYLLIQSKGNQYNSSHNCTSYPTTKKRLILSKRVYSTRTRGRSGPLQSLARKLGRFKVRAVIVDDIASEESNRKR

SEQ ID NO: 188307 - protein, 142 aa, Glycine max
  Coding DNA Sequence Number=SeqID_71529
MKKIQGFALGLRDSHYLLSLNLVLLLLVSALREVVSIPQGKTLTRVTQRNVACVSTRILPTWFPLEEFMRGRQPSTTSLWAMIKSRHMTETSMRAGNASVYGFLKPQSIQRSGQSQFESEDYIKKWMHNSHRDVYLGAYLNE

SEQ ID NO: 188308 - protein, 84 aa, Glycine max
  Coding DNA Sequence Number=SeqID_71530
MVRIDANFKEKTSIDEFNIFFEGGEGEDAARGREWRPEERERGLEEEMDCSSSGEGDGEEERGAPERGVGIKGEEVGKSWGIVR

SEQ ID NO: 188309 - protein, 158 aa, Glycine max
  Coding DNA Sequence Number=SeqID_71531
MENLEHGHGIHPNWSPTCGLILDQIRQRRNNFVFLGSWTIDITIQILVLQSLSYLKASFVLDTICSMTFVQMEVASGSSWKFPSLVWYNINIDDVVHISDNEADCGEVICDHEGQYVLGFKVDRGKISVVNVELWGVFHGARLALDKGMNNTIVKTES

SEQ ID NO: 188310 - protein, 126 aa, Glycine max
  Coding DNA Sequence Number=SeqID_71532
GLILDLVTGFDKGNLGVTIDEGDLVVMDLAPHCCVVRTHCLLCRVEGAVATLPYVAVYLRRPPPPWKLPHSSLGLAHVRHTICLLWSLLNMRRQRDSEKGYALPSQFCSVASVMGVTSPQVPLPLL

SEQ ID NO: 188311 - protein, 105 aa, Glycine max
  Coding DNA Sequence Number=SeqID_71533
FAKHNTQWLSASKNPEEDELLGSLSAPLQIIKRTTSTHLLSERGGGDILTTCIFAIFHPALLCVVKEVSGLWKAKSSVGSSLGNWSDSKVLDSTGLSCCTATRNR

SEQ ID NO: 188312 - protein, 418 aa, Glycine max
  Coding DNA Sequence Number=SeqID_71534
  Homolog annotation: Hit_ID=Q1ZY19; Match level="QueryCoverage=87%, HitCoverage=81%, E-value=1e-31, Identity=26%"; Hit description =Fgenesh protein 60
  Pfam annotation: Domain name=DUF247; Domain location=39-404; Score =509.8; E_value=3e-150; Accession=PF03140.6; Description=Plant protein of unknown function
MEEEANHHAIDISNIIDRERLASMELKISENPKFLCKAAGKRSCCIFRVPQSLVEVNGKAYQPRIVSIGPYHRNQPRLNMIEEHKWRYLGSLLSRTNTIGFVLEDLFKAIAPLESEARECYSETINLDSHDFIQMMILDGCFIIELFRKVARLVPFEREDPLLTMVWILPFFYRDFLKLENQIPFFILNQLYQVTKLPGEKSTPTLSTLALLFFNNSLQKPDESLQNDVQGKHLLDLVRSSFIPKNDEETEPRKRVMTPTHVILCVSKLRRAGIKINPSKESESFLNVKFRRGVIEMPSLTVDDFMSSFLLNCVALEQCYSGCSKHFTAYITLLDCLVNTYRDVEYLCDRNVVENHLGTEGEVASFINNAGKDVAWASFKHTYFDTPWSFISLLAASILLLLTVAQTYFSASQYFHQT

SEQ ID NO: 188313 - protein, 123 aa, Glycine max
  Coding DNA Sequence Number=SeqID_71535
MTITAASEMLVLNQLPQPETPPNIDIPSTDCPPQQSIDENYVHAVPVPPSIAKEEEEGERKMTRVSKLVNRVLDKYEKLPASLKDHINLEEMLGMKMKRRVETQNTTSRGPQHPINEKLERFK

SEQ ID NO: 188314 - protein, 244 aa, Glycine max
  Coding DNA Sequence Number=SeqID_71536
MDGNIDVAIVKEFYANLYDPEDKSPKQVRVRGHLVKFDADALNTFMKTPVIIELGENLPAYSRFTQLRPNPQELAARLCIPGKEFELNADGLPLKILRKNLTTLAQRWSVLSFSNLVPTSHTSDITLDRARLIYNIIQNMDMNLGHIISSQISLIVQHDSSQEPKLVEDDVPPEPFIIETNPVPQEEADAQEPTSPIPFSPALVIDDSQPSVPASEPEQPIVQDPLAAPVLDLNEHAKDHPQED

SEQ ID NO: 188315 - protein, 559 aa, Glycine max
  Coding DNA Sequence Number=SeqID_71537
MMTSAGLLNYISGKGSESYVAFGSERAWTKYATSGLPHSLNIIIMAQKYLHELLEEDQEPFFLNKYISDRRTQMKRPSPKTSLQVKKRKSTNPNTNFPRNLCKSACLFSLTDTPDLRKSPLFEFTSPVKSPCKSPNAIFLHIPSRTAALLLEAALRIQKHSSHVTSKPKTKAHSFGLFGSLYKRLTQRNQKKHEIESGGGVKISVKDVLKWDSSVGRRKVSKANGKCKEQEETVNVNVNVNTCSYNGSSALWSESNEDNKSLDMETSSSGYYSEEIHFVTNHKQYSTCFCESPFRFVLQTSSPSSGHHTPELPSPSRHPTEEKESNEGESVKKFESGEEEEEDKEQCSPVSVLDPPFEDDDEGHGNGDEEEEEEGGFDMECSYAIVQRAKQQLLYKLCRFEKLAELDPVELEKRMQDQEEDEDETFMEEEHGDDENNQASYKENDFIELIFQALCQSRVHDRQQIPEDFKKLVSDLIMEEERALDSLEDRDMVIRRICKRLELWKEVESNTIDMMIEDDFSREDGVWRKNIEQIRNMAGELELAIFGFLVEEFSEELVC

SEQ ID NO: 188316 - protein, 139 aa, Glycine max
  Coding DNA Sequence Number=SeqID_71538
  Homolog annotation: Hit_ID=Q9XIS5; Match level="QueryCoverage=38%, HitCoverage=6%, E-value=1e-10, Identity=70%"; Hit description=Starch branching enzyme
MIGFKTPYWHNLWLLSGKTLAVKSSHDSDSLSSAIAESDKVLIPQDQDNSASLTDQLETPDITSEDAQNTMVSTKINIFSSYYCTYTNSILLLLFSTDNYHNCPLTLSSHHHTSGENSALSLRLKVGNWYFLVIFYPLQ

SEQ ID NO: 188317 - protein, 177 aa, Glycine max
  Coding DNA Sequence Number=SeqID_71539
  Homolog annotation: Hit_ID=Q9SJR4; Match level="QueryCoverage=98%, HitCoverage=84%, E-value=1e-52, Identity=63%"; Hit description =Expressed protein
  Pfam annotation: Domain name=DUF662; Domain location=1-176; Score =305.0; E_value=1.4e-88; Accession=PF04949.3; Description=Family of unknown function (DUF662)
MQSENQNNQLVVQNSGSLSFSSHLSKEDEEMSRSALSTFRAKEEEIERKKMEVREKVQLQLGRVEEETKRLATIREVKKLLMETTLEYQELEALADPMRKEVALVRKRIDSVNKELKPLGHTCQKKEKEYKDALEAFNEKNREKVQLITKLMELVGESERLRMKKLEELSKNIDSMQ

SEQ ID NO: 188318 - protein, 153 aa, Glycine max
  Coding DNA Sequence Number=SeqID_71540
  Homolog annotation: Hit_ID=Q9XIS5; Match level="QueryCoverage=26%, HitCoverage=4%, E-value=2e-10, Identity=78%"; Hit description=Starch branching enzyme
MRKVHYERRSCFGEKREETQFCDRHGSSSCAAKEKPEIEFPRWCKPYFFVLRVYSLVENEIEKIIGCSLSEAEEEQIQSFDECVEFEKWKLYGEGWRYLGGGDNESPNSMAMGVMGPTGPSSLILIVHCLSQTNNKALLGYEMSGYGRASLII

SEQ ID NO: 188319 - protein, 183 aa, Glycine max
  Coding DNA Sequence Number=SeqID_71541
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS5; Match level="QueryCoverage=75%, HitCoverage=15%, E-value=7e-73, Identity=92%"; Hit description =Starch branching enzyme
  Pfam annotation: Domain name=Isoamylase_N; Domain location=26-107; Score=96.8; E_value=6.7e-26; Accession=PF02922.8; Description =Isoamylase N-terminal domain
MVVHMCSNGSKLPARGQNEDGEQGGGIGCATGITYREWAPGAKSAALIGDFNNWNPNADVMTKNEFGVWEIFLPNNVDGSPPIPHGSRVKIRMDTPSGIKDSIPAWIKFSVQAPGEIPYSGIYYDPPEEEKYVFKHPLPKRPKSLRIYESHIGMSSPVSKFFFLNVILISEGEPWYSGKVVPW

SEQ ID NO: 188320 - protein, 89 aa, Glycine max
  Coding DNA Sequence Number=SeqID_71542
MKELNLTMPIIGVVLNNIYTHTIYIILGHIIFIDCEIERSGFVYHTESSKVTTRNTRFKHHKNVQFRCVSDATLSDVTEAKGGNQIVAS

SEQ ID NO: 188321 - protein, 73 aa, Glycine max
  Coding DNA Sequence Number=SeqID_71543
MNGFLHLSLHLMHMVIGELMLALNAHCRNLPFGGRATRDSQVRLPRKEYARSRHQRLFEENVGKTRKDVVYEL

SEQ ID NO: 188322 - protein, 70 aa, Glycine max
  Coding DNA Sequence Number=SeqID_71544
MDFVGDVREVFVVDWACSIGWALGRREIRYWPSNCIDAGDIVMVMAWASPSFFLSPPVPVLLLAAFVEAT

SEQ ID NO: 188323 - protein, 129 aa, Glycine max
  Coding DNA Sequence Number=SeqID_71545
  Subcellular localization annotation: CTP_CleavageSite=87; ConfidenceScore=5.66e-01
MRKIPKIAAKRVFSLVFLDPSSPRLASGSPGPPNNFMVKKPTRLGELIASTLSFSSPGRATFAPSAHFPINRHAREAEEGFQHSALRDFERNKGEEEEISENEVEALPNHDCNQPLHHSSFSVLLSSSS

SEQ ID NO: 188324 - protein, 516 aa, Glycine max
  Coding DNA Sequence Number=SeqID_71546
  Gene Ontology: Mol. function=nucleoside-triphosphatase activity; Cellular component=integral to membrane; Biological process=transport
  Homolog annotation: Hit_ID=Q2PCF1; Match level="QueryCoverage=99%, HitCoverage=80%, E-value=0.0, Identity=48%"; Hit description =Pleiotropic drug resistance protein 2
  Pfam annotation: Domain name=ABC2_membrane; Domain location=335-516; Score=117.4; E_value=4e-32; Accession=PF01061.14; Description=ABC-2 type transporter
  Pfam annotation: Domain name=ABC_tran; Domain location=48-238; Score =97.7; E_value=3.5e-26; Accession=PF00005.17; Description=ABC transporter
  Pfam module annotation: Pfam domain module=ABC2_membrane::ABC_tran; Domain location=335-516::48-238
MVLPFQPLSLAFNDVNYYVDMPAEMKSQGINEDRLQLLHDASGAFRPGILTALMGVSGAGKTTLMDVLAGRKTGGYIEGSISISGYPKNQATFARVSGYCEQNDIHSPYVTVYESLLFSAWLRLPSDVKAQNRKMFVEEVMELVELNQIRNALVGLPGVDGLSTEQRKRVTIAVELVANPSIIFMDEPTSGLDARAAAIVMRTVRNTVDTGRTVVCTIHQPSIDIFEAFDELLLMKRGGQVIYAGPLGHHSQKLIEYFESIAGVQKIKDGYNPATWMLEVSTPSIEAHLGIDFAEIYTNSTLYQRNQELIKELSTPPQGSSDLRFPTKYSQSFFVQCKACFWKQYWSYWRNPSYNAVRLFFTIAIGIMFGLIFWNKAKNIKKQQDLFDLLGAMYAAVMFLGTSNTMGVQPIVDIERTVLYRERAAGMYSTLTYAISQVAIEAIYSATQTTIFSVIIYSMMGFEWTARKFLSFYYFMLMCLIYYTLYGMMIVAVTPSFQIAAVCNSFFLTIWNTSVA

SEQ ID NO: 188325 - protein, 255 aa, Glycine max
  Coding DNA Sequence Number=SeqID_71547
  Gene Ontology: Mol. function=nucleoside-triphosphatase activity; Cellular component=integral to membrane; Biological process=transport
  Homolog annotation: Hit_ID=Q7PC87; Match level="QueryCoverage=76%, HitCoverage=13%, E-value=6e-78, Identity=65%"; Hit description =Pleiotropic drug resistance protein 6
  Pfam annotation: Domain name=ABC2_membrane; Domain location=1-157; Score=75.5; E_value=1.6e-19; Accession=PF01061.14; Description=ABC-2 type transporter
MFSTVMFLGTMNAVGVQPVVDIERTVLYRERAAGMYSALPYALGQVVIEIMYSSIQTVMYTIIIHSMMGFKWNVGKFLSFYYYMLMCFIYFTLYGMMTIALTPSYQIASICISFFLCIWNLFSGFFIPRVEIPVWWRWFYWATPNAWTIYGLVTSQLGDEIAQIDVPGAKSMGLKELLKENMGFDYDFLPVVAIVHYFALKSNLNSACCTCCSVMGRCNCFQNRGGSLKIACMQGTAHYEKLNTADALGHLIKLN

SEQ ID NO: 188326 - protein, 448 aa, Glycine max
  Coding DNA Sequence Number=SeqID_71548
  Gene Ontology: Mol. function=nucleoside-triphosphatase activity; Cellular component=integral to membrane; Biological process=transport
  Homolog annotation: Hit_ID=Q7PC87; Match level="QueryCoverage=91%, HitCoverage=72%, E-value=1e-165, Identity=53%"; Hit description =Pleiotropic drug resistance protein 6
  Pfam annotation: Domain name=AAA; Domain location=193-351; Score= -30.3; E_value=0.042; Accession=PF00004.19; Description=ATPase family associated with various cellular activities (AAA)
  Pfam annotation: Domain name=ABC_tran; Domain location=191-414; Score= 65.9; E_value=1.3e-16; Accession=PF00005.17; Description=ABC transporter
  Pfam module annotation: Pfam domain module=AAA::ABC_tran; Domain location=193-351::191-414
  Subcellular localization annotation: CTP_CleavageSite=26; ConfidenceScore=5.45e-01
MASTSVRNDLVSGKRNQRSWPSSSFRAASWSASPFTKSAGRSSGEDNEEDLKWAAIERLPTLDRMRKGMMSVVLDNGKVVCCQVDVTHLKLQDKKQLLDTVLKYVDDDNDKFLRKLRDRTNRVGIKIPNIEVRYENLSVEGNVHVGTRALPTLLNVTLNTFERILELFRLAPSKKRKIHILKDVSGIVKPSRMTLLLGPPGAGKTTLLLALAGKLDPDLKVSGRITYCGHELKEFVAKKTCAYIGQHDLHYGEMTVRETLDFSGRCLGVGTRYQMLEELLRREKQAGIKPDPEIDAFMKATAIYGQKTNLQTDYVLKIIGLDICADTLVGDNMRRGISGGQRKRVTTGEMLVGPAKALFMDEISTGLDSSTTFQICKFMRQMVHIMDETMVISLLQPAPETYELFDDVILLSEGQIVYQGQREHVLEFFENMGFKCPPRKGVADFLQE

SEQ ID NO: 188327 - protein, 147 aa, Glycine max
  Coding DNA Sequence Number=SeqID_71549
  Gene Ontology: Mol. function=transition metal ion binding; Biological process=cytoskeleton organization and biogenesis
  Pfam annotation: Domain name=Transposase_21; Domain location=1-106; Score=-64.0; E_value=3.8e-09; Accession=PF02992.5; Description =Transposase family tnp2
MYDAHVGNTFLLRAMIFCTINDFPGYGNLSEYSVKGHHACPICGKNTSFIQLKHEKKTIYTRHWRFLKHYHPYHRLKKAFNGTNETEGAPKPLAGHQVYDRVKDIVNVFSKTRRKDHADKNIWKKRIWLRWVYDISYIRSLKVAERI

SEQ ID NO: 188328 - protein, 58 aa, Glycine max
  Coding DNA Sequence Number=SeqID_71550
MFSPSGIKKSLEICEKNCFREKNPSRGASVTLLRRFCKQFRGDSSPFFIVLCRSSVFN

SEQ ID NO: 188329 - protein, 280 aa, Glycine max
  Coding DNA Sequence Number=SeqID_71551
  Gene Ontology: Mol. function=nucleoside-triphosphatase activity; Cellular component=integral to membrane; Biological process=transport
  Homolog annotation: Hit_ID=Q7PC87; Match level="QueryCoverage=98%, HitCoverage=66%, E-value=1e-125, Identity=53%"; Hit description =Pleiotropic drug resistance protein 6
  Pfam annotation: Domain name=ABC_tran; Domain location=24-214; Score =91.5; E_value=2.6e-24; Accession=PF00005.17; Description=ABC transporter
MKNQGINEDRLQLLRDVSGAFRPGILTALMGVSGAGKTTLLDVLVGRKTGGYIEGSISISGHLKNQATYARVSGYCEQNDIHSPYVTVYESLLFSAWLRLPSHVNTQTRKMFVEEVMEWVELKPIKDALVGLPGIDGLSTEQRKRLTIAVELVANPSIILMDEPTSGLDARAAAIVMRTVRKTVDTGRTVVCTIHQPSIDIFEAFDELLLMKRGGQVIYAGPLGHHSQKLIEYFEAIAGIQKIKDGYNPATWMLDISTPSMEAQLDIDFAKIYVNSTLYQ

SEQ ID NO: 188330 - protein, 379 aa, Glycine max
  Coding DNA Sequence Number=SeqID_71552
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=29%, E-value=1e-124, Identity=54%"; Hit description =Integrase, catalytic region
MATVRVVLALASINRRHLHQLDVSNAFLHGDLRENVYMEIPPGLLGYTSTKKWYEKLSNLLLTCGCSHAHADHSLFIKAHNSEFTAIIVYVDDIVLTGNSLAEIERIKRILHTNFHIKDLGKLKYFLGIEVAHSDKGNSLCQRKYCLDLLKDSSMLGCKPSSTPMDNSLRLHNDSSSFLDDPLSYRRLVGRLLSAFFNILKGVQEKAYFFPRTCSPHLLGFSDADWATCIDSRRSITGYCFFIGNSLVSWKTKKQTIVSCYSSEAEYRALASATCELQWLSYLLRDLLIPLSKTSILYCDNHSALHIAANPVFHERTKHLDIDCHLVREKSQAGLMLLLRVPSLNQLVDIFTKALPPQSFSTNLSKPQLQNIFAPPACR

SEQ ID NO: 188331 - protein, 108 aa, Glycine max
  Coding DNA Sequence Number=SeqID_71553
MPKLRVIGVGGGDIVGRWASILSNYQVKKAFLQVSQTNHLQCAHVLYFTRNFRKITRKSNMTWEISELAPPGPEDLLRRFINCWYWAIVGSSSPDESEVAIGRWRLEA

SEQ ID NO: 188332 - protein, 871 aa, Glycine max
  Coding DNA Sequence Number=SeqID_71554
  Gene Ontology: Mol. function=protein serine/threonine kinase activity; Biological process=protein amino acid phosphorylation
  Homolog annotation: Hit_ID=Q9LFA2; Match level="QueryCoverage=99%, HitCoverage=100%, E-value=0.0, Identity=49%"; Hit description =Protein kinase-like
  Pfam annotation: Domain name=Pkinase; Domain location=488-820; Score =235.8; E_value=9.2e-68; Accession=PF00069.15; Description=Protein kinase domain
  Pfam annotation: Domain name=Pkinase_Tyr; Domain location=488-820; Score=-2.3; E_value=2.5e-12; Accession=PF07714.7; Description =Protein tyrosine kinase
  Pfam module annotation: Pfam domain module=Pkinase::Pkinase_Tyr; Domain location=488-820::488-820
MGSFSGTCEIVEARGELNTRKAPGVYQSSSECSTSEKNHKLSVLKLGYKDDLDDDINKLFESIALKSSSRDLSLFQDGTSPRLKSALKKPITTGVPRSPRVGTSESVNLKQALRDLCISKASEMAAMKRLSKSTTASPRLSEVGKIQTLYNSVVAETCRSGSSFVESKGHQIEISLVPEKGKSLSLEKTSQSYQTSQIASSSRNIHSSWEIAVATTKYDAGSSLIQSDLACSSSKVGIQSQRVVPVETEEQASASSPSLYNTFGSKSEVPKNASSPKKLGNKAYMSNTGKKGRLQTVSSSTSVNDNRVNKPPCHAPRTVKSVIKNKNLSKKKQKEDSGSALHGPTPNEVNKPVPGTPRLICERCRCALENTCEEKNQDIVALDSISPGDGVNLSNVHSGSNKPGLVSSSVNKSKTGAKVKNTKLKEQIDFSQSSKSSQGEYSSSTSTSDESNVSGSSRSTRPHMSKDVRWAAIRHAQMQHGVLGLRHFNLLKKLGCGDIGTVYLAELIGTSCLFAIKVMDNEFLERREKMPRAQTEREILRILDHPFLPTMYAQFTSDNLSCLVMEYCPGGDLHVLRQKQLGRYFSEPAARFYVAEVLLALEYLHMLGVVYRDLKPENILVREDGHIMLTDFDLSLRCAVNPTLLKSSSDVDPAKISGLSAQASCIEPFCIEPSCQVPCFSPRLLPAAAKARKLKVDLAAQVRSLPQLVAEPTDARSNSFVGTHEYLAPEIIKEEGHGAAVDWWTFGVFLYELLYGRTPFKGSNNEETLANVVLQGLRFPKHPNVSFQAKDLIRGLLVKEPENRLGSEKGAAEIKQHPFFEGLNWALIRCAVPPELPDFYDFGVSDMVNPQGKGAKYLECKVGEHVEFELF

SEQ ID NO: 188333 - protein, 834 aa, Glycine max
  Coding DNA Sequence Number=SeqID_71555
  Gene Ontology: Mol. function=protein binding
  Homolog annotation: Hit_ID=Q2PCF1; Match level="QueryCoverage=38%, HitCoverage=38%, E-value=1e-67, Identity=67%"; Hit description =Pleiotropic drug resistance protein 2
  Pfam annotation: Domain name=ABC2_membrane; Domain location=625-834; Score=100.1; E_value=6.5e-27; Accession=PF01061.14; Description=ABC -2 type transporter
  Pfam annotation: Domain name=ABC_tran; Domain location=542-799; Score= -43.5; E_value=0.0012; Accession=PF00005.17; Description=ABC transporter
  Pfam module annotation: Pfam domain module=ABC2_membrane::ABC_tran; Domain location=625-834::542-799
MVCEIDLTVDITPLIPAVTVASSSRAMIPLVPEKSSSVNHIAVQIMPYNEFGPPLSNVTKLTFEGRTDVSVQALCSAISGSGNFPSLHSRDKRLKSVVSNFEMLHMGGCRGLSLTYIFYLCLISSQCETWVFLNIPPHAQHFWAWCVDNMVGDPFNGSKIDSNTILECGFEPNSTPKANPWGISESSLLELMSQAQVLKSLCLRWTDLVDQALYNFVGSSLEMLDVSDTKVISDMIVMNFVTSLKYLQVLALCYCFGDISMSSFKFPMQNLRKLRLERITPWMTNDDLVVLAQNCRNLLELSLLGCPLLDPEVTANGASALLDCKALEDILLRHNGPGLPRNFICYAASEMPLLRKLSLDICDASEGDFDIPNQYADKYFLSTLKIARCKSQRCAFNLPAPAPGVHRRSVHVETLVLVWNSRDLIRTVSPELETASFRDAWTAAPDMFNMSGRHALEDDEEELKWAAIDGLPTFERMRKGVLKYVHDDGHVGDVHVGSRALPTLLNATLNAFKSVLGMFCLAPSKKREIQILKDVCGIVKLSRMTLLLGPPSSGKTTLLLALAGKLDRDLRVSGRINYCGHELNELVPQKTCAYISQHDIHYGEMTVRETLDFSGRCLGVGTRYEPLVELSRRDREAGIKPDPEIDAFMKAIALSGRKTNLVTYYVLKEHKLRTEMSVGTVQDGQKFFGALFFTLINVMFNGIAELSMTVYRHPVFYKQRDFKFYPAWAFGLPIWLLRIPLSIMESGIWIVLTYYTIGFAPSASRFFRQFLALFGIHQMALSLFRFLAAAGRTLVVANTLGTFSLQLVFVLGGFVIAKDDIEPWIMWGYYLTPI

SEQ ID NO: 188334 - protein, 568 aa, Glycine max
  Coding DNA Sequence Number=SeqID_71556
  Gene Ontology: Mol. function=nucleoside-triphosphatase activity; Cellular component=integral to membrane; Biological process=transport
  Homolog annotation: Hit_ID=Q7PC87; Match level="QueryCoverage=97%, HitCoverage=86%, E-value=0.0, Identity=44%"; Hit description =Pleiotropic drug resistance protein 6
  Pfam annotation: Domain name=ABC_tran; Domain location=151-374; Score= 54.0; E_value=4.9e-13; Accession=PF00005.17; Description=ABC transporter
MRTTSSSKDILIQEDNEQDLKWDKIQRFPMFDRLRKGMLRLVLDRGNVVPYQVVDVTNQGLQDKKLLLESVLKDDNEKFLRKFRERVDRVGIEIPKIEVRFENLSVEGDVHVGRRALPTLHNVTLNAFEFASFRKRKNHILKDVSGIVKPSRMTLLLGPPGAGKTTLLLALAEKLDRDLRAFGRVTYCGHDLNEFVAKKTCAYISQHDLHHGEMTVRETLDFSAHCLGVGTRYEMLKEISRREREAGIKPDPEIVAFMKGIAISGQKNNLITDYIIKILGLDICADIKVGDNMRRGISGGQKKRVTTGEMLVGPAKVFFMDEISTGLDSSTTFQICKFLRQMIHTMEVTMLVSLLQPAPETYELFDDIILLSEGQIVYQGPREHVLEFFENMGFKCPERKGVADFLQEVTSKKDQQQYWSRRNEPYRYVSVPEFAGSFHLFYVGKKLASEIKVPYDKSQTNEAALVKKKYGFTVFFRTEMPVGTVENGQKFYGALFFTLFNMMFNGSSEQAMIVSRLPVFYKQRDFMFYPAWAFALPVWILRIPISFLESGIWIALTYYTTGFAPSSS

SEQ ID NO: 188335 - protein, 198 aa, Glycine max
  Coding DNA Sequence Number=SeqID_71557
  Homolog annotation: Hit_ID=Q8S8F2; Match level="QueryCoverage=32%, HitCoverage=8%, E-value=2e-09, Identity=44%"; Hit description=F-box protein family, AtFBL11
MYVEKNSSPTSARDKATIEYISGRQPSVNNSLISAPNCPKKTQVPHRLEKATIEYINERQPSPYELAFEVELGPNPHSKNMWAKHSKSFGKLPYDLLLSLVKHPHLTVDSELHLSDALLLWLESNTENLERPSKSEENCYEVLKQGKDGKGKSSNLNNCEFVRSYDDDNKHWQKLRGFNGATGSFHCLTYNAYSEMMP

SEQ ID NO: 188336 - protein, 357 aa, Glycine max
  Coding DNA Sequence Number=SeqID_71558
  Gene Ontology: Mol. function=nucleoside-triphosphatase activity; Cellular component=integral to membrane; Biological process=transport
  Homolog annotation: Hit_ID=Q7PC84; Match level="QueryCoverage=97%, HitCoverage=71%, E-value=1e-139, Identity=51%"; Hit description =Probable pleiotropic drug resistance protein 11
  Pfam annotation: Domain name=ABC_tran; Domain location=68-247; Score =60.7; E_value=5e-15; Accession=PF00005.17; Description=ABC transporter
MAVKNSTEIATSSNQDPSRGMLLPFQPLSLAFNHIGNYVDMPAEMRSRGIIKDRLQLLQDVSGAFRPGILTALVGVSGAGKTTLMDVLAGRKTGGYTEGSVSISGYPKNQATFARISGYCEQNDIHSPHVTVYESLLFSAWLRLPSDVNAQTPRMFDEVMELVELNQISDALVGLPGVDGLSTEQRKRLTIAVELVANPSIIFMDEPTSGLDAIVAAIVMRTQNFHLFTSVAHIFLGILGVPKIKDGYNPATWMLDISYTSMEANLEVDFAEVYAKSTLCRRNQELIEELSTPVPDSKDLYFPTKYSQSFFVQCKANFWKQFWSYWRYPQYNAVRFFMKIVVGVMFGVIFWNDAQKT

SEQ ID NO: 188337 - protein, 105 aa, Glycine max
  Coding DNA Sequence Number=SeqID_71559
MDNESSLLNLFVTVKPLSTLLQSLNEYIGANLNLVQQYATSIHSQTSNASMSKSEFVDSEMQDEFYDAISAESLSSDEESDEDMELDQVSFFNLLINHKKVFTRN

SEQ ID NO: 188338 - protein, 63 aa, Glycine max
  Coding DNA Sequence Number=SeqID_71560
MLVKNLIGRLGVHDKTNYTLASQVTLTRLKGALKPSVFTPKAYTPKSPLGPLPLDSGPTQKTF

SEQ ID NO: 188339 - protein, 254 aa, Glycine max
  Coding DNA Sequence Number=SeqID_71561
  Gene Ontology: Mol. function=nucleic acid binding
  Homolog annotation: Hit_ID=Q2QXN6; Match level="QueryCoverage=83%, HitCoverage=48%, E-value=3e-22, Identity=33%"; Hit description =Calmodulin-binding family protein, putative, expressed
MEVETHSLSPTFELIHLLSQSTTDTYFPPNNAANQPSLGHATAVLKLQKVYRTRLAGWPTPPLLPRRWQAIDYVRVNHSTISFFNLPETAASCWSRVKLNAAKVGKGLSKDAIAQKCWLSSIGSKLLIHDIAMDITYNTTIKNGVKQMLASRFFLLIFHLRMLFQYNKLNCLQEREQYEYIVREDKIINKQYGDLFHTNEDSEDAKWIFVMSTSKKLYAGKKKKGLFHHSSFLAGGATLAAGRLVAENEILKVN

SEQ ID NO: 188340 - protein, 90 aa, Glycine max
  Coding DNA Sequence Number=SeqID_71562
MNNVSMMDAESEKRSASTISFSSSSSNSSSSCHRLDRLVDAEEIQAAETLAQLAMRDSHSADKWCTKQDTTRVTRESPTLLHSDLSLGPG

SEQ ID NO: 188341 - protein, 82 aa, Glycine max
  Coding DNA Sequence Number=SeqID_71563
MGPKSTLRLIRTLGPSLASLAQSTWSFLSNALARGKNYLKDNSKVIGGDPLLKLIVVDWLKVDKSIDKIALHHRSLVQVVMN

SEQ ID NO: 188342 - protein, 98 aa, Glycine max
  Coding DNA Sequence Number=SeqID_71564
MAELCLVPDIIIPLKFKVSDFDKYKGTSCPKNHLKMYYRKMGAYAKDEKLLMHFFQESLTGAAVAWQYEYNFDMAPDRMHLQNMCKKEHESFKEYAHR

SEQ ID NO: 188343 - protein, 237 aa, Glycine max
  Coding DNA Sequence Number=SeqID_71565
  Homolog annotation: Hit_ID=Q39802; Match level="QueryCoverage=32%, HitCoverage=28%, E-value=2e-24, Identity=71%"; Hit description =Cytokinin induced message
MGERELEPLEINDEAGPIARDPGKKANEALIKKSEKEKFVRIVGARDIRLKVDDNRGHAAVETEDAFGLEGFHNCVASVFVNLCCALGLHLGFDGVEGEEADVSEGADEATRGGVDEDMIKDKEGFEEGLWAGLWAGPGPFGGGGEGESGGRPREDEKPEGITLLATTDLPESVSLMENGALSGEPLLSFQIAPHDRCMEYHEAENASLSSTLSRSPFPSSYSAQTAKYSGLDPKST

SEQ ID NO: 188344 - protein, 203 aa, Glycine max
  Coding DNA Sequence Number=SeqID_71566
  Gene Ontology: Cellular component=lysosome; Biological process =sphingolipid metabolic process
  Pfam annotation: Domain name=SapB_1; Domain location=123-161; Score =32.4; E_value=1.5e-06; Accession=PF05184.5; Description=Saposin-like type B, region 1
  Pfam annotation: Domain name=SapB_2; Domain location=79-112; Score =29.3; E_value=1.4e-05; Accession=PF03489.7; Description=Saposin-like type B, region 2
  Pfam module annotation: Pfam domain module=SapB_1::SapB_2; Domain location=123-161::79-112
SLKRSRLSIVVFLVLSRAPPPVALLGFPNVREKENGLKPPFHGPICDAYFFLHRHYIANPNGEELNRKSDVSELCEEYTAECIELVDHYAPRFFLEIASVQPGELCKQIHICQSAKISSEVEGNSCDSCKDTVSALLVKLNDPDTKLEIMEALLKACNSMDKFSKKDIIVAAPSRGWSNQINEIIVHCWNWIDFFFCGATAEL

SEQ ID NO: 188345 - protein, 146 aa, Glycine max
  Coding DNA Sequence Number=SeqID_71567
  Subcellular localization annotation: CTP_CleavageSite=20; ConfidenceScore=5.09e-01
MNRLHKQQVLDRGPNPSLVVLRLISTTFMSSLVFLPIPIPSSHTCRQPLQITFQLLQHCGLQWNVTPWRGTIIIVVVVSFNKRFFGDGRGLQEESDGYYVCNTKSRGPLWIDVGRKVEDVGVVEGGGTKKELVVEKDGEREDFLNV

SEQ ID NO: 188346 - protein, 61 aa, Glycine max
  Coding DNA Sequence Number=SeqID_71568
MIEASLLLTAVEAGQACNVVHISAVFRNFSALTRIKGKKEVAQVAPSVFGECLIQVALPKR

SEQ ID NO: 188347 - protein, 73 aa, Glycine max
  Coding DNA Sequence Number=SeqID_71569
MVSGHDNSEKGNSLACAVVPQDEMSDARQCTTPFDRGHGGATEMQANGRGHGEVTVDQNFRETGKRELERECS

SEQ ID NO: 188348 - protein, 109 aa, Glycine max
  Coding DNA Sequence Number=SeqID_71570
IAPARHPVDPKKSNRVLELPALITGLCQFYGVPVTPSKVTKPPTNRAFIMKYCAPRHPQGETPQQPGDSQQQATDALPPPPKPLNSSTKAGAFPTTCGRLAGDQVQSQR

SEQ ID NO: 188349 - protein, 562 aa, Glycine max
  Coding DNA Sequence Number=SeqID_71571
  Gene Ontology: Mol. function=identical protein binding; Cellular component=cytoplasm; Biological process=negative regulation of enzyme activity
  Homolog annotation: Hit_ID=Q9LZS6; Match level="QueryCoverage=92%, HitCoverage=69%, E-value=1e-173, Identity=59%"; Hit description =Cucumisin-like protein
  Pfam annotation: Domain name=PA; Domain location=170-269; Score=34.3; E_value=4.2e-07; Accession=PF02225.12; Description=PA domain
  Pfam annotation: Domain name=Peptidase_S8; Domain location=1-396; Score=-17.3; E_value=7.4e-06; Accession=PF00082.12; Description =Subtilase family
  Pfam module annotation: Pfam domain module=PA::Peptidase_S8; Domain location=170-269::1-396
FNLAKSNSPSDNLSPADDIGHGTHTASTAAGAAVKGASLYGIGKGTARGGVPSARVAMYKVCWLDDCNDMDMLAAFDEAIADGVNIISISIGGPSHDFFTDPIAIGSFHAMGRGILTSCSAGNGGPRPMTVENVAPWLLTVAASAVNRQFTTLVAFGDGKNITGLSINTFAPKKKMYPLTSGLLASNLSGEGYGSASGCDYGTLSKEKVQGRIVYCVGGTGTQDLTIKELGGAGAIIGLDEEIDASYTTVIPGTFVEASTVGNTIDLYINSTKNARAVIHKTTTTEVPAPFLASFSSRGPQTITPNILKPDLVAPGVNILAAYSKLVTLTGYHEDNRYDVFNILSGTSMACPHATATAAYVKSFHPDWSPAAIKSALMTTATPIKISDNFTELGSGSGQIDPVKALHPGLVYDMRISSYIGFLCKAGFNNTNIGILIGKPNFNCTSIKPSPGTDGINYPSMHIQLLSASDRISAVFLRTVTNVGSRNSTYKAKVTTPKGLSVKVKPNILKFSRLHQKLSFKVVLKGPPMPEDTFVESASLEWKDSEHTVRSPILVFKPMTVY

SEQ ID NO: 188350 - protein, 162 aa, Glycine max
  Coding DNA Sequence Number=SeqID_71572
MDMPPLKLATYHRVKDIPTIKIHAHARTNNLLGQAIAGQYPDEKISTTTVETEMFQQDDCSRHMKVEQDADVLPNTSYSLVRSRKSRRNLTEEEKEVRRIRRILANRESARQTIRRRQFVRSNHQFYFRDLQIYLFIIHSLLDTVVHWTWLIPTVIINWMTI

SEQ ID NO: 188351 - protein, 331 aa, Glycine max
  Coding DNA Sequence Number=SeqID_71573
  Homolog annotation: Hit_ID=Q0GPE0; Match level="QueryCoverage=56%, HitCoverage=99%, E-value=2e-98, Identity=92%"; Hit description=BZIP transcription factor bZIP39
MFQALCEELTRKAASLVVENENLKREKQLALNEYQSLETTNKHLKAQIAKSINTEVEKTPVEPGSSVAEVTPLSGNGPWFLYNHFPVPQIFWPSILQFSNPVHLQNTSLNSFSIPPNAYVPCSSESESRHKQNNLINDNRTQNPFYMFPCPWLFPLPQFGNQQSSPSSSLKDEQDNLSLGKPCSSSSSLNTMANVDYQAALPIKLKTAASGWTEAISINGPGWATPRSSLDGGEKKTGCYIIEKYHEPSLGCNGHASAVKQEHEFQLHSAPNNKVSSTAYIATSSLEKKQGQCICQGRNLVDAVAAAEARKRRKELTKQKSIHNRQSRMHC

SEQ ID NO: 188352 - protein, 65 aa, Glycine max
  Coding DNA Sequence Number=SeqID_71574
  Gene Ontology: Mol. function=ribonuclease H activity; Biological process=DNA integration
FSEGDLVLKKVSQALKDNKGKWAPNYEGPFVVKKAFSGRSLVLANMDDEELPSPVNSDVVKRYYA

SEQ ID NO: 188353 - protein, 156 aa, Glycine max
  Coding DNA Sequence Number=SeqID_71575
  Gene Ontology: Mol. function=identical protein binding; Cellular component=cytoplasm; Biological process=negative regulation of enzyme activity
  Homolog annotation: Hit_ID=Q9LZS6; Match level="QueryCoverage=89%, HitCoverage=18%, E-value=7e-45, Identity=63%"; Hit description =Cucumisin-like protein
  Pfam annotation: Domain name=Subtilisin_N; Domain location=1-75; Score=50.5; E_value=5.5e-12; Accession=PF05922.7; Description =Subtilisin N-terminal Region
MGELPVARTYAVESHHHNLLEAAIGDKQLARESKIHSYGKSFNGFVARLLPHEAEKLQEEDSVVSVFPNTHRKLHTTRSWDFLGMPLNVKRNSKVESHIIVGVLDTGIWVDCPSFNAEGYGPPPRRWKGKCETGANFTGCNKYCSMHHLYLCDFVQ

SEQ ID NO: 188354 - protein, 955 aa, Glycine max
  Coding DNA Sequence Number=SeqID_71576
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=96%, HitCoverage=96%, E-value=0.0, Identity=53%"; Hit description =Receptor protein kinase-like
  Pfam annotation: Domain name=LRRNT_2; Domain location=27-74; Score =29.8; E_value=9.5e-06; Accession=PF08263.3; Description=Leucine rich repeat N-terminal domain
  Pfam annotation: Domain name=LRR_1; Domain location=104-126; Score =17.5; E_value=0.047; Accession=PF00560.23; Description=Leucine Rich Repeat
  Pfam annotation: Domain name=LRR_1; Domain location=128-150; Score =16.4; E_value=0.11; Accession=PF00560.23; Description=Leucine Rich Repeat
  Pfam annotation: Domain name=LRR_1; Domain location=152-174; Score =12.6; E_value=1.3; Accession=PF00560.23; Description=Leucine Rich Repeat
  Pfam annotation: Domain name=LRR_1; Domain location=176-198; Score =7.9; E_value=9.6; Accession=PF00560.23; Description=Leucine Rich Repeat
  Pfam annotation: Domain name=LRR_1; Domain location=200-222; Score =19.5; E_value=0.012; Accession=PF00560.23; Description=Leucine Rich Repeat
  Pfam annotation: Domain name=LRR_1; Domain location=224-246; Score =4.2; E_value=48; Accession=PF00560.23; Description=Leucine Rich Repeat
  Pfam annotation: Domain name=LRR_1; Domain location=248-270; Score =14.3; E_value=0.43; Accession=PF00560.23; Description=Leucine Rich Repeat
  Pfam annotation: Domain name=LRR_1; Domain location=272-294; Score =15.0; E_value=0.27; Accession=PF00560.23; Description=Leucine Rich Repeat
  Pfam annotation: Domain name=LRR_1; Domain location=296-318; Score =16.0; E_value=0.14; Accession=PF00560.23; Description=Leucine Rich Repeat
  Pfam annotation: Domain name=LRR_1; Domain location=320-342; Score =7.1; E_value=13; Accession=PF00560.23; Description=Leucine Rich Repeat
  Pfam annotation: Domain name=LRR_1; Domain location=344-366; Score =11.7; E_value=1.9; Accession=PF00560.23; Description=Leucine Rich Repeat
  Pfam annotation: Domain name=LRR_1; Domain location=368-390; Score =6.4; E_value=18; Accession=PF00560.23; Description=Leucine Rich Repeat
  Pfam annotation: Domain name=LRR_1; Domain location=392-413; Score =4.2; E_value=46; Accession=PF00560.23; Description=Leucine Rich Repeat
  Pfam annotation: Domain name=LRR_1; Domain location=415-437; Score =9.2; E_value=5.4; Accession=PF00560.23; Description=Leucine Rich Repeat
  Pfam annotation: Domain name=LRR_1; Domain location=439-461; Score =7.0; E_value=14; Accession=PF00560.23; Description=Leucine Rich Repeat
  Pfam annotation: Domain name=LRR_1; Domain location=463-486; Score =4.4; E_value=43; Accession=PF00560.23; Description=Leucine Rich Repeat
  Pfam annotation: Domain name=LRR_1; Domain location=488-509; Score =6.2; E_value=20; Accession=PF00560.23; Description=Leucine Rich Repeat
  Pfam annotation: Domain name=LRR_1; Domain location=511-533; Score =12.0; E_value=1.6; Accession=PF00560.23; Description=Leucine Rich Repeat
  Pfam annotation: Domain name=LRR_1; Domain location=535-557; Score =17.1; E_value=0.065; Accession=PF00560.23; Description=Leucine Rich Repeat
  Pfam annotation: Domain name=LRR_1; Domain location=559-581; Score =7.2; E_value=13; Accession=PF00560.23; Description=Leucine Rich Repeat
  Pfam annotation: Domain name=LRR_1; Domain location=583-606; Score =15.4; E_value=0.2; Accession=PF00560.23; Description=Leucine Rich Repeat
  Pfam annotation: Domain name=Pkinase; Domain location=700-940; Score=- 30.7; E_value=9.9e-07; Accession=PF00069.15; Description=Protein kinase domain
  Pfam annotation: Domain name=Pkinase_Tyr; Domain location=700-940; Score=-112.1; E_value=1.4e-05; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=27-74::104-126::128-150::152-174::176-198::200-222::224 -246::248-270::272-294::296-318::320-342::344-366::368-390::392 -413::415-437::439-461::...
  Pfam module annotation: Domain location=463-486::488-509::511 -533::535-557::559-581::583-606::700-940::700-940
MEVFKYSHIKNLLLATFMVSSAVLAIDDPYSEALLSLKAELVDDDNSLQNWVVPSGGKLTGKSYACSWSGIKCNNGSTIVTSIDLSMKKLGGVVSGKQFSIFTNLTSLNLSHNFFSGNLPAKIFNLTSLTSLDISRNNFSGPFPGGIPRLQNLIVLDAFSNSFSGSLPAEFSQLASLKVLNLAGSYFRGSIPSEYGSFKSLEFLHLAGNSLSGSIPPELGHLNTVTHMEIGYNLYQGFIPPEIGNMSQLQYLDIAGANLSGLIPKQLSNLSNLQSLFLFSNQLTGSIPSELSNIEPLTDLDLSDNFFTGSIPESFSDLENLRLLSVMYNDMSGTVPEGIAQLPSLETLLIWNNKFSGSLPRSLGRNSKLKWVDASTNDLVGNIPPDICVSGELFKLILFSNKFTGGLSSISNCSSLVRLRLEDNLFSGEITLKFSLLPDILYVDLSRNNFVGGIPSDISQATQLEYFNVSYNQQLGGIIPSQTWSLPQLQNFSASSCGISSDLPPFESCKSISVVDLDSNNLSGTIPNSVSKCQTLEKINLSNNNLTGHIPDELATIPVLGVVDLSNNNFNGTIPAKFGSCSNLQLLNVSFNNISGSIPAGKSFKLMGRSAFVGNSELCGAPLQPCPDSVGILGSKCSWKVTRIVLLSVGLLIVLLGLAFGMSYLRRGIKSQWKMVSFAGLPQFTANDVLTSLSATTKPTEVQSPSVTKAVLPTGITVLVKKIEWEERSSKVASEFIVRLGNARHKNLVRLLGFCHNPHLVYLLYDYLPNGNLAEKMEMKWDWAAKFRTVVGIARGLCFLHHECYPAIPHGDLKPSNIVFDENMEPHLAEFGFKQVLRWSKGSSPTRNKWETVTKEELCMDIYKFGEMILEIVTGGRLTNAGASIHSKPWEVLLREIYNENEGTSASSLHEIKLVLEVAMLCTQSRSSDRPSMEDVLKLLSGLKHLEDGRTSKEG

SEQ ID NO: 188355 - protein, 548 aa, Glycine max
  Coding DNA Sequence Number=SeqID_71577
  Gene Ontology: Mol. function=oxidoreductase activity; Cellular component=membrane; Biological process=electron transport
  Homolog annotation: Hit_ID=Q2MJ03; Match level="QueryCoverage=84%, HitCoverage=90%, E-value=1e-159, Identity=58%"; Hit description =Cytochrome P450 monooxygenase CYP94C9
  Pfam annotation: Domain name=p450; Domain location=68-514; Score =79.8; E_value=8.5e-21; Accession=PF00067.12; Description=Cytochrome P450
MELELESFTLCTLMQLFTNIPFGSTLCLSLAIIIITLVILTTFSSSLFLRWPKIITFFCSCETCQAYLTSGWSKTFDNLCDWYAHLLRNSPTKTIHIHVLRNTITANPDNVEYMLKTRFHNFPKGKTFSTILGDFLGRGIFNVDGESWSFQKKMASLELSKNSIRSFAFEVVKFEIKDRLIPLLVLSKQNDCVLDLQDVFKRFSFDSICRFSFGLDPMCLELSLPISEFAMSFDLASKLSAERAMSVSPLIWKIKRFLNVGSEKKLRKAIKMIDILAREVIRQRRKMGFSSISPHKDDLLSRFMRTITDDTYLKDIIVSFLLAGRDTVASALTSFFWLLAKHPEVESQILLEAEQVIGSDYNKDLTSYEELQQLHYLQAAANESMRLYPPIQFDSKFCLEDDVLPDGTFVKRGTRVTYHPYAMGRLEEIWGSDCFEFRPERWLKEGLFCPQNPFKYPVFQAGIRVCLGKEMALLELKSVALSLLRRFHIELAAPPPHHHHHSTPRFSPGLTATFSCGLRVKVLSLAPLECCQCISARVILPDYTSNIE

SEQ ID NO: 188356 - protein, 201 aa, Glycine max
  Coding DNA Sequence Number=SeqID_71578
  Gene Ontology: Mol. function=oxidoreductase activity; Cellular component=membrane; Biological process=electron transport
  Homolog annotation: Hit_ID=Q2MJ03; Match level="QueryCoverage=68%, HitCoverage=34%, E-value=9e-47, Identity=70%"; Hit description =Cytochrome P450 monooxygenase CYP94C9
MALSADSFDAKSKDIANSDIGRDSSRHIGSNPKENLQMLSNENLLKTSCEGSYRVLAEFKTRHLLLEAPGFSVDVEDSSAEEIAEDGGERFSLGEVVEPGLEHVFHVVGVGGDGVSEDVDVDGFCRRVSEEVSVPIAKRRKRDEEKVVRITRVMMIMASERHSVLPKGMLVKSCIRVHSVKDSSSSSIDGLWIKIEYRAGF

SEQ ID NO: 188357 - protein, 198 aa, Glycine max
  Coding DNA Sequence Number=SeqID_71579
DVRKKAQAIQKQNTAPHVLSHGGYEYLEQKLLAEKTKKKLEEAAHSGSIDDVIDPPSPIRRHVKWKMARTKKTGEMTTEAAKEIAEKIDSFEEQATQGSFVPHGQHPGRVRAAGAGVTIKQYFGSAPRTSHSSSSLPPEELQQLTQQIRDQLEESITEKVTRQLMASFSQMQSQIQSHMQSQGLALPPKPLVGPSGPH

SEQ ID NO: 188358 - protein, 96 aa, Glycine max
  Coding DNA Sequence Number=SeqID_71580
  Homolog annotation: Hit_ID=Q1S438; Match level="QueryCoverage=70%, HitCoverage=9%, E-value=1e-08, Identity=48%"; Hit description=WRKY DNA-binding domain, putative
MRQFGALANRLTSSTKQPQQKLTIWTNIQTRIKDTKLSFDWKADGQDKTSSTSVGTALLDPMSTNKAKSLCMFELEDTPQLSSTLASNDGHEDGTA

SEQ ID NO: 188359 - protein, 282 aa, Glycine max
  Coding DNA Sequence Number=SeqID_71581
  Gene Ontology: Mol. function=hydrolase activity, acting on ester bonds; Biological process=lipid metabolic process
  Homolog annotation: Hit_ID=Q7X9E8; Match level="QueryCoverage=32%, HitCoverage=98%, E-value=7e-36, Identity=70%"; Hit description=Lipase
  Pfam annotation: Domain name=Lipase_GDSL; Domain location=5-271; Score=13.0; E_value=0.00015; Accession=PF00657.12; Description=GDSL -like LipaseAcylhydrolase
MESFITSGSDRDFCSFVNKTKYLRVKSPIPYRLRKLMPQHLKYGMNFAFGGTGVFNTFVPLPNMTTQIDFLEQLIKDKVYNSLDLTNSVALVSVAGNDYGRYMLTNGSQGLPSFVASVVNQTANNLIRIKGLGVKKIAVGALQPLGCLPPQTATTSFQRCNATSNALVLLHNSLLNQAVTKLNQEITKERSSFVILNLFDSFMSVLNNPSTHNIRNKLTPCCVGVSTNYSCGSVDKNNVKKYRVCDDPKSAFFWDLVHPTQAGWHAVYNKLRTMNDLQHILY

SEQ ID NO: 188360 - protein, 33 aa, Glycine max
  Coding DNA Sequence Number=SeqID_71582
MAHVNNGRIIRQALENVVITFSLSQSAGLASIR

SEQ ID NO: 188361 - protein, 295 aa, Glycine max
  Coding DNA Sequence Number=SeqID_71583
  Gene Ontology: Mol. function=hydrolase activity; Cellular component =extracellular space; Biological process=biological_process
  Homolog annotation: Hit_ID=Q8S340; Match level="QueryCoverage=93%, HitCoverage=64%, E-value=1e-128, Identity=73%"; Hit description =Purple acid phosphatase
  Pfam annotation: Domain name=Metallophos; Domain location=2-190; Score=47.6; E_value=4.1e-11; Accession=PF00149.18; Description =Calcineurin-like phosphoesterase
MTGGDLGQTEWTASTLKHVDSNDYDVFLLPGDLSYADSQQPLWDSFGRLVEPYASKRPWMVTEGNHEIESFPIIYPQGFQAYNARWPMPFQQSGSTSNLYYSFEVTATHFIMLGSYTDFDAQSQQYTWLQSDLANIDRAKTPWVIVLLHAPWYNTNEAHQGEGESMRQAMEELLYEARVDLVFAGHVHAYERFTRIYDNKADSCGPMYVTIGDGGNREGLALMFKNPPSPLSLYREPSFGHGRLRILNETHAHWSWHRNNDADAVVADGVWIESLSSSKACSKTPDQQDAANEEL

SEQ ID NO: 188362 - protein, 175 aa, Glycine max
  Coding DNA Sequence Number=SeqID_71584
  Gene Ontology: Mol. function=hydrolase activity; Cellular component =extracellular space; Biological process=biological_process
  Homolog annotation: Hit_ID=Q8S340; Match level="QueryCoverage=75%, HitCoverage=31%, E-value=7e-40, Identity=60%"; Hit description =Purple acid phosphatase
MAFPILLHTLCFLLFPQPLLSQENFVRQPAGQLIITPHHGSHSDPQQVHISLVGKEKMRVSWITEDKHTESVVEYGTKAGEYREKATGLHTSYQYFLYNSGKIHNVVIGPLQPGTTYFYRCGGSGPDFSFKTPPPKFPIEFVIVVLQAAVVGQDKDYTPPVHSCQTCLNKSIANH

SEQ ID NO: 188363 - protein, 199 aa, Glycine max
  Coding DNA Sequence Number=SeqID_71585
  Gene Ontology: Mol. function=ribonuclease H activity; Cellular component=intracellular; Biological process=DNA integration
  Pfam annotation: Domain name=rve; Domain location=22-177; Score=52.8; E_value=1.1e-12; Accession=PF00665.16; Description=Integrase core domain
CRKWQAFTDNVNAPLVPLNVVATPWSFSMWGIDVIRANEPKASNGHRFILVAIDYFTKCVEAASYASVTRSVVVRFIKKEIICRYSLPRKIIIENATNLNNKMMKEMCEDFKIQHHNSTPYRPKMNGAVEVANKNIKKIVQKMNVSYKDWHEMFPFTLQEVPSLRILAESGLEELEWAKARFNQVNLIGAWMMKNYLCP

SEQ ID NO: 188364 - protein, 54 aa, Glycine max
  Coding DNA Sequence Number=SeqID_71586
MKMQMRVPGFLLFLLTIGIFEVDAVYGYVRPPPRKTLFVPHANQDSHSPQQFIA

SEQ ID NO: 188365 - protein, 79 aa, Glycine max
  Coding DNA Sequence Number=SeqID_71587
MWCLVHLYGCSWSTGVKSPRCLSSSAAQQLVSEPMIRLDDQLKQDDGDRSLDMEIPYIESLPGGYNVKFTYMVAYDPLV

SEQ ID NO: 188366 - protein, 1218 aa, Glycine max
  Coding DNA Sequence Number=SeqID_71588
  Gene Ontology: Mol. function=RNA-directed DNA polymerase activity; Cellular component=chromatin; Biological process=chromatin assembly or disassembly
  Pfam annotation: Domain name=RVP; Domain location=340-444; Score= -6.8; E_value=0.018; Accession=PF00077.10; Description=Retroviral aspartyl protease
  Pfam annotation: Domain name=RVP_2; Domain location=327-458; Score= -36.2; E_value=0.00066; Accession=PF08284.2; Description=Retroviral aspartyl protease
  Pfam annotation: Domain name=rve; Domain location=1095-1218; Score =42.4; E_value=1.5e-09; Accession=PF00665.16; Description=Integrase core domain
  Pfam annotation: Domain name=zf-H2C2; Domain location=1036-1077; Score=18.1; E_value=0.0014; Accession=PF09337.1; Description=His(2) -Cys(2) zinc finger
  Pfam module annotation: Pfam domain module=RVP::RVP_2::RVT _1::Retrotrans_gag::rve::zf-H2C2; Domain location=340-444::327 -458::581-750::83-173::1095-1218::1036-1077
MAESSNDRVEAALARLTSRIEDLLQHVTPSTSPPFPPRSPIPALSHRIKLDVPRFDGTDPLGWIFKITQFFEYHGTPEHDRITIAAFYMEGRALAWFQWMSSNGQFTSWPVFLQALQTRFAPSQYEDPSGSLFKLTQRTTVTEYLSEFEELANRVVGLPAPFLLSCFVSGLAPEIRLEVMVNQPLTVAQAAGLTRLHEEKLRDLRFDFRQLPRQRAPPPPPLASPQPPSLTPFASPRLSPLPPLLPSPPRPSPPPMVRRLTPEELASRRERGLCFSCDEKFHKGHRCAPRVHLLIADADDPLEHVGSNIDPVDPGDPTPGPIDLPETPAHISLNSLAGHLAPKTLRLVGHISGHSVLVLIDSGSTHNFIQDQLVAQLGLPCRPTTPLKVLVGNGQHLQCHTTYDSITIDLQQHSFVVDLYVLSIAGANVILGVQWLQSLDPVLTDYTKLSMQFFHDGRIVQLQGDPVAQRDLLSSPQFRRVCRNQPNNICFHITVLPEDSEPVMPSPIEPQVQHLLQQFSVLFQDPTQLPPARDTDHQIHLRPDATPINVRPYKYPYYQKREIETQVETMLQRGIIQPSKSPFSSPVLLVKKSDNTWRFCVDYRALNALTIKDRFPIPTIDELLDELGGASCFSKLDLVQGYHQIRMQSEDIPKTAFRTHHGHFEFKVMPFGLCNAPSSFQATMNTLFRPYLRCFIIVFFDDILIYSVSLSDHLRHLQTTFQVLYDNHFVLKLSKCLFAQPQVEYLGHLVSHRGVQPVASKIAAIAQWPNPRSVRALRSFLGLAGFYRRFIRGYATIAAPLVKATTVEPLHWTPATQTAFDTLKAALTSAPVLALPDFKLPFTVETDASAIGMGAVLSQQGHPIAFFSKPFSQKMLRASTYVRELCAITIAVRKWRQYLLGHSFTILTDHQSLKELMTQVVQTLEQHTYLARLMGYDYHIQYRLGSHNQAADALSRLPEGASQAFLILSVPCLTFLDELHDQLRTNSTFQQKLLDVQNHLDHHPEFSIADKLLLYKGRIWLPSDIPIITTLLTEYHATPTGGHAGVAKTVARLMTNFYWPGLRDDVSRFVAQCVDCQVTKYETKKLAGLLCPLPVPSQPWYDLSLDFITSLPAYRGNTVILVVVDRFSKGIHLGMLPPSHSALTVAKLFLDIVVKIHGMPRSLVSDRDPLFVSQLWQELFKASGTQLRMSSAYHPQSDGQTEVMNRVVEQYLHAFVHR

SEQ ID NO: 188367 - protein, 319 aa, Glycine max
  Coding DNA Sequence Number=SeqID_71589
  Gene Ontology: Mol. function=peroxidase activity; Cellular component =vacuole; Biological process=response to oxidative stress
  Homolog annotation: Hit_ID=Q1T3V2; Match level="QueryCoverage=97%, HitCoverage=97%, E-value=1e-103, Identity=60%"; Hit description=Haem peroxidase, plant/fungal/bacterial
  Pfam annotation: Domain name=peroxidase; Domain location=43-283; Score=457.0; E_value=2.4e-134; Accession=PF00141.13; Description =Peroxidase
MESRGYLFFLLQGLVFAALATSAFSQLSPNYYDYSCPNALSTIKSVVEAAVQKEHRMGASLLRLHFHDCFVNGCDGSVLLDSTSSIDSEKNAAANFQSARGFEVVDDIKKAVDQACGKPVVSCADILAVAARDSVVALGGPSWKVSLGRRDSTTASREAADASIPAPFFSLSDLITNFKNHGLDEKDLVVLSGGHSIGYARCVTFRDHIYNDSNIDANFAKQLKYICPTNGGDSNLSPLDSTAANFDVTYYSNLVQKKGLLHSDQELFNGGSTDELVKEYSDDTEDFYEDFANSMIKMGNIQPLTGNQGEIRVNCRNVN

SEQ ID NO: 188368 - protein, 139 aa, Glycine max
  Coding DNA Sequence Number=SeqID_71590
MVFIKSLWFMLPTPMLRISTLQRFGFHHSNASESPQKPDSGGGDINEGSGGVSVLRDDEVDEGGGFDAQASNFQGRALRSLLWQLNSLMFSVSACDGIGEVIDMTTPKIVKNLERLEKEENILPSPDIDGFMKVVSSAK

SEQ ID NO: 188369 - protein, 337 aa, Glycine max
  Coding DNA Sequence Number=SeqID_71591
  Homolog annotation: Hit_ID=Q1SP02; Match level="QueryCoverage=61%, HitCoverage=63%, E-value=4e-13, Identity=27%"; Hit description=IMP dehydrogenase/GMP reductase
MVRTKGLGQALVMMMMIMMPPTAHVVEDPPMAAEELNEEQQQPPIEEGVTNVKGFPRMERYERLELKLSSHGRKMAKFGRLAPEIEGLETSSFHLPDEEVTITLDDMASLLHLPIVRAFHTFELLYVDDIVDMLVELLESGTYAWGTVTLVHMYDNLNEASKSTVRQLARYITLLQALPVSTYRRRLDKLTPDVVYWIPNGDHRSFREFEVISLFSGHLRWGPLTVIHRPKKVVRQFGYIQTIPPHLVVPSASVEEMDAKWMQFGDYIAHQPVAAGAPNEVDVNVHRPGHVVDGYVAIVDKLERLLNLRIPTEGIKPCIVVEKCLSIARSYIGQPTI

SEQ ID NO: 188370 - protein, 71 aa, Glycine max
  Coding DNA Sequence Number=SeqID_71592
MAFGFYPRVQEEQDPPAELKRVLDDNDPIEVVAMHGDEGGIMVGACEVAVRGGNRSGQARPDFKRPKLSLR

SEQ ID NO: 188371 - protein, 75 aa, Glycine max
  Coding DNA Sequence Number=SeqID_71593
MLQESHEIFVCIKGDCKTTRLVRAKLAFKSQLGYVGAHLTVPGRIEFFFFSEPMWDTECQFQGGKEKCLIADWFP

SEQ ID NO: 188372 - protein, 113 aa, Glycine max
  Coding DNA Sequence Number=SeqID_71594
MTVIITTVFESEKFSKTSNGISPIKNLAKAPGPAYGKTIPHQNVTSNGKDLHQFQTYTYSPVSVFESSSSSSVENSNFDRPVIPVKQARSNVSILQTSVLYETMTSTFCIIFF

SEQ ID NO: 188373 - protein, 39 aa, Glycine max
  Coding DNA Sequence Number=SeqID_71595
MASPMTCGGTLWFYFHHPETFKPDDAQGSSLLGRDDQVR

SEQ ID NO: 188374 - protein, 372 aa, Glycine max
  Coding DNA Sequence Number=SeqID_71596
  Gene Ontology: Mol. function=ubiquitin-protein ligase activity; Cellular component=ubiquitin ligase complex; Biological process =protein ubiquitination
  Homolog annotation: Hit_ID=Q84VE7; Match level="QueryCoverage=95%, HitCoverage=52%, E-value=1e-55, Identity=35%"; Hit description=Arm repeat protein
  Pfam annotation: Domain name=U-box; Domain location=272-346; Score =90.2; E_value=6.2e-24; Accession=PF04564.6; Description=U-box domain
MAISPETFPTRKRRPENMASFMSPKINDLNVLCSLLQLTDQICSLNLTTTLLNRVSSSTIRKTQLLGVVFEELVRVSNLNSNSSVLFLCLEEMYIVLHNIKILIEDFSNGSKFNLLMQIETVADNFHRLTGELSTLLDVLPLQELDLNDDVRELALLVRKQGSEAKAFIGAEQISLRNDVVFVLDRIKNEIVPDQAHLASIFEKLEIRDASSCRAEIESLEEEIHNRSEEQPKTDLVALIGLVRFAKCVLYGASTPSQKTVTMRRNQSLELTIPADYRCPISLELMRDPVVVATGQTYDRASIKLWMDSGHNTCPKTGQTLSHTELIPNRVLRNMIAAWCREQRIPFKVETVTGKHNSGVTNKAALEATRMM

SEQ ID NO: 188375 - protein, 50 aa, Glycine max
  Coding DNA Sequence Number=SeqID_71597
MDEAKPMATFMHPSIVIDKDGKGNDTPEAIDADVACQFLGKSLASWSSKN

SEQ ID NO: 188376 - protein, 99 aa, Glycine max
  Coding DNA Sequence Number=SeqID_71598
MTITPPHEKGIMIRSPKKKSSVEAEKLGRKRQRADMKPLLYFKTRSFKRSLVLDGQRESGQWKVWTDFFEIHEPMYPRLVRAFFSATKVDQYNFTLKAT

SEQ ID NO: 188377 - protein, 149 aa, Glycine max
  Coding DNA Sequence Number=SeqID_71599
  Gene Ontology: Mol. function=pepsin A activity; Biological process =proteolysis
  Homolog annotation: Hit_ID=Q9LHE3; Match level="QueryCoverage=75%, HitCoverage=27%, E-value=5e-27, Identity=57%"; Hit description =Nucleoid chloroplast DNA-binding protein-like
NCINYTVIEVLKLEAQKPNRADEHSLVQVPAAGDSVPNHNFSQRDCFESEPAFGVGVVAMGDLVMAATLVEVDIIELVVDVGGARDGSEDGWHWTHMSSLPESMSMYWYVAGLPIPIHTKYSPLPSFVVMCPLSRVGLGVQTTREINVA

SEQ ID NO: 188378 - protein, 197 aa, Glycine max
  Coding DNA Sequence Number=SeqID_71600
  Gene Ontology: Cellular component=mitochondrion
  Homolog annotation: Hit_ID=Q3LHL2; Match level="QueryCoverage=85%, HitCoverage=31%, E-value=3e-13, Identity=28%"; Hit description =Hypothetical protein PPS5
  Pfam annotation: Domain name=DUF292; Domain location=30-154; Score =68.7; E_value=1.9e-17; Accession=PF03398.5; Description=Eukaryotic protein of unknown function, DUF292
MWSYAIRYALVCVGVCGWKKAFKCENLIMQFQAQLIIQKNRRHVIINQSREDIVQLLQIDKLEGAFSRVDQLYKDTCLLTAYDLIDNFCECIISNMSFISKCSSVHNLSTNVVVAIASLTYASSRCGELPLLHLIRNLFRERYGRDFDITNVELFAGNYVDLPLRKNLSIYSVPEDEKLMLLNDIALENFNKELEIL

SEQ ID NO: 188379 - protein, 68 aa, Glycine max
  Coding DNA Sequence Number=SeqID_71601
MASCCTSKTKNIKVEVEGEGTCGAGSYTRSLRDRSELEDAFQRGVLFAAITKRIAKIAAEKCTGDVPK

SEQ ID NO: 188380 - protein, 123 aa, Glycine max
  Coding DNA Sequence Number=SeqID_71602
  Gene Ontology: Mol. function=binding; Cellular component=membrane coat
  Homolog annotation: Hit_ID=Q2RBN7; Match level="QueryCoverage=62%, HitCoverage=4%, E-value=1e-30, Identity=75%"; Hit description =Clathrin heavy chain, putative, expressed
MGSLDRITCCLQALWGKKECFSSCLFVCYDLIPADIALELAWMNNMIDFAFPYLLQFIREYTGKVDELVKDKIEASNQVKTKEQEEKENMDAQLLPLNLPAPPMGGLGMPPMPPFGMPPMGSY

SEQ ID NO: 188381 - protein, 210 aa, Glycine max
  Coding DNA Sequence Number=SeqID_71603
MAYSLVDDTSSHLFSFIFYCNSMAKINGELVPKEWDEKTKVQHDQKAGNILTFGLSLDELFHTARTSNKIHPHSKSLGLRKTFEDDELNIKISNCLKRTWEQKITSIKESKDLASMPMEALFGKLLAYEYKLIQQSHVKDTKKKNKWIVLKASSLKENHKEESSDDEDAQKLNLMVKKFGKFLNGSKDKKFSKPSKKVKNNSNTFTSKTS

SEQ ID NO: 188382 - protein, 156 aa, Glycine max
  Coding DNA Sequence Number=SeqID_71604
MRQQISSPWMLIGDFNEIISPSGVSGGSYIVPRACLMADMMMSHTVSKVAAIVKKIPLYKVWWGCTFQETMLSNEVKDHFQEFKGLALNTVKLFPLPPYPREADSGQHLKRTQVTWGQLRIDSFRHKMLALWTQLHQQQTWLDGDGHRHTSCARCK

SEQ ID NO: 188383 - protein, 57 aa, Glycine max
  Coding DNA Sequence Number=SeqID_71605
  Gene Ontology: Mol. function=protein binding; Cellular component =cytoskeleton
  Pfam annotation: Domain name=DUF623; Domain location=2-53; Score =54.9; E_value=2.7e-13; Accession=PF04844.4; Description=Protein of unknown function, DUF623
MESMMEMIVENNIRASKDLEDLLACYLSLNSDEYHDLIIKTCSVADRNKFTRDMNSV

SEQ ID NO: 188384 - protein, 131 aa, Glycine max
  Coding DNA Sequence Number=SeqID_71606
MEEKVKLKINEGLRSTYLKLLWRRGERRHHPLENKPWKEKLHHQDSALDKKLRKGASVEEVNERKRERKWNGKLKEERKRTQGPKIYPKAHENPRALSCIFGPILLESSIQCPWGVGLGSLSISREATSDI

SEQ ID NO: 188385 - protein, 84 aa, Glycine max
  Coding DNA Sequence Number=SeqID_71607
MLATHSGYRDTTKKPASNCVFTYSFIFRDISGFILLNFYFIGEHSGFRARLGELLLQPKVTLLAQASAARPSELVTSPLSYLGA

SEQ ID NO: 188386 - protein, 191 aa, Glycine max
  Coding DNA Sequence Number=SeqID_71608
  Gene Ontology: Mol. function=zinc ion binding
  Homolog annotation: Hit_ID=Q1RX12; Match level="QueryCoverage=71%, HitCoverage=15%, E-value=2e-43, Identity=60%"; Hit description=Zinc finger, RING-type; Transcription factor jumonji, jmjC; Cupin region; Zinc finger, FYVE/PHD-type
MSGLRLTHVNPNALELLSKISIWQKIDLFQGYKLISFLRISYWVNILSELVCKAKELVQAYKLQNVVKTADNFCSCLKLDRNTDVSYSNMRKAASWEDLTDNYLFCSKAVDPQYKDLRHFQWHWEKGEPVIVSNVLECTSGLSWEPLVMWRALRHVTNTKHGQHLAEKTIDCLDWTESHQNRMSLKYFVKY

SEQ ID NO: 188387 - protein, 242 aa, Glycine max
  Coding DNA Sequence Number=SeqID_71609
  Gene Ontology: Mol. function=hydrolase activity; Cellular component =extracellular space; Biological process=biological_process
  Homolog annotation: Hit_ID=Q9LXI7; Match level="QueryCoverage=95%, HitCoverage=54%, E-value=4e-89, Identity=65%"; Hit description =Purple acid phosphatase
  Pfam annotation: Domain name=Metallophos; Domain location=105-226; Score=5.7; E_value=0.099; Accession=PF00149.18; Description =Calcineurin-like phosphoesterase
  Subcellular localization annotation: CTP_CleavageSite=46; ConfidenceScore=5.16e-01
MGPNVDNGWAFQVHISQVGQNKMRISWITDSPTPAKVSYGPSPSVNASSAIGTTSSYRYLVYESGEIHNVVIGPLNPNTVYYYRLGDPPSSQTYNFKTPPSQLPIKFAVVGDLGQTDWTRSTLEHVNKSNYDMLLLPGDLSYADFIQDLWDSFGRLVEPLASQRPWMVTQGNHEVEMIPLIHTTPFTAYNARWLMPFQESGSNSNLYYSFDVAGVHVIMLGSYTDFDSSSPQYKWLQNDLQK

SEQ ID NO: 188388 - protein, 176 aa, Glycine max
  Coding DNA Sequence Number=SeqID_71610
  Subcellular localization annotation: CTP_CleavageSite=54; ConfidenceScore=5.24e-01
MLIPSSSVNTTPELKIFILTSFLRFFRRFPQINVGGDSVHLSSFGKRTREPRLRSPAKGHVATQLKNDDDVNTMLMCNDQFLCVVSIELLCTIGRTLEGILNLLQATMTHSHDALLYYNGRWNMPRKHDFGDYSFIGKNLKKFDIPLGCTIDELKDLIKQVGSQGIPLTVFMNHKQ

SEQ ID NO: 188389 - protein, 76 aa, Glycine max
  Coding DNA Sequence Number=SeqID_71611
  Gene Ontology: Mol. function=hydrolase activity; Cellular component =extracellular space; Biological process=biological_process
  Homolog annotation: Hit_ID=Q2QXM4; Match level="QueryCoverage=97%, HitCoverage=16%, E-value=8e-27, Identity=65%"; Hit description =Ser/Thr protein phosphatase family protein, expressed
MYITIGDGGNREGLATKYINPKPTISIFREASFGHGTLEVFNVSHARWTWHKNDNDEAVISDFVWLTSFSSNPSCK

SEQ ID NO: 188390 - protein, 76 aa, Glycine max
  Coding DNA Sequence Number=SeqID_71612
MGLRMCVPGFLLLLIIGIFELDVVSGYIQPPPRQTLFIPHTDQDSHSTQQVHISQLGQNKMRISWITGSPTPAKVT

SEQ ID NO: 188391 - protein, 76 aa, Glycine max
  Coding DNA Sequence Number=SeqID_71613
MERLNSELYYQNCHMIKENERLRKKAQLLNQENQQLLSELKKKLSKGNAKTNAAPNTILDLNLGSSSSHNPSGSSN

SEQ ID NO: 188392 - protein, 84 aa, Glycine max
  Coding DNA Sequence Number=SeqID_71614
MFYRIKMVIPQKSTMKLTILLLFIMIASDVCKKSDARNVVTLRCKNHDYCQYLFRFSGCKCFDAWCRCPREVTPFVSPTINNHI

SEQ ID NO: 188393 - protein, 539 aa, Glycine max
  Coding DNA Sequence Number=SeqID_71615
  Gene Ontology: Mol. function=oxidoreductase activity; Cellular component=intracellular; Biological process=lignin catabolic process
  Homolog annotation: Hit_ID=O24044; Match level="QueryCoverage=99%, HitCoverage=92%, E-value=0.0, Identity=70%"; Hit description=Laccase
  Pfam annotation: Domain name=Cu-oxidase; Domain location=124-277; Score=214.0; E_value=3.3e-61; Accession=PF00394.12; Description =Multicopper oxidase
  Pfam annotation: Domain name=Cu-oxidase_2; Domain location=389-523; Score=184.5; E_value=2.6e-52; Accession=PF07731.4; Description =Multicopper oxidase
  Pfam annotation: Domain name=Cu-oxidase_3; Domain location=1-114; Score=221.7; E_value=1.6e-63; Accession=PF07732.5; Description =Multicopper oxidase
  Pfam module annotation: Pfam domain module=Cu-oxidase::Cu-oxidase _2::Cu-oxidase_3; Domain location=124-277::389-523::1-114
MQNFTRLCQTKSIVTVNGRFPGPRIIAREGDRIVVKVVNHVQYNVTLHWHGIRQLKSAWADGPAYITQCPIQTGQSFVYNFTVIGQRGTLWWHAHISWLRTTLYGPIVILPKRHVPYPFPQPFREVPIILGEWWKADTEAVINQAMQTGLAPNISDVHTINGLPGPVSNCAAKETFQLKVKPGKTYLLRLINAALNDEMFFSIANHTLTMVEADAVYVKPFSTKIVLITPGQTVNVLLKAKSKAPNGTFAISTRPYATGPASFDNTTATGFLEYKKTSHASNKSNTKKLPLLRAVFPKFNDTVFAMNFHNKVRSLANARFPAKVPKTVDRHFFFTVGLGISKCSKNQQCQGPNNTRVAAAVNNVTFVTPNIALLQAHFFNKSKGVYTTDFPSNPPFKFNYTGTPPSNIFVSSGTKTVVLPYNTSVELVLQDTSIIGAESHPLHLHGFNFFIVGQGNGNFDPKKDPIKFNLVDPAERNTAGVPSGGWVAVRFLADNPGVWFMHCHLEVHTSWGLKMAWIVQDGKRRNQKLPPPPSDLPKC

SEQ ID NO: 188394 - protein, 579 aa, Glycine max
  Coding DNA Sequence Number=SeqID_71616
  Gene Ontology: Mol. function=structural constituent of ribosome; Cellular component=intracellular; Biological process=translation
  Homolog annotation: Hit_ID=Q9ZQW2; Match level="QueryCoverage=98%, HitCoverage=98%, E-value=0.0, Identity=73%"; Hit description=Laccase
  Pfam annotation: Domain name=Cu-oxidase; Domain location=165-318; Score=220.2; E_value=4.8e-63; Accession=PF00394.12; Description =Multicopper oxidase
  Pfam annotation: Domain name=Cu-oxidase_2; Domain location=429-563; Score=178.2; E_value=2.1e-50; Accession=PF07731.4; Description =Multicopper oxidase
  Pfam annotation: Domain name=Cu-oxidase_3; Domain location=39-155; Score=230.0; E_value=5.4e-66; Accession=PF07732.5; Description =Multicopper oxidase
  Pfam module annotation: Pfam domain module=Cu-oxidase::Cu-oxidase _2::Cu-oxidase_3; Domain location=165-318::429-563::39-155
MDSPHFPSFASLRVLLFGFCVITLFPEFVVSITRHYTFNVEYLNVTRLCHTRNILSVNGKFPGPRLVAREGDRVVVKVVNHVSNNVSIHWHGIRQITTGWADGPAYVTQCPIQTNQSYTYNFTIVGQRGTLLWHAHISWLRATIYGPIIILPKHNESFPFEKPHKEIPILFGEWFNVDPEAVISQALQTGGGPNVSDAYTINGLPGPLYNCSSKDTYTLKVKPGKTYLLRLINAALNEELFFSIANHTLTVVEADARYTKPFDTDTLLIAPGQTTNVLLKTKPYFPNATFQMSARPYFTGRGTFDNSTTAGTLIYKQPLKNSSVKNLTLLKPTLPPINATSFVANFTAKFRSLASAKFPAKVPQKVDRKFFFTVGLGTSPCPKNTTCQGPSNNTKFAASVNNISFALPSSVSIMQAYYSGQANGVFKTDFPATPLNPFNYTGTPPNNTMVTNDTKLVVLKFNTSVEVVLQDTSILGAESHPLHLHGYDFFIVGQGFGNYDPNNDPAKFNLIDPVERNTVGVPAGGWIAFRFLADNPGVWFMHCHLDLHTSWGLRMAWLVLDGPGPKQKLQPPPSDLPKC

SEQ ID NO: 188395 - protein, 109 aa, Glycine max
  Coding DNA Sequence Number=SeqID_71617
MARGIFYCHHLAVTYSQRCVKARTFTANFLWACWILKEGAKGCLKIVLNCNLVKWGCHYGVGRRVQNAEVGAESDSSGFHLPAAAAAEEAGGRKATTAAEGGVLPATGS

SEQ ID NO: 188396 - protein, 247 aa, Glycine max
  Coding DNA Sequence Number=SeqID_71618
MRCKEVKRLRKEAKSRIFQDDGMHDLDIVEWKKKRKLQSDQLDLIRPKHKCWVGSFSSEHASVFDKNPVLESMHNHTVESSKHESAKDSNSFMEDCDTAMSVNEEAKHETDCGSSYLYGRPSTSLGNHCPLDVSTVNRVSYIDEEAFVDSQCIPPYDDADAQALINHEEHFLGLGSFSGHECSEDAEDSNEDPVEKEFEDFLYSSGVNPNVYVLSSGRWDVNQEAQSSSRPPTIDQEFEEYFSMLML

SEQ ID NO: 188397 - protein, 152 aa, Glycine max
  Coding DNA Sequence Number=SeqID_71619
  Homolog annotation: Hit_ID=Q9SJM8; Match level="QueryCoverage=85%, HitCoverage=59%, E-value=3e-36, Identity=64%"; Hit description =Expressed protein
MEETTIQPKMTPNWIFPASNWKRQKDIVVDAERVQNGSDFAPDLVGVDPELVEEGFLVVEVGGAAGAHGGAGVDRPRGGGRRGGAYVEGHEGDTGVRLERRRGHAPLLEVWTRRGGVAGGGESHRRDLELFIGHDEIEIWLEERGFRSGTRV

SEQ ID NO: 188398 - protein, 112 aa, Glycine max
  Coding DNA Sequence Number=SeqID_71620
MDLNELGLSLTLQKGKNLEGVEAAVSLSLDHVLSEYHLLSKTSACLASKRNLEENLSCQHALSVSSARQTRSLSLLALSANMTLSQNSFIRAKRENGTKRAFEDRKPFLSLK

SEQ ID NO: 188399 - protein, 72 aa, Glycine max
  Coding DNA Sequence Number=SeqID_71621
MQKEMRDVTFKMIKTASRALLNNGRSLYTEKHERLLPRSLDNLLNFASAVQQLHYYKKTYIILGLPNTARFV

SEQ ID NO: 188400 - protein, 190 aa, Glycine max
  Coding DNA Sequence Number=SeqID_71622
  Gene Ontology: Mol. function=DNA binding; Biological process=DNA integration
  Homolog annotation: Hit_ID=Q1SS72; Match level="QueryCoverage=93%, HitCoverage=13%, E-value=2e-34, Identity=38%"; Hit description =Integrase, catalytic region
  Pfam annotation: Domain name=zf-CCHC; Domain location=117-134; Score =10.6; E_value=0.017; Accession=PF00098.13; Description=Zinc knuckle
  Pfam annotation: Domain name=zf-CCHC; Domain location=155-172; Score =12.8; E_value=0.0078; Accession=PF00098.13; Description=Zinc knuckle
  Pfam module annotation: Pfam domain module=zf-CCHC::zf-CCHC; Domain location=117-134::155-172
MKQGALSVTEYFTRLRVIWDEIENFRPDPVCSCNIRCSCSTFTIIAQRKLEDQAMQFLHDLNVQYANIRSHVLLMDPILAISKIFSYVAQQERQLLGNTASNLNLESKDISINAAKTVCDFCGRIGHVENVCYKKHGMPPNYDGRNKSNNTRYGKTCTHCGKIGHTVDVCYRKHGFPPGIQTLQSKHNCE

SEQ ID NO: 188401 - protein, 118 aa, Glycine max
  Coding DNA Sequence Number=SeqID_71623
MGTQRSACTIVLVMAAVLGRVSEWVTVFAVLVVHGGCVGSADGWAWPMVVFGGCVGSADGWARPMVVVQWLCWLGRWLGSADGGGSRRRKGAEWWLVVALGCSGVLTVRIPLSLSLSL

SEQ ID NO: 188402 - protein, 218 aa, Glycine max
  Coding DNA Sequence Number=SeqID_71624
  Gene Ontology: Mol. function=nucleoside-triphosphatase activity; Biological process=proteolysis
  Homolog annotation: Hit_ID=Q1SWT0; Match level="QueryCoverage=88%, HitCoverage=54%, E-value=5e-49, Identity=53%"; Hit description=F-box protein interaction domain
  Pfam annotation: Domain name=FBA_1; Domain location=55-213; Score= -49.3; E_value=0.039; Accession=PF07734.3; Description=F-box associated
MTISDFDRLGVLYEEVSWEDVSLHPLWEIYSLRNNSWSRLDVNVADCCHQIPGYQVYVDGMCHWRGHEGIPQEECLVSFDLSNQVFFTTPMPLDMDDMRAFLGSTNDDFDFSLDRYLVVLNGSIALISYYVETTIFHISILGEVGVKESWTKLFIVGPLPCVYCPIGVGKNGDIFFRRKDYELVWFNLSTNMIEELGIKGENNSCQIGIYKENLISIE

SEQ ID NO: 188403 - protein, 368 aa, Glycine max
  Coding DNA Sequence Number=SeqID_71625
  Gene Ontology: Mol. function=phosphopantetheine binding; Biological process=metabolic process
  Homolog annotation: Hit_ID=Q0BVN1; Match level="QueryCoverage=95%, HitCoverage=63%, E-value=5e-59, Identity=33%"; Hit description=Non -ribosomal peptide synthetase modules
  Pfam annotation: Domain name=PP-binding; Domain location=50-116; Score=8.1; E_value=0.03; Accession=PF00550.15; Description =Phosphopantetheine attachment site
MVPVSIIKMREMPRMPSGKIDRKKLPAPESFISHEKSEDIEINPEAPIEEKLLQTLHWMFPGKEIQLHQDFFTDLGGHSLLAATLVSHLRQKAGIPYASLKDIYENRPLSAYSDCLKNKHTEKTSDQEPFTRVSSFQYYACNLAQTISLLVVFALFSVQIFFPYLSYYYFQLNGYGTGLALLSAILLYTLIPPVYSVIILLTKWLVIGKIKEGDYPLWGWYYFRWWLWKTVKRLMPSEFIVETPLYPKYLKLLGVQVHPSAQLSLLPIAAEDLVTIDQNVTTSSGCSIDNASVENGVLKIRKVHIKAHAYLGSSAIVCGNTVIEEFGELQDLSCLNEGNTIGYGEVWDGSPAEKLRTKILSQGVCNTV

SEQ ID NO: 188404 - protein, 121 aa, Glycine max
  Coding DNA Sequence Number=SeqID_71626
MENIGSGRGRTFQIAGSRLPDCMHACGSCSPCRLVTGRATWRWCRHSHQHLPFCLRGVEDASTNGKLLKAPVKREALGLQRCIVQQVKVAATQGQQVRGEGRAIGDCELHKGGVIPSSVLL

SEQ ID NO: 188405 - protein, 101 aa, Glycine max
  Coding DNA Sequence Number=SeqID_71627
METASFNGEFVSTGHVDGNPLLLLAISGRGASRQRCWRFQGCAEIAALTGDFQGLRVGCRERGTKAISEALHGAAAAEQGVAIRNCDLVRKPPAVLAICIR

SEQ ID NO: 188406 - protein, 221 aa, Glycine max
  Coding DNA Sequence Number=SeqID_71628
MEWKGDHYRMELSRLGILCNGQKPQRAMSSEGRTPMAHELISQTKSTSSTKDQDTNMEILQVPRATPAYAPQPQPSIIPPSIDKKEVVVIKKPERLSKAEARKKAKFNKTFDEKGVLEMEESSSVEDEQRKVVEEEALEGEDDEERRMKELQPVQVEPNTNPHAKLDKVILQYVLVASINEDLIVADVVEIDDRVLGVVPRPMTAEDEKKVIETLEKHMEA

SEQ ID NO: 188407 - protein, 82 aa, Glycine max
  Coding DNA Sequence Number=SeqID_71629
MVEKGKFDHIEERLKAIEGGGDYAFANMVELCPVPDIIIPPKFKVPDFDKSKGTTYPKNHLKVYCRKMGAYSKDEKLLMHFF

SEQ ID NO: 188408 - protein, 145 aa, Glycine max
  Coding DNA Sequence Number=SeqID_71630
MGLRIEKSGLEKQFQNIPFDCKGNRERTFGQISPFGVLLQTYSPNGVILKEFPPWCCFVRGLHGFCMETASFNGEFVSTGHVDGSPLLLLPISGGGTSRQRCWRFQGCAEIAALTGDFRQATSLGLQTLQDVQDAVAADFLTFWA

SEQ ID NO: 188409 - protein, 629 aa, Glycine max
  Coding DNA Sequence Number=SeqID_71631
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=96%, HitCoverage=94%, E-value=1e-177, Identity=54%"; Hit description =Mitogen-activated protein kinase
  Pfam annotation: Domain name=Pkinase; Domain location=37-302; Score =163.9; E_value=4.1e-46; Accession=PF00069.15; Description=Protein kinase domain
  Pfam annotation: Domain name=Pkinase_Tyr; Domain location=38-307; Score=-7.1; E_value=4.9e-12; Accession=PF07714.7; Description =Protein tyrosine kinase
  Pfam module annotation: Pfam domain module=Pkinase::Pkinase_Tyr; Domain location=37-302::38-307
RVVVISDRATARAMYKGRLGGKAQLGYVETDPLGRYGRFRDILGKGAVKVVYRAFDEVLGIEVAWNQVKLGDVFHSPDLLPRLYSEVHLLKNLEHDSIMTFHDSWIDVNCRTFNFITELFTSGTLREYRKKYQRVDIRAVKNWARQILSGLEYLHSHDPPVIHRDLKCDNIFINGHLGQVKIGDLGLAAILRGSQHAHSVIGNFSCSFSTPEFMAPELYEEEYNELVDIYSFGMCMIEIFTSEFPYSECSNPAQIYKKVTSGKLPEAYYRIHDLEAQRFVGKCLANVSERLSAKELLLDPFLAKEQLDSPLPSPTLPKKQAPTLNFTASLAKELSQPKSNQTKDSHMTITGSINEEDDTVFLKVQISNKDGQKRNIFFPFDTIYDTAIDVAMEMVKELEISDLEPLEIAKMIEEEISALVPKWRDWGSAEYQKQHSFSYEEEYDMSNHHPFFSTSSRSSSHASLPVFGSSYKNNSHYRGNHYPFAQDWPQDELFMNDDASSQSSMNSFKCFNFNCCDPGNEDEHDPTLVLGAEHLYYTPKGNEKCIRFCPREEVMDADFTKQLCNMRMDSHRCHGMHRLTRIRSFVDLRRQQLQRSLMEEIHKRRMFKTVGAVENIGFQNPEGGGCFSY

SEQ ID NO: 188410 - protein, 161 aa, Glycine max
  Coding DNA Sequence Number=SeqID_71632
  Homolog annotation: Hit_ID=Q1SN43; Match level="QueryCoverage=59%, HitCoverage=17%, E-value=2e-19, Identity=45%"; Hit description =Nucleic acid-binding, OB-fold, subgroup
MGNGGIFLAHATSQCTLIQRCFFCEKCNKHVTNVVLRYRIKVCVIDESDSATFVIFDQDASILFSKSCANIFETYQKRGLAGTFQREIINLVNRSFLLKVEDKSGCNSQFEKTFRDLMPKFFDVVENDSQCGEKETTDLSKDSKELTFTKHNFYCKLTWMN

SEQ ID NO: 188411 - protein, 226 aa, Glycine max
  Coding DNA Sequence Number=SeqID_71633
  Gene Ontology: Mol. function=nucleic acid binding; Biological process= DNA integration
  Homolog annotation: Hit_ID=Q1SX43; Match level="QueryCoverage=56%, HitCoverage=16%, E-value=6e-10, Identity=32%"; Hit description=IMP dehydrogenase/GMP reductase
  Pfam annotation: Domain name=zf-CCHC; Domain location=133-150; Score =12.9; E_value=0.0074; Accession=PF00098.13; Description=Zinc knuckle
MLCTLLEEEYTKVHNLKSAKQIWDNFAVTYKGTSQVTTLRVLKNLESISLEELIGTLKVHEQELQQDKGLAREKSLALSSKKNKKEPSSREQDDLAFIYHKIYKMWRNKSGSKWRSSSRRMPQDKKEKDKSSIVYYECTKPRHFKSECPDLEKSQDKKFFRTKEKKGLICICAYKNLRRDFKNLSKDHLKLEKTFQDQVDGSLNESAQAVKLVKLLKKKSPSYALR

SEQ ID NO: 188412 - protein, 107 aa, Glycine max
  Coding DNA Sequence Number=SeqID_71634
MPAYAEDRVGDIKHLCTVAMLAVQLTGPNKLNANVRMAYSHEEKKSEENKVKEKKAEEEEKKEDEKKPEESKADKESKEESAPPEIVQGTTFAMHEHFKHDFWHLLS

SEQ ID NO: 188413 - protein, 99 aa, Glycine max
  Coding DNA Sequence Number=SeqID_71635
MEKRFSVERMETNLVIKNTLESSLKSFTRIVIYNMNLIMQQRLPPSIQHQFAPPPPLTIVVQPHLEFLASKATIPNDLVPMPSLLQPNSPPPNLSNSVY

SEQ ID NO: 188414 - protein, 122 aa, Glycine max
  Coding DNA Sequence Number=SeqID_71636
MVLKEELAACSRSKRNLTQRLCETETNMLAIITKYQEELSLATTHEHRVADEYAQVKNTITKRATRHPYRTRSKSRTMGDQEETQEQMKADMSALKEQMASMMEAMLGMRQFMEKNVANTAA

SEQ ID NO: 188415 - protein, 164 aa, Glycine max
  Coding DNA Sequence Number=SeqID_71637
  Subcellular localization annotation: CTP_CleavageSite=36; ConfidenceScore=5.24e-01
CKERNHSLFRLGKQKIPKNKGKRVFSLSFLDPSSPRLAYGSSGPPNYFRVKELARLGKPVTSGVSISSPGRAAIAPSAYFPINRHAKEAERGFQHSVVKEIERIRREEEEMKLGRYQIVIVINPYFVSCSVFFVRPSGAPLLLCAYPSSPSIINDLIFLCKVQS

SEQ ID NO: 188416 - protein, 84 aa, Glycine max
  Coding DNA Sequence Number=SeqID_71638
MSPHVMQDGGSSQYWIIIVILQRILLGETAVYAMMLVFSTEFSPLKTILFGNLSQDTVEPLMEALEEDYKDGNEINESSQFIGG

SEQ ID NO: 188417 - protein, 66 aa, Glycine max
  Coding DNA Sequence Number=SeqID_71639
MEHETFLATWLAEIDFSPNGLRFSNLQPQPRLINHEKPMLCGWHKLNPLKIEGRRFALDSTRDYFP

SEQ ID NO: 188418 - protein, 93 aa, Glycine max
  Coding DNA Sequence Number=SeqID_71640
MEEKVKLKINGGLRRTYLKLLCSDYPLMEACLRSFYGGWIFELQWGPSMVIFSHGVAVEDKGEELSTWEASLRSKEEKFLEKLEGGYSHPSNM

SEQ ID NO: 188419 - protein, 61 aa, Glycine max
  Coding DNA Sequence Number=SeqID_71641
MVTLFLSHHHWTLLLWVPQEANAKSWSCGKACRKLKNHGKIRDKVVIGEMDNYTTLAMRKD

SEQ ID NO: 188420 - protein, 91 aa, Glycine max
  Coding DNA Sequence Number=SeqID_71642
MCTGAESRGDINGDPVISKVGGDYEDRMRTIELEGGEETACNWGTFVRGLLQGIQHHLTALNLPSLSASEEENAETSMQTIFLEQVFLLLV

SEQ ID NO: 188421 - protein, 452 aa, Glycine max
  Coding DNA Sequence Number=SeqID_71643
  Gene Ontology: Mol. function=drug transporter activity; Cellular component=membrane; Biological process=multidrug transport
  Homolog annotation: Hit_ID=Q1SB90; Match level="QueryCoverage=98%, HitCoverage=82%, E-value=1e-131, Identity=50%"; Hit description =Multi antimicrobial extrusion protein MatE
  Pfam annotation: Domain name=MatE; Domain location=1-158; Score =129.4; E_value=1e-35; Accession=PF01554.9; Description=MatE
  Pfam annotation: Domain name=MatE; Domain location=220-383; Score =130.6; E_value=4.2e-36; Accession=PF01554.9; Description=MatE
  Pfam module annotation: Pfam domain module=MatE::MatE; Domain location=1-158::220-383
MTSLMMYSRSAVSMLFLGRQGKVELAGGSLALGFANITANSVLKGLTMGMDPICCQAYGAKRWSVLNQTFLRTLCLLLLVAIPISILWLNMEPILQMLGQDPEVTKVAQVYMVFSIPELLAQAHLNPLRSFLRTQGLTTPVTIAASCAALLHLPINYFLATYLNLGVKGIALATGLNSINMTLGLLLYILFSKKPLKPWQGATLLSAFHGWKPLLSLALPSCISVCLEWWWYEIMLFLCGLLSNPQATVATMGILIQTLGFLYVFPFSLSIALTTRIGHSLGAGQASKAQSTAIIGFLTAFTLGLTAFILLFLVRKSWGKLFTNETQIVELVTTILPILGLCEVSNWPQTVSCGILSGTARPYLGARINLCAFYLVGLPVSVFATFIYKYELVGLWSGMVAAQASCLCMMVYTLIQTDWEQQCKRAVELAQKTTERENKNDDEESGLLGSDQ

SEQ ID NO: 188422 - protein, 121 aa, Glycine max
  Coding DNA Sequence Number=SeqID_71644
  Subcellular localization annotation: CTP_CleavageSite=58; ConfidenceScore=5.51e-01
MQNWIYTGSATTHAYIQSSSKFHLSIFTNLVKPFTSNAPQRTSLLCVQCLHQEANSTSCNEPQRTFLLCVQLLHQEAITPLAMNPKGRYSFVSSDYTKKQIPLLAMNPQGCYSFVSNDSTK

SEQ ID NO: 188423 - protein, 278 aa, Glycine max
  Coding DNA Sequence Number=SeqID_71645
  Homolog annotation: Hit_ID=O63067; Match level="QueryCoverage=25%, HitCoverage=7%, E-value=5e-11, Identity=56%"; Hit description =Aspartokinase-homoserine dehydrogenase
MSFQFCFEVPDSLHLSESILYALRGAKHHRHTRNSTKFMTKGVEEEKGASWGSCHSLSRRFNTDRRWLLGSRCTLARGSEGCSRCCFTFWCCFHIVMYLESEQRLEKWYSLNPCKVIIATGFISSTPQNVSEAVILKTPSLIHNKQMGGLQAARDNAKTWITVQPVEGAFVVNLGDLCHKVGRSLFCLGLLICYGNQLLASSILIDVGRSVRLFMKYLFVEDFVVKVRSLQALGFVLIARPEYMLENDVGKILEETISSTSDTSIKIQGLQNMFEYLF

SEQ ID NO: 188424 - protein, 537 aa, Glycine max
  Coding DNA Sequence Number=SeqID_71646
  Gene Ontology: Mol. function=hydrolase activity; Biological process =pyrroloquinoline quinone biosynthetic process
  Homolog annotation: Hit_ID=Q7X5S1; Match level="QueryCoverage=53%, HitCoverage=93%, E-value=1e-137, Identity=84%"; Hit description=PqqB
  Pfam annotation: Domain name=Peptidase_M19; Domain location=1-214; Score=208.2; E_value=1.9e-59; Accession=PF01244.11; Description =Membrane dipeptidase (Peptidase family
AGMIDAELTQLEAFYRLGVRSIGPFWNLPNAFGTGVSGPFPGSPDTGPGLTSAGEALIHACNRRRIMIDVSHMNEKTFWQTAALSRAPLVATHSNAHALCPQPRNLTDAQLDAIGQSGGMVGVNFGTAFLRADGKRDSATTGLTEIVKHVEYLIAKLGEDRVGFGSDFDGVNVPQPLADVGGLPLLTQALAQAGFDNRLLEKLTWRNWLNVLAATWVLGSAAGGGFPQWNCNCANCSGLRNDTLQAQARTQSSIIVSDNGTDWVLCNASPDISQQIARTPELVKHGVLRGTAIGSIILTDSQIDHTTGLLSLREGCPHQVWCTPEVHADLTSGFPIFTMLQHWNGGLQHRALTPLEPFRVDVCASLQFTAIPILSNAPPYSPYRDRPLPGHNVALFIENTTNGQTLLYAPGLGEPDAVIMPWLQKADCLLIDGTVWQDDELLTTGVGKNTGKAMGHLALAEEQGLMALLAALPARRKILIHINNTNPILNEHSPQRQFLTQQGIEALRAKGAYYHIHHPYHIAMHNGAATREQIQGW

SEQ ID NO: 188425 - protein, 67 aa, Glycine max
  Coding DNA Sequence Number=SeqID_71647
  Subcellular localization annotation: CTP_CleavageSite=28; ConfidenceScore=5.26e-01
MAQPNVALSAQLALSTPRISSRAKHTARAKRATPKQHALSELLLSEAGRAKRAYEGPRVRCSREGNF

SEQ ID NO: 188426 - protein, 221 aa, Glycine max
  Coding DNA Sequence Number=SeqID_71648
MDETHEAPQDHTLTSIRVYPGNTIEGHSFSGILVPNTLGVPQYRPPSQPLHFGMGGKPSVVVEKENFDHIEERLGPLKEGGNYGFTDMSELCLVSDVVIPPKFKVYSWKDLMDAFIKKYQYNSNMATDRMQLQNMCKGDNESFKEYGQRWRDLVTQVVPLTVEREMITMIMDTLLGFYYEKMIGYMPSSFVDLVFPSERIEVGQRRGKFDYVASVSSDVVK

SEQ ID NO: 188427 - protein, 85 aa, Glycine max
  Coding DNA Sequence Number=SeqID_71649
MRGGRERGGRTLEGEAKRTKKGIGVAETERSNGDIDCLSPRSRGARLRPRQGGSGKRRWWWHHHDGRICKLQGAHHQLSKLLHLS

SEQ ID NO: 188428 - protein, 153 aa, Glycine max
  Coding DNA Sequence Number=SeqID_71650
MPSFKRQPYGEEEEEEHNEEEEATTTKQRCHHSNNKSRHYLPRRRTHVEEEETKMHEEEEEPRMQELDESTNEKKHQNEEVLWSRKPKRKQEAEQEEEEAYTFPHESKIIMHTYLVWSTSVKEMEGANNGGAELETYNFLLDQRSRSTISESN

SEQ ID NO: 188429 - protein, 133 aa, Glycine max
  Coding DNA Sequence Number=SeqID_71651
IAPARHLVDPEKSNRVLGFPALITGLFQFYGVPVAPNKVIRPPNNRAFIKKYCAPQASAGRDTTVAWGWPAAGNRRTASTFKAPQLIYKGWSFAYDPWPTSRQPSPKPKVSKSTRSVTDKSSRVQLKTLKKRY

SEQ ID NO: 188430 - protein, 154 aa, Glycine max
  Coding DNA Sequence Number=SeqID_71652
  Gene Ontology: Mol. function=transferase activity; Biological process= metabolic process
  Homolog annotation: Hit_ID=Q67V33; Match level="QueryCoverage=60%, HitCoverage=33%, E-value=4e-18, Identity=46%"; Hit description =Ribosomal protein-like
MSQLARIKRSTNDSPQTKLGYDKGEGVIVVEAKGVVVGGRGRGGVWWLGANKGKGHGEIHILAYESPANSVDEYVRLVNCTTIECLEAFVKGVNEIFGDEYLRSPNNNDINHLLQIGEARRFPGSNNNTNVLNQSPVFNDVFQRQAPPVQFTIN

SEQ ID NO: 188431 - protein, 166 aa, Glycine max
  Coding DNA Sequence Number=SeqID_71653
  Gene Ontology: Mol. function=RNA-directed DNA polymerase activity; Biological process=RNA-dependent DNA replication
MASYSYLVMSFSLKNAGATNQRLMDKIFKNQLRRNLEIYVDNIVFKRRNKVGQGMQRPTFRNSKSSSLHHLSSLDLNRLNGDYQTKDPQMTRYYHIATQLKEAFTKFKLKHIVIENNKIVDLLSKLVGRKKKGQYTTIIQETILEPSLNKVVVSVTLINQEWMTEI

SEQ ID NO: 188432 - protein, 138 aa, Glycine max
  Coding DNA Sequence Number=SeqID_71654
MALKYGLFSNSLCKKSPLEDSPGEEVQTWHASAMCAALSLSTWWRPKEGCPSLNELGEIISTPYPVMKFPSESVKIITIRVDQMTTRECYVVSLKIAKGKKVAEPKVQLVACITLNNNLGEAKLIQERQTREQSLLKR

SEQ ID NO: 188433 - protein, 138 aa, Glycine max
  Coding DNA Sequence Number=SeqID_71655
MGRILCAPAEESSVPLSGTTVVGGATCLKVDVAAPVSGTTTIEGGLHPNSGMHENHGEDEVQLPLPNPPPNVINLDSKAIVVQVTTPCPFLPLLPSPKKPSKAKRFPFIVLPRHTWVHGEANSYFTNFLTYKSITKFL

SEQ ID NO: 188434 - protein, 130 aa, Glycine max
  Coding DNA Sequence Number=SeqID_71656
MVELVSITILSAIENYPTFLSMKENVSSLWVKDSNPLCSHPILYAQAVKLRYAKGSRPSSVNGFHCAFPSTDLRDDVEFQRELFECAKVEKAISKATKANETLVQSTKDSWKSLEDTKTKLEEAESREEA

SEQ ID NO: 188435 - protein, 347 aa, Glycine max
  Coding DNA Sequence Number=SeqID_71657
  Gene Ontology: Mol. function=nucleic acid binding; Cellular component= intracellular; Biological process=DNA integration
MAMNEEMESLLKNQTWDLVELPEGRRVLRCSGSSRRNLNRPLKKSSAIKHVCLSGNSRHGIRETHVKTVFLHGRLEEDILMQQPKGSVTRDSMSSLSLMGISKVPLTRVYHSKVKDSSHIYLLLYMDDKLIASQNLLAIQKLKSLLSNEVKMKDMRFVEKILGMEIKSDVGSLIYAMVCTRANLAQAISVMSRIDIELVYHGDMSCAFACYSNSDYGANLDAKRSMTRGRVHGSGKNSKGRNQGLISNIGFSRENAIIFYDSLSAIYLAKDQVHHERTKHISIKYHFICSEKRVEVQKVDTRENPIDMFMKPIPRSKVEIVDCLTMDDRDRVDDNFGLLVQYSCLLY

SEQ ID NO: 188436 - protein, 99 aa, Glycine max
  Coding DNA Sequence Number=SeqID_71658
MTTSNCQQATTNMHLHQTNHKDLGPKGNQNGKNVSQHALLREREARLSGALSKGGKMHGVATNVDKSGALAPTYPLSKRKSDLRSSFLGVNQAILFTCK

SEQ ID NO: 188437 - protein, 696 aa, Glycine max
  Coding DNA Sequence Number=SeqID_71659
  Gene Ontology: Mol. function=RNA-directed DNA polymerase activity; Biological process=RNA-dependent DNA replication
MVKVGEDTTNNNGEDEHKNEEGETRDPTKGARKQKHERERMGARVTCPQGDEQSTYTLPERTQGGSHDGTTNLDKDLDAFLTQENLYTNDDAILCCVIPTSFKAALNWLSGLPQRSMCVFDTLAKRFSAQYVTNWSHPMTSAALASLRQADNESLQKFMARFGRIAVQIRNLNPEVTLYSMLFTLWPGKFADKMSRFKNEVIQVRQKREKREGSNKTDSHKLNKRHMQDKRKPLPKGPKYERYTPLTTNHTTILEEAFNLEVPIRLPLTKPPGPGLGATKYYRYHHGIGHNTEHYWALKDNIEKLIQTGQSNQSCKGHLHTIRDIDINFVNTPLERSFPPVTFTNRVQSSIDILYWKNFQRLKVSLDIVHPHVGPLIGFSGERVETRGYVNLMTTFEPSPPCSHLKMKFPTLTQEIVTIKANEKQARQCYGESLKVAPYRPTREPCKPHSIATKGTQFMSMDEGPQIWALTIYQASLDDECEIDLRDDASDRGPKPIKELVKLEVRFSTLLTNVVMVTKANDKWRMCTNYTNRNRACPKDAYPLPNIDRLVDGASGFQGHALWPKKCKCYIPNIDEPNFQATEQKKLQALPNDREGGARTHYLGPATQTLLLKSSNGSQNKPPYQTDFLAEFIGNNQTTLDWWSLYVNGVSNMKGRRARIILEALILNFKASNNQVECEALIASLKLARDVKTKKL

SEQ ID NO: 188438 - protein, 529 aa, Glycine max
  Coding DNA Sequence Number=SeqID_71660
  Gene Ontology: Mol. function=oxidoreductase activity; Cellular component=intracellular; Biological process=lignin catabolic process
  Homolog annotation: Hit_ID=O24044; Match level="QueryCoverage=99%, HitCoverage=90%, E-value=0.0, Identity=78%"; Hit description=Laccase
  Pfam annotation: Domain name=Cu-oxidase; Domain location=112-265; Score=225.3; E_value=1.3e-64; Accession=PF00394.12; Description =Multicopper oxidase
  Pfam annotation: Domain name=Cu-oxidase_2; Domain location=379-513; Score=183.2; E_value=6.4e-52; Accession=PF07731.4; Description =Multicopper oxidase
  Pfam annotation: Domain name=Cu-oxidase_3; Domain location=1-102; Score=187.6; E_value=3e-53; Accession=PF07732.5; Description =Multicopper oxidase
  Pfam module annotation: Pfam domain module=Cu-oxidase::Cu-oxidase _2::Cu-oxidase_3; Domain location=112-265::379-513::1-102
MVTVNGQFPGPRIVAREGDRLLIKVTNHVSNNITIHWHGIRQLQSGWADGPAYVTQCPIQRGQSYVYNYTIVGQRGTLWWHAHISWLRSTLYGPLIILPKLNAQYPFAKPHKEVPIVFGEWWNADPEAVITQALQTGGGPNVSDAYTINGLPGPLYNCSDKDTFKLKVKPGKIYLLRLINAALNDELFFSIANHTLTVVEADAVYVKPFATNTILITPGQTTNVLLKTKSHYPNATFLMTARPYASGLGTFDNTTVAGILQYKTPPNTHHSAASLKNLPLLKPILPALNDTSFATKFNNKLRSLASAQFPANVPQKVDTHFFFTVGLGTTPCPQNQTCQGPTNATKFAASVNNVSFIQPTTALLQTHFFGQSNGVYTADFPAKPLIPFNYTGTPPNNTMVSNGTKVVVLPFNTSVELVMQDTSILGAESHPLHLHGFNFFAVGQGFGNFDPNKDPANFNLLDPIERNTVGVPSGGWVAIRFLADNPGVWFMHCHLEVHTSWGLKMAWVVLDGKLPNQKLFPPPADLPKC

SEQ ID NO: 188439 - protein, 60 aa, Glycine max
  Coding DNA Sequence Number=SeqID_71661
MRAFNNYLSSTRGIPISDCLANSPTSLCKGGDTSDIGNGDAADAGANDDYVADIIVAQEA

SEQ ID NO: 188440 - protein, 1178 aa, Glycine max
  Coding DNA Sequence Number=SeqID_71662
  Gene Ontology: Mol. function=ATP-dependent helicase activity; Cellular component=nucleus; Biological process=ER to Golgi vesicle -mediated transport
  Homolog annotation: Hit_ID=Q94LY4; Match level="QueryCoverage=87%, HitCoverage=99%, E-value=0.0, Identity=52%"; Hit description=Sec31p
  Pfam annotation: Domain name=WD40; Domain location=112-151; Score =28.9; E_value=1.8e-05; Accession=PF00400.22; Description=WD domain, G-beta repeat
  Pfam annotation: Domain name=WD40; Domain location=162-201; Score =19.3; E_value=0.014; Accession=PF00400.22; Description=WD domain, G -beta repeat
  Pfam annotation: Domain name=WD40; Domain location=275-313; Score =18.5; E_value=0.024; Accession=PF00400.22; Description=WD domain, G -beta repeat
  Pfam annotation: Domain name=WD40; Domain location=318-357; Score =10.1; E_value=2.4; Accession=PF00400.22; Description=WD domain, G -beta repeat
  Pfam module annotation: Pfam domain module=WD40::WD40::WD40::WD40; Domain location=112-151::162-201::275-313::318-357
MACIKGVNRSASVALAPDAPYLAAGTMAGAVDLSFSSSANLEIFKLDFQSDDQELPLVAECPSSDRFNRLSWGKNGSGSEDFALGLVAGGLVDGNIDIWNPLTLIRSESNQSSLVGHLVRHKGPVRGLEFNVIAPNLLASGAEDGEICIWDLVNPSEPTHFPPLKSTGSASQGEISFLSWNSKVQHILASTSYNGTTVVWDLKKQKPVISFADSVRRRCSVLQWNPDVATQLVVASDEDGSPSLRLWDMRNTISPIKEFVGHTRVDSIQPMLPNVPELDNLPENQGVIAMSWCPNDSSYLLTCGKDSRTICWDMISGEVIAYELPAGTNWNFDVHWYPRIPGVISASSFDGKIGIYNIKGCRQNDIGENDFGAVPLRAPKWYKRPAGVSFGFGGKLVSFHPRASAAGSPAGASEVYVHNLVTENGLVSRSSEFEAAIQNGERSLLRVLCGKKTEESESEEERETWGFLKVMFEDDGTARTKLLSHLGFNVPSEAKDTVNDDLSQEVNALGLEDTTVDNTGHVSTNETPIFSTDNGEDFFNNLPSPKADTPVSTSAGNFVVAENANGSKKIQDDVEVEESSDPSFDDSVQHALVVGDYNGAVMQCISANKWADALVIAHVGNASLWESTRDQYLKMVRSPYLKIVSAMVSNDLLSLVNTRPLKFWKETLALLCSFAQRDEWTMLCDTLASKLMGAGNTLAATLCYICAGNIDKTVEIWSRSLSNEHEGKSYVDLLQDLMEKTIVLALATGQKQFSASLCKLVEKYAEILASQGLLTTAMEYLKLLGSEELSPELTILKDRIALSTEPEKDFKTTAFEGSQSHSGSYYGADNSNYNSNYYQEPVPTQVQHGVSGIQYPDSYQQSFDPRYGRGYGAPTHTPPQQPLQPNLFVPPQATQVAQTPQPTFSNTAVAPPPLRTFDPQTPPVLRNVERYQQPTLGSQLYNTTNPPYQPTPPAPSQVALSHGQNLSQVVAPTPNPMGFMPVSGSGNVQRPGMGSIQPPSPPQVQPVQPPPAPPTPPPTLQTADTSKVPGHQMPIVTTLTRLFNETSDALGGSRANPARKREIEDNSKRLGGLFAKLNSGDISKNASDKLLQLCQALDNGDFGTALQIQVLLTTTEWDECQSWLGSLKRMIKTRQSHLAVVIADPPINLSHRLLLKAVTEDALVSTGCPWRLGPSVIM

SEQ ID NO: 188441 - protein, 169 aa, Glycine max
  Coding DNA Sequence Number=SeqID_71663
  Gene Ontology: Mol. function=RNA-directed DNA polymerase activity; Cellular component=intracellular; Biological process=RNA-dependent DNA replication
MKADMEAMKGQMTTVMEQIMSMIKMMKELCEDFKIQHHDSTPYRPKMNGAVEEIPFLRLLSEVKLEGLECAQTCFDRLNLIKGKRLDAMSHGQLRRIKNAFGKRMRLRKFNEVDLVLKKVSHVQKDLRGKWTPNYEGPFVTKKEFLDGTWILINMDGEELPLPVNLDVV

SEQ ID NO: 188442 - protein, 84 aa, Glycine max
  Coding DNA Sequence Number=SeqID_71664
MAQGITCEIKKIMQGLAKNFAATIVEAMPWHLTKTHPCEVSQTQPWYSTQKDAQRDTIAKNKQKNTYLQWRGHDSNKVAKRAKP

SEQ ID NO: 188443 - protein, 58 aa, Glycine max
  Coding DNA Sequence Number=SeqID_71665
  Homolog annotation: Hit_ID=Q9SKM8; Match level="QueryCoverage=79%, HitCoverage=25%, E-value=1e-11, Identity=65%"; Hit description =Expressed protein
MILKETGRVRSRCEDLEAMEKKLKEKNVKYMKRTLEREDGTTMDQIFFNDPDGFMVEI

SEQ ID NO: 188444 - protein, 651 aa, Glycine max
  Coding DNA Sequence Number=SeqID_71666
  Gene Ontology: Mol. function=oxidoreductase activity; Cellular component=intracellular; Biological process=lignin catabolic process
  Homolog annotation: Hit_ID=O24044; Match level="QueryCoverage=75%, HitCoverage=84%, E-value=0.0, Identity=79%"; Hit description=Laccase
  Pfam annotation: Domain name=Cu-oxidase; Domain location=234-387; Score=220.3; E_value=4.3e-63; Accession=PF00394.12; Description =Multicopper oxidase
  Pfam annotation: Domain name=Cu-oxidase_2; Domain location=501-635; Score=187.4; E_value=3.4e-53; Accession=PF07731.4; Description =Multicopper oxidase
  Pfam annotation: Domain name=Cu-oxidase_3; Domain location=140-224; Score=86.5; E_value=8.4e-23; Accession=PF07732.5; Description =Multicopper oxidase
  Pfam module annotation: Pfam domain module=Cu-oxidase::Cu-oxidase _2::Cu-oxidase_3; Domain location=234-387::501-635::140-224
  Subcellular localization annotation: CTP_CleavageSite=45; ConfidenceScore=5.01e-01
MQLIGYSDADWAGCMDSRKSISGYCFFIGKSLVSWRAKKQATVSRSSSEAEYRALSSAAYLRVQLTRTPTLYCDNQSAVHIASNPVFHERTKHLEIDCHLVREKLLKGTLKLLPVSTSDQVADFLTKALAPPKFHDFVSKLSMINIYHDKLEGGYHPTRHGIRQLRSGWADGPAYVTQCPIQTGQSYVYNYTIVGQRGTLFWHAHISWLRSTLYGPIIILPKQGAPYPFTKPYKEVPVIFGEWWNTDPEAVITQALQTGGGPNVSDAYTINGLPGPLYNCSAKDTFKLKVKPGKTYLLRLINAALNDELFFSIANHTLTVVDVDAIYVKPFDTDTILIAPGQTSNVLLKTKSHYPNATFFMSARPYATGQGTFDNSTVAAILEYEVPPHFVHSTTSVKKLSLFKPILPALNDTSFATNFANKLHSLASAQFPANVPQKVDKHFFFTVGLGTTPCPQNQTCQGPTNATKFAASVNNVSFIQPTTALLQAHFFGQSNGVYSPYFPISPLVPFNYTGTPPNNTMVSNGTKVVVLPFNTSVELVMQDTSILGAESHPLHLHGFNFFVVGQGFGNFDPKKDPVNFNLVDPVERNTVGVPSGGWVAIRFLTDNPGVWFMHCHLEVHTSWGLKMAWIVLDGKLPNQKLLPPPADLPNC

SEQ ID NO: 188445 - protein, 284 aa, Glycine max
  Coding DNA Sequence Number=SeqID_71667
  Gene Ontology: Mol. function=serine-type endopeptidase activity
  Homolog annotation: Hit_ID=Q1RW49; Match level="QueryCoverage=93%, HitCoverage=44%, E-value=2e-24, Identity=33%"; Hit description=IMP dehydrogenase/GMP reductase
  Subcellular localization annotation: CTP_CleavageSite=41; ConfidenceScore=5.03e-01
MRVCVIFRQISVGGQNLGPWKNGVTQVAQAARPRTKGTLVLAANRTNRPDILHGFRRYQGGWDIANRHYWALGNINFPHACGMVNMVNLDAESVGFTGVAGLTLAVLWFISFGLALVIHLCCGWGINIKDKGSNRLQRIWTGCIVLSFGQDKFHGEAVDTLHYVVNQSDYTVQTLRNVTEYLALAKTIAVAEMFLPSNIMDDIDKLNVDLNSAANTLSEQTKENSFKIRKASSFDYDVSNDASTGSNWVNPVYPWISTRNPRICYQWMAIGCNHIHSLWSVHNP

SEQ ID NO: 188446 - protein, 279 aa, Glycine max
  Coding DNA Sequence Number=SeqID_71668
  Gene Ontology: Mol. function=DNA binding; Cellular component=beta -galactosidase complex; Biological process=DNA integration
  Homolog annotation: Hit_ID=Q1SH28; Match level="QueryCoverage=98%, HitCoverage=31%, E-value=2e-78, Identity=46%"; Hit description =Integrase, catalytic region
NGPEFLMPDFYASKGILHQTSCVDSPQQNGRVERKHQQILNIGRALLVQSNLPKSFWCYAVSHAVYIMNRVPAPNLQNKSPYTLLYNTAPDFDTLKVFGSLAFSMSITHCTEPQSYEEASKHEHWVTAMKEELNALAKNCTWKIVELPPHTKPIGCKWVYKVKHKANGQIERYKARLVAKGYNQVEGIDYFETFSPVAKITTVRTLLAVAAIKNWHLHQLDVNNAFLHGDLQEDVYMKIPDGVTCAKPNSVCKLQKSLYGLKQASRKWYEKLTNLLLKE

SEQ ID NO: 188447 - protein, 78 aa, Glycine max
  Coding DNA Sequence Number=SeqID_71669
  Gene Ontology: Mol. function=methyltransferase activity; Biological process=metabolic process
  Homolog annotation: Hit_ID=A0BJY2; Match level="QueryCoverage=63%, HitCoverage=21%, E-value=2e-07, Identity=46%"; Hit description =Chromosome undetermined scaffold_111, whole genome shotgun sequence
MFRDVSSCNTYNYGEAVYWDARYIQEDGSCDWYQRYSALRPFVRNFIPLSSRILMVGCGNSGWYYNSPSLPSLLFRVS

SEQ ID NO: 188448 - protein, 40 aa, Glycine max
  Coding DNA Sequence Number=SeqID_71670
  Homolog annotation: Hit_ID=Q1SKN1; Match level="QueryCoverage=97%, HitCoverage=2%, E-value=3e-07, Identity=62%"; Hit description =Integrase, catalytic region
MPCVKETKVDSIHDVYSMGNSITPKRLGEIRLNKKSSTYV

SEQ ID NO: 188449 - protein, 132 aa, Glycine max
  Coding DNA Sequence Number=SeqID_71671
MFVVWATIYSYSVVCEVPCHAIMNQRLSCLLYGQFLTPLEPIKKLAYQNDPFIMAEQAKQAFYVQDPCDERWSVVLHGKTIGVNVEDDDSYIHTYVTPLSTQMWPNIVGEEEAGNVHANRNDHDEGELINII

SEQ ID NO: 188450 - protein, 134 aa, Glycine max
  Coding DNA Sequence Number=SeqID_71672
  Gene Ontology: Mol. function=methyltransferase activity; Biological process=metabolic process
  Homolog annotation: Hit_ID=Q242G5; Match level="QueryCoverage=87%, HitCoverage=51%, E-value=7e-09, Identity=31%"; Hit description=RIKEN cDNA 5630401D24-related
MNVRDMSLFPDESFDGVIDKGTLDSLMCGTDAPISAAQMLAEITYGDPTVRMPHISRPVFNWKITLYNIPRPGFQKPESSTPSRKSYLEPIALTEKGLLSADFVLEDPDSHYIYVCKKINDTEIDNNTCIPINS

SEQ ID NO: 188451 - protein, 65 aa, Glycine max
  Coding DNA Sequence Number=SeqID_71673
  Homolog annotation: Hit_ID=Q1S277; Match level="QueryCoverage=68%, HitCoverage=17%, E-value=6e-10, Identity=66%"; Hit description=XRCC4, N-terminal
MFVYMHVKDKVVTENELFEKMKVEAEKCLTQTERIANERLEFESEIYAKHGSALCQEGTMVLANF

SEQ ID NO: 188452 - protein, 183 aa, Glycine max
  Coding DNA Sequence Number=SeqID_71674
  Gene Ontology: Mol. function=DNA binding; Biological process=DNA integration
  Homolog annotation: Hit_ID=Q1SFD6; Match level="QueryCoverage=57%, HitCoverage=7%, E-value=4e-44, Identity=78%"; Hit description =Integrase, catalytic region
  Subcellular localization annotation: CTP_CleavageSite=51; ConfidenceScore=5.45e-01
MPPRIAPPPPADPSTDPTSPFFVHPSDGPSSVKVTPLLDGSNYHSWARSLRRALGAKLKFEFLDGTIPMPVDAFDPSFRAWNRCNMLIHSWILNSVEPSISRSIVFMDNASDVWLDLKERFSQAPIRPIVSRITIHWPSFYNVVTGKTLALPNLIALQHIPLSPAGVIAKRPAPIALPNSCAA

SEQ ID NO: 188453 - protein, 92 aa, Glycine max
  Coding DNA Sequence Number=SeqID_71675
MEAGLGEELEEDIGDGGRGYTQNLQLLEELHFATTARKLKFECHLDSDIIDFKVLASLVIVVCLIEMVVLAGTFGTNVVNIAMLNLYYVMLR

SEQ ID NO: 188454 - protein, 44 aa, Glycine max
  Coding DNA Sequence Number=SeqID_71676
MLWCAQKSRLSNIKGIKTCFYPYGTLSKIATVAKKQANIFCRSM

SEQ ID NO: 188455 - protein, 147 aa, Glycine max
  Coding DNA Sequence Number=SeqID_71677
MAEQAKQVFYVQDPCDERWLVVLHRKTVGVNVELDDSYIDTYVSPLSTQMSPNIVGEEEADDIHTNGYTTQLPPPPLTGAASQLSSTLKQTRKTTQLRSLATRPIGAERPLVHVDPTTGKAKGPHRKKLRTYLGIVICDKVDVTYKN

SEQ ID NO: 188456 - protein, 75 aa, Glycine max
  Coding DNA Sequence Number=SeqID_71678
MRSARSNIENAGSNNLLENLPNSMKAHTDLSMVVELTMECRNNNFAEENVVREAALGLESTEKLIKLLSQTQQQF

SEQ ID NO: 188457 - protein, 60 aa, Glycine max
  Coding DNA Sequence Number=SeqID_71679
MVKHLVKEGMPLILHFRLILAHISVKCFTLWSVINVSGGAEQELLVSRESKRRGSRACRN

SEQ ID NO: 188458 - protein, 69 aa, Glycine max
  Coding DNA Sequence Number=SeqID_71680
  Subcellular localization annotation: CTP_CleavageSite=23; ConfidenceScore=5.10e-01
MPSTPPTSDSPTRMCGSNPMMVFAFTLSSSSSSLIAEFDADPIDVLIPTNIVLVKERTDYEDDKRNIVV

SEQ ID NO: 188459 - protein, 76 aa, Glycine max
  Coding DNA Sequence Number=SeqID_71681
EKGYCYSKLGLQMPSVWFDRGVSSSCAYFVRGGLRHLVTPLQHFWQHIINQGTGGREQKMEDYMGGSSLGVMKLEE

SEQ ID NO: 188460 - protein, 60 aa, Glycine max
  Coding DNA Sequence Number=SeqID_71682
MNLSLESAKENEANVIVYITYNTNVILYTSFKKMRPEGTELQKEYDGREKFFVTPAEKNV

SEQ ID NO: 188461 - protein, 54 aa, Glycine max
  Coding DNA Sequence Number=SeqID_71683
MASGNRLPRSNRPLVINYQSCVIDYTVYGAGFHVLKLCNSSLASVVMGRIVLLP

SEQ ID NO: 188462 - protein, 103 aa, Glycine max
  Coding DNA Sequence Number=SeqID_71684
MASGASIKFSKTLEIFLKKALGGKHLPISPINRGRRLSFEDPKPLCYAFQLFWVKKTCFREENPSRGASVTLPRRFREQIREDFPPFFTVLCPFFIRSLVFNR

SEQ ID NO: 188463 - protein, 44 aa, Glycine max
  Coding DNA Sequence Number=SeqID_71685
MRSCFEDLDWFEDLVDFVDIGESCQVYVVSVFMGALRVNSSLDT

SEQ ID NO: 188464 - protein, 139 aa, Glycine max
  Coding DNA Sequence Number=SeqID_71686
MAPTLLLLNPFCPCDHSNSKNVGNVEIPTPNDGVGRGYGQGKGYGASEGNNVDGAGGVGGEVVVVERGGGFGVGVGIGHDGGGGGGGGGGGGGGSSNVSSFINPNLRKKQVTRRSFIITHFSATLDSLCGTKFANNAPH

SEQ ID NO: 188465 - protein, 232 aa, Glycine max
  Coding DNA Sequence Number=SeqID_71687
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=65%, HitCoverage=15%, E-value=1e-66, Identity=86%"; Hit description =Plasma membrane ATPase 1
  Pfam annotation: Domain name=E1-E2_ATPase; Domain location=40-161; Score=-98.1; E_value=0.0008; Accession=PF00122.10; Description=E1-E2 ATPase
MKSVTKTAEGKPPQHGPQWIEAKSHVQTGNYECGYYVMHWIWCIVTGGLKDDWIHWFSDRSPGGGDKDYKEVPPPPLFQKVLTAIGNFCICSIVVGMVIEIIVMYPIQDREYRPGIDNLLVLLIGGIPIAMPTVLSVTMAIGSHRLSQLGAITKRMTAIEEMAGMDVLCSDKTGTLTLNKLTVDKNLIEVFAKGVDADTVVLMAAQASRLENQDAIDTAIVGMLADPKEVSH

SEQ ID NO: 188466 - protein, 66 aa, Glycine max
  Coding DNA Sequence Number=SeqID_71688
MFTGERRGGPGHVLEGGKKSTQGCKVEKVIDEDWYCQEQWTDMRKEQRRRDIFLSFYKIICNPTLT

SEQ ID NO: 188467 - protein, 112 aa, Glycine max
  Coding DNA Sequence Number=SeqID_71689
MHATSTSVCTATGIFPVARWGGVHTAAQWCCGEYICWCGVLFGSSDNVLDMAIAWVTDDSSGVMDGSDLVFGSWRSWWCLMIAMVENVKCLPHVTTRNFRPRVPSENDGPGG

SEQ ID NO: 188468 - protein, 170 aa, Glycine max
  Coding DNA Sequence Number=SeqID_71690
MSDIEQVQEQMKVDMEAMKEWMTTIMEAMVSMRKMMEVNAATTVALVLLLRGTRFTRSDVVGQGGETAEKSYGPHYVQDQKERLRAIEGGGNYSFADMSELCLVPDVVIPSKFKVPEFDKYKGTTCPKNHLKMYCRKMWVYAKDEKMLMHFFQESLAGAIITWYTNLEPS

SEQ ID NO: 188469 - protein, 146 aa, Glycine max
  Coding DNA Sequence Number=SeqID_71691
MCKRDNESFKEYAHRWRDLATQVVLPMTERERDDNNDNGHTAGMRKWKFNDVASANPGNRGLGRSGERKKEGEPHVVAALPAWPNFPLALIISCTNILPRNITTQPISVFPIIHHLPTKNTQLATKLTPKMDTKSTRCTSKTKHYP

SEQ ID NO: 188470 - protein, 455 aa, Glycine max
  Coding DNA Sequence Number=SeqID_71692
  Gene Ontology: Mol. function=GPI anchor binding; Cellular component =anchored to membrane
  Homolog annotation: Hit_ID=Q336X8; Match level="QueryCoverage=90%, HitCoverage=86%, E-value=1e-122, Identity=54%"; Hit description =Expressed protein
MGFSQDANFYRGSLCCQLILFFIWLPTFQYVTAREIHADHRRISTLVELAKEPASGESGLFDPIEISPAVLPKFPYPTESLPPMYPTFPTRYEPVLTGKCPVNFSHSGISSILDKTASDCSGPLAALVGNVICCPQLSSLIHIFQGYFSMKSDHLVLPNAVADHCFSDIISILASRGANSTIPRLCSIKSSNFTGGSCPVKDDSTFEKTVNSSKLLEACSTVDPLKECCRPVCQPAIMDAALQISGRQMMINNNENMAGEVNHTDYLNDCKSVVYSYLSKKLSFEAANTAFRILSACKVNKVCPLTFKEPTEVINACWNVAAPSPSCCSSLNTYITGIQKQMLITNKQAIICATLFGSMLRGGGVMTNIYELCDVDLKDFSIQGCLLRSLPGDVIFDNSSGFSFTCDLSDNIAAPWPSSSSSFASMSLCAPGCNSGGVGLLLLIFSFFIFSTLLY

SEQ ID NO: 188471 - protein, 212 aa, Glycine max
  Coding DNA Sequence Number=SeqID_71693
MAQQEEGWPLGLRFLNSRIELMRNGSGSASFSTVLTASHTPSTDSSSDLDTEQCPLFGYCTISYSADLNLDMLYSFMLSTGSFFHDNSITLGSLIGISSFLELSRRSTRGRMMEPSKDNKRIHKLKPWLFSLCSRLSTDAVIGNDAPSLGHYLEAERRAASTYRRNQCPTTYGPNGFSPIQDSTSLLVRSQIDHWPSASLGGEHDLNREMEE

SEQ ID NO: 188472 - protein, 202 aa, Glycine max
  Coding DNA Sequence Number=SeqID_71694
  Gene Ontology: Mol. function=metal ion binding; Biological process =defense response to bacterium
  Homolog annotation: Hit_ID=Q2TE73; Match level="QueryCoverage=73%, HitCoverage=34%, E-value=5e-31, Identity=46%"; Hit description=Ring zinc finger protein
  Pfam annotation: Domain name=zf-C3HC4; Domain location=83-131; Score =14.2; E_value=0.0053; Accession=PF00097.15; Description=Zinc finger, C3HC4 type (RING finger)
MIFFFSLVISIISKILWIPWSPQANLLSELNQEAKALLEKALLEANREREKTILKETDMPPSPLHSESEDDNIASEASDMELCCICFDQACTIEVRPCGHQMCAHCTLALCCHKKPDPATAGLSGPVCPFCRGTILQLLVAKINKISDTEVESGPMKPRRSRKSNFSEGSSSFKSLSAMGSFGRIAGRNSGKITDEKQWEVS

SEQ ID NO: 188473 - protein, 47 aa, Glycine max
  Coding DNA Sequence Number=SeqID_71695
MARSLDLFSSSTQPDLRTKASDKNADLSFKIEEGFGPNGLGILSVTD

SEQ ID NO: 188474 - protein, 210 aa, Glycine max
  Coding DNA Sequence Number=SeqID_71696
MEDSGAILAHISSLKEMLDQVNEEIEANIQVTREIESSIVKCEEIEADLATREAELIRTSAMLQFDTVGYVTVAADFRDSVSTLEKELCCLKVKRDEIVSKVDENRENFTTLCLEFQREIDKREDCEVRVLLSEKHSLENEIQLLDKKNNVLKNSVLAFVEEILENLHSSNSALEVQIQRRNWENEKLLKDINDLKTTLLSAIGTSDDVL

SEQ ID NO: 188475 - protein, 76 aa, Glycine max
  Coding DNA Sequence Number=SeqID_71697
MATEHIRKTKLWSQSPRRQIEAATVSRVQEHEARIVAPLKLTGNKLFAVMQLFAFGYSWRLRIMLPHMMWALATSH

SEQ ID NO: 188476 - protein, 367 aa, Glycine max
  Coding DNA Sequence Number=SeqID_71698
  Gene Ontology: Mol. function=nutrient reservoir activity; Cellular component=cellulose and pectin-containing cell wall
  Homolog annotation: Hit_ID=Q43557; Match level="QueryCoverage=89%, HitCoverage=88%, E-value=1e-102, Identity=54%"; Hit description =Unidentified precursor
  Pfam annotation: Domain name=DUF642; Domain location=46-367; Score =678.5; E_value=5.1e-201; Accession=PF04862.3; Description=Protein of unknown function, DUF642
MSETFIFTLSLVMLCAASAFAAVPHRLPEVYLKNGNFEENPNPKYLKKTTLIGKYALPKWEISGHVEYVSGGPQPGGMYFPVSHGVHAVRLGNEASISQTIKVKPGKWYALILGASRTCAQDEVLRISVPPQSGEVPLQTLYSLNGDVIAWGFRPTSSVAKVILHNPGIQEDPACGPLLDAVAIAEFCPPKPTRANLVKNPGFEVGPFPIFNSTNGVLLPPEQEDHVSPLPGWMIESLKAVKFIDAKHFNVPFGQGAVELIAGRESVIAQILRTVPNKIYNMKFTIGDARNGCHGSMMIEAFAAKDTLKVPFKSEGKGEFKTVSFKFRAIENRTRITFYSSFYHTRIHDYGSLCGPVIDQVIVYPVA

SEQ ID NO: 188477 - protein, 113 aa, Glycine max
  Coding DNA Sequence Number=SeqID_71699
  Homolog annotation: Hit_ID=Q6IM91; Match level="QueryCoverage=35%, HitCoverage=72%, E-value=8e-10, Identity=65%"; Hit description=DVL10
MGEGEQADSHAIVIDLHCIAIVHFPTSLFVVGCGKSNNVTPRVGTHMEKNRNFNVFIAETRVKDLIGNSVVVPAEEHGYAASEDVEARLLLLCNQIAPFSKACFPARLGESHA

SEQ ID NO: 188478 - protein, 136 aa, Glycine max
  Coding DNA Sequence Number=SeqID_71700
  Homolog annotation: Hit_ID=A0DY41; Match level="QueryCoverage=47%, HitCoverage=18%, E-value=1e-09, Identity=49%"; Hit description =Chromosome undetermined scaffold_7, whole genome shotgun sequence
MVMNSIPAYSFILDEKLGNKFLVDTSMLSTCALLSTEWFRTATRFCYKSDASSEIPTQICPNILKGSFYANPILDTPTTEASLIQRYPSYCGSNIWPRNALPELEVAFKALGKLIFDIGLMLAYHCDQYGKTAINI

SEQ ID NO: 188479 - protein, 82 aa, Glycine max
  Coding DNA Sequence Number=SeqID_71701
MDSSGNGHDYSKHKKDYEDYEINDKQKERVGRSRKLGTNGEDESEGSNRGVKRKCSSKATTDGDNYNLRSKQGAKKRQKERT

SEQ ID NO: 188480 - protein, 646 aa, Glycine max
  Coding DNA Sequence Number=SeqID_71702
  Gene Ontology: Cellular component=nucleus; Biological process =regulation of progression through cell cycle
  Homolog annotation: Hit_ID=Q6YXW5; Match level="QueryCoverage=99%, HitCoverage=65%, E-value=4e-80, Identity=33%"; Hit description =Cyclin-like protein
HLDHKNVLKNPKMQLDIVGVITHLAQQTRVQQSVAIIGALSDMMRHLRKSIHCSLDDSNLGSEIIQWNQKYRMEVDECLVQLTIKIADAGPVIDTMAVLLENMSNITVMARTLIAAVYRTAQIVASIPNLSYQNKARLAFPEALFHQLLLAMVHADHETRVGAHRIFSVVLVPSSVCPQPSSSGTPMTHAADIQRMLSRNVSVFSSSSALFEKLERKQNSLPEDSHADGNVNDNSILNRLKSTYSRTTSTRKSALTSAEYTDNRNSKVHNSSMMSRLKSSYSRATSVKKPQIPTTVEENTTNTSNKQQVLPIRLSSHQITLLLSSIWAQSIYPLNTSENFEAIAHTYSLVLLVARSKVDPFLQLVNDSKLQAVTDTDKQPSKVYGSKEDDEDALKSLSAIKLTESQSKESFATMIVQSLGKSSNESSILRERLLNDFSPDDACPLGAQLSAETTGNMYQSGLKEDKLPDMVDISLFTIDDDIPPCGLESQANSDSMQQPSQNLSLLSVDDILGSVSETTHQVGRISISTPFDMPYKEMALHCEALLVGKQQKMSTFMGTLPMQGYSFRIPAPEYYQQKDESSNSSVQQTLSSSGNPFLDSNFDSNSHNTLPDTAPRLCATAYQHQAAFFQLPASRPYDNFLKAAGC

SEQ ID NO: 188481 - protein, 375 aa, Glycine max
  Coding DNA Sequence Number=SeqID_71703
  Gene Ontology: Mol. function=isomerase activity; Cellular component =integral to membrane; Biological process=protein folding
  Homolog annotation: Hit_ID=Q1ST49; Match level="QueryCoverage=94%, HitCoverage=94%, E-value=1e-174, Identity=82%"; Hit description =Peptidylprolyl isomerase, FKBP-type
  Pfam annotation: Domain name=FKBP_C; Domain location=63-165; Score =76.9; E_value=6.4e-20; Accession=PF00254.18; Description=FKBP-type peptidyl-prolyl cis-trans i
  Pfam annotation: Domain name=TPR_1; Domain location=188-221; Score =12.1; E_value=0.2; Accession=PF00515.18; Description=Tetratricopeptid e repeat
  Pfam annotation: Domain name=TPR_1; Domain location=239-272; Score =18.8; E_value=0.02; Accession=PF00515.18; Description=Tetratricopepti de repeat
  Pfam annotation: Domain name=TPR_1; Domain location=273-306; Score =27.1; E_value=6e-05; Accession=PF00515.18; Description =Tetratricopeptide repeat
  Pfam annotation: Domain name=TPR_2; Domain location=188-221; Score =8.7; E_value=3.2; Accession=PF07719.7; Description=Tetratricopeptide repeat
  Pfam annotation: Domain name=TPR_2; Domain location=239-272; Score =17.2; E_value=0.059; Accession=PF07719.7; Description=Tetratricopepti de repeat
  Pfam annotation: Domain name=TPR_2; Domain location=273-306; Score =28.5; E_value=2.4e-05; Accession=PF07719.7; Description =Tetratricopeptide repeat
  Pfam module annotation: Pfam domain module=FKBP_C::TPR_1::TPR_1::TPR _1::TPR_2::TPR_2::TPR_2; Domain location=63-165::188-221::239 -272::273-306::188-221::239-272::273-306
MEELQGSQTQSSLGQEDENEVITESSAFVKGEPAPEFSSNPPKVDSEVEVLHEKVTKQIIKEGHGQKPSKYSTCFWDMVVVHYRAWAEKSEHKFEDTWLEQRPIEMVLGKEKKEMTGLSVGVASMKAGERALVRVGWELGYGEEGSFSFPNVPPKADLVYEVELIGFDETKEGKARSDMTVEERIGAADRRKMDGNALYQEEKLEEAMQQYEMAIAYMGDDFMFQLFGKYRDMALAVKNPCHLNMAACLIKLNRYEEAIGQCNTVLGEDENNVKALFRRGKARATLGQTDAAREDFLKATKYAPQDKAIAKELRLLAEHDKAVYQKQKEIYKGIFGPRPQPVPKPRNWLILIWQWLLSVFYGLVTLFKRERHKSD

SEQ ID NO: 188482 - protein, 122 aa, Glycine max
  Coding DNA Sequence Number=SeqID_71704
MATPMSTACYLDKDETGQSIDIKKYRASSPSFLSKAHSWWGSYFFQGLFPSGWRLLSLFFLCLPLHLHGGKSPLKDLIEAQRSSLHIIFTSKLPPFTKPLPKDTFFAIRRELGLLDINDLNK

SEQ ID NO: 188483 - protein, 54 aa, Glycine max
  Coding DNA Sequence Number=SeqID_71705
MVRMVALADAGRMSVQKSLYSKPIHKLGIVVLVSSLKARRTTTTNRYNYGSGLK

SEQ ID NO: 188484 - protein, 162 aa, Glycine max
  Coding DNA Sequence Number=SeqID_71706
  Gene Ontology: Mol. function=nucleic acid binding
  Homolog annotation: Hit_ID=Q1RXW3; Match level="QueryCoverage=54%, HitCoverage=11%, E-value=7e-09, Identity=40%"; Hit description=Zinc finger, CCHC-type
  Pfam annotation: Domain name=zf-CCHC; Domain location=71-88; Score =21.9; E_value=0.00024; Accession=PF00098.13; Description=Zinc knuckle
  Subcellular localization annotation: CTP_CleavageSite=46; ConfidenceScore=5.33e-01
MDGTVKAQFFAKLQGLKCDVVLSFRRRVHQGTNSVSSPVSINFSPSMKMVTYNEVETIYNNVESIKDKSSIVCYECKKLGHFKYECENLKKIQDKTKFFKTIEKKGFRSMCEDPDETLSDEDDEEANICLMENTTSEGSESDQEDELIKTYKEISRIYPEII

SEQ ID NO: 188485 - protein, 57 aa, Glycine max
  Coding DNA Sequence Number=SeqID_71707
  Homolog annotation: Hit_ID=Q2L357; Match level="QueryCoverage=94%, HitCoverage=8%, E-value=8e-08, Identity=42%"; Hit description =Putative cyclin-related protein
VWFMGEFTHISAEFDNVVSVVLENYGDVKEDSQNENAMRLYSWRMVVNDRGEVNVPV

SEQ ID NO: 188486 - protein, 114 aa, Glycine max
  Coding DNA Sequence Number=SeqID_71708
  Gene Ontology: Cellular component=nucleus; Biological process =regulation of progression through cell cycle
  Homolog annotation: Hit_ID=Q6YXW5; Match level="QueryCoverage=93%, HitCoverage=10%, E-value=2e-40, Identity=71%"; Hit description =Cyclin-like protein
MKKKKMSVISRNIWPVCGSLCCFCPALRERSRHPIKRYKKFLADIFPRTPDEEPNERMIGKLCEYASKNPLRVPKITSYLEQRCYRELRTENYQSVKVVICIYRKLLISCKDQM

SEQ ID NO: 188487 - protein, 208 aa, Glycine max
  Coding DNA Sequence Number=SeqID_71709
SGEVEKFLKKYFSESKTVEADRKIKLKTPEEAMELIENMTASDHAILHDRAHTKKNLLELTSQDSMFAQNKLLVNTLETLTETLSAHESGACMVQNDTTNKVNYMGNQNRQGFHQGGPPGFYHKAIRNLEVQMGQLAQKIAKGPTKTFGANTEKNPKEECKAIDASKEEHAKEKENNDKVSTQKTKSQLAREARREIPPAVLMEATLP

SEQ ID NO: 188488 - protein, 689 aa, Glycine max
  Coding DNA Sequence Number=SeqID_71710
  Gene Ontology: Mol. function=solute:hydrogen antiporter activity; Cellular component=integral to membrane; Biological process =regulation of pH
  Homolog annotation: Hit_ID=Q2QLJ1; Match level="QueryCoverage=98%, HitCoverage=80%, E-value=3e-82, Identity=30%"; Hit description =Sodium/hydrogen exchanger family protein, expressed
  Pfam annotation: Domain name=7TMR-DISM_7TM; Domain location=248-427; Score=-43.9; E_value=0.1; Accession=PF07695.2; Description=7TM diverse intracellular signalling
  Pfam annotation: Domain name=Na_H_Exchanger; Domain location=24-459; Score=52.6; E_value=1.3e-12; Accession=PF00999.11; Description =Sodiumhydrogen exchanger family
  Pfam module annotation: Pfam domain module=7TMR-DISM_7TM::Na_H _Exchanger; Domain location=248-427::24-459
MAIAITQCSEKLGYLILQLGKNFLVFMAMVVACNGVHFLLKPCSQPRVTSDIIVGLIMGNIPFLRKLYDEFNSTFGFIMDFGMMCYMFVLGIEMDPYVLLKKPTKDAQIAYAGILCTFIISSSLTSLLRYFTVQSGLAVSISLSALLSSTASPVLTRVITSLKIGKSDIGSLVIGAGMHSDFLCSLLLSVGYIFLSSDIYCLGPKKDKALMAVITMSVAVLAQTLFTAVVSPVFMAWVNNENPEGKPMKGSHLVLSIAFMVMICASSTLYNYSPVLSAFMTGICLPREGRLSKWVITKINYLLATIFFPIFFLWMGYAADMTKFNPGDPITWIRLFLPVAVAVLGKVIGTLVAGALLGFHWPESIAVGLLLITKGHFQIYLSIKAASIFLISLLSSPINYLHCINESSISLFVCPSLVLITFQLNCGTSGTPSSAIVPVIAIFLTLVHAPIVVAHIIKRARKRAPTHSNALQLLDPLSELRILLCLHGLDNVPASINFMEISRGSADSSILVYVAEIIELTDQIAATLESGEGVHTTTIKDKQVIEMREQITSSFQAYVDRDGNGITFKRSLAVSTITSMAQNICVLAEDLMIALIILPFHRYQRQDGKLDGGNPGFRYVNRKLLKSAPCSVGILVNRGFGSVENISRFEPLLKVAIIFVGGRDDREALAYVGRVAWHSGVKVTVIRFL

SEQ ID NO: 188489 - protein, 149 aa, Glycine max
  Coding DNA Sequence Number=SeqID_71711
  Pfam annotation: Domain name=zf-CCHC; Domain location=77-94; Score =31.1; E_value=3.8e-06; Accession=PF00098.13; Description=Zinc knuckle
MELQGLNQNEEPDKKKRSIALKTSSSMQEENEEEESEDEEDFSLFVKKFQKFVKKRRIERHQNFNNGRRSQEDSQILRCYKCNQLGHIKANCPSNEEWPDKSDKKRYEERRTKKAYIACDDNDSFDGSEKEINLLTKDFESDENISQED

SEQ ID NO: 188490 - protein, 492 aa, Glycine max
  Coding DNA Sequence Number=SeqID_71712
  Gene Ontology: Mol. function=phosphoric monoester hydrolase activity; Cellular component=endoplasmic reticulum; Biological process =metabolic process
  Homolog annotation: Hit_ID=Q9XGY7; Match level="QueryCoverage=99%, HitCoverage=99%, E-value=1e-167, Identity=58%"; Hit description=Acyl CoA reductase
  Pfam annotation: Domain name=Epimerase; Domain location=15-338; Score= -49.4; E_value=0.0063; Accession=PF01370.11; Description=NAD dependent epimerasedehydratase family
  Pfam annotation: Domain name=NAD_binding_4; Domain location=17-318; Score=340.8; E_value=2.3e-99; Accession=PF07993.2; Description=Male sterility protein
  Pfam annotation: Domain name=Sterile; Domain location=391-492; Score =98.3; E_value=2.3e-26; Accession=PF03015.9; Description=Male sterility protein
  Pfam module annotation: Pfam domain module=Epimerase::NAD_binding _4::Sterile; Domain location=15-338::17-318::391-492
MELGSITDFLQNKNILVIGATGFLAKIFVEKVLRVQPNVKKLYLLLRATDAESASQRLHNEIMRKDLFRLLKENVGAKFNAFVSEKLTLVPGDISQEDLNLKDPILREEIYNQIHCIVNFAATTNFDERYDVALGINTFGVKHVLNFAKSCIKLKVLVHVSTAYVCGERGGLIVEDPCQLGVSLNGVPGLDIGMEKRVVEDKMNQLHEEGATEEDVKMAMKDLGMKRATLYGWPNTYVFTKAMGEMLVETLKKNMSVIIVRPTMITSTYKEPFPGWVEGVRTIDSVIVAYGKGKLPCFLLDINAIFDVIPADMVVNAIITTLVAHANQPCDNIIYQVGSSIANPIRYHNLKDYIYRYFKAKPWVNKEGNPVMVGKVTVLDTMTSFQRYMFIRYLLPLKGLELANVAFCQYFQGMCLDIRRKIHIVMQLVDLYKPYVFFKGVFDNMNTEKLQTAVRQGEVEMEYSFYFDPKMIDWEDYFMNIHIPGIVKYVFK

SEQ ID NO: 188491 - protein, 83 aa, Glycine max
  Coding DNA Sequence Number=SeqID_71713
  Subcellular localization annotation: CTP_CleavageSite=49; ConfidenceScore=5.10e-01
MSGHTQNESDRLNTTTMTVMYRLARCKGSLGLCGGKFPSTNPSLFLPPRAMNIARFHEFQFSNVRGYENQTETISIIDDVRII

SEQ ID NO: 188492 - protein, 381 aa, Glycine max
  Coding DNA Sequence Number=SeqID_71714
ALLMNALSTHLHAKREFRRAKRAPSLSPRRARALSAHWWLSAQTRDTGPHRVRHMERIPPGIPFSSYQRPHGIGTVTTYPSVGGRRVTRGGGACHPARPGELGCFLQKQPPSGGTPGRPKWARYQENIHLRNILPERNIALAPKMYDEFYGEIHRRYWHRCLTMLPEKQIDIALTLKKFLGTLVTIAEGEQLTTYARYLHSHPDYKAIATKLCIPERRFQLNADVELWKILRKDLTTLAHTWSVLSYFNIALTLHTSNINVDQARLIYGLVMQMDMDGIDSDTLAFESLSPASPSPHHSGCTTTITTSGLTSSHAFYNQPFFLLLSPAEASCTDDAVSLSRPTPDHPEHASVIPPPRHGSPVDDARGFHPSSSMARIPTLL

SEQ ID NO: 188493 - protein, 392 aa, Glycine max
  Coding DNA Sequence Number=SeqID_71715
  Gene Ontology: Mol. function=nucleic acid binding; Cellular component= beta-galactosidase complex; Biological process=DNA integration
  Pfam annotation: Domain name=rve; Domain location=121-281; Score =154.6; E_value=2.7e-43; Accession=PF00665.16; Description=Integrase core domain
MDSFPSIQRAFSLVILEEKQRKDKQQNKVIGKGNLHQVLYHFQPHSEYACSSMHTVGLSQCNNVAYANVWHARMGHLSDNVPKILSNKISFHIPKDFSSNCCLICPLPKFKRLSFDSHNNFSESPFDLIHYDIWGPFPHDTHDGKKYFLTIVDDNSRYNWVHLMRNKSEAPHLLQAFFKLVQTQFSKSIKAMRSDNAKELALTEFLHNARVVHQFSCPHRPQQNSVIERRHQHLLNVARALMFQAQLPIYFLGECVSTTAYIINRTSSSNLQNQSPYELLYGKVPAYDLIKVFGCLCYAATVPAQRHKFTPRATKCVFLGYPFGYKGYKLYDLDNRKFLISRDVTFQENSFPFATSTYITSDSFPNLVVPRPLPDMLPDPNPTHQPPPEPEP

SEQ ID NO: 188494 - protein, 1206 aa, Glycine max
  Coding DNA Sequence Number=SeqID_71716
  Homolog annotation: Hit_ID=Q6CVT9; Match level="QueryCoverage=42%, HitCoverage=54%, E-value=2e-10, Identity=23%"; Hit description =Similarities with sp|P38266 Saccharomyces cerevisiae YBR108w singleton
  Pfam annotation: Domain name=zf-C3HC4; Domain location=20-59; Score =7.6; E_value=0.026; Accession=PF00097.15; Description=Zinc finger, C3HC4 type (RING finger)
MGFDNECIVNIQSLAGEYFCPVCRLLVFPNEALQSQCTHLYCKPCLTYVVSTTRACPYDGYLVTEADSKPLTESNKALAETIGKIAVHCLYHRSGCTWQGTLSECTSHCSGCAFGNSPVVCNRCGIQIVHCQGVQGQAGITQDPSATSAVTSTDQNQNAAPVAATASQTAVTTTMPGQVSNQLPNPASQTQASVQTAGQPTAEQWYQQQQYQQYYQQYPGQDPYQQQYQHYYPYQQSVVPQYQQAYGQPQPQSQSQPQGQLQPQPQPQSQPQFQPQQQAQGLSHPPIHIQAPVAPPSHNQMQVQQPSQQLQPAVQPHGQTSHAPGHGQAFPQSQAQPYPYPQVQPHSVQPQPQQPMQMPPYQQPHPQMQHSQPQIQQPVQKYPVPQSQVHAQLQPNAPIQHHSQLPMPPHQPVTPNVQPQVQNATSHSVTGHHSYPQPPHHPNMQPGVPQHAIHMHPLSGPQSQAQHPIQMQNQFPPQIPTARPNQSHAMFPNQQQPALLPSSVQGQTTPPLQQQSVYTHNQPPGQINQHPTLPPVQQIPQQLFAQHQMPIPSHLRPQDPAHSFPKHAYPQSQGNTAGRPLVPNHAGHLQPFAQSANTIPVRPGQNGAGYLPENQKLLVGANNQVQLPSELQSRAPESIERQGDVVEQQTDSASGKLSKVFKDLDNVSGSANELKSEKVEADLKPTEVGNKQNSEDPHSLKTSVPNANAVENDDSVNKNLGMGEAAESNWKPSSGAMHGVQNDSNEHSVQGNEFQDGHPPKTETKLPESETNKLHNGDNPEPSVSQSNGGFAQLSHPATFTDLSKHQQPTISYGPPSVQQRSSAITSQLPHPTVPNQSLSSVHSSTLIRNHGTAHALHSGQPLTENFPPTMFKQPQDSDIQFNTPGRSLQPQSLGPPRPFNQVHEPPSHAGTSNLPRLGGPQFGAPLPGDMHGRMTANLPRHAPEGFGLQDETFKPFHALNQQNIDRREFDDDLKKFSSLPSNSEPVSKFGNYSLGAHDAGKRPVGIHDDVIKKSGSALHPGYLEPGPGYGRHHMDGIASRSPVSEYAEMSSRRLGPHAGSLVGKAGIDDFEGRVARRFGEFHDSRFPHLPSHLHRDDFDGFGNFRMGEHPRSGDFIGQDEFGGHFRRGEHLAPHNFPRHLQLGEPIGFGAHPGHMRAVELDGFRGFESFGKGGRPGHPQLGEPGFRSSFSLPGFPNDARFLTVKF

SEQ ID NO: 188495 - protein, 838 aa, Glycine max
  Coding DNA Sequence Number=SeqID_71717
  Homolog annotation: Hit_ID=Q9FGV5; Match level="QueryCoverage=93%, HitCoverage=94%, E-value=1e-53, Identity=27%"; Hit description =Arabidopsis thaliana genomic DNA, chromosome 5, TAC clone:K16F13
MGMETVWNSQSNWTIASGSIRDCITFQSSLSLLHDDDDSESTPTPLLLHPPSPDSTPCEIKITFAEKHELRQIYVRSTARVYEIYYAPNSRTNNDYLSTVRCGIAVRDDQVLRSPSIQNLSDDNVNKTEDDWVEVKVPDSPSQTKPYPNSTKTSLSQSQDLYEATAEINDANPCISVTLRLLSLQNKGRVYVDEIYVFADPVDSVDSESQENHNENSSSSSLMAMFLPLMQLSKTTGLSNLNSLRKEKLHVSEDDFEVTLTSDSVIKTQLKGNTSITDPQEVKLNEVKGGWVGPSQPDALSQDARIESNHAAVSSQTAKMDSTCSVVPSKIAEMENNHSAVPFQFAKTECNCSAVPSQGSIPESNHGDYLGGKVERALEQLVSRMDRIEEICLGFQEKMVMPMSSMEARLQRVELQLDTLTKKLQTSALPSCSRISAPDASCIESDANSFEECPDYTVTRENESDEKHLHTEVPYDSALMSDSENATQLLPGLVVTAPEFPDGEDEDGDASGQEINSSKDKGKQSIDDALSSALASFLSSLSLDSPKYTKSLSVKAPEFSNEDEDDNESNNSEIAKNYQVHLTDSEEFSLIQVLASSSTWENSEKINPDSNDKHSKKTAQEAEENDQLCSAEGDQDEVCVKTGFIDSFEEDKNGKVNCQKSDISDELVDNQTPFGHSITKEGPSSGTELTVAAEVPRKTFHENIIENVLGFALASSVVDFENPILDVKFISQRSPATERFLEDLLVGTQDQETSSRDQPVKESNDDVNVKEQLKSNGDVSVEEQSNLISIEDGELVIPASDSHFAVDKDVCASSIIAPVNNEDDNLPLPEDHKRKRDQ

SEQ ID NO: 188496 - protein, 98 aa, Glycine max
  Coding DNA Sequence Number=SeqID_71718
  Gene Ontology: Mol. function=nucleotide binding; Cellular component =cytoplasm
  Homolog annotation: Hit_ID=Q8RUN2; Match level="QueryCoverage=92%, HitCoverage=43%, E-value=7e-30, Identity=64%"; Hit description =Expressed protein
  Pfam annotation: Domain name=Lysine_decarbox; Domain location=1-69; Score=16.4; E_value=4.9e-06; Accession=PF03641.4; Description=Lysine decarboxylase family
MEELLEVIAWSQLGIHDKPVGLLNVDGYFHSLLSLFDKGVEEGFIDNSARHIVVIADTAEELIKRMEEYVPNHHKVATRQSWARDQLLFEPTETGEIL

SEQ ID NO: 188497 - protein, 61 aa, Glycine max
  Coding DNA Sequence Number=SeqID_71719
MIFQSSSSSTPTTNLASTVVVDVPCAAEEVKHTCKFNFKEMRKEHIVKPEPMVKDEKLKKI

SEQ ID NO: 188498 - protein, 74 aa, Glycine max
  Coding DNA Sequence Number=SeqID_71720
  Homolog annotation: Hit_ID=Q84MC2; Match level="QueryCoverage=89%, HitCoverage=30%, E-value=8e-18, Identity=63%"; Hit description =Lysine decarboxylase-like protein At5g11950
MEEVKVSPENKHKGRFQRICVFCGSRVGYKSSFSDAALELGKLLVERKIDLVYGGGRLGLMGLISQTVLKGGRH

SEQ ID NO: 188499 - protein, 215 aa, Glycine max
  Coding DNA Sequence Number=SeqID_71721
MTLVAQKLKDLSEIVEDDEGLVQMALQKRKVASPKAFAPKKAKNAQSVIKAWASVIPSTIPRCIKMRVTEANPKMGDNEMGVSFIGNKEHLTFSSSNSESTSDTPTLPPHKHALFRGAAIKEPLADAQRFPLAFDKGNPTLVTPFSKVIFSKPVFRETEFVQAPSWTRYDYVHTASKAFKTLSSDDIIHLSPLQWTHLEQPIIVKMPPHMLAPET

SEQ ID NO: 188500 - protein, 110 aa, Glycine max
  Coding DNA Sequence Number=SeqID_71722
MEQQKLNFSLNSKARNVMLYTFLEEEYTKVHNLRSAKQIWDTLVVTYEVTSQVTTLRVLKNLDSMSLEELIGTLKVHEQELQQYKGLIREKSLALNTRKNKKESSSREQI

SEQ ID NO: 188501 - protein, 140 aa, Glycine max
  Coding DNA Sequence Number=SeqID_71723
MMLGTSRVRLCEWILKKPPLLAMMEVTMLCTTRFFRCYVLLGTSNLKYKGTYDLKKVAEAQMKKKAEEEVIAIAEKELVASVQAEAFAKFMDNTIMHWVIIDLTITGVMDETSEASNATMIDEVESYIQDPTSKQSTTSN

SEQ ID NO: 188502 - protein, 696 aa, Glycine max
  Coding DNA Sequence Number=SeqID_71724
  Gene Ontology: Mol. function=nucleic acid binding; Cellular component= spliceosome; Biological process=mRNA processing
  Homolog annotation: Hit_ID=Q10M01; Match level="QueryCoverage=98%, HitCoverage=100%, E-value=1e-125, Identity=43%"; Hit description =Zinc finger C-x8-C-x5-C-x3-H type family protein, expressed
  Pfam annotation: Domain name=RRM_1; Domain location=355-423; Score =20.3; E_value=0.0019; Accession=PF00076.12; Description=RNA recognition motif. (a.k.a. RRM, R
  Pfam annotation: Domain name=zf-CCCH; Domain location=218-243; Score =23.3; E_value=0.00088; Accession=PF00642.15; Description=Zinc finger C-x8-C-x5-C-x3-H type (and similar)
  Pfam module annotation: Pfam domain module=RRM_1::zf-CCCH; Domain location=355-423::218-243
MDSYEATRVVFSRIQNLDPENASKIMGLLLLQDHGEKELIRLAFGPEALVHSVILKARKELGLPSNSPHTTSTLPSPSPYLSKQNSTSSRLSALTIPNPSASWPTMSELQTPDDLVAGSLTSSSSLPYYANGGSDPVDEFQLQDQLAFLNDGSNTSTSHKNNNPDLFYPNNNSDLSSSPTTAADPTLFPSDGWGGSLHRRSCSVSDACLGSEDPNSGLGWKPCLYFARGYCKNGTSCRFLHGGLGDADVGGAAAAMVGSPSKIEMMEQCHELLRSKSFQQQRLAAASQLMASSIFPYSPKSMNFLLQQQQNDTQRAAAAALMMSEDLHKFGRSRLERNDFSLNSPVMVNPASRQIYLTFPADSTFREEDVSNYFSIYGPVQDVRIPYQQKRMFGFVTFVYPETVKLILSKGNPHFVCDARVLVKPYKEKGKVPDKKQQQQVDRGDFSPCGTPTGLDARDQFDLQLGGRMLYNTQDMLWRRKLEEQADLQQALELQSRRLMGLQLLDIKKHHQRALSTGSPIPSPTHSPNMFNQNIVPSFHINSESPKESGSTSAPASTASVSAGQQPVNISVGKEVVVNGENGYKEGNGKQSSSHDDCDLQECLEHNLPDSPFASPTKAAVPGDFMAPFSNGPNVAIDTDASAASVNFKFGTSTLLPAASPLDMGTFKSYNCQIPRFSSGHGTIGMFTGTGGPIGI

SEQ ID NO: 188503 - protein, 34 aa, Glycine max
  Coding DNA Sequence Number=SeqID_71725
MAKRFVWRTDKPQADLPQTPNSRYLRFSFSVPAG

SEQ ID NO: 188504 - protein, 78 aa, Glycine max
  Coding DNA Sequence Number=SeqID_71726
MRLEIKEVKLVKEMVALFSTDTKVSGYCCGRWRYSQSQKAYGEKEKVDASYGIMLKAYMASGQNGHRPQSPPFTLKRA

SEQ ID NO: 188505 - protein, 59 aa, Glycine max
  Coding DNA Sequence Number=SeqID_71727
MGALKPCPNQGFHQHKFQYIMLEASRHNQHRLKIKEFFMWNNSQTAAAHIGWKEDVAHE

SEQ ID NO: 188506 - protein, 509 aa, Glycine max
  Coding DNA Sequence Number=SeqID_71728
  Gene Ontology: Mol. function=nucleic acid binding
  Homolog annotation: Hit_ID=Q9LK10; Match level="QueryCoverage=85%, HitCoverage=45%, E-value=1e-89, Identity=41%"; Hit description =Similarity to DNA repair protein
  Pfam annotation: Domain name=Helicase_C; Domain location=356-435; Score=49.0; E_value=1.6e-11; Accession=PF00271.21; Description =Helicase conserved C-terminal domain
MKKIQLRSASTTLFLMRRLGYTADGVVDSERCCRRVSSGGGNTSQFDGDLMNLVMTQKQFGLTMKRVDPCSQGGCIVSHAPGTGKTTLTMVFLQTYLQLFPKCLPIIIAPANILLTWEDELRKSNIGIPFHNLNNSELSREEKLINEVDWSGNQKQNKDAIRMVKLFSWYKEKSILLISYNLYEKLAGATSEGDGKKEKKNSKMKKKRRNVQGQGSTLKVEWERFCVTILERKDVSWDWEPDSSGDTADEKINQLKLLMNPFVHVHKGNILQKNLPGLRDCVLVLKPDILQQETLESIECSQIALNFEHKLAWVSVHPSLFLNCSLSKKEESVVHKDKLEKLRLNPYGGDQLESAINWSVGTEVLYMYGKLDQKQKQSLIQCFNDSNSQAKVLLASVKASSDGINLIGASRVMLLDVVRNPSVERQAICRAYRLGQKRVVFTYHLLAQGTPECTKYCKQAEKNRLSELVFSNRNAESDKLKSSGVRFEDRVLDLMVQHKKLKDMFGECL

SEQ ID NO: 188507 - protein, 486 aa, Glycine max
  Coding DNA Sequence Number=SeqID_71729
  Gene Ontology: Mol. function=drug transporter activity; Cellular component=membrane; Biological process=multidrug transport
  Homolog annotation: Hit_ID=Q1S7F1; Match level="QueryCoverage=98%, HitCoverage=88%, E-value=0.0, Identity=72%"; Hit description=Multi antimicrobial extrusion protein MatE
  Pfam annotation: Domain name=MatE; Domain location=224-387; Score =149.0; E_value=1.3e-41; Accession=PF01554.9; Description=MatE
MTHSSRNEGHRKDIRANSSHRFNHIFESHDLHGLPGLPRRDGARRRLPLDRVRQHHRLLRDLGPGHGNGTHLRASLRCQTIEDTGPNPPENRPPSPLKLPPHFPDDHEISSTAQTFILFSIPDLFLLSLLHPLRIYLRTQSITLPLTYCSAVSVLLHVPLNFLLVVHLKMGVSGVAIAMVWTNLNLFLFLSSFIYFSGVYKDSWVPPSTDCLRGWSSLLALSVPTCVSVCLEWWWYELMIILCGLLLNPKATIASMGILIQTTSLVYVFPSSLSLAVSTRVGNELGANRPAKARISMIVSLACAVALGVTAMLFTTLMRHRWGRFFTSDQQILHLTSIALPIVGLCELGNCPQTTGCGVLRGSARPTVGANINLGSFYLVGMPVAVLLGFVGKMGFPGLWLGLLAAQGSCAALMIFVLCTTDWNAQVQRANELTNANSAPSKLPTTECNNVRLPEILVMDTEDHHDEIITKTPSLETDPLIIHTSK

SEQ ID NO: 188508 - protein, 220 aa, Glycine max
  Coding DNA Sequence Number=SeqID_71730
  Homolog annotation: Hit_ID=Q9SLV1; Match level="QueryCoverage=40%, HitCoverage=41%, E-value=3e-18, Identity=48%"; Hit description=ZW2 protein
MSMFASTPQENVEKSFLAFYEGWLARQENLLKQLLSVARNGPLSLPAIYGREIQRGKRRRLPSLFSTLAFRVRKGSPLDWGLQALSNSPFSRRRREGVNGGAEGEGGENEGQDEEGGEGADGGSSFSSREHGESADAGTDEGGGGYLESAADGGVAGGDDALSDEGQDVGFAKSRELTSKLNPIQSFETITYSYDEWRGEALLVLLATCSHDISYDRMNS

SEQ ID NO: 188509 - protein, 191 aa, Glycine max
  Coding DNA Sequence Number=SeqID_71731
  Gene Ontology: Mol. function=sucrose transporter activity; Cellular component=integral to plasma membrane; Biological process=sucrose transport
  Homolog annotation: Hit_ID=Q1S7F0; Match level="QueryCoverage=64%, HitCoverage=34%, E-value=4e-26, Identity=44%"; Hit description =General substrate transporter; Sucrose/H+ symporter, plant; Major facilitator superfamily MFS_1
MAIGNILGYATGSYSGWYKSAFFLDIIFIAITTYISIVAAKEVPLSSIGAHPVEEAAAGEAFLWELFGTFRYFSTPVWTILSVTALTWIGMGALGLLLNSVVLGVTSVLMERLCRKRGPGIVNGSPKSCNCVPTVDHGISYLVEETPAFGVAAVAALASGLIAVLFIPRPGGQKPSLEAQYEVLCSFCIWH

SEQ ID NO: 188510 - protein, 342 aa, Glycine max
  Coding DNA Sequence Number=SeqID_71732
TRSKRKIESVSGASLKRERVSERGFDCLGGHAGDPIEISDSEAEEGIRHSEKKRFLVQKESKREEGKGCPVFVDKVENFGNDDYSCVPENRISLPDEKEHCVDKSEDCATTGEDFQVDYGESDCYSSSEDSDSSYDDDDDADEDERGGYSKTTTSSKSEIYKQEAMNAAHKAKRVESVNADAQVFGEHWKSSGCSMKRRDRGHQSVSLPKKTEYSTVIKKNLDDHEGKEHHRVKGTGRRSVSLLPKSQEKIGDSAKAARVVDDETGDRDELHEVLRMPSRTKNRCFKLFNEFFWGKNDSVKDDSNWLEEKDDDVGQGQTQPLASRETDSLNWNFMKKEPSSV

SEQ ID NO: 188511 - protein, 51 aa, Glycine max
  Coding DNA Sequence Number=SeqID_71733
MASKGKTRWSLTWFFSQSNNNKEPCRGSMTNEVGQGRRNQARDNPRCHNYL

SEQ ID NO: 188512 - protein, 586 aa, Glycine max
  Coding DNA Sequence Number=SeqID_71734
  Gene Ontology: Mol. function=protein binding; Cellular component =ubiquitin ligase complex; Biological process=ubiquitin cycle
  Homolog annotation: Hit_ID=Q9FLR4; Match level="QueryCoverage=78%, HitCoverage=95%, E-value=1e-102, Identity=50%"; Hit description =Arabidopsis thaliana genomic DNA, chromosome 5, P1 clone:MBK20
MSFRWENENPNPNSPLKKRWSLNQMVMAMKLQSLSCSPGITDKSNPILSPFPLPITDRTLLLSDELLLKIIALVSDSSTQRNSNSLVCKRWLNLQGRLVRSLRISDWNFLLSGRLIHRFPNLNHVDLLSAALISPKYSDVLLTNRVISMHLSSDSFPNWCFCEDNMLPFQVIDNGLTSLAAGCPNLRRLHVIGATEIGLLTVAEECSTLQVLELQRCSDNILRGIAACGNLQILKLVGHVDGFYNSVVSDIGLTILAQGCKRLVKLELSGCEGSFDGIKAIGKCCQMLEELTFSDHRMGDGWLAAISFCENLKTLRFQSCKRIDPNPGMEEYLGCCPALDRLHLQKCQLRDKKSVAALFSVCRVVREIVIQDCWGLDNSIFSFAMICRRVKLLYVEGCSLLTTEGLECVIHSWKELQSLRVVTCKNIKDSEISPALATLFTTLKELRWSPDTKSLLPSGVMGKKEEKKDPPMKKNKEKEKEKCVAVTSPVSGEDSDDKQRPAFPSVRFSSRNASSKYDFVKVKVWLGDNADHYYVLSRFLLSRMLTVTKIPNHVAIKIALELKKLLTDNSLLDVYVALHLFLSPFS

SEQ ID NO: 188513 - protein, 315 aa, Glycine max
  Coding DNA Sequence Number=SeqID_71735
  Gene Ontology: Mol. function=oxidoreductase activity; Cellular component=cytosol; Biological process=flavonoid biosynthetic process
  Homolog annotation: Hit_ID=Q9FJK0; Match level="QueryCoverage=99%, HitCoverage=100%, E-value=1e-118, Identity=63%"; Hit description =Aldose reductase-like protein
  Pfam annotation: Domain name=Aldo_ket_red; Domain location=8-287; Score=373.7; E_value=2.9e-109; Accession=PF00248.11; Description =Aldoketo reductase family
MRSNHVRLNCGITMPLIGLGTYSFPNDRKATELAVHNALEMGYRHFDTAKIYGSEPALGKALNEAICEGEIEREGIFLTSKLWGSDHHDPVSALKQTLENLGMEYLDMYLVHWPVKLKPWVNYPVPNEDDFEKLDLETTWAGMEKCLEMGLCRCIGVSNFSSKKIECLLDYASTPPAVNQVEMHPMWRQGRLRKTCGDQKIHVSAYSPLGGPGNAWGSTAVVHHSIIRSIAFKHKATPAQVALKWGLSKGSSVIVKSFDQERMKENMGSFDLRLDNEDILEIEKLEEMKIMRGEFHVNETTSPYRTIEELWDDEI

SEQ ID NO: 188514 - protein, 120 aa, Glycine max
  Coding DNA Sequence Number=SeqID_71736
MAIKSEHEDDFKKSRLEEKQILVTMEYRYKMIYGERHTSKKAGIVKGGNRPKKQELLVYERKKCVTATERELEEREEGHNRMDSWQGEVGGEDTGIKQQEERREYIGGRGNWSGASFIWR

SEQ ID NO: 188515 - protein, 274 aa, Glycine max
  Coding DNA Sequence Number=SeqID_71737
  Homolog annotation: Hit_ID=Q9FII8; Match level="QueryCoverage=98%, HitCoverage=59%, E-value=5e-77, Identity=56%"; Hit description =Similarity to ATP/GTP nucleotide-binding protein
MVYELLRTSTDAPLASTPVWARDFSSSEELITEFCRECRVVRKGLAGDLKKAMKDGKPIIIEGIHLDPSIYLVDDDNKSPSGVHSENKEINPAFMTLDDNATAQIKDSHVSSSDESNGGSRILSSDEGVSADQVDAVSNSMASIGLAESIPEHKVASLRELETDKTTISKEKSGPKPIIVPIVLKMAEFDHKALLEEWISARTFNDKCPDLDNEKLIANLKTIQDYLCSFTSQGLTVVNVSATTFPQTLDWLHGYLLQCIEQGIEENVTPVAPA

SEQ ID NO: 188516 - protein, 306 aa, Glycine max
  Coding DNA Sequence Number=SeqID_71738
  Gene Ontology: Mol. function=nucleic acid binding; Cellular component= intracellular; Biological process=regulation of transcription
  Homolog annotation: Hit_ID=Q9M202; Match level="QueryCoverage=93%, HitCoverage=96%, E-value=7e-37, Identity=32%"; Hit description=Zinc finger protein-like
  Pfam annotation: Domain name=zf-C2H2; Domain location=185-207; Score =18.8; E_value=0.019; Accession=PF00096.16; Description=Zinc finger, C2H2 type
  Pfam annotation: Domain name=zf-C2H2; Domain location=237-259; Score =25.0; E_value=0.00026; Accession=PF00096.16; Description=Zinc finger, C2H2 type
  Pfam annotation: Domain name=zf-C2H2; Domain location=7-29; Score =17.7; E_value=0.041; Accession=PF00096.16; Description=Zinc finger, C2H2 type
  Pfam module annotation: Pfam domain module=zf-C2H2::zf-C2H2::zf-C2H2; Domain location=185-207::237-259::7-29
MEKNNSKVCKICSKCFSSGKAMGGHMRSHFAKLPIPPKPKTKNQALDNSTELTHLPTQSASPLTSYPQKQPSQNFRSLKHNVFAFLANSNRENESRSYPKNPTRKRSKCHRRFIPAAEMNAEAEPKQVSSKLDSLIAEEAAWTLLMLSRDKWPESKETKKQKMKGKDGENGCNDLLVQTQSRAKFQCKRCGKTFQSYQALGGHKANHKKNESICQEGGDSNDDGSDKNSVIVDEKVFECPYCSKVFKSARALGGHKKVHFSKTIIANAQTTANEFGGRLVVDLNFPAPREDEEVSHIEFLAAFGEV

SEQ ID NO: 188517 - protein, 84 aa, Glycine max
  Coding DNA Sequence Number=SeqID_71739
MKGILKRSERYGKGKASRVKFKGSDRHMSEVWSGANKNIGRGRGHATVNSSSWDPTGALVWWRVLSWAPQPLSSVSLIPLTLSP

SEQ ID NO: 188518 - protein, 1030 aa, Glycine max
  Coding DNA Sequence Number=SeqID_71740
  Gene Ontology: Mol. function=protein serine/threonine kinase activity; Cellular component=integral to membrane; Biological process=protein amino acid phosphorylation
  Homolog annotation: Hit_ID=Q9FII5; Match level="QueryCoverage=94%, HitCoverage=94%, E-value=0.0, Identity=60%"; Hit description =Receptor protein kinase-like protein
  Pfam annotation: Domain name=LRRNT_2; Domain location=29-80; Score =24.8; E_value=0.00031; Accession=PF08263.3; Description=Leucine rich repeat N-terminal domain
  Pfam annotation: Domain name=LRR_1; Domain location=109-131; Score =9.8; E_value=4.2; Accession=PF00560.23; Description=Leucine Rich Repeat
  Pfam annotation: Domain name=LRR_1; Domain location=133-155; Score =14.7; E_value=0.33; Accession=PF00560.23; Description=Leucine Rich Repeat
  Pfam annotation: Domain name=LRR_1; Domain location=157-179; Score =8.9; E_value=6.2; Accession=PF00560.23; Description=Leucine Rich Repeat
  Pfam annotation: Domain name=LRR_1; Domain location=181-203; Score =6.0; E_value=21; Accession=PF00560.23; Description=Leucine Rich Repeat
  Pfam annotation: Domain name=LRR_1; Domain location=205-227; Score =15.9; E_value=0.14; Accession=PF00560.23; Description=Leucine Rich Repeat
  Pfam annotation: Domain name=LRR_1; Domain location=229-251; Score =15.8; E_value=0.15; Accession=PF00560.23; Description=Leucine Rich Repeat
  Pfam annotation: Domain name=LRR_1; Domain location=253-275; Score =15.5; E_value=0.19; Accession=PF00560.23; Description=Leucine Rich Repeat
  Pfam annotation: Domain name=LRR_1; Domain location=277-299; Score =12.8; E_value=1.2; Accession=PF00560.23; Description=Leucine Rich Repeat
  Pfam annotation: Domain name=LRR_1; Domain location=301-323; Score =13.5; E_value=0.77; Accession=PF00560.23; Description=Leucine Rich Repeat
  Pfam annotation: Domain name=LRR_1; Domain location=325-347; Score =14.5; E_value=0.38; Accession=PF00560.23; Description=Leucine Rich Repeat
  Pfam annotation: Domain name=LRR_1; Domain location=349-371; Score =11.1; E_value=2.4; Accession=PF00560.23; Description=Leucine Rich Repeat
  Pfam annotation: Domain name=LRR_1; Domain location=373-396; Score =6.1; E_value=21; Accession=PF00560.23; Description=Leucine Rich Repeat
  Pfam annotation: Domain name=LRR_1; Domain location=397-419; Score =9.8; E_value=4.1; Accession=PF00560.23; Description=Leucine Rich Repeat
  Pfam annotation: Domain name=LRR_1; Domain location=421-443; Score =9.6; E_value=4.5; Accession=PF00560.23; Description=Leucine Rich Repeat
  Pfam annotation: Domain name=LRR_1; Domain location=445-464; Score =8.7; E_value=6.7; Accession=PF00560.23; Description=Leucine Rich Repeat
  Pfam annotation: Domain name=LRR_1; Domain location=466-488; Score =10.3; E_value=3.3; Accession=PF00560.23; Description=Leucine Rich Repeat
  Pfam annotation: Domain name=LRR_1; Domain location=490-511; Score =2.2; E_value=1.1e+02; Accession=PF00560.23; Description=Leucine Rich Repeat
  Pfam annotation: Domain name=LRR_1; Domain location=513-535; Score =11.5; E_value=2; Accession=PF00560.23; Description=Leucine Rich Repeat
  Pfam annotation: Domain name=LRR_1; Domain location=537-559; Score =12.8; E_value=1.2; Accession=PF00560.23; Description=Leucine Rich Repeat
  Pfam annotation: Domain name=LRR_1; Domain location=561-583; Score =16.7; E_value=0.083; Accession=PF00560.23; Description=Leucine Rich Repeat
  Pfam annotation: Domain name=LRR_1; Domain location=585-608; Score =8.1; E_value=8.6; Accession=PF00560.23; Description=Leucine Rich Repeat
  Pfam annotation: Domain name=LRR_1; Domain location=85-107; Score =13.0; E_value=1.1; Accession=PF00560.23; Description=Leucine Rich Repeat
  Pfam annotation: Domain name=Pkinase; Domain location=712-988; Score =140.4; E_value=4.9e-39; Accession=PF00069.15; Description=Protein kinase domain
  Pfam annotation: Domain name=Pkinase_Tyr; Domain location=711-988; Score=104.7; E_value=2.7e-28; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=29-80::109-131::133-155::157-179::181-203::205-227::229 -251::253-275::277-299::301-323::325-347::349-371::373-396::397 -419::421-443::445-464::...
  Pfam module annotation: Domain location=466-488::490-511::513 -535::537-559::561-583::585-608::85-107::712-988::711-988
MKHFLLFLITFSFLCQTHLLILLSATTTLPLQLVALLSIKSSLLDPLNNLHDWDPSPSPTFSNSNPQHPIWCSWRAITCHPKTSQITTLDLSHLNLSGTISPQIRHLSTLNHLNLSGNDFTGSFQYAIFELTELRTLDISHNSFNSTFPPGISKLKFLRHFNAYSNSFTGPLPQELTTLRFIEQLNLGGSYFSDGIPPSYGTFPRLKFLDLAGNAFEGPLPPQLGHLAELEHLEIGYNNFSGTLPSELGLLPNLKYLDISSTNISGNVIPELGNLTKLETLLLFKNRLTGEIPSTLGKLKSLKGLDLSDNELTGPIPTQVTMLTELTMLNLMNNNLTGEIPQGIGELPKLDTLFLFNNSLTGTLPRQLGSNGLLLKLDVSTNSLEGPIPENVCKGNKLVRLILFLNRFTGSLPHSLANCTSLARVRIQNNFLNGSIPQGLTLLPNLTFLDISTNNFRGQIPERLGNLQYFNMSGNSFGTSLPASIWNATDLAIFSAASSNITGQIPDFIGCQALYKLELQGNSINGTIPWDIGHCQKLILLNLSRNSLTGIIPWEISILPSITDVDLSHNSLTGTIPSNFNNCSTLENFNVSFNSLIGPIPSSGIFPNLHPSSYAGNQGLCGGVLAKPCAADALAASDNQVDVHRQQPKRTAGAIVWIVAAAFGIGLFVLVAGTRCFHANYNHRFGDEVGPWKLTAFQRLNFTAEDVLECLSLSDKILGMGSTGTVYRAEMPGGEIIAVKKLWGKQKENNIRRRRGVLAEVEVLGNVRHRNIVRLLGCCSNNECTMLLYEYMPNGNLDDLLHAKNKGDNLVADWFNRYKIALGVAQGICYLHHDCDPVIVHRDLKPSNILLDAEMKARVADFGVAKLIQTDESMSVIAGSYGYIAPEYAYTLQVDEKSDIYSYGVVLMEILSGKRSVDAEFGDGNSIVDWVRSKIKSKDGINDILDKNAGAGCTSVREEMIQMLRIALLCTSRNPADRPSMRDVVLMLQEAKPKRKLLDSVIVGRCAGDNVVGGGGGDIPLPQKPTADQC

SEQ ID NO: 188519 - protein, 59 aa, Glycine max
  Coding DNA Sequence Number=SeqID_71741
  Subcellular localization annotation: CTP_CleavageSite=16; ConfidenceScore=5.16e-01
MSDMALPKASPTFTPMCSKAPNPKSSFTANDFRGSSYGMHIDIDSCIHRSCLPFIPPIP

SEQ ID NO: 188520 - protein, 319 aa, Glycine max
  Coding DNA Sequence Number=SeqID_71742
  Gene Ontology: Mol. function=two-component sensor activity; Cellular component=chromosome; Biological process=DNA metabolic process
  Homolog annotation: Hit_ID=Q1SRL8; Match level="QueryCoverage=67%, HitCoverage=91%, E-value=7e-86, Identity=72%"; Hit description=SMC -like protein-related
MQAEESNMEEKLKGLKDEVHAAESKLKRLQEEEALLLDNIHRQKDEIRKIADKITVFGGNKVLDLLRIIENYHQRFKMPPIGPIGAHLKLLHGNKWALAVEHAIGRLLNSFIVTDHADCRLLKQCAKEAHFGHLQIIVYDFSIPRLTIPQHMLPDTEHPSILSVLQCENQTVINVLVDHGNVERQVLVKDYEVGKVVVFDRRIRNLKEAYTEDGCRMICSIGKNPSPTLARDSAKIEYISGGKPSPYELAFGVELGLNPHSKMVLEPILDPFKGSPTMLSTRQAQKCLDVRGCIEKNPSPSLTSDSTKIEYISGGQPSP

SEQ ID NO: 188521 - protein, 147 aa, Glycine max
  Coding DNA Sequence Number=SeqID_71743
MCPAKFRDKQPTAKAYFEKSMNMDHDGRCGEGFALKPSRFSMCPVVGFGPWLGLGKPLVEILPPGQLRGFCPLLAWLGSAVLGFVGDLEGTGRIKATRAESQWIVAARPLCHLQYPVAYLSRLQRILPAARWELRFKASRRANPPHE

SEQ ID NO: 188522 - protein, 49 aa, Glycine max
  Coding DNA Sequence Number=SeqID_71744
MESRSLPKDKQLFLFSQFSMYIIELEKHKGSPFQVHPQACSSKALPAKK

SEQ ID NO: 188523 - protein, 105 aa, Glycine max
  Coding DNA Sequence Number=SeqID_71745
MAALALCLATCCFGTFKHKHDPILALHLHFQIRFKAELPKNIIHSVRHPVTKLAEENNKTRNPTLIKPQIPSRHQKPIKVCSKVTAPNGTNIDTAHQTLANRGIR

SEQ ID NO: 188524 - protein, 86 aa, Glycine max
  Coding DNA Sequence Number=SeqID_71746
MSYRNETQKHDVIGFRGLEKRRYELGELLYSISLKLRVDILTPQALTPLRKMKAKIHSGTTITLDSRLTNGYVNYVHIGKEICSTF

SEQ ID NO: 188525 - protein, 663 aa, Glycine max
  Coding DNA Sequence Number=SeqID_71747
  Gene Ontology: Mol. function=DNA photolyase activity; Cellular component=mitochondrion; Biological process=aromatic compound metabolic process
  Homolog annotation: Hit_ID=Q652J5; Match level="QueryCoverage=96%, HitCoverage=92%, E-value=0.0, Identity=50%"; Hit description =Deoxyribodipyrimidine photolyase family protein-like
  Pfam annotation: Domain name=Abhydrolase_1; Domain location=424-647; Score=42.6; E_value=1.3e-09; Accession=PF00561.10; Description =alphabeta hydrolase fold
  Pfam annotation: Domain name=DNA_photolyase; Domain location=5-172; Score=22.6; E_value=2.4e-07; Accession=PF00875.8; Description=DNA photolyase
  Pfam module annotation: Pfam domain module=Abhydrolase_1::DNA _photolyase; Domain location=424-647::5-172
MKATGTAILWFKHDLRTDDHPALLAASAFPSLVPIYVFDHRILSRFSDETLELVLLAVEDLRKSLKDRGSDLVIRFGNAENVIQQLATEVVTSTEQVKATCVFAEQEVEYELRFIIDVVKQRLKSVSVPQGSPRIELWRTPFYDIKDLENLPASYDEFKKLRLSVTTPLQLSVSKLPGAEIELDWGVLPSYDDIKGFLTSNQQKSGEKWSLMKETSAETILRRKVLKSGNNIERSSRFGLTQSRERNGSVFVTQKGNIVGGSTNNVLNALAAYLRYLEGTARDDWQEVHEKVRASESRNGASFIGLFGPALSLGIISRRKVHYEAIKYEKERNAGFLSPFGYSAATIAAAVDAVCSMEWYWLLALKNQKNNHGIHSTRIWKWKGFLIQYSVAGEDGPAILLVHGFGAFWEHYRDNIHGLAESGNRVWAITILGFGKSEKPNVVYTELLWAELLRDFIVDIVGEPVHLVGNSIGGYLVAIVARVWSDLIKSIVLINSAGNVIPRYSFIPLSTIQDRQTSGASWLGSRILVFYLRLRTQELLKKCYPTRVERADDFLISEMLRASYDPGVLVVLESIFSFNLSIPLNFLLEDVKEKVLIIQGMKDPISDSNSKVAMLKEHCDGVMIKELDAGHCPHDEVPERVNTIICEWILGVESNNILAECAV

SEQ ID NO: 188526 - protein, 378 aa, Glycine max
  Coding DNA Sequence Number=SeqID_71748
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q50HW5; Match level="QueryCoverage=78%, HitCoverage=71%, E-value=1e-137, Identity=81%"; Hit description=Beta- 1,3-glucuronosyltransferase
  Pfam annotation: Domain name=Glyco_transf_43; Domain location=78-309; Score=311.6; E_value=1.5e-90; Accession=PF03360.6; Description =Glycosyltransferase family 43
MKPPPLPRAAANNAQQLLREERVLRNRVEREGFVVDPVSLSAEREWQSERFDFAPKKPLIVVTPTYERTFQAYFLNRLGQVLRLVPPPVVWIVVEMKAASMETAEVLRKTGVMYRHLVCNKNLTDVKDRGVHQRNTALEHIEHHRLDGIVYFADDDNVYSLELFDALRDIRLNIYKLCNKHFIRKELGSRFGTWPVAMLVPSKNKAILEGPVCNASQVIGWHTNEKSKRLRRFHVDMSGFAFNSTILWDPKRWQRPSSNPIRQLDTVKEGFQETTFIEQLVEDESQMEGSPPGCSKILNWHLHLTAHNIVYPKGWVLQKNLDAVIPVKWTHEIASIGTNALCRRARQEQEQDKKAKIKFETARHNGQIDRCYFNCHAK

SEQ ID NO: 188527 - protein, 163 aa, Glycine max
  Coding DNA Sequence Number=SeqID_71749
  Gene Ontology: Mol. function=phosphotransferase activity, alcohol group as acceptor
MWYDTDQVIVIWKTKQFQQYGKVERWLEDIWVWMLKFKDAVFGIALESSAEILGCAPLIMRITNQVLSFYQSTPGSVGIKLLALKFLEMFVLLFSSDFNDAEKLAAKGIRQAVNVSWLVGHPHPVLDPVVLMSDANRTIGILLNLLQSVGSLPGCLTIAVVNW

SEQ ID NO: 188528 - protein, 984 aa, Glycine max
  Coding DNA Sequence Number=SeqID_71750
  Homolog annotation: Hit_ID=Q69R94; Match level="QueryCoverage=95%, HitCoverage=69%, E-value=1e-115, Identity=37%"; Hit description =Putative symplekin
  Pfam annotation: Domain name=WI12; Domain location=102-213; Score= -36.8; E_value=0.056; Accession=PF07107.2; Description=Wound-induced protein WI12
MNAGDAADQVIRQVDKMIKNGDRSTRDARVSKDDQPSAQSPVSGELSRKRPVPLDNEQLANGHDTISKRIRSGSGSDSHSTLPTQINDSGQDVNSVNGVSANVPVLDSELTAVEQMIAVIGALLAEGERGAESLEILISKIHPDLLADIVITNMKHLPNTPPPLARIGNLPVTRQLSSQVSQSQVIAASVPINSVQSLSGTAQASFPSTSTTVTATATTSLPSDTSSFSNQPADSKRDPRRDPRRLDPRRVVVTPGEATASIADDTGATKLVFDEPVSSIKPVSLPVGTADDNTPSDLTVKIINDDIVSEGSPVSGPDRLTPKTEDLERLGDIHQITEADTSLDLPLSSTYLRDEDPSTVKLPDDTETIGTDSSIFEFDQFSLDVQVESTLEDTCLELPQLPPYIELSKEQESKVKNMAVMRIIDSYKHLHGTDCQQFSMPLLARLVAQGHELVLHVLYHLHSLMIVDSVGNASSSAVLYEKFLLGVAKTLLDSFPASDKSFSRLLGEVPLLPESSLKILNDLCYSDVIGHDGKIIRDIERVTQGLGAIWSLILGRPQNRQACLGIALKCAVHPQDDIRAKAIRLVTNKLFQLNYISGDVEKFATKMLLSAVEHEVSDTGLLQSGHTEQRAEAELPQLMGCGLVIVVPDKLIIGSVYLILQIESHEISTSQVESTISEIDSAIVAKPSIQSVPSISFSEAQRLISLFFALCTKKSGLLQIVFSVYGQAPKTVKQAFHRHIPIVVRALGQSYSELLRIISDPPQGSENLLTLVLQILTQDTTPSSDLISTVKRLYETKFKDVTILVPLLSSLSKQEVLPIFPRLVDLPLEKFQRALAHILQGSAHTGPALTPVEVLVAIHGIVPEKDGLALKKACLLPSTLMLQITDACSACFEQRTVFTQQVLAKALNQMVDQTPLPLLFMRTVIQAIDAFPALVDFVMEILSKLVSRQLPPQQLESALNRHANLRGPLASYASQPTVKSSLSR

SEQ ID NO: 188529 - protein, 66 aa, Glycine max
  Coding DNA Sequence Number=SeqID_71751
MYLKVRERLVASLSFDMAAAEMKMILGSDRTYVRFGNVDVSGTFWRESEIPSLAYPGRWRMKKRFR

SEQ ID NO: 188530 - protein, 725 aa, Glycine max
  Coding DNA Sequence Number=SeqID_71752
  Gene Ontology: Mol. function=shikimate 5-dehydrogenase activity; Cellular component=cytoplasm; Biological process=aromatic amino acid family biosynthetic process, shikimate pathway
  Homolog annotation: Hit_ID=Q9ZPK4; Match level="QueryCoverage=73%, HitCoverage=99%, E-value=0.0, Identity=78%"; Hit description =Glutamyl-tRNA reductase
  Pfam annotation: Domain name=GlutR_N; Domain location=91-240; Score =271.9; E_value=1.3e-78; Accession=PF05201.5; Description=Glutamyl -tRNAGlu reductase, N-terminal domain
  Pfam annotation: Domain name=GlutR_dimer; Domain location=409-515; Score=189.5; E_value=7.9e-54; Accession=PF00745.11; Description =Glutamyl-tRNAGlu reductase, dimerisation domain
  Pfam annotation: Domain name=Shikimate_DH; Domain location=244-396; Score=211.9; E_value=1.4e-60; Accession=PF01488.10; Description =Shikimate  quinate 5-dehydrogenase
  Pfam module annotation: Pfam domain module=GlutR_N::GlutR _dimer::Shikimate_DH; Domain location=91-240::409-515::244-396
  Subcellular localization annotation: CTP_CleavageSite=51; ConfidenceScore=5.79e-01
MAVSTTFSAPKLEALFLKCSSSSSSPSPSRASFTTFPRQNRRTLIQRGFIRCDALASDASSVAPNNATALEQLKISAADRYTKERSSIIVIGLSVHTAPVEMREKLAIPEAEWPRAIAELCSLNHIEEAAILSTCNRMEIYVVALSQHRGVKEVMEWMSKVSVEFLSQMHRFLLYNNDATQHLFEVSAGLDSLVLGEGQILAQVKQVVKVGQGVSGFGRNISGLFKHAITVGKRVRTETNIASGAVSVSSAAVELAYMKLLEASHDNARMLVVGAGKMGKLVIKHLVAKSCKKMVVVNRTEERVAAIREELKDIEIIYKPLSEMLTCAGEADVVFTSTASESPLFLKHHVKDLPPANQDVGGRRFFIDISVPRNVGSCVSDLESVRVYNVDDLKEVVAANKEDRLRKAMEAQAIIAEESKQFEAWRDSLETVPTIKKLRAYAERIRLAELEKCLGKMGDDIPKKTRRAVDDLSRGIVNKLLHGPMQHLRCDGNDSRTLSETLENMHALNRMFNLETEISVLEEKIRAKMQWRYDRAEPKSLVLMAIRRSSWEPPVKLASSMVQACRRFCRGAGACFSEKGVATAIGELPASCNSHWRVAQEEIAITNGRKYIALQICDDEDVETMLESFKQQQEMSVLELYIEKDVAGGSMFHSANSLTSCGNYVSNDYTQPPTNMSNLNLDEDDDHDDDDYLVSNSYVEESLDEDDSVDGISDTDNEVPDMIPP

SEQ ID NO: 188531 - protein, 406 aa, Glycine max
  Coding DNA Sequence Number=SeqID_71753
  Gene Ontology: Mol. function=phosphoenolpyruvate carboxykinase (ATP) activity; Cellular component=cytosol; Biological process =gluconeogenesis
  Homolog annotation: Hit_ID=Q8W505; Match level="QueryCoverage=90%, HitCoverage=68%, E-value=1e-162, Identity=65%"; Hit description =Phosphoenolpyruvate carboxykinase
  Pfam annotation: Domain name=PEPCK_ATP; Domain location=11-395; Score= 613.7; E_value=1.6e-181; Accession=PF01293.11; Description =Phosphoenolpyruvate carboxykinase
MERITENGSDSSVSLRRNTSNNGRRGLPMIQTDSEVCHDDSTPLSNSNPSVQVYVNDQFLNWDPEHRIKVRIVSARAYHSLFMHNMCIRPTPKELEEFGTPDFTIYNAGLFPCNRYTHYMTSSTSIDINIARKEMVILGTQYAGEMKKGLFGLMHYLMPKRYILSLHSGSNMGKDGDVALFFGLSGTGKTTLSTYQNRYLIGDDEHCWSENGVSNIEGGCYAKCVDLSKDKEPDIWNAIKFGTENTRAAYPIEYIPNAKIPCVAPHAKNVILLACDAFGVLPPVAGTEDGIKEPQATFSACFGAAFIMMPPTKYAAMLAEKMQKHGATGWLVNTGWSGGSHGLGNRIKLAYTRKIIDAIQSDKKTYQDTLLKLASLFKKNFDGFTTYKIGGDQKLTEEIVSAGPIF

SEQ ID NO: 188532 - protein, 204 aa, Glycine max
  Coding DNA Sequence Number=SeqID_71754
MAKSYKNLQAKLQELQSILDQALLLGPETQSQDSISNDIKHKLAFIGNLLAAQVSSHHPSKPHHLHHISERFSTCSCSDSCLNNDDETDLIAFEDPERLLLDSNCEKAMVEYSGAVAEATGYVDEEKQTEEMKNGFDKLESFDYEDADDFLEDFAGDKGLVEFEGALLRKPEGKKENYLETEESRHSTFGERCCALAAGDLSLA

SEQ ID NO: 188533 - protein, 755 aa, Glycine max
  Coding DNA Sequence Number=SeqID_71755
  Gene Ontology: Mol. function=metal ion binding
  Pfam annotation: Domain name=VWA; Domain location=351-529; Score =50.3; E_value=6.6e-12; Accession=PF00092.18; Description=von Willebrand factor type A domain
  Pfam annotation: Domain name=zf-C3HC4; Domain location=118-162; Score= 34.9; E_value=2.7e-07; Accession=PF00097.15; Description=Zinc finger, C3HC4 type (RING finger)
  Pfam module annotation: Pfam domain module=VWA::zf-C3HC4; Domain location=351-529::118-162
  Subcellular localization annotation: CTP_CleavageSite=59; ConfidenceScore=5.67e-01
MGTGWRRAFCTRDPASTISDKQPRSPSQSPSPSPRSCARLGFLSGGSNPSTPRLRCTTTAETVSQTVTVSESPRVHSKNTTPRAAKSPKTLSVSNPTSPRSPLKLSLFRNSFKFRSSCGICLNSVKTGQGTAIYTAECGHAFHFPCIAAHVRKHGSLVCPVCNATWKDVPLLAAHKNLAPESATQNNVVVVQRVAESPYTNAASDKKPTENNNASPVFKAYNNNNHVEPPAKHSDPSRSYDDDEPLLSPTSDGRIIPIPEADEDEDEDPGEFQGFFVNPKNSSSSKSYSDSLQTSDGDSRTVQVKLMPECAVISVSRAHETYALVLKVKAPPPPPPPSRSSAAPSQRAPIDLVTVLDVGGNMTGGKLHMLKRAMRLVISSLGTADRLSIVAFSATSKRLLPLRRMTSQGQRVARRIVDRLVIGQGSSVGDALRKATRVLEDRRERNPVASVMLLSDGQEEKVQNQRGNNNQRKSSSHVSSTRFAHIEIPIHAFGFGAKSGYSQEPGEDAFAKCVGGLLSVVVQDLRIQVGFESESVEISAIYSCSGRPTLMSSGAVRMGDLYAEEERELLVELRVPASSGTGAHNHVMTVRCLYKDPATQEIVYGREQGLLVPPPQSSGTRIERLRNLFITARAIAESRRLLEHSPDFTSAHHLLASARVLLMQSNSASAQEYVRGLEAELAELHWRRQHEQMQVQVQQRRRGAEREVMALLDENGEPLTPTSAWRAAEKLAKMAMMKKSLNRVSDLHGFENARF

SEQ ID NO: 188534 - protein, 32 aa, Glycine max
  Coding DNA Sequence Number=SeqID_71756
MSGMEPKQVSQLSNPSLSDPLVLVLGPVLYDP

SEQ ID NO: 188535 - protein, 318 aa, Glycine max
  Coding DNA Sequence Number=SeqID_71757
  Gene Ontology: Mol. function=DNA binding; Cellular component=nucleus; Biological process=regulation of transcription
  Homolog annotation: Hit_ID=UPI00001631DC; Match level="QueryCoverage =90%, HitCoverage=80%, E-value=4e-72, Identity=49%"; Hit description =ANAC026; transcription factor
  Pfam annotation: Domain name=NAM; Domain location=1-124; Score=285.9; E_value=7.9e-83; Accession=PF02365.6; Description=No apical meristem (NAM) protein
FHPTDEELVDYYLRKKIASRRIDLDVIKDVDLYKIEPWDLQEICRIGAEEQNEWYFFSHKDKKYPTGTRTNRATAAGFWKATGRDKAIYSKHELIGMRKTLVFYKGRAPNGQKSDWIMHEYRLETDENGTPQAIFKKRVTTMRKVSEHDSSCWYDEQVSFMQDLDSPKQTCQSNLVYQQLPYPCKKELDLPPYQLPRDHFLQLPLLESPKLLQSASAIAPINNPMEGYVLDHVNHSTSLLPPSLIQQEHVGQQNFQATYGNINNSNEQAVDPVTDWRVLDKFVASQLSQDASKENIFQGTDNSSVQFRHLDKQKLVGT

SEQ ID NO: 188536 - protein, 219 aa, Glycine max
  Coding DNA Sequence Number=SeqID_71758
  Gene Ontology: Mol. function=sequence-specific DNA binding; Cellular component=nucleus; Biological process=regulation of transcription, DNA-dependent
  Homolog annotation: Hit_ID=Q8H279; Match level="QueryCoverage=98%, HitCoverage=99%, E-value=5e-66, Identity=62%"; Hit description =TAGL12 transcription factor
  Pfam annotation: Domain name=K-box; Domain location=96-191; Score =23.4; E_value=4.7e-06; Accession=PF01486.8; Description=K-box region
  Pfam annotation: Domain name=SRF-TF; Domain location=9-59; Score =95.2; E_value=1.9e-25; Accession=PF00319.9; Description=SRF-type transcription factor (DNA-binding and dimerisation domain)
  Pfam module annotation: Pfam domain module=K-box::SRF-TF; Domain location=96-191::9-59
MARGKVQLKRIENPVHRQVTFCKRRAGLLKKAKELSVLCDAEIGLFIFSAHGKLYELATKGTMQGLIERYMKFTRGAQPEAAAPEAHPLLEMPLQDAHKTINGELKVAKEETNALKQEIQTLQKGISYLFEGGNKTMAIDELQLLEKNLETWIYHIRSMKMNIMLQEIQALKDKEGTLKAANKYLHDKIVENTAISNFAEFATDTSYPLIVQDGGFQLY

SEQ ID NO: 188537 - protein, 482 aa, Glycine max
  Coding DNA Sequence Number=SeqID_71759
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q5K6L5; Match level="QueryCoverage=94%, HitCoverage=93%, E-value=1e-137, Identity=52%"; Hit description=Endo- 1,4-beta-glucanase isoform 01
  Pfam annotation: Domain name=Glyco_hydro_9; Domain location=24-477; Score=758.3; E_value=4.8e-225; Accession=PF00759.9; Description =Glycosyl hydrolase family 9
MGFPQRLLFILAGTILSVTGLKHNYGEALSKSILFFEGQRSGKLPPTQRMTWRKDSALQDVYIIPDTTVLPFLRKVDLVGGYYDAGDNVKFNFPMAFSTTMLAWSVIEFGKLMGPDLKHALDAIRWATEYFLKATSIPGFVFAQVGDPYADHNCWERPEDMDTPRTAFAVSRDFPGSEVSAEIAAALAASSVVYRKYHIGYSTRLLQRAIKVFDFADKYRGSYNDSLGPWDELVWGAAWLFKATKRPYYLDYIDKNIYNLKNFAEFGWDSKDAGINVLVSKLLINSSSNSKPFILNNADKFVCSVLPESPSVSVSYSPGGLLFKPGGSNLQHATAISFLFLVYAGYLKKTNKEIDCGGKVFASPKRLKQIARGQVDYILGSNPVNMSYMVGYGAKYPERIHHRASSLPSVDEHRGHIGCKGGSFYFHSQNPNPNLLVGAVVGGPDMKDSYADSRADFVHSEPTTYINAPLVGVLAYFNSHPS

SEQ ID NO: 188538 - protein, 909 aa, Glycine max
  Coding DNA Sequence Number=SeqID_71760
  Gene Ontology: Mol. function=DNA binding; Cellular component=beta -galactosidase complex; Biological process=DNA integration
  Homolog annotation: Hit_ID=Q1SDN3; Match level="QueryCoverage=98%, HitCoverage=97%, E-value=1e-170, Identity=47%"; Hit description =Polynucleotidyl transferase, Ribonuclease H fold
  Pfam annotation: Domain name=zf-CCHC; Domain location=243-260; Score =13.0; E_value=0.0071; Accession=PF00098.13; Description=Zinc knuckle
  Pfam module annotation: Pfam domain module=RVT_2::Retrotrans_gag::zf -CCHC; Domain location=399-654::73-188::243-260
AFNNVESYLYLHPSENPAAALVSPVLDSTNYHSWSRSMITALSAKNKLEFVDGSAPEPLKTDRTYGAWRRCNNMVVSWIVHSVAASIRQSVLWMDKAEDIWRDLKSRYSQGDLLRISDLQQEASTLKQGALSVTEYFTKLRVIWDEIENFRPDPACTCNSRCSCSAFAIIAQRKLEDRAMQFLRGLNEQYTNIRSHVLLMDPIPAISKIFSYVAQQERQLLGNSSSPNLNFESKEISINATKSICDYCGQMGHTESVCYKKHGMPPNHEMRNKGNGGRKTCTHSGRIGHTVDVCYRKHGYPPGYKPFNGRSTVNNMVTMDNKTMDNQTQHHESQDLVQFSPEQYKALLALIQRPSIGNTASEQTKQVASISSCTTDKLPNPVEPSSYAEASQHDCWLKAMKAELQALQLNETWQLTPLPPHKTAIGCRWVYKVKHKADGSIERYKARLVAKGYTQMEGLDYLDTFSPVAKLTTVHLLLAVAAMNHWHLRQLDVNNAFLHGELEEEVYMQVPPGLTVTNPNLVCRLQRSLYGLKQASRQWFMKLSGFLTVHGFQQSHSDHSLFLRFNGSVTTILLVYVDDIILTGNSNTAIQEVLTLLDQAFKIKDLGNLKYFLGLEIARSSEGIHLSQRKYTLDILSDSGMLGCRPNTTPMDSSTKLHATTGTPLSAEASSSYRRLIGRLIYLNNTRPDIAYAVQQLSQYMSSPTDAHLQAAYRILQYLKGTPGSGIFFSATGTPQLRAFSDSDWAGCQDSRRSTTGFVVYFDSSLISWQSKKQSTVSRSSSEAEYRALASTTCELQWLTYLLHDFRMTFVEPATIYCDNHSAIRIATNPVFHERTKHIEIDCHVVRQQVTSGHLKLLPVSSSLQLADIFTKALPSTIFQPLCNKLGMLNIHSQLEGGILTASNKKTES

SEQ ID NO: 188539 - protein, 91 aa, Glycine max
  Coding DNA Sequence Number=SeqID_71761
MEKLLKEHHHEQAANLFGMPTMGTPKNGSPTTMVKMLCQVPDDYLPEIDEVGTAWRNELCWSLSKSIVWRINSIFSLMTSWRHCYHLGGRR

SEQ ID NO: 188540 - protein, 94 aa, Glycine max
  Coding DNA Sequence Number=SeqID_71762
  Subcellular localization annotation: CTP_CleavageSite=24; ConfidenceScore=5.43e-01
MAKLSNKSPVELPSTATYPMTSVRAKSKSASSKKKKCMGVTTNIYLRKTLEKPKKKKGKIPFGAVEARPGELMLSSEGMSLPKRAEAHLNKLVA

SEQ ID NO: 188541 - protein, 421 aa, Glycine max
  Coding DNA Sequence Number=SeqID_71763
  Homolog annotation: Hit_ID=Q10L99; Match level="QueryCoverage=95%, HitCoverage=93%, E-value=2e-27, Identity=26%"; Hit description=IQ calmodulin-binding motif family protein, expressed
  Pfam annotation: Domain name=IQ; Domain location=135-155; Score=33.2; E_value=8.9e-07; Accession=PF00612.17; Description=IQ calmodulin -binding motif
  Pfam annotation: Domain name=IQ; Domain location=157-177; Score=14.3; E_value=0.44; Accession=PF00612.17; Description=IQ calmodulin-binding motif
  Pfam module annotation: Pfam domain module=IQ::IQ; Domain location =135-155::157-177
  Subcellular localization annotation: CTP_CleavageSite=57; ConfidenceScore=5.06e-01
MVKKGWFSMFKKLFLWNTHSSQEKKEKRRRAWIFGRVKTKRLPSITAPPPPPSKETRLSEAEEEHSKHALTVAIASAAAAEAAITAAQVAVEVVRLQSAAHLQLKEKQEQLQLQPVKTSHDAPQNTHQRQRKIQESSAIKIQTAYRGYLARKALRALKGIVKLQAIIRGRAVRRQALSTLKCLESIMDSNSERTWDDSILLKEEVDASCVSKKEAVLKREKVKEYSFNHRRSAESERNKINGRWRYWMEQWVDTQLSKSKELEDLDSVFSSHYSRPGEECGRRQLKLRNFQRQNQIEALDSPSLSSRNQTSGAEDHSVPSSPAIPTYMAATKSTQAKARSTSSPRARIGGNFDINSDSYSPCKNKLPIVTSINGEVLSNGRIGKLSSNQQRSPSLKGLPRPLKLSQTLRGLSINSDCPVPI

SEQ ID NO: 188542 - protein, 526 aa, Glycine max
  Coding DNA Sequence Number=SeqID_71764
  Gene Ontology: Mol. function=catalytic activity; Cellular component =intracellular; Biological process=metabolic process
  Homolog annotation: Hit_ID=Q2HU53; Match level="QueryCoverage=84%, HitCoverage=69%, E-value=1e-76, Identity=29%"; Hit description =Tetratricopeptide-like helical
  Pfam annotation: Domain name=PPR; Domain location=159-193; Score =44.5; E_value=3.6e-10; Accession=PF01535.11; Description=PPR repeat
  Pfam annotation: Domain name=PPR; Domain location=260-294; Score =43.4; E_value=7.6e-10; Accession=PF01535.11; Description=PPR repeat
  Pfam annotation: Domain name=PPR; Domain location=327-361; Score =21.3; E_value=0.0035; Accession=PF01535.11; Description=PPR repeat
  Pfam annotation: Domain name=PPR; Domain location=390-424; Score=6.2; E_value=1.4; Accession=PF01535.11; Description=PPR repeat
  Pfam annotation: Domain name=PPR; Domain location=426-460; Score=0.4; E_value=6.7; Accession=PF01535.11; Description=PPR repeat
  Pfam module annotation: Pfam domain module=PPR::PPR::PPR::PPR::PPR; Domain location=159-193::260-294::327-361::390-424::426-460
MIATLVRFPPNRMSLCSQKKNKKKNINENKTWKQRRLESQERRNGLSFPKPKSTPLLIHHRPHPKTKLEALEQVVKDLEASVEKGIKIDPEIYASLLETCYRFQAILHGIRVHRLIPTSLLHKNVGISSKLLRLYASCGYLDDAHDLFDQMAKRDTSAFPWNSLISGYAQVGHYDEAIALYFQMVEEGVEADLFTFPRVLKVCAGIGSVQVGEEVHRHAIRAGFAADGFILNALVDMYSKCGDIVKARKVFDKMPHRDPVSWNSMLTAYVHHGLEVQAMNIFRQMLLEGCEPDSVSISTVLTGVSSLGLGVQIHGWVISQGHEWNLSIANSLIMMYSNHGRLEKARWVFNLMPERDVVSWNSIISAHCKRREALAFFEQMEGAGVQPDKITFVSILSACAYLGLLKDGERLFALMCGKYKIKPIMEHYGCMVNLYGRAGLIKKAYSIIVDGIGTEAAGPTLWGALLYACFMHGDATIGEIAANWLFDLEPDNEHNFVLLMRIYENAGRLEDMERVRMMLVDRGLDY

SEQ ID NO: 188543 - protein, 75 aa, Glycine max
  Coding DNA Sequence Number=SeqID_71765
MPEQCSSIVKITTSLAKVPNSSTKSGEDCTTLEKEAKPIELLMGKWDHRPWRRFFRRRRSPVRPPTFYDINAPLP

SEQ ID NO: 188544 - protein, 146 aa, Glycine max
  Coding DNA Sequence Number=SeqID_71766
MSEDAPEIFDGGRTFATDDDPIYPSKVQWVSLETIKKTKRNEQVFSYFDTVVMGNTAAIAEEEPLVPGVTEDNLSDDSQASQMPIRNRDADLGFMFFRSDCVVDLLNYTTGPFTQYNTKVHHDRPGQLYGHTEMSYNKKEIRGLLN

SEQ ID NO: 188545 - protein, 300 aa, Glycine max
  Coding DNA Sequence Number=SeqID_71767
  Homolog annotation: Hit_ID=UPI00004BB5B4; Match level="QueryCoverage =53%, HitCoverage=11%, E-value=3e-07, Identity=22%"; Hit description =Trinucleotide repeat-containing 6B protein.
MFVYCHSNVFDWNDSAAEEAFQNAKSHYWAKINSLPCDISLPDPDTYINQIDWSPYIDPDLIKEIDGAFFIVPDEEQENAMKNKRTKTSLNDENPWECTDTPLSTALENNEVQGWNQGNSGDVDNTDNPWECSITCGNGGLTDNAWEGGPVKSWGWNEEKGHNNQCKDWNSGNSQDKGWGKARDSSWCQQQSNNLANFGNSSWHCKSSQQNVTPMKTGWRNRGANVSGWKQQEKAGVSRRNYGGGWTAQNKGNQWNQGNQWREGSHRHTLGYNGSQFQRDGCQTGHYWGKERSKKRDFFP

SEQ ID NO: 188546 - protein, 115 aa, Glycine max
  Coding DNA Sequence Number=SeqID_71768
  Homolog annotation: Hit_ID=Q1SYS1; Match level="QueryCoverage=47%, HitCoverage=17%, E-value=1e-09, Identity=54%"; Hit description=SDL-1 protein
MKHRRDLRGERGLKVELPIVVIRKRRRSGAAKIDAVGMMGVRIMGGEMGKGRRLHAGEVVTPGGWSGGEGSLKSVELVVGDRHGGGCGGWRTQHGCGRRRQQQTVTGEEGGCQLS

SEQ ID NO: 188547 - protein, 262 aa, Glycine max
  Coding DNA Sequence Number=SeqID_71769
  Homolog annotation: Hit_ID=Q9FKM4; Match level="QueryCoverage=28%, HitCoverage=12%, E-value=4e-14, Identity=64%"; Hit description =Arabidopsis thaliana genomic DNA, chromosome 5, P1 clone:MUA2
  Subcellular localization annotation: CTP_CleavageSite=52; ConfidenceScore=5.37e-01
MCFKYHNSFCYSTNSDTPTKNSVTPAFSQPPKPIPERTHTKQNKTIKRGLASAGELRSHTDLVTSGPATRNDDAEVRTMMGLGGWGHGGNGTHNNEGAVDNDIPTSANKGAHASTIGFNGFFAIPMNKPPKSFFKPDSTPTQTGLSQTCSKSSSMCNHISIFISSAMGSASRSQHSPPPPPPYRSQRTELLWREIDVAARRDLNTHSLVDDVDAREHIHGVVVIGDGDAEHVDVAHAVVDLHTDNDMSLHAARGSSPMDFGA

SEQ ID NO: 188548 - protein, 255 aa, Glycine max
  Coding DNA Sequence Number=SeqID_71770
  Homolog annotation: Hit_ID=Q9FHN0; Match level="QueryCoverage=47%, HitCoverage=15%, E-value=1e-15, Identity=37%"; Hit description =Similarity to endopeptidase
MLLQTQFLSCWVQHLSPGQTQGRLFLRINIKSEKASSDDSGPSKTGVGFGSSDTAAVPVSSKKKKKAQRERASIIRRSPLEKPAFVSEQQVGKAKEENKNESAFLLAWLGFGVVILVEGIALAASGSRRRTQNMTAYTIIPDHSIHSTAQGMAQVLHAVLRVPYAHTRSTFREFRRYFLKRRIIGVMEESRVQVRDFEKFQVEERMKVIKEILNLLEGLEMDRLLDSPKQGANPMVSGKLELIKAKITVHDNDSY

SEQ ID NO: 188549 - protein, 251 aa, Glycine max
  Coding DNA Sequence Number=SeqID_71771
MGTISLNKKNLRAEGIYTRSRVDESEANIIIDILNVYGAASGQLINFQKSKIIFSSNTNYLQRQYLSSPLGVTESIGTSYVEFDQYALELGDSKFDTKHVWVNPRSWTRLQPKSSGFDRLDSRNNFRSLSYELCTEAVKYVGVGIRPGESQLGQLAQARKFFLGESYRLQRCPIAQKYMFFSVLLPQTLTQHRKPPPPLPMTTGDRHKLSLLAIEPPQGEEHFNQRGIFIIQLKDSAENIALNPSFVVSSR

SEQ ID NO: 188550 - protein, 186 aa, Glycine max
  Coding DNA Sequence Number=SeqID_71772
  Homolog annotation: Hit_ID=O04421; Match level="QueryCoverage=33%, HitCoverage=52%, E-value=7e-20, Identity=74%"; Hit description =Signal recognition particle 14 kDa protein
  Pfam annotation: Domain name=SRP14; Domain location=1-64; Score=78.2; E_value=2.6e-20; Accession=PF02290.6; Description=Signal recognition particle 14kD protein
MFERSTKLGSVWVTLKRSSLKSKVQRNKLAAAGEAIEFRCLIRATDGKKTISTSVDDKDHQHWLSRGKWLEFYDFYHYAEYNADTAFHHLICGLLGWDVTKSRILFQHCGAGFENLAWGIATGGEKGSKAYLLLAAQFDAEVLCRKGWDILLQGGIRASPGAAVKLCLGDLLVMGSNPETASLHMQ

SEQ ID NO: 188551 - protein, 82 aa, Glycine max
  Coding DNA Sequence Number=SeqID_71773
MEMERNLLELIEWYGMSALNMEVDPKPRLLTLSMFGRKGNEPLSEEIKNKNKNYSIVSETNEQSKARKIEARPNMRRELPQS

SEQ ID NO: 188552 - protein, 302 aa, Glycine max
  Coding DNA Sequence Number=SeqID_71774
  Gene Ontology: Mol. function=protein dimerization activity; Biological process=electron transport
  Homolog annotation: Hit_ID=Q1S735; Match level="QueryCoverage=88%, HitCoverage=53%, E-value=1e-67, Identity=47%"; Hit description =Probable transposase [imported]-Arabidopsis thaliana-related
  Pfam annotation: Domain name=DUF659; Domain location=160-269; Score= -7.8; E_value=9.8e-07; Accession=PF04937.6; Description=Protein of unknown function (DUF 659)
  Pfam annotation: Domain name=zf-C2HC_plant; Domain location=1-29; Score=13.4; E_value=0.001; Accession=PF07567.3; Description=Protein of unknown function, DUF1544
  Pfam module annotation: Pfam domain module=DUF659::zf-C2HC_plant; Domain location=160-269::1-29
GGGINRFKAHLAGQKGQVETCKKVPADVQHEMKQLLRQIEKNKKRKVQQEQSNKSDTFEMDEDPMGIVKELRGTPKPISSKSQKGKNTPYVDDYFIPITTPGAQPSLKSVLQNKQIIEKCDKAIAKWMIDAPVSINAVNSTYYQPMIDAISSMSPGYKAPNFYRICGPLLNMWVDEVRKLVEGYKEVWKETGCTLMVDGSIDASYASKSTEMFFKLYKEMVLYVGAKNVVHIVTDNAANYVVVGRDKRKVEPYLEVLDRHCDSQLCKDLYAAGYWLNPACRLNAKEFKKHWNTQSGILELIG

SEQ ID NO: 188553 - protein, 99 aa, Glycine max
  Coding DNA Sequence Number=SeqID_71775
MALRTLDLLQPAPYDLLDVFMCNAFVAELWGFKCVVSLAKELHFKMDSLSAIRMVLISVTFLQVGMDLHARIGSYFSSPKSGISPVNASMLIWLDMIYI

SEQ ID NO: 188554 - protein, 57 aa, Glycine max
  Coding DNA Sequence Number=SeqID_71776
  Gene Ontology: Mol. function=nucleic acid binding
  Homolog annotation: Hit_ID=Q2VCH8; Match level="QueryCoverage=89%, HitCoverage=23%, E-value=1e-14, Identity=69%"; Hit description=RNA binding protein-like protein
MLSFQERTLEEHMKLVEKIMKHDKNRRKRIEAAGVDYECPEIVVNIQPAPKKMKFED

SEQ ID NO: 188555 - protein, 54 aa, Glycine max
  Coding DNA Sequence Number=SeqID_71777
MEDSVSFDESIFIITEEKDKHLQGLCLYLSLTRNSSNERESLNLIPTPNEEGTK

SEQ ID NO: 188556 - protein, 405 aa, Glycine max
  Coding DNA Sequence Number=SeqID_71778
  Gene Ontology: Mol. function=N-acetyltransferase activity; Biological process=metabolic process
  Homolog annotation: Hit_ID=Q42381; Match level="QueryCoverage=97%, HitCoverage=99%, E-value=1e-153, Identity=66%"; Hit description =Putative N-acetyltransferase hookless1
  Pfam annotation: Domain name=Acetyltransf_1; Domain location=61-165; Score=65.2; E_value=2.1e-16; Accession=PF00583.14; Description =Acetyltransferase (GNAT) family
MGEDLSSTLVVREFDLNKDRERVEAVERSCEVGPSGKLSLFTDMLGDPICRVRHSPAFLMLVAEIGGELVGMIRGCIKTVTCGKRLSRNGKHNNTNAKHVPVYTKVAYILGLRVSPNRRRMGIGLKLVRKMETWFRDNGTEYSYMTTEKNNLASVKLFTDKCGYSKFRNPSILVNPVFAHPARVSPKVRIISLSPSEAEVLYRHHFATTEFFPRDVDSVLNNKLNLGTFLAVPNESYKSDIWLGPDLFLSDPPHSWAMVSVWNSKEVFTFELRGASRVSRTLAKTTRVVDRALPWLRLPSMPDLFRPFGFHFMYGLGGEGPEGVKMVKALCGFAHNLAMEKGCRVLATEVSPNEPLRFGIPHWKMLSGEDLWCMKRLGEDYSDGSVGDWTKSQPGMSIFVDPREV

SEQ ID NO: 188557 - protein, 53 aa, Glycine max
  Coding DNA Sequence Number=SeqID_71779
FLQTFLKSSCEYQSPRLATSSPGLVLFLQPLPCKPTGSRKEEWGEELMKRNRA

SEQ ID NO: 188558 - protein, 140 aa, Glycine max
  Coding DNA Sequence Number=SeqID_71780
MASGNRLPRGLKWDWKIVEASSNRLPACVIDYTEEQATGNRLPVPRGSLGDPRRQYEVPISGHDSIHGDFIGASRGTRAHASAHRGVDITHAYTIPSNGASPSDREGDEDPLPEVDSPEDVMSASEADSTEDSGPGEMAI

SEQ ID NO: 188559 - protein, 448 aa, Glycine max
  Coding DNA Sequence Number=SeqID_71781
  Gene Ontology: Mol. function=racemase and epimerase activity, acting on carbohydrates and derivatives; Cellular component=cytoplasm; Biological process=carbohydrate metabolic process
  Homolog annotation: Hit_ID=Q9STI6; Match level="QueryCoverage=75%, HitCoverage=79%, E-value=1e-138, Identity=71%"; Hit description =Nucleotide sugar epimerase-like protein
  Pfam annotation: Domain name=3Beta_HSD; Domain location=73-353; Score= -79.5; E_value=3.9e-07; Accession=PF01073.9; Description=3-beta hydroxysteroid dehydrogenaseisomerase family
  Pfam annotation: Domain name=Epimerase; Domain location=72-324; Score= 210.7; E_value=3.4e-60; Accession=PF01370.11; Description=NAD dependent epimerasedehydratase family
  Pfam annotation: Domain name=NAD_binding_4; Domain location=74-300; Score=-48.2; E_value=1.6e-05; Accession=PF07993.2; Description=Male sterility protein
  Pfam annotation: Domain name=Polysacc_synt_2; Domain location=72-339; Score=-194.6; E_value=0.068; Accession=PF02719.6; Description =Polysaccharide biosynthesis protein
  Pfam annotation: Domain name=RmlD_sub_bind; Domain location=71-394; Score=-145.2; E_value=0.00016; Accession=PF04321.7; Description=RmlD substrate binding domain
  Pfam annotation: Domain name=adh_short; Domain location=70-240; Score= -59.8; E_value=0.048; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=73-353::72-324::74-300::72-339::71-394::70-240
  Subcellular localization annotation: CTP_CleavageSite=62; ConfidenceScore=5.36e-01
MVDKPMSIHRTRFPFSITKLLFWSLILLSFIVLFFLGSPPSSASPSHRRRSLRGGDWETSVRESAKSKSLRVLVTGAAGFVGTHVSIALKRRGDGVVGIDNFNRYYEASLKRARSNLLAQHKIFVVEGDINDGSLLKSLFKLGKFTHVMHLAAQAGVRYAMKNPKSYVHSNIAGLVSVLEACKNANPQPAVVWASSSSVYGLNSKVPFSEKDRTDRPASLYAASKKAGEEIAHTYNHIYGLSITGLRFFTVYGPWGRPDMAYFFFTKDILKGKQISVFEGPNGRSVARDFTYIDDIVKGCLGALDTANRSTGSGPAQLRLYNLGNTSPVAVSKLVRILEKLLKVNANKKLLPMPPNGDVFFTHADISLAKKELGYNPTIDLETGLRKFLDWYMDYYSSSSSLPKRAWLYLPMSLSGYRTLNFTTDSFHLPLFYNTSFLWKVIAALQSS

SEQ ID NO: 188560 - protein, 399 aa, Glycine max
  Coding DNA Sequence Number=SeqID_71782
  Gene Ontology: Mol. function=oxidoreductase activity; Cellular component=integral to membrane; Biological process=electron transport
  Homolog annotation: Hit_ID=Q67Y73; Match level="QueryCoverage=97%, HitCoverage=98%, E-value=1e-85, Identity=43%"; Hit description=MRNA, complete cds, clone: RAFL25-12-F01
  Pfam annotation: Domain name=DAO; Domain location=8-219; Score=-25.4; E_value=0.00025; Accession=PF01266.14; Description=FAD dependent oxidoreductase
  Pfam annotation: Domain name=FAD_binding_3; Domain location=6-356; Score=-35.9; E_value=2.4e-08; Accession=PF01494.9; Description=FAD binding domain
  Pfam module annotation: Pfam domain module=DAO::FAD_binding_3; Domain location=8-219::6-356
MDRTVDADIVIVGGGICGLATALALHRKRIKSLVLERSENLRATGAAIIVHANGWRALDQLGIGSTLRQTAIQIQGGRFISLNEAEPMEFPFGVDQELRCLKRTDLMKAMADNLPAGTIRTNCQVLSIELDPLTRSPQLLLSNGSILQAKVVIGCDGVNSAIANMFGLHRTKLLLFSTCVARGFTNFPNGHEFGSEFAMMSRDQVQLGRIPVSDKLVYWFVTRPRTSKDSTIWKDPVLIRQSLIESMKGFPEGAVEIIRNCKLSFLHLTELKYRAPWDLVFNKFRKGTVTIAGDAMHATGPFIAQGGSASIEDALVLARCLAQKKAEETAEINIAEAEEAFDQYVKERKMRNFWLSLHSFLVGKKLDTKSSIVRFIILAIMGILFRDPDWHSRYHCGVL

SEQ ID NO: 188561 - protein, 647 aa, Glycine max
  Coding DNA Sequence Number=SeqID_71783
  Gene Ontology: Mol. function=metal ion binding
  Homolog annotation: Hit_ID=Q9C810; Match level="QueryCoverage=99%, HitCoverage=90%, E-value=0.0, Identity=53%"; Hit description=PHD finger protein At1g33420
  Pfam annotation: Domain name=PHD; Domain location=550-599; Score =47.3; E_value=5.1e-11; Accession=PF00628.19; Description=PHD-finger
MTWQILFRVGDLLDAPDLSPAIVTLDIVEEDVTRSRASVYCDQCRVVGWSGHPVCRKRYHFIIRAASDAVEAYQRPCSRCGNLLQLSETRCRSCNFAITVDDLEDWVYLQIEDNTHLLHGVVHSNGYGHLLTLNGREGGSKLLSGSDIMNFWDRLCAAISVRKVSVMDLSKKFGLEYRLLHAITNGHSWYGNWGYEFGTGSYALTQDAYKNAVNTLSSMPLSSFSFHGRGPRSHLECVISLYQSLAETELLTIGHLFSFMLTLIHECRKPVAMRTSKQTSNMLCAWTGNDVEEVQHALIKVLLASGACTEAKWVTRRALKGAVCRGVSSPELLDYCLKHFPGKLTANGMIVCSRCNPISSGIEFRLEPWCNGLSTKSSYPTEVQLISDLTFLFNSIIHPDKMVCYRPKIMRKSVADSARKLLDCKQFMKDYKPYEMAVELPSVIRLWCHVELSDQPKDDPSPPPELIMLPLNATVADLRSEATSAFQEVYAMYKRFQAEELLGYGSISDSLTIRFLLGTSGSIQIQGKCPAKHGLSRFRMERGTEVWKVDCTCGAKDDDGEKMLACDTCGVWQHTRCAGIDNNTDGMPSKFVCMGCVNLYREETKKLPAPGEEANETCKFNTSCRNEAVARDCATVSCNIAVNFGVG

SEQ ID NO: 188562 - protein, 395 aa, Glycine max
  Coding DNA Sequence Number=SeqID_71784
  Gene Ontology: Mol. function=catalytic activity; Cellular component =membrane; Biological process=carbohydrate metabolic process
  Homolog annotation: Hit_ID=Q7G3M2; Match level="QueryCoverage=90%, HitCoverage=87%, E-value=3e-46, Identity=36%"; Hit description =Expressed protein
  Pfam annotation: Domain name=Glyco_hydro_17; Domain location=17-256; Score=-157.3; E_value=0.04; Accession=PF00332.9; Description =Glycosyl hydrolases family 17
  Pfam annotation: Domain name=X8; Domain location=307-392; Score =179.4; E_value=9.1e-51; Accession=PF07983.3; Description=X8 domain
  Pfam module annotation: Pfam domain module=Glyco_hydro_17::X8; Domain location=17-256::307-392
MRCLFPLLFLCSLGLTVTGQEFIKFINLCETTEDILQASSHAELPLAVSVNAGNLNEVSFSILLAEKWLRHNVLAQYPASNITTIVIGTTAFCQQGHQHNNLAVVLSSLKNVYHSLKRWGLEKAIKVSAAFNLDCLSLNSVSFNNDLKMVKPLIEFLKEVNSTYSVIPHYGFSHFSDESFSLVSSHLESMKKLGFFHLNSINVATIVPKGRKTIARKLSVVDFSPIGPFPVRPAPMPEVAKSPMTPSNVPLPPLAQVVSSPPPILSPTFAPEEPPFGVPASSPHGFTLPPCIPLHNGSPQIFPIQKLWCVAKPSVPEETLQQAMEYACGEGGADCMEITPQGNCYNPDTVVAHASYAFNSYWQKHKRSGGTCSFGGTAMLINSDPSFLHCRFILS

SEQ ID NO: 188563 - protein, 190 aa, Glycine max
  Coding DNA Sequence Number=SeqID_71785
  Gene Ontology: Mol. function=transcription factor activity; Cellular component=nucleus; Biological process=regulation of transcription, DNA-dependent
  Homolog annotation: Hit_ID=Q75UJ6; Match level="QueryCoverage=58%, HitCoverage=52%, E-value=5e-22, Identity=47%"; Hit description=DREB -like protein
  Pfam annotation: Domain name=AP2; Domain location=39-103; Score =131.3; E_value=2.8e-36; Accession=PF00847.10; Description=AP2 domain
MRKKRMMLTVLLKKQNPVGATEIQCRRQCISEKAKRKRQSAFRGVRKRSWGRYVSEIRLPGQKTRIWLGSFGSPEMAARAYDSAAFFLKGTSATLNFPDLVHSLPRPLSSSRRDIQSAAAEAALHSPPPKEEQESIFTSTTTSSFHDVMEAPLMSPLRVDSTFGDFSWDQLFDFNDDILIVGSTSATLVP

SEQ ID NO: 188564 - protein, 460 aa, Glycine max
  Coding DNA Sequence Number=SeqID_71786
  Gene Ontology: Mol. function=hydrolase activity, acting on ester bonds; Cellular component=cellular_component; Biological process =lipid metabolic process
  Homolog annotation: Hit_ID=Q9FVV1; Match level="QueryCoverage=77%, HitCoverage=95%, E-value=1e-127, Identity=60%"; Hit description =Putative GDSL-motif lipase/acylhydrolase; 82739-81282
  Pfam annotation: Domain name=Lipase_GDSL; Domain location=129-441; Score=187.2; E_value=3.9e-53; Accession=PF00657.12; Description=GDSL- like LipaseAcylhydrolase
MKIEEKTHQNSGCHKEIEVTITKSNQKREQRHTSTYLMELAWPFVVAVSEWTMINTSSITTTTRPSLYIVHNKLSIFQLQYSLLLSILILMRNRGVWEDASTATVLVLVLCSSYGIAEVKSQSQKVSGLFVFGDSLVEVGNNNFLNTIARANYFPYGIDFGRGSTGRFSNGKSLIDFIGDLLGIPSPPPFADPSTVGTRILYGVNYASASAGILDESGRHYGDRYSLSQQVLNFENTLNQYRTMMNGSALNQFLAKSIAVVVTGSNDYINNYLLPGLYGSSRNYTAQDFGNLLVNSYVRQILALHSVGLRKFFLAGIGPLGCIPSLRAAALAPTGRCVDLVNQMVGTFNEGLRSMVDQLNRNHPNAIFVYGNTYRVFGDILNNPAAFAFNVVDRACCGIGRNRGQLTCLPLQFPCTSRNQYVFWDAFHPTESATYVFAWRVVNGAPDDSYPINMQQMATI

SEQ ID NO: 188565 - protein, 142 aa, Glycine max
  Coding DNA Sequence Number=SeqID_71787
MGTRRTTSASQENNRYCPSHGRGAHWREGSESCLVSLAECHGRVWWLKNSSLSSSYFPLVFSPGPKTSRISSENTFESCQHACTVMGHVNIVSVRCGLKMLIMAKDMVLAFCCSVLLCSTSSGQDEFFGVSSEHQFPAGSLP

SEQ ID NO: 188566 - protein, 889 aa, Glycine max
  Coding DNA Sequence Number=SeqID_71788
  Gene Ontology: Mol. function=actin binding; Cellular component =phragmoplast; Biological process=actin cytoskeleton organization and biogenesis
  Homolog annotation: Hit_ID=Q1S7L8; Match level="QueryCoverage=98%, HitCoverage=98%, E-value=0.0, Identity=63%"; Hit description=Actin -binding FH2
  Pfam annotation: Domain name=Extensin_2; Domain location=10-418; Score=-117.6; E_value=0.01; Accession=PF04554.4; Description =Extensin-like region
  Pfam annotation: Domain name=FH2; Domain location=442-838; Score =549.3; E_value=3.9e-162; Accession=PF02181.13; Description=Formin Homology 2 Domain
  Pfam module annotation: Pfam domain module=Extensin_2::FH2; Domain location=10-418::442-838
  Subcellular localization annotation: CTP_CleavageSite=35; ConfidenceScore=5.31e-01
MKALHLSFYFYIIVFTLSLFLSFQVNTVKGVNNTSANESGNRRILHQPLFPASSAPPPAGTASPPPPPAVITPPSPDGGNIPFFHEYPADQNQQAAPSSTVNSSIANPTATQPTKGTKKVAIAISVGIVTLGMLSALAFFLYKHRAKHPVETQKFVAAGSGNNNNNNPPNRNSNSNEDANTTSAPSSFLYIGTVEPTVSRDANKPNRSPYHKLKRSDRYRPSPELQPMPPLTKPPGGNYPPALSSSPESDEESRETAFHSPQNSSIDGYYTPASRHSSLVNGSPAKRETNSTPAPVVPFSKRTSPNSRVSAPSPEIRHVIIPSIKQPPPPSPPPPKHSLKPEFSAPPPPPNLKRLQSTTTTTDTALHVSRTSLNPPPPPPPPPPPPPPPLQQKSVSPAVSASSNSASVKRQSWSPVQCSVTKGSDGVEQSQSVSSSERHEANDTDGAKPKLKALHWDKVRATSDRATVWDQIKSSSFQLNEDMMESLFGCKATNFTPKEPPRKKSVLPSVDQENRVLDPKKSQNIAILLRALNVTRDEVSEALLDGNPEGLGTELLETLVKMAPTKEEEIKLKNYDGDLSKLGAAERFLKAVLDIPFAFKRVEAMLYRANFDAEVNYLRKSFQTMEAASEEIKNSRLFLKLLEAVLRTGNRMNVGTNRGDAKAFKLDTLLKLVDIKGTDGKTTLLHFVVQEIIRSEGAGAESANDNVKMDSKFNEDEFKKQGLRVVAGLSRDLSDVKKAAGMDSDVLSSYLSKLETGLDKVRLVLQYEKPDMQGNFFNSTKLFLKYAEDEIVRIKADERKALYLVKEVTEYFHGNATKEEAHPLRIFMIVRDFLNILDLVCKEVEKMHDRIVGGSGRSFRIPPNASLPVLNRYNHPKQDRSSDEESSSP

SEQ ID NO: 188567 - protein, 42 aa, Glycine max
  Coding DNA Sequence Number=SeqID_71789
MEDTLNVMLVRTCRRSRRDGRVMHGVATSSSSFCFVPLALGD

SEQ ID NO: 188568 - protein, 149 aa, Glycine max
  Coding DNA Sequence Number=SeqID_71790
  Gene Ontology: Mol. function=RNA-directed DNA polymerase activity; Biological process=RNA-dependent DNA replication
  Homolog annotation: Hit_ID=Q1SFJ7; Match level="QueryCoverage=72%, HitCoverage=12%, E-value=6e-24, Identity=48%"; Hit description=RNA -directed DNA polymerase
MAMTGVSTYSRGKLRQFLGSAGTTLPSEKLKQKETIPLELTFELEFYVNAVLPKSVSSFIALIPKTDHPQSLSEYGPISLIGSINKIMSKLLANRLKKALSSIISPTPGRQIMDGVLITNELVDWGKRFNRKFLIFKDDFQKAYGSVSL

SEQ ID NO: 188569 - protein, 818 aa, Glycine max
  Coding DNA Sequence Number=SeqID_71791
  Gene Ontology: Mol. function=nucleic acid binding; Cellular component= nucleus; Biological process=negative regulation of transcription
  Homolog annotation: Hit_ID=Q9M378; Match level="QueryCoverage=94%, HitCoverage=38%, E-value=0.0, Identity=72%"; Hit description=TATA box binding protein (TBP) associated factor (TAF)-like protein
  Pfam annotation: Domain name=DEAD; Domain location=223-394; Score= -38.6; E_value=0.01; Accession=PF00270.19; Description=DEADDEAH box helicase
  Pfam annotation: Domain name=HEAT; Domain location=138-174; Score =18.8; E_value=0.02; Accession=PF02985.12; Description=HEAT repeat
  Pfam annotation: Domain name=HEAT; Domain location=59-94; Score=29.2; E_value=1.5e-05; Accession=PF02985.12; Description=HEAT repeat
  Pfam annotation: Domain name=Helicase_C; Domain location=622-700; Score=73.7; E_value=5.7e-19; Accession=PF00271.21; Description =Helicase conserved C-terminal domain
  Pfam annotation: Domain name=ResIII; Domain location=219-388; Score= -30.2; E_value=0.016; Accession=PF04851.6; Description=Type III restriction enzyme, res subunit
  Pfam annotation: Domain name=SNF2_N; Domain location=225-537; Score =363.7; E_value=2.9e-106; Accession=PF00176.13; Description=SNF2 family N-terminal domain
  Pfam module annotation: Pfam domain module=DEAD::HEAT::HEAT::Helicase_ C::ResIII::SNF2_N; Domain location=223-394::138-174::59-94::622 -700::219-388::225-537
MDFLLTFLKPSLSVEYESTLENFGGAHDCLDTSEPEHRGDRQANVVRSVAPILNEELKPKLLTLLPCIFKCIQHSHVAVRLAASRCITSMAQSMTVKVMGAVVENAIPMLEDASSVYARQGAGMLISFLVQGLGVELVPYAPLLVVPLLRCMSDCDQSVRQSVTHSFASLVPLLPLARGLPQPIGLGEGVSRNAEDLQFLEQLLDNSHIEDYKLCTELKVTLRRYQQEGINWLAFLKRFKLHGILCDDMGLGKTLQASAIVASDIAEHRTSIGNEDLLPSLIICPSTLVGHWAFEIEKYIDVSVISSLQYVGSAQERMLLRDHFCKHNVIITSYDVVRKDIDFLGQLLWNHCILDEGHIIKNAKSKVTLAIKQLKAQHRLILSGTPIQNNIMDLWSLFDFLMPGFLGTERQFQATYGKPLLAARDPKCSARDAEAGALAMEALHKQVMPFLLRRTKDEVLSDLPEKIIQDRYCDLSPVQLKLYEQYSGSRVKQEISSVVTSNESAAAEGSSSSTKASSHVFQALQYLLKLCSHPLLVIGEKIPESLSTILSELFPAGSDVISELHKLYHSPKLVALHEILEECGIGVDNSGSEGAVNVGQHRVLIFAQHKAFLDIIERDLFQTHMKSVTYLRLDGSVEPGKRFEIVKAFNSDPTIDVLLLTTHVGGLGLNLTSADTLVFVEHDWNPMRDLQAMDRAHRLGQKKVVNVHRLIMRGTLEEKVMSLQRFKVSVANAVINSENASMKTMNTDQLLDLFASAETSKKGASVLKSSENNSYGDAKLVGCRKGLKSILGGLEELWDQSQYTEEYNLRQFLARLND

SEQ ID NO: 188570 - protein, 241 aa, Glycine max
  Coding DNA Sequence Number=SeqID_71792
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=Q9FIJ7; Match level="QueryCoverage=72%, HitCoverage=61%, E-value=1e-64, Identity=69%"; Hit description =Probable adenylate kinase 2, chloroplast precursor
  Pfam annotation: Domain name=ADK; Domain location=70-238; Score =211.5; E_value=1.9e-60; Accession=PF00406.12; Description=Adenylate kinase
  Pfam annotation: Domain name=ADK_lid; Domain location=189-220; Score =10.7; E_value=0.027; Accession=PF05191.4; Description=Adenylate kinase, active site lid
  Pfam annotation: Domain name=Thymidylate_kin; Domain location=70-226; Score=-52.7; E_value=0.098; Accession=PF02223.8; Description =Thymidylate kinase
  Pfam module annotation: Pfam domain module=ADK::ADK_lid::Thymidylate _kin; Domain location=70-238::189-220::70-226
  Subcellular localization annotation: CTP_CleavageSite=39; ConfidenceScore=5.71e-01
MVVLGTTSPSISCLPSSTQTDYKARRYCSFPQRPRPRPRASRFFCGSPFAPNAIHSPSLSVTNEALNVMISGAPASGKGTQCHLITNKYGLVHIAAGDLLRAEIATGSDNGKRAKQYMEKGQLVPDEIVVMMVKERLLKPDSKENGWLLDGYPRSLSQATALEALGFRPHIFLLLEVSEDVLVERVVGRRLDPVTGKIYHLKYSPPETQEIAARLTQRFDDTEEKAFINISLYETTIPSFH

SEQ ID NO: 188571 - protein, 214 aa, Glycine max
  Coding DNA Sequence Number=SeqID_71793
  Gene Ontology: Mol. function=protein serine/threonine kinase activity; Cellular component=cytoplasm; Biological process=protein amino acid phosphorylation
  Homolog annotation: Hit_ID=Q39183; Match level="QueryCoverage=94%, HitCoverage=35%, E-value=2e-68, Identity=62%"; Hit description =Serine/threonine protein kinase (AT5g47750/MCA23_7) (Protein kinase (EC 2.7.1.37) 5)
  Pfam annotation: Domain name=Pkinase; Domain location=1-214; Score= -63.7; E_value=9.1e-05; Accession=PF00069.15; Description=Protein kinase domain
MGGPVAFFIFLFNLSSKRFYVAEVLLAQEYLHMLGVVYRDLKPENILVREDGHIMLTDFNLSLRCWVNPIVVKSSSTSVDPTKTSSSCSQANCMHPFCLQPNWHVSCTPILLPSGAKSQKIKAEISGQVGPLPQLIVEPTNARSNSFVGTYEYLAPEIIKGEGHGSSVDWWTFGILLFELLYGITPFKGSTNEDTLANVVSQSLKFPDTPIVSF

SEQ ID NO: 188572 - protein, 332 aa, Glycine max
  Coding DNA Sequence Number=SeqID_71794
  Gene Ontology: Cellular component=nucleus; Biological process =regulation of progression through cell cycle
  Homolog annotation: Hit_ID=Q1S7L6; Match level="QueryCoverage=94%, HitCoverage=95%, E-value=7e-98, Identity=57%"; Hit description =Cyclin, N-terminal
  Pfam annotation: Domain name=Cyclin_N; Domain location=51-184; Score =95.4; E_value=1.7e-25; Accession=PF00134.13; Description=Cyclin, N -terminal domain
MGSSGSGTLFSLSSLLCDEEGEARLFKDQDENPGIFYSLDNSCFVLEDEEEYIEYLFKQETGFRSQNHHFFTSDDHSNRHWLRSARVDAIDWILNTQAKFGFKVETAYLSVTYFDRFLSKRSIDESKPWAIKLLSVASLSLAAKMEEQNVPVLSEYPMDDYRFENKVIKNMELMILSTLDWKMGSATPFSYLHYFVGKFCPGSKPQIIITKATEHIVAMVKDVNLMDQRPSLIASAAILAAFDATLTRKAMDLRLSLISSWGNVESGHVFFCYNLIQEKMKSKVKTPCSNLMSAQSSSTCVLENQSDTSSGAKRKLSFEDSENCAGQKLHRP

SEQ ID NO: 188573 - protein, 260 aa, Glycine max
  Coding DNA Sequence Number=SeqID_71795
  Gene Ontology: Mol. function=transcription cofactor activity; Cellular component=nucleus; Biological process=regulation of transcription, DNA-dependent
  Homolog annotation: Hit_ID=Q1S7L7; Match level="QueryCoverage=90%, HitCoverage=63%, E-value=2e-88, Identity=68%"; Hit description=Zinc finger, TAZ-type; BTB/POZ
  Pfam annotation: Domain name=BTB; Domain location=65-171; Score=42.5; E_value=1.5e-09; Accession=PF00651.21; Description=BTBPOZ domain
  Subcellular localization annotation: CTP_CleavageSite=27; ConfidenceScore=5.49e-01
MTSMGENCFKPLQNTKKITPMPPPMPRFAATSCPCKCLVSKNSTPPRGRNNNVSPAAIEFWERLFYQGYKADVCINTDNGGVVYAHSNILAMSTPVFRGMLKQANCHRRWRTISITGVPHDAVQVFIRFLYTSSYEKEEMDEFVLPLLVLSHVYVVPHLKRECEQKLELSLLTIDNVVDVFQLALLCDAPRLSLICHRKVLKNFKVVSETEGWKTMKLSHPALEKEIVESMVDEDICLDTRELKMDFVRGKDNHVKEIHT

SEQ ID NO: 188574 - protein, 118 aa, Glycine max
  Coding DNA Sequence Number=SeqID_71796
MTISRFQERKRKKFTRPLLLGFKSYFWQMQLPLFLVIISMLLNEIFCKDPKLTYAFMDWDLETQRNIRTLRRWHDIGHGGRCGISRQNRCRIIDNTGNEITQSDAVEHIFLGQHGQQK

SEQ ID NO: 188575 - protein, 225 aa, Glycine max
  Coding DNA Sequence Number=SeqID_71797
  Homolog annotation: Hit_ID=Q10GR2; Match level="QueryCoverage=46%, HitCoverage=9%, E-value=2e-09, Identity=35%"; Hit description=HEAT repeat family protein
  Pfam annotation: Domain name=HlyC; Domain location=106-221; Score= -102.9; E_value=0.09; Accession=PF02794.7; Description=RTX toxin acyltransferase family
  Subcellular localization annotation: CTP_CleavageSite=45; ConfidenceScore=5.50e-01
MEKRLRSSLQSSAQEFISLATKQNLKSSKSSLKTLVHSIRLSSPLCSSLPPTLSDSISASLQSFQNLLEPNSAANLGSPRTPPSKRPRRSSRRSEPQPEPADEKHNILARLEILGHIALLCVSHPRKPFSLYDLLPGVQALHDNLIVFESEPSLSSAIEGLCEEWWKENLAGRESLISQSLPFLLSRSLTLKKKVDVHRVCVLREAFALFDFDDESIEDLKLLLV

SEQ ID NO: 188576 - protein, 420 aa, Glycine max
  Coding DNA Sequence Number=SeqID_71798
  Gene Ontology: Mol. function=metal ion binding; Cellular component =endoplasmic reticulum; Biological process=lipid catabolic process
  Homolog annotation: Hit_ID=Q8W5R2; Match level="QueryCoverage=96%, HitCoverage=43%, E-value=0.0, Identity=77%"; Hit description=Shoot gravitropism 2
MAEGEELRPDLLKNTPSNIARLEDVIEHSKARQKYLAHTSSSSDGGDVRWYFCKISLAPNELAASVPPTEIVGKSDYFRFGMRDSLAIEASFLQREEELLSSWWREYAECSEGPRERQSSSSKADTESFMGHTQSSQLYEIEEERVGVPVKGGLYEVDLVKRHCFPVYWNGENRRVLRGHWFARKGGLDWLPLREDVAEQLEIAYRSQVWHRRTFQPSGLFAARVDLQGSTQGLHALFMGEDDTWEAWLNFDASGFSSFVSFAGNGIKLRRGYSPSNSPKPTQDELRQQKEEDMDDYCSQVPVRHLVFMVHGIGQRLEKSNLVDDVGNFRHITASLAEQHLTPHQRGTQRVLFIPCQWRRGLKLSGETAVEKITLDGVRGLRVTLSATVHDVLYYMSPIYCQDIINSVGWISTEQKRDVM

SEQ ID NO: 188577 - protein, 483 aa, Glycine max
  Coding DNA Sequence Number=SeqID_71799
  Gene Ontology: Mol. function=nucleic acid binding; Cellular component= nucleus; Biological process=negative regulation of transcription
  Homolog annotation: Hit_ID=Q9M378; Match level="QueryCoverage=95%, HitCoverage=22%, E-value=1e-123, Identity=54%"; Hit description=TATA box binding protein (TBP) associated factor (TAF)-like protein
MNKVLEFGALLASGGQEYDIGNDNIKNPKERLVRQKQNLRRRLGLDVCEQFVDISDVIRDEDLMASKSDSHLNGIDRRLFTSCSAHNIQKMVSNMVPSVKSKWPSARELNLLKRKAKINSKDQTKSWCEDGSTEASGAQNLTSKGTCPDSVNYSKAFVGVNHDEDGLEHDGDGQWPFHTFVEQLIIDMFDPVWEVRHGSVMALREILAHQGASAGVFKPDSRMGGTLFIELEDKSIPNILKREREIGLNMQVSTDEFVSNLKRPKLEDVSSSTSMDSVMTCNNEADIEISISSETHGFNLALDYGNRQFNGNSVDMDCSDGLHDACKEPANIAEQNGYSDDNKVPSENLSVLRNLPQNCELMHSVKVVRSSWLRNCEFLQDCVLRFLCVLSLDRFGDYVSDQVVAPVRETCAQALGAAFKYMHPALVNETLNILLKMQARMGDSTWQSSWYQIFGCRTAGSSARPFGLLLLLAATVLFPALMH

SEQ ID NO: 188578 - protein, 233 aa, Glycine max
  Coding DNA Sequence Number=SeqID_71800
  Homolog annotation: Hit_ID=Q9M378; Match level="QueryCoverage=58%, HitCoverage=7%, E-value=4e-39, Identity=61%"; Hit description=TATA box binding protein (TBP) associated factor (TAF)-like protein
  Pfam annotation: Domain name=HEAT; Domain location=129-165; Score =18.5; E_value=0.025; Accession=PF02985.12; Description=HEAT repeat
MAAYIYPAQCPDLNKREPRALAHLMSYFMIQLKAKANILNNEIDLVQSGHQFCNKFFEVAESQYWHRYTIILHFSLEVIQRIDGVMNLLAEIYSQEDMAPKMYKVFKLAENEMENGVGGCGDVDGEENPYVLSTLAPRLWPFMRHSITSVRYSAIRTLERLLEAGYKRSMSELSSVSFWPSFIFGDTLRIVFQNLLLETNEDILRCSERVWSLLVQRPKEDLCLVVSHSVSSM

SEQ ID NO: 188579 - protein, 84 aa, Glycine max
  Coding DNA Sequence Number=SeqID_71801
MPTSSKAYLSHLVCVMGVGSGLWLLFGGALLMVVFGSKFNNPGRVKMDCEELDTPREKHVTIEIERKRQTDREFGLAPLFYTEK

SEQ ID NO: 188580 - protein, 631 aa, Glycine max
  Coding DNA Sequence Number=SeqID_71802
  Gene Ontology: Mol. function=binding; Cellular component=nucleus; Biological process=inner cell mass cell proliferation
  Homolog annotation: Hit_ID=Q10GR2; Match level="QueryCoverage=98%, HitCoverage=51%, E-value=1e-146, Identity=45%"; Hit description=HEAT repeat family protein
  Pfam annotation: Domain name=HEAT; Domain location=129-160; Score =11.9; E_value=1.5; Accession=PF02985.12; Description=HEAT repeat
  Pfam annotation: Domain name=HEAT; Domain location=206-242; Score =16.7; E_value=0.086; Accession=PF02985.12; Description=HEAT repeat
  Pfam annotation: Domain name=HEAT; Domain location=82-114; Score=4.2; E_value=13; Accession=PF02985.12; Description=HEAT repeat
  Pfam module annotation: Pfam domain module=HEAT::HEAT::HEAT; Domain location=129-160::206-242::82-114
MIRSQIPFGRKSMLEAYGDILFRAWRAAQGESRTEIENGFLQEMIEAAIHAGSGAFASYIRRVLEAFINQRTTDGVEKMLYRLAEPVIFRSLQVANSNVRQNALHLLLDMFPLEDPDATKEEKDTLLDKQFFLLERLLTDDCPEVRTIAVEGSCRVLHLFWEVIPSPIITKMITKIVDDISHDGCNEVRLSMLNGIIYLLGNPHSHEILKVLLPRLRHLMLDKVLAIRVAAVDLLLHLKDVRDFQFNKVVELDVLLSALASDQPPVAQKITKLLLPSYFPSKVPIEEACNRCVTLVKRAPMAGARFCQFAILEGASKSHLMELVKVFLSLILSPDKLDANQIEGFLVATSYVCDSLACEPCYINALKELLDGEKMKGLLTLASKGQAQSSLFNIVSNVRPDDVAGILEECMSVVTNCSGLPEDVDRQTEIRSAHKLLLSLGGFDDLIEALTAFLHKAAYRCHIKFGVDMPSHSVSFAKRKKSKSSGKFSIKSKIINRKQSFEDDYLVAVGVTWQVRDLLLQEDTRKAILESPSLEMLFVSLKVISEVSIVHCGHHEYIDICPVLAYVAFALQMTVDNVGRSSIHNSDTKRKKTKIDSSTLLSEAKYLGADNRACAQLFRKTIWSWWHHEKS

SEQ ID NO: 188581 - protein, 109 aa, Glycine max
  Coding DNA Sequence Number=SeqID_71803
MSLPRFLNRVLIAEQVIAPFLGSLAPPTSLNGISWKETKRGRKCSIINVSNQSCIRTRKDIFKIKKHKKPKRSPMTRYLMAPLKGHERHQRGKDESFGSLRAVFSFKEK

SEQ ID NO: 188582 - protein, 243 aa, Glycine max
  Coding DNA Sequence Number=SeqID_71804
MSCKILNEEVDSHASQQDKNSMEGKTTNDEAKLARETTIEKVIEEEVDPSTKREKHKENSVTNVDCEDNFLDNPITNLIKKEVEVGDATEPHSFQDSNIHKKDCYDETKITLGPKFDHEGGWNINDIGIMEFQLAGSAMELRQKEYIESVMVIKVIWNPPLSLPPSKPPDLNLHAGAVSGSFLVKLQGVQLSSSNQRKLEKVSTCNSNFQIPTLWTRLTFRRGVLLGYKEKGELVNIVRLLMS

SEQ ID NO: 188583 - protein, 287 aa, Glycine max
  Coding DNA Sequence Number=SeqID_71805
  Gene Ontology: Mol. function=transferase activity, transferring hexosyl groups; Cellular component=intracellular; Biological process= metabolic process
  Homolog annotation: Hit_ID=Q1SQR9; Match level="QueryCoverage=76%, HitCoverage=63%, E-value=3e-58, Identity=36%"; Hit description =Tetratricopeptide-like helical
  Pfam annotation: Domain name=PPR; Domain location=149-183; Score =44.5; E_value=3.5e-10; Accession=PF01535.11; Description=PPR repeat
  Pfam annotation: Domain name=PPR; Domain location=184-218; Score =43.3; E_value=8.4e-10; Accession=PF01535.11; Description=PPR repeat
  Pfam annotation: Domain name=PPR; Domain location=28-62; Score=12.0; E_value=0.28; Accession=PF01535.11; Description=PPR repeat
  Pfam annotation: Domain name=PPR; Domain location=69-103; Score=14.6; E_value=0.14; Accession=PF01535.11; Description=PPR repeat
  Pfam module annotation: Pfam domain module=PPR::PPR::PPR::PPR; Domain location=149-183::184-218::28-62::69-103
MIIECLCSGGKVLEAEAYFNSLEDTNIEIYSAMVNGFCEADLVKTSYEVFLKLSNQGDMAKEASCFKLLNKLCMTAALCQAGDMKNARTLFDVFVNRGFTPDVDELLAGSLKAYLHKRFSPHGKGKTTSLYVSTILRDMEQMEINPDVVCYTVLIDGLMKTDNFQQAVSLFDKMIESGLEPDTVTYIALVSGLCNRGHMEKAVTLLNEMSSKGMIPDATHQCRNQKKKKNKKMNMLRIGHYDNGIFSIWDLRPKQNRNCFSMESESIKTTSNETCRELKTEKCITNG

SEQ ID NO: 188584 - protein, 123 aa, Glycine max
  Coding DNA Sequence Number=SeqID_71806
  Gene Ontology: Mol. function=protein binding; Cellular component =integral to membrane; Biological process=intracellular protein transport
  Homolog annotation: Hit_ID=Q1T6P9; Match level="QueryCoverage=90%, HitCoverage=49%, E-value=5e-28, Identity=61%"; Hit description =Vesicle transport v-SNARE
MSCGEFEGYERQYCELSANLSKACIDNVAAPLNGELKKQKKSEIKEGIEEGEALIRKMDLDARSLQPDLKAVLLAKVREYKADLNNIKREVKKIISADLNPSSARDELLESTMTNAMMKLFEE

SEQ ID NO: 188585 - protein, 187 aa, Glycine max
  Coding DNA Sequence Number=SeqID_71807
  Homolog annotation: Hit_ID=Q1SQR9; Match level="QueryCoverage=50%, HitCoverage=12%, E-value=4e-11, Identity=47%"; Hit description =Tetratricopeptide-like helical
MAISRQPSRQYISCFKPFPLISLNMLNTVTKIILKAVHIDKRRVVLNIQTQALTLHLLHHLYRILHFPQLTQSIKHIVLGHLIEKHPGFLKLIHHLQRRGGRWWWLMRWRKRVSSWRYGDVGVDGVRETGVAEVCEEGESVGGGVVEMVWRTSKVEKEEEGVKGVLEWASAVEANGCQRVVKVGLCL

SEQ ID NO: 188586 - protein, 52 aa, Glycine max
  Coding DNA Sequence Number=SeqID_71808
MASLVTNKVESRKWSVDAIRQCYLQLLTCFRLYLIILCAACPLDIRMNSSPS

SEQ ID NO: 188587 - protein, 119 aa, Glycine max
  Coding DNA Sequence Number=SeqID_71809
  Subcellular localization annotation: CTP_CleavageSite=39; ConfidenceScore=5.12e-01
MKTKIPEYPPISNPSEQQGLTSNSRSTWTTGLSAPAGLVANDLSRLAFLVHFKLSEACALSENHALSEALSPLSELGEFGGESEKHLCAQCVISSLCKESVSSHSKRAQLAQQIFTNSG

SEQ ID NO: 188588 - protein, 90 aa, Glycine max
  Coding DNA Sequence Number=SeqID_71810
MSLATLFGKLQEHEMEFMRLYQHEENEKKRKGIALKTSSSSIHEENIKKDSNEKNLEEDDDFNLFVKRFNKFLKNKGNQKRSNFNPKRKG

SEQ ID NO: 188589 - protein, 84 aa, Glycine max
  Coding DNA Sequence Number=SeqID_71811
NKLLSKQLEILIETLGYRLYHLTRVYSRSSRVLIINNNSGGHTLATISNHKSTKSALKNLQVQVGQLAKQIADKSSNSFVANTE

SEQ ID NO: 188590 - protein, 80 aa, Glycine max
  Coding DNA Sequence Number=SeqID_71812
MDEFDLQVAWLGAQPSPFGGGGASAAQELVPEEPATATTEGEDELTLPEPFYFDAHENPKAFSCIYGPIFLESSIQCPCG

SEQ ID NO: 188591 - protein, 368 aa, Glycine max
  Coding DNA Sequence Number=SeqID_71813
  Homolog annotation: Hit_ID=Q00V78; Match level="QueryCoverage=35%, HitCoverage=65%, E-value=3e-24, Identity=46%"; Hit description =Chromosome 15 contig 1, DNA sequence
  Subcellular localization annotation: CTP_CleavageSite=34; ConfidenceScore=5.37e-01
MACAVQRRLSATQAISGSVACGQSIMSRVPVMPLASISANCSCGDSCCAWVCMSQKPGTSLRPPASSTGNVVSRGALPMAVIVPSRTVTVVGALTWPRATSTTRALTITRLLPGSGNGGADSGQSRAAANSNGGASRRMARTIGHRRRWAERGNATCCIHDPAFLALGRPQGAASRTRAPVTIGIWPCLAPGRLPCAVELLITPCHVHRPDRFRPSPPVPARAARQHHPGLHCQALFVYENWTSTRCLTVPVTEANRHLLRSGYEARNREELPVLVRWFEGVESPRANYLVVILYSAGQLAKEGSPIEADWGIVGCIYTAEPEEVPMAPITMMRNALGVEEGGSGVPLDREAYRRSVEFWENNANWRP

SEQ ID NO: 188592 - protein, 115 aa, Glycine max
  Coding DNA Sequence Number=SeqID_71814
MDVRRWMPFAWVAAGLLAASESSAAKYDAGAACGALSDVTQIRDAGVGSLQAQATSGRCTFHVEADDAAALSRQQSLLQSVSAIACGGPATTRPSQGAAGFDLQMPARCPLSSST

SEQ ID NO: 188593 - protein, 383 aa, Glycine max
  Coding DNA Sequence Number=SeqID_71815
  Gene Ontology: Mol. function=transferase activity, transferring glycosyl groups; Cellular component=cytoplasm; Biological process =metabolic process
  Homolog annotation: Hit_ID=Q8S997; Match level="QueryCoverage=82%, HitCoverage=72%, E-value=4e-43, Identity=33%"; Hit description =Glucosyltransferase-12
MEHSDTPHILAIPFPAEGHIKPMFNLAKLLSHRGHRITFVNTHHNHNRLLQFTDLPSFHTQFPDFLFASITDGIPSDDPRKGALLNYLPMLITPSARSLVAKEFRELFLRLLEKNGDRWQQPSCIIVDGLMSTIVMGVAQEFRIPVIAFRTYSATCTWVTIFMSKLAQEGAQLLRSNQGLENLLRNCDFPYPGGMRDLIVEETLAMTQASAIILNTFEQLEPSIITKLATIFPKVYSIGPIHTLCKTMITTNSNSSPHKDGRLRKEDRSCITWLDHQKAKSVLYVSFGTVVKLSHEQLMEFWHGLVNSLKPFLLVLQKDLIIQKNVPIELEIGTKERGFLWKIGLNMNGSCDRFFVEKMVRDIMENEDLMRLANDVAKKALHG

SEQ ID NO: 188594 - protein, 171 aa, Glycine max
  Coding DNA Sequence Number=SeqID_71816
MEPVKVVMRKTNNRKIPIISTESGNSRTSGSRFDVISDNGKQVFESTNYVDIEAAFNSKCRVHGGDNSGIFGCIRKQKEYGPTLASRIMQANFKGDNEKQVKVWNVFGRKNPQRGKGKELNKEGKANFKKNNTPKIKYKEQVGVVIKVTVSAKEVPVEEKKKRNYDEIFNF

SEQ ID NO: 188595 - protein, 224 aa, Glycine max
  Coding DNA Sequence Number=SeqID_71817
MGLSPKDATWERWDELSQSFHLEDKVIFPRDGNDSATNHTEATNNDNLTDEGKEEINYSRPKRNQYVSRIRNRAVEKILNGIGVGWACSIIGHVASKSHCIGGQRVMKDQLDHYVNLSWDFKLLEPFKRCIVVSCRAGEGHLHKIPRDSSVKVVYVPMALMNEVLETQINVFNDKTNFLAHNPAADQLLNHKEVSPESSRNLNPSRCVIYSEQKQFQLPEKKIP

SEQ ID NO: 188596 - protein, 294 aa, Glycine max
  Coding DNA Sequence Number=SeqID_71818
  Gene Ontology: Mol. function=sugar porter activity; Cellular component=membrane; Biological process=transport
  Homolog annotation: Hit_ID=Q329G5; Match level="QueryCoverage=100%, HitCoverage=94%, E-value=1e-126, Identity=81%"; Hit description =Putative periplasmic ribose-binding protein of ABC transport system
  Pfam annotation: Domain name=Peripla_BP_1; Domain location=26-290; Score=-18.7; E_value=1.8e-05; Accession=PF00532.11; Description =Periplasmic binding proteins and sugar b
MRFNPIITGLLAATLFSAPFVQAKELKSIGVTVGDLANPFFVQITKGAELKARQLAGDKVNVTLVSSGYDLGQQVAQIDNFIAAKVDMIILNAADSKGIAPAVKRARDAGIVVVAVDVAADGANATITSDNTQAGAMACKYISDRLKAKGNVVIINGPPVSAVQNRVEGCMNELKTHPDIKLLSYNQNAKGSREGGLEVMTGLLSANPKIDAVFAINDPTAIGADLAAKQAQRSEFFIVGVDGSPDGEEALKRKGSLFVATPAQDPQVMAAKAVEIGYDILQGKPAPDKPVLIP

SEQ ID NO: 188597 - protein, 121 aa, Glycine max
  Coding DNA Sequence Number=SeqID_71819
  Homolog annotation: Hit_ID=Q1S858; Match level="QueryCoverage=33%, HitCoverage=5%, E-value=2e-08, Identity=58%"; Hit description =Integrase, catalytic region
MGKTHEIPHHNLANFEPCLGYATKGQAVGGVPLPNRHMSNLSIHPGATKMYQDLKTMFWWSNMKIKVSELIFSLKWHLQSSFFLLHSTAIDLQEAKDYIDEEHLRPTSSTWSYVMCLGALG

SEQ ID NO: 188598 - protein, 97 aa, Glycine max
  Coding DNA Sequence Number=SeqID_71820
  Homolog annotation: Hit_ID=Q1SIQ0; Match level="QueryCoverage=44%, HitCoverage=12%, E-value=5e-07, Identity=54%"; Hit description=Zinc finger, CCHC-type
MWWVALESTIQSEGLNEDYFFVFLSNIIESVNDEIDIIHGSDDIGKFICNGFDTLKEFSDRSDDVAPCGACRPWIFLINGVLCFLKMNGSAMEKEER

SEQ ID NO: 188599 - protein, 105 aa, Glycine max
  Coding DNA Sequence Number=SeqID_71821
MTPTRDVLLYYNGRWNMSRQNEFVGYSFTGKNPKKFDIPTGCTMDELKDLIKQVAPPGIPPYGIDETQMVLTKSNYWKKIGPIEILAVFSKLVPEMEDELSLSQN

SEQ ID NO: 188600 - protein, 275 aa, Glycine max
  Coding DNA Sequence Number=SeqID_71822
  Gene Ontology: Mol. function=transferase activity, transferring hexosyl groups; Cellular component=integral to membrane; Biological process=carbohydrate biosynthetic process
  Homolog annotation: Hit_ID=Q4WBB7; Match level="QueryCoverage=97%, HitCoverage=89%, E-value=1e-44, Identity=38%"; Hit description =Glycosyl transferase family 8 domain containing protein
  Pfam annotation: Domain name=Glyco_transf_8; Domain location=4-252; Score=97.0; E_value=5.5e-26; Accession=PF01501.10; Description =Glycosyl transferase family 8
MYAWVTLLTQPEYYVGVKALHRSLKRSETRWPLIVMVTDAIDLSMREALQALGCVIHPVQPLMPDAALEQHYASAQFGEVWSKLRAWELTGCERVVFLDADMLVLRNMDELFTLDLGKHALAACHACRCNPNQIASYPESWQPEHCHYTWQARGETPPADLDNYLNGGFLVLQPDQAVFDWLQQKVAEIGDLRRYPFSEQDLLNEVFAGRWLPLPYIYNALKTLPFQHAGLWHDDEVKNLHYILAKPWKRDLNQPEAQRDRYYALDKLWWELGAD

SEQ ID NO: 188601 - protein, 194 aa, Glycine max
  Coding DNA Sequence Number=SeqID_71823
  Gene Ontology: Mol. function=binding; Cellular component=cytosol; Biological process=biosynthetic process
  Homolog annotation: Hit_ID=Q1GLR6; Match level="QueryCoverage=96%, HitCoverage=33%, E-value=8e-17, Identity=33%"; Hit description =Tetratricopeptide TPR_2 precursor
RARWKLPHASPVAASFNSSHKLSRSLLECWTQILREAPDALLLVCLAPQAHRGFLQSWDLLGGDRDRLRLLSPMPAEQYLECMASCDLFLDAFNYQAGATAIDAASAGLPLLTCPGELPLSRLGSSVNRQLGMPELICNGHHDYVQRAVTLLRNPAALSELRQRVTVRNKDSALHSAARAATDLQALYQDLLGE

SEQ ID NO: 188602 - protein, 210 aa, Glycine max
  Coding DNA Sequence Number=SeqID_71824
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q62D08; Match level="QueryCoverage=95%, HitCoverage=93%, E-value=9e-58, Identity=54%"; Hit description =Oxidoreductase, 2OG-Fe(II) oxygenase family
MVLEASQLSRYADELKTTGSTLIPMGVVFDASTLKELERLQSLLPEEAVTQGDAGDTHDIYVRRIMVDRQGEVPQVVNRPHADQILGILNREECRNAIAELFQSQDAFHIRRAQMNRMTAGSFIGLHLDAASNPDYDYSMIIQLGHDFAGGDFVVHDDAGARHAYAATYGTVLLTTCKLRHEVARVTAGERNALVYFYSRHDGANRRHDA

SEQ ID NO: 188603 - protein, 88 aa, Glycine max
  Coding DNA Sequence Number=SeqID_71825
AAGLPEFGCTLSRRGWGRGIAQEATAGVLEWMDRVARIEATSAITDLRNRSALALANAVGYSIVEEMDFEGNPFAVLTRTSSLTTLTS

SEQ ID NO: 188604 - protein, 48 aa, Glycine max
  Coding DNA Sequence Number=SeqID_71826
MASIATVVAVVVELPSYLVSEYQPNVPGISDRQTVIQCNALLVLPMIV

SEQ ID NO: 188605 - protein, 433 aa, Glycine max
  Coding DNA Sequence Number=SeqID_71827
  Pfam annotation: Domain name=Transposase_23; Domain location=62-126; Score=-7.7; E_value=0.0079; Accession=PF03017.5; Description =TNP1ENSPM transposase
MTMALKEAIKIELSHKGSLESLIIQPELQQLGARVSTKGSNAQSNAQPSREYDGDVIPKMGLYVQRKDGTLGLVAMGRIMDRDSVIRTVAYADDVVRVSVDTVIDPDAEIPYATSEIQYVKQTLHTFVAWPTDLVKLVLDEDEVIIPHKVDAHGDKPTNVEADDPMRGLIKYSFDIYNNPVEFKFDGSKFGIVDAPTSIFLTYSDVSEIIAGDKSLNISVQQLWLMYMHEWSETLGQGSNYAFLEPQSLVVSKDTHGECEKYLERWLKESDREVYIGPYFHHVMTKLKTGLSPESKAAAPKWIEVKSHIQIGFYECGYYVMHWMWNIITSDIKSDWSMWFGDETPLDKDNITTIRKKWTRYFLKTAYDMITIGTSFITEEVPGYSSLRRNLLHLAPSFLQWQITYAASIYPEFIGIILVGVMGKRNLNLGSQP

SEQ ID NO: 188606 - protein, 43 aa, Glycine max
  Coding DNA Sequence Number=SeqID_71828
MGIMGVVFVQNSTLGMGDRGKHEDLQMTIWTGMQHMTLEPFKK

SEQ ID NO: 188607 - protein, 42 aa, Glycine max
  Coding DNA Sequence Number=SeqID_71829
MDSLRRHEANLTKRLSTGNGVVAVVVRRSNGGGVAEQDWRRE

SEQ ID NO: 188608 - protein, 65 aa, Glycine max
  Coding DNA Sequence Number=SeqID_71830
  Gene Ontology: Mol. function=sequence-specific DNA binding; Cellular component=nucleus; Biological process=regulation of transcription
  Homolog annotation: Hit_ID=Q9FRP5; Match level="QueryCoverage=58%, HitCoverage=14%, E-value=3e-09, Identity=76%"; Hit description =Putative DNA-binding protein
  Pfam annotation: Domain name=WRKY; Domain location=30-62; Score=-4.7; E_value=0.0027; Accession=PF03106.6; Description=WRKY DNA -binding domain
MSSSHWVVIECCLQLRHGHRILSTTDREVTIDAATERKQVERSRIDLNMLVITYTSDHNHPWPTH

SEQ ID NO: 188609 - protein, 122 aa, Glycine max
  Coding DNA Sequence Number=SeqID_71831
  Gene Ontology: Mol. function=protein serine/threonine kinase activity; Cellular component=membrane; Biological process=protein amino acid phosphorylation
  Homolog annotation: Hit_ID=Q10SE3; Match level="QueryCoverage=60%, HitCoverage=13%, E-value=5e-15, Identity=57%"; Hit description =Protein kinase domain containing protein, expressed
MGEIKEECTSPDKRKVALYSSGESKAIASACETASSLGSIGPELSHLRWGMWYKLRELEAATNGLCEENVNGEGGYGSVYRGLFPNGTKVAGDLDLICPKEGYFFLFLFLIDFTLIHSVSSP

SEQ ID NO: 188610 - protein, 82 aa, Glycine max
  Coding DNA Sequence Number=SeqID_71832
  Subcellular localization annotation: CTP_CleavageSite=64; ConfidenceScore=5.07e-01
MARNTTDNLQYKTKNQKHRQPYLHEQLQVATPLKRARLRLRGGGGNSTRFGGRKTRQCRVPFVEVRERAQCQGGARDTVDGS

SEQ ID NO: 188611 - protein, 60 aa, Glycine max
  Coding DNA Sequence Number=SeqID_71833
SAHRPQEGHQAPINRAFIKKYYAPRQAQGETPQQPRDGQQRAISAPPPPLEFTSAHPQKG

SEQ ID NO: 188612 - protein, 196 aa, Glycine max
  Coding DNA Sequence Number=SeqID_71834
MARIMSEIEEVQEQMKANIEAMKDQITTMMKAMMSMRKIMKVNAVAVATTSVAVEVDPTHPFGINQVNRPVPDMVGQGGKALGSMGDPHLVQVPRKHPFPPYALPPNYAPPNVVHLPDENVDHSAPIPLESQQPQSGHAHVFQPMWETPKVPRDHTLADFEPHLGCASEGQAFGGVPQPNTLGGSLVSPTTLYILW

SEQ ID NO: 188613 - protein, 107 aa, Glycine max
  Coding DNA Sequence Number=SeqID_71835
VEERLRSIGKASGGTIGILEDLHMCESTSSRSYYKLHVVVVTPTYIFPNDAPITLRSYLVSPQWFFFDMFHFADLPCCCCCTMLKRHVKRIHPHVGDLHGVESTYMA

SEQ ID NO: 188614 - protein, 49 aa, Glycine max
  Coding DNA Sequence Number=SeqID_71836
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q2PMM9; Match level="QueryCoverage=98%, HitCoverage=8%, E-value=6e-19, Identity=73%"; Hit description=NADH -plastoquinone oxidoreductase subunit 5
MGEYNQLSLRISSLYQKQAKGGIPQRESVPTKKEVFVIAGEYPTRASIE

SEQ ID NO: 188615 - protein, 181 aa, Glycine max
  Coding DNA Sequence Number=SeqID_71837
  Gene Ontology: Mol. function=transferase activity; Cellular component= nucleus; Biological process=regulation of transcription
  Homolog annotation: Hit_ID=Q6Z996; Match level="QueryCoverage=87%, HitCoverage=37%, E-value=3e-36, Identity=41%"; Hit description =Putative pentatricopeptide (PPR) repeat-containing protein
  Pfam annotation: Domain name=PPR; Domain location=39-73; Score=41.2; E_value=3.4e-09; Accession=PF01535.11; Description=PPR repeat
MGFHSYLHIDNALIAMYSKCRAIDDALYIFENMVSRDVVTWNTMISGYPQHGLAQEAIILFEEMIKQGFNPHAVTYHGVLSSCRHGGLPELDDYSRIADHLGWAGLLLETRDFVENMPISPNAVIWGSLFFSSRLHGSVQFGIQAAEDKAVRLILQTHCLLLGPHQNKIPASFNDNRGATK

SEQ ID NO: 188616 - protein, 186 aa, Glycine max
  Coding DNA Sequence Number=SeqID_71838
  Gene Ontology: Cellular component=endoplasmic reticulum; Biological process=ER to Golgi vesicle-mediated transport
  Homolog annotation: Hit_ID=Q94CG2; Match level="QueryCoverage=56%, HitCoverage=79%, E-value=2e-34, Identity=68%"; Hit description=Bet1 -like SNARE 1-2
  Pfam annotation: Domain name=SNARE; Domain location=58-120; Score =46.1; E_value=1.2e-10; Accession=PF05739.9; Description=SNARE domain
MYAIICHLQSVVSSIRPILRPILDNRSSRSSLVDGFDSLEEGGLRASSSYSREINEHDNDKAIESLEDRVSFLKRLTGDIHEEVESHNQLLDRVGIKMDGSRGMMMGTMDRFKNVFEKKSARKTCSLVVMPFTLCPDMTEITIYGDKNLGPFRCLYFGRFINKVVFKKNQTIRHFFLCLSLSLNTA

SEQ ID NO: 188617 - protein, 77 aa, Glycine max
  Coding DNA Sequence Number=SeqID_71839
  Subcellular localization annotation: CTP_CleavageSite=22; ConfidenceScore=5.16e-01
MGKTRQTWNVWFFRKNLFRKVSGRTTSSITSGRSCSGNFLEEALLEEPKGHPEEPLLPETFRNNFFWKVSGRSGSSG

SEQ ID NO: 188618 - protein, 175 aa, Glycine max
  Coding DNA Sequence Number=SeqID_71840
YAQRWRDLVAQVAPPMVEREMVTMIVDTLPVFYYEKLVGYMPSCFADLVFARERIDVGLKRGKFDYVSPVGTNGSRRGLFRHSARPAKGTHASTGGAPQAPAPTQPHPANNAQAGSELHPDPNDIQGPLAISHCQPIGHGDSGNDLPVFAPEVDGPNIKTNPLSNHGGGAVNAIE

SEQ ID NO: 188619 - protein, 170 aa, Glycine max
  Coding DNA Sequence Number=SeqID_71841
MGNYISCTLAPPLMKNTRAKRVIFPTGEVKQYKEQVINAAELMLECPTHFLTNSKSLHIGRRFSPLGADEELECGNVYIFFPMRRLNSMVTAADVAVLFMAANMATKRISSREDLISRDHSIDVIGINDEVPRLSLEGLEVESGFRNRLSYCRSRKPVLETINEEPIWLK

SEQ ID NO: 188620 - protein, 58 aa, Glycine max
  Coding DNA Sequence Number=SeqID_71842
MDKYFSKMSHDIDMHEGTDINMTMDEDIRMQCLTLKNYDCSEFLAIMKFFYTQDELLK

SEQ ID NO: 188621 - protein, 100 aa, Glycine max
  Coding DNA Sequence Number=SeqID_71843
MVVAVNNHGGGCGGGHDNCGENGHDNGGSHVEVERISWRDNSLTRKRKALERLARKQPNSPVLPNLPLPSIQEEEEIIMAEEEQGNPSTTIKSTKCIKNG

SEQ ID NO: 188622 - protein, 124 aa, Glycine max
  Coding DNA Sequence Number=SeqID_71844
MVIGLLKKSYNPVSFGQPNVAPCRTCRSWIFFIAGVLCFLKINGSGMEKVERMWQWGVANKCLLSQPTLFGRATWGSRVDKSRALAPTYPPSKRKSDLRSSFKRGESSDSFYLQGGHLRCWTLK

SEQ ID NO: 188623 - protein, 197 aa, Glycine max
  Coding DNA Sequence Number=SeqID_71845
  Gene Ontology: Mol. function=DNA binding; Cellular component=nucleus; Biological process=regulation of transcription
  Homolog annotation: Hit_ID=Q2LME9; Match level="QueryCoverage=67%, HitCoverage=51%, E-value=1e-14, Identity=38%"; Hit description=MYB11
WSLIAGRLPGRTDNEIKNYWNTNIGRKLQNGGAGTTLNTLQQEDQNVKEQEWHYDKGSCLVQTKATRWTKVTVTNEISQPNEGITIKSNVGDNKMKGFLVSPSKESNNDSVLLDFMADFEMDGNFFSELLKMDLPESSCKENKILGDNGNPSTVDKVYLSPKSSCDTAHFPWGDSFYDTNFDFLPVTIFMESGFDWL

SEQ ID NO: 188624 - protein, 160 aa, Glycine max
  Coding DNA Sequence Number=SeqID_71846
MWAIIDEYKEKLNLAATHEQRLEDEYTKISAEREARERVINSLHRGAMVWMDRFAFTLNGSQELPRLLAKAKAMADVYSAPEEIHGLLNYCQHMIDLVAHIIRSRSNTITKHTPRHPYRTRSESRAMCDVEEVQEQMKANMLTLKDQMASMMEAMLGVIP

SEQ ID NO: 188625 - protein, 80 aa, Glycine max
  Coding DNA Sequence Number=SeqID_71847
  Gene Ontology: Mol. function=ATP binding; Cellular component =chloroplast
  Homolog annotation: Hit_ID=Q2PMM5; Match level="QueryCoverage=99%, HitCoverage=3%, E-value=1e-37, Identity=96%"; Hit description =Protein ycf2
MVERKNPYLTRLLTIPMNSIGPKNDTLEESSESSNINRLIVPVLYLPKGTKISESYFLDPKESTRVLPITNKYIMPESNW

SEQ ID NO: 188626 - protein, 138 aa, Glycine max
  Coding DNA Sequence Number=SeqID_71848
MASGNRLPGLKTRLQKGNWEIVEAFGNRLPVCVIDYTEEWVTGNRLPGFHVLKLCNSSWPLIVMAAQLIHDRVEMECLEGAWETLEGNTRCRFRGTIRFTTTSLVYPDEPARTLQRTVEWILPSPTPYRLVEPVQVIE

SEQ ID NO: 188627 - protein, 110 aa, Glycine max
  Coding DNA Sequence Number=SeqID_71849
  Subcellular localization annotation: CTP_CleavageSite=22; ConfidenceScore=5.45e-01
MASPPASPPPPPPPSDTLASPSAVKRTCKATCLRSLSTRPPGAERLVVHIDPATGKADGPHRKKLRTYLGVVARDKVDVTYENWKEVEFEIPEASDNRTKKKLLKTVDER

SEQ ID NO: 188628 - protein, 40 aa, Glycine max
  Coding DNA Sequence Number=SeqID_71850
MDDTVCEKYDIIKKKWAQFCQTRKDPSWEDVRKKGQAIQK

SEQ ID NO: 188629 - protein, 67 aa, Glycine max
  Coding DNA Sequence Number=SeqID_71851
GYLMVTRTFRQPGENEPVDAQRLTLSPAPFVVLTREARDSESGGRLRCLMVIRAFRQPRGTNSAVSG

SEQ ID NO: 188630 - protein, 907 aa, Glycine max
  Coding DNA Sequence Number=SeqID_71852
  Gene Ontology: Mol. function=RNA-directed DNA polymerase activity; Cellular component=chromatin; Biological process=chromatin assembly or disassembly
  Pfam annotation: Domain name=Chromo; Domain location=589-639; Score =15.9; E_value=0.013; Accession=PF00385.14; Description='chromo' (CHRromatin Organisation MOdifier
  Pfam annotation: Domain name=RnaseH; Domain location=75-196; Score= -30.8; E_value=0.043; Accession=PF00075.14; Description=RNase H
  Pfam annotation: Domain name=rve; Domain location=308-440; Score =32.2; E_value=1.8e-06; Accession=PF00665.16; Description=Integrase core domain
  Pfam annotation: Domain name=zf-H2C2; Domain location=249-290; Score =20.2; E_value=0.00075; Accession=PF09337.1; Description=His(2) -Cys(2) zinc finger
  Pfam module annotation: Pfam domain module=Chromo::RnaseH::rve::zf -H2C2; Domain location=589-639::75-196::308-440::249-290
MLQWLTPRTTKAVQIFLGLPEFYRRFIQKYATIAAPLIKATTKEPLRWTTETQEAFDTLKRALSTAPVLTLPNFDLPFTVETDASGVGMGAVLSQQGHPIAFFSRPFSPKLLCSSTCVHELFAITVAIKKWRQYPLGHQFIILTDHQSLKELLTQVIQTPEQHMYLARLLGYDYQIHYRSGVHNQAADALSRLPEQEPTFTMLLSRAAIKENPASHSDFSIANNLILHRGCIWLPKDHPMIPTLLKEYHATPTGGHVGIAKTIIRISENFYWPGLPSDVTQFIATCLDCQCTKYKTKKFAGLLCPLPVPHRPWEDLSLDFITGLPPYHDNSVILVVVDRFSKGVHLGMLSMAHTAHTMASLFVELVELFRLSGTQLKMTSAFHPQSDGQTKVLNRVVEQYLRSFVHHQPLTWGKFLAWAEYSHNTSWNSATGTTPYEVAFGRKPFSYPEYIARTSHLDVVDTILTDRDEVFQFIRRKLIKAQASMKDQANHKRRDVSYQPGDWVLLKLRPYRQSTAKGSQSFSGKLAKRFYDPFKILEHIGKVAYCLELPAEAKIRSVFHCSMLKPFRGDPIDSTFELPNYILNHQPVIVPMENLDYRRTNSPNATWEVLVQWQGLSPDDTSWENWSQLQQAYHLEDKLALTVIMKHTALSPSFQFLESLSHARDESFRVQARDYACNTKVGSAMDVDHCQQKEEEEEQEDPFLKFVDYARSKLLSLEGDRNKDDDDADGLGWSWIVSRILKTCIAYSSGVTPAILLSELSLRKILDAPSEADAGPTTAISCPHGQSMPEQAPGAKLVLIPECFWLFLTPDDPLGGPTFSSDSEECSQCSNELSEEACLEDSLSTQLIERPPKLVFKRGAIIQRESSEGCLTIVSENDWKCFCEEWGGIETKGMSATIDHVSWPWIS

SEQ ID NO: 188631 - protein, 202 aa, Glycine max
  Coding DNA Sequence Number=SeqID_71853
  Homolog annotation: Hit_ID=Q1T0F4; Match level="QueryCoverage=29%, HitCoverage=8%, E-value=6e-16, Identity=69%"; Hit description =Nucleic acid-binding, OB-fold
MLGRDERWRSRHYLQISISFDVLPHIKCSRKHKHPHAYIRGLLEFQYHRCLSTPQTTIGCKRIRNMCTEILPSHSYSLDLIINPPLQKQKQNPRAEKNQRMATMTGVSLSCPRVFFNASGSPQNAHAVKFYDLTGLQNGILKRGREIFLTGCYLRTPTGGSGHSRLLPTEYLVILLDEVMVKDFLILNLSTVKFNWANKRSE

SEQ ID NO: 188632 - protein, 150 aa, Glycine max
  Coding DNA Sequence Number=SeqID_71854
MSRSGQPQDLKNFEQMPYWQCLLQSEKLSYKDVFTKLAHSTVAHSSLRIETFQAIYLLSQRGLLKLEDRDFPSYDFPSYLSSLSERLSTWIDSLYGGSLKLEDRDFPSYLSSLSERLSTWIDSPYGGSLKLEDIDFPTYLSSLSKKLTQA

SEQ ID NO: 188633 - protein, 125 aa, Glycine max
  Coding DNA Sequence Number=SeqID_71855
  Subcellular localization annotation: CTP_CleavageSite=27; ConfidenceScore=5.44e-01
MHALLGSFNSGNWFDSKVLDSAGMSCRAFTRNQVSSSFNVAGLTPFVVSDDFEHLRENAFQEGGNDKNPKTAQIQEPMTRIRIKQSMDTLQQMVADILNKVQVEKDESPEVEALLRILIVVEGPD

SEQ ID NO: 188634 - protein, 147 aa, Glycine max
  Coding DNA Sequence Number=SeqID_71856
  Subcellular localization annotation: CTP_CleavageSite=17; ConfidenceScore=5.30e-01
SNTSRLGFPALITALCRARGVVSDSLTFECLSPARPTELPSTSAAPTPASTLAAPSVPMVAPPDSIPLVEQFNEMDESSEATILGPFDIREEAEETQVRQVVAATPERSLEANLEPSAPMVNVPSPHPAADPSTPLLEMPEDLLHQS

SEQ ID NO: 188635 - protein, 401 aa, Glycine max
  Coding DNA Sequence Number=SeqID_71857
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=97%, HitCoverage=86%, E-value=1e-133, Identity=57%"; Hit description =Serine carboxypeptidase II, putative
  Pfam annotation: Domain name=Peptidase_S10; Domain location=38-391; Score=415.1; E_value=9.6e-122; Accession=PF00450.12; Description =Serine carboxypeptidase
MTTLPHSFTMIVTLIIVLAQTLVVVNSLPEADKITNLPGQPHVKFQQYSGYITVDDQNQRALFYYFVEAEKHPTSKPVVLWLNGGPGCSSIGVGALVEHGPFKPGDNNVLVKNHYSWNKVANVLYLESPAGVGFSYSSNTSFYTLVTDEITARDNLIFLQRWFTEFPEYSKNDFFITGESYAGHYAPQLAQLIVQTKTNFNLKGVAIGNPLMEFDTDLNSKAEFFWSHGLISDSTYDLFTRVCNYSTIRRQTIQGNLSDVCAKINGLVFTEVSNYIDQYDVTLDVCLSSANQQAYVLNQMQETQKIDVCVDDKAVTYLNRKDVQKALHAKLVEVSKWSACSRVLHYDRRNLEIPTVSILGSLVNSNIRVLWRSRFSYPITGISVSGEWISQGTWTEYNSGI

SEQ ID NO: 188636 - protein, 260 aa, Glycine max
  Coding DNA Sequence Number=SeqID_71858
  Gene Ontology: Mol. function=serine carboxypeptidase activity; Cellular component=cellulose and pectin-containing cell wall; Biological process=proteolysis
  Homolog annotation: Hit_ID=Q1M2Z7; Match level="QueryCoverage=62%, HitCoverage=64%, E-value=3e-60, Identity=66%"; Hit description =Serine carboxypeptidase II
  Pfam annotation: Domain name=Peptidase_S10; Domain location=28-259; Score=91.4; E_value=2.8e-24; Accession=PF00450.12; Description =Serine carboxypeptidase
INYYSCANTYGVNSVPEADKISNLLVQPHVKFQQYSGYITVDNQNQRALFYYFVEAETDPTSKPVVLWLNGGPGCSFIGAGALVEHGPFKPGDDNVLVKNYYSWNKVANLIYLESPAGVGFSYSSNTSFYTLVTDEITARDNLVFLHHWFTEFPAYSNNDFFITGESYAGKAYKRLSMLSLLESPNGQLAAVFSDNLEIATISIIGSLVNSSIRVLGSGIQWRSRSLLGSRSLVNGLAKELGLNTTVAYKAWFEGKHVNT

SEQ ID NO: 188637 - protein, 461 aa, Glycine max
  Coding DNA Sequence Number=SeqID_71859
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=98%, HitCoverage=99%, E-value=1e-165, Identity=61%"; Hit description =Serine carboxypeptidase II, putative
  Pfam annotation: Domain name=Peptidase_S10; Domain location=38-454; Score=616.9; E_value=1.8e-182; Accession=PF00450.12; Description =Serine carboxypeptidase
MTMLPQSFTMIATLIIVLAQTLVGVSSLPEADKIINLPGQPKVKFQQYSGYVTVDDQHQRALFYYFVEAEEDPSSKPLVLWLNGGPGCSSIGTGAFTEHGPFRPSDNNLLEKNDYSWNKAANMLYLESPAGVGFSYSRNKSFYALVTDEITARDNLLFLQRWFTKFPEYSKRDFFITGESYGGHYVPQLAQLIVQTKTNFNLKGIAIGNPLLEFNTDFNSRSEYFWSHGLISDPTYEVLTRDCNFSSIRRQWQNGNLRGVCEKANKLLDSEVSYYVDEYDVTLDVCLSPVNQQAYVLNQLQETQKIDVCVGDKTTTYLNTKEVQEALHANLVGVAKWSTCSSVLHYDYQNLEVPTIPILGSLVKSSIRVLVYSGDQDSVIPLLGSRSLVNGLAKEIGLNTTVAYRPWFGEKQVAGWTQVYGDILSYATVRGASHEAPFSQPQRSLVLLKAFLEGKPLPGVV

SEQ ID NO: 188638 - protein, 794 aa, Glycine max
  Coding DNA Sequence Number=SeqID_71860
  Homolog annotation: Hit_ID=Q3R5S2; Match level="QueryCoverage=42%, HitCoverage=85%, E-value=1e-104, Identity=57%"; Hit description=TPR repeat precursor
  Pfam annotation: Domain name=Peptidase_M48; Domain location=196-369; Score=94.3; E_value=3.6e-25; Accession=PF01435.8; Description =Peptidase family M48
  Pfam annotation: Domain name=TPR_1; Domain location=590-625; Score =13.5; E_value=0.13; Accession=PF00515.18; Description=Tetratricopepti de repeat
  Pfam annotation: Domain name=TPR_1; Domain location=731-764; Score =10.8; E_value=0.28; Accession=PF00515.18; Description=Tetratricopepti de repeat
  Pfam annotation: Domain name=TPR_2; Domain location=517-550; Score =8.4; E_value=3.5; Accession=PF07719.7; Description=Tetratricopeptide repeat
  Pfam annotation: Domain name=TPR_2; Domain location=590-623; Score =18.8; E_value=0.02; Accession=PF07719.7; Description=Tetratricopeptid e repeat
  Pfam annotation: Domain name=TPR_2; Domain location=625-658; Score =0.4; E_value=30; Accession=PF07719.7; Description=Tetratricopeptide repeat
  Pfam annotation: Domain name=TPR_2; Domain location=659-692; Score =0.5; E_value=28; Accession=PF07719.7; Description=Tetratricopeptide repeat
  Pfam annotation: Domain name=TPR_2; Domain location=731-764; Score =13.5; E_value=0.79; Accession=PF07719.7; Description=Tetratricopeptid e repeat
  Pfam annotation: Domain name=TPR_4; Domain location=518-542; Score =0.9; E_value=29; Accession=PF07721.5; Description=Tetratricopeptide repeat
  Pfam annotation: Domain name=TPR_4; Domain location=555-580; Score =7.7; E_value=4.5; Accession=PF07721.5; Description=Tetratricopeptide repeat
  Pfam annotation: Domain name=TPR_4; Domain location=659-684; Score =1.8; E_value=23; Accession=PF07721.5; Description=Tetratricopeptide repeat
  Pfam annotation: Domain name=TPR_4; Domain location=731-756; Score =0.0; E_value=37; Accession=PF07721.5; Description=Tetratricopeptide repeat
  Pfam annotation: Domain name=TPR_4; Domain location=764-789; Score =23.1; E_value=0.001; Accession=PF07721.5; Description=Tetratricopepti de repeat
  Pfam module annotation: Pfam domain module=Peptidase_M48::TPR_1::TPR _1::TPR_2::TPR_2::TPR_2::TPR_2::TPR_2::TPR_4::TPR_4::TPR_4::TPR _4::TPR_4; Domain location=196-369::590-625::731-764::517-550::590 -623::625-658::659-692:...
  Pfam module annotation: Domain location=:731-764::518-542::555 -580::659-684::731-756::764-789
RYRPGPHQLGADPERDRALPVVPGAVRGGTGTGLRGAAVPPRAVCPPVEGRASVAGRAVADLWRHGCCVLLVVPAHRYALGRDRRARAEQRCGACRTCVLRGNVTPCPLDERLSRYATHCAYEHGGGSMKQLLLALVITTLVSACATTTSPTGRRQMVGGVSQAQLDQLGAQAFAETKQKEKISTDGRQNGYVQCVVNALVAQLPPQYRGVRWETAVFVDKEPNAFALPGGKVGVNTGIFTVAKNQDQLAAVIGHEIGHVIARHHEERITRQMGAQTGLAVLGALAGAAYGEGAASTVNQLGGMGAQTAFLLPGSRTQESEADVIGQRLMAQAGFNPAQAPTMAVHPPRPSQPDPGTATRCTGSDAGLSAGAGGRAAAKVRMSAHFYAVLQHIKRFLTPSVSDTFGGSDFSDSPTLPLTGAVLSVLVATALTGAVVTDAFAQSSRSSERGNRGGKQAKAEALYPNATREEPTVKASAKLGSKLQKMIDSYNKEKFPETRTQADAILADSAANEYDKSLAAQLASQAAYQTDDTPAAVAYLKQVLQFNGLDNNGHFQSMLMLGQLQLQEDQTAEGLATLDKYFAESKSTKPEELIAKGQALYQLERYQEAIPVLKQAIAGATEPKDNWNQLLMAALAEAGQSGEAVKEAEALAAKNPNDKKAQLNLASMYMQADQMEKAAAVMDKLRSSGQLTEEREYKQLYSIYANTEHKEKDVIAVINEGLQKGILKPDYQVYLALAQSYYYSDQVPQAIDAWQKAAPLSKDGETYLNLARVLHAEGRIPEAKQAAQQAVWLN

SEQ ID NO: 188639 - protein, 155 aa, Glycine max
  Coding DNA Sequence Number=SeqID_71861
MNNGIDKVVQKNDGDYERKASMKALNHIQLLKRELAGKDAEETDEQIKQLQDRVSILQDDFGEGVAIEDDEGHRLMLQEELEKSDDETRIESKRVKDVNSMLGSLMDKFHYDQNNSEKPRLQRDLKEIAETKDLEDIARLTHKKQELEFLKENIN

SEQ ID NO: 188640 - protein, 62 aa, Glycine max
  Coding DNA Sequence Number=SeqID_71862
GNFRKKGIQCGFEAELSCSKFGHGGLEAVLASDRKFGVRHSKCVLKWKGMWLLMEGSVERKQ

SEQ ID NO: 188641 - protein, 45 aa, Glycine max
  Coding DNA Sequence Number=SeqID_71863
MTYVYFVSPTLDSFSKTQACTSVSLSSKETGTYVWWMNHDRVIRA

SEQ ID NO: 188642 - protein, 384 aa, Glycine max
  Coding DNA Sequence Number=SeqID_71864
  Homolog annotation: Hit_ID=Q2HVE2; Match level="QueryCoverage=39%, HitCoverage=28%, E-value=7e-13, Identity=34%"; Hit description =Ribonuclease H
MLQTNQCFSLVMNRVLACVTNLAGSTGEIAYVEHLAVSTGEIALTHLAKKNGGISAALACAAGGTPFSPVLLAASPKFATIDKVGHGLGLPAILPLEKTRAHCSFIYPWVNAWKGRWLDDKYILSEFAPNLPFHMQNFCVADLVDGHKMGEFSVAIAYKLIAYHHTAEADDVRKRIWILHVPKWSNKDPACYHCNVSIESIVHVHRDCPLAMDKSDFFGSVTRAIIGLGLNCGLPSAITFGLGGISRSLIQILLNPLDRGSIFERGRLVCSEYRWGSERAPGYCRLWRLIRDCDGQWKGGFAKCIGRAFVFMAELWGVWVDSKAVPTAIKGNKLGEGNFCAYKLTDYASSDGCKLVIFEHYPSFLKDLIFDDARGIYFPRVIAV

SEQ ID NO: 188643 - protein, 361 aa, Glycine max
  Coding DNA Sequence Number=SeqID_71865
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=99%, HitCoverage=73%, E-value=3e-98, Identity=53%"; Hit description =Serine carboxypeptidase II, putative
  Pfam annotation: Domain name=Peptidase_S10; Domain location=37-361; Score=299.5; E_value=6.3e-87; Accession=PF00450.12; Description =Serine carboxypeptidase
MFPQPWIFLIATIIAISLFMSSLVESFPVADKVKSLPEQSPVSFQQFAGFVPVDDKNQRALFYYFVEAETNPASKPLVLWLNGGPGCTSVGVGAFTEHGPFVTNQGEAIEKNQYSWNKEANILYLESPAGVGFSYSLNLSFYKTLNDEITARDSLVFLRRWFAKFPEYKNRDFYITGESYGGHYVPQLAELIIKSKVNFNLKGIAIGNPLLDFDTDMNAVDEYYWSHGIISDYAYKIRTSLCNSSRVLREYFSGQISKDCLVAAQKVSEEYSFTNFIDPYYVVGEKCLSYNVSQAGFLRETLNSGMFQFRNSHYVLQTEEPDQQVDECNLKYSEMYLNRKDVQKALHARLEGTTKYRLCSK

SEQ ID NO: 188644 - protein, 88 aa, Glycine max
  Coding DNA Sequence Number=SeqID_71866
MANNKAESEVTISDSEDDDNYVQLLDAFNEMHQEEKKLAIANNLLKGCKVLEVKVEYLIKKISKFTMGRDNLEALLAQQKYAIEKARV

SEQ ID NO: 188645 - protein, 108 aa, Glycine max
  Coding DNA Sequence Number=SeqID_71867
MPPPQWDIRGEAQSRLECGLRVLHVSPPWVERHMHDQMGVVGSQWVWVRSCRHSHPEHVQHWVVYSWEAIHMVGRNACSEPTQNEGRSHFPTHCLPDLPYARLDDLLD

SEQ ID NO: 188646 - protein, 52 aa, Glycine max
  Coding DNA Sequence Number=SeqID_71868
MENEQFLIEQTWRSTQECRLLFWKIPSLVGVLIGIKGGVWSWMYIGWILWPI

SEQ ID NO: 188647 - protein, 278 aa, Glycine max
  Coding DNA Sequence Number=SeqID_71869
MQGIGSLLKGHRLFLSSIDLLFFDPEVERIVRRNNSLKKKRKTLERLARLEPNSLVLPNMSGGSQCGNKGISHWIGPTKQINQKKPVIATFTQGVDEPLCEAWEWFNSLFKQCLAHGLDDGGQINTFLVGLRPQTKLMLNASTRRKIMYKTPDEAKEIIENNTSNDYEVLHDRILTPTQNGGVLEQPPHGNQAQQGHPYKPLHQDYTSKLEDTLNQFMQISVTNQKNKDASSKNLEVQMGQIAKEVIEHKSRPLVTNTQTNPMEQYKAITTKEMYIGR

SEQ ID NO: 188648 - protein, 48 aa, Glycine max
  Coding DNA Sequence Number=SeqID_71870
MEVEEPWQGLWLPLHYQAFCCKIPSLVGVLALDMRRAGFVVDLGMAFV

SEQ ID NO: 188649 - protein, 103 aa, Glycine max
  Coding DNA Sequence Number=SeqID_71871
MKDSIKSKINYWGAQLVPWVRYLDLGILLLLCSVHLPLCVHILCITRHHPSVGRKDPLRKDPRKGMRNWKERDNTSALALGHMVNDHPESLLQKGNITLIEGG

SEQ ID NO: 188650 - protein, 160 aa, Glycine max
  Coding DNA Sequence Number=SeqID_71872
MGNHKGRARIRGRCGSGFLRVATCGCGGGCVYLGLWGRGWKCVVVVMLGIGGCMLQSGGVFGAEVVGHSMDIGWHDGVVWWMELANLGFLLMMTCVSGPEDHLPPQTQTNGSMTLEYDVIVAERNVGRYFREVVNTHEPLTLGAFQMTPLTSIIKDFQKP

SEQ ID NO: 188651 - protein, 61 aa, Glycine max
  Coding DNA Sequence Number=SeqID_71873
MCPMYVFKKVTRTLRWFAKERGSRQNPLSAPCPYSRDLYGRELNKAFSDNSQGGHISLDGL

SEQ ID NO: 188652 - protein, 642 aa, Glycine max
  Coding DNA Sequence Number=SeqID_71874
  Gene Ontology: Mol. function=aminoacyl-tRNA ligase activity; Cellular component=membrane; Biological process=translation
  Homolog annotation: Hit_ID=UPI00005F8258; Match level="QueryCoverage =91%, HitCoverage=70%, E-value=1e-153, Identity=49%"; Hit description= COG3264: Small-conductance mechanosensitive channel
MMLSTEFMLKPRPFLLLLLLLFGLQLTPFGAVAAAQDDPAAESAPDPATQLKAAQKQLDSMKQLVSKATTDNQLSKLRLATDDLVASMEKLATDLQPEQDKLKAQLDVLGPAPAAGALPETPAVAQQRNALNNSKKQLDDAVKRAQAIKTSAFELGQQIGDLRRVAFKTQLALNTGSILGIKFWAPVLQPSENDVQRLDQFNAEMKAAWDASWQDEWRYSTLALLALAVIVWSWGRYFSERFLAWASIRFLPDGRLRRSFMALVTVVVTVITTSIALNLLYYVFVRVQPLPVMLEDFAEGFNRLGIFCALIAGLGRAALSLNRPSWRLASMDNEVAAGLRYFSPLLAGLALAFGTVELINNVVSASLATTIFGNGLVAGLIGMVLLAAPLRGQRIRRRLEQQGAHLEKRTLVSGLVHLVTLVCSVVILFSLLIGYIAFARFLTYQLIWVVLVLMAFYFMVLFATDLCAALFSPQTVSGKMLKKTLSFKDRHLEQMAIITTALAKCSLLLLMIVSLFNGSFGSTTPGSLMEKIVSILTGEGLQRFNIVPGNLLNAVICLAIGIYILRAVRRWLGSELLPKTISDVGIRASLVTLFSNIGYVLVILITLAALGIQWSNLAWIVSALSVGIGFGLQEIVKTLFPA

SEQ ID NO: 188653 - protein, 68 aa, Glycine max
  Coding DNA Sequence Number=SeqID_71875
MEGLGGAVESLEVLWWRWPAAVVVEVEPLCFLDDFFIWIWLRNEKGRAPPRKEGGRGFCIRREKKLYL

SEQ ID NO: 188654 - protein, 118 aa, Glycine max
  Coding DNA Sequence Number=SeqID_71876
  Gene Ontology: Biological process=intracellular transport
  Homolog annotation: Hit_ID=Q1SBA4; Match level="QueryCoverage=65%, HitCoverage=21%, E-value=2e-34, Identity=89%"; Hit description =RanBP1; EVH1
MFLVAHAKLIENELEQPSSPSVKKSEEKGVVVVHEVKCKLYVKSSDPGDKDAWKDKGMGQLSIKCKEGVSKATKESKPTIVVRNEVGKVLLNALLYPGIKTNLQKNSLVAIFHTSVRH

SEQ ID NO: 188655 - protein, 64 aa, Glycine max
  Coding DNA Sequence Number=SeqID_71877
  Gene Ontology: Mol. function=protein dimerization activity
  Homolog annotation: Hit_ID=Q9ZU73; Match level="QueryCoverage=63%, HitCoverage=13%, E-value=2e-09, Identity=68%"; Hit description=Ac -like transposase
MASKSTFSIGSQVLNKYRTRLLGDNVQALICTKNWLLGFDEQGGPYAGQASPLTHPFMGVTSRA

SEQ ID NO: 188656 - protein, 70 aa, Glycine max
  Coding DNA Sequence Number=SeqID_71878
  Gene Ontology: Mol. function=sequence-specific DNA binding; Cellular component=intracellular
  Homolog annotation: Hit_ID=Q1SNM1; Match level="QueryCoverage=98%, HitCoverage=16%, E-value=2e-16, Identity=70%"; Hit description =Histone-fold/TFIID-TAF/NF-Y
MQADEDVGKIALAVPVLVCCWLFVCHIHVVDIALECITAKALELFLQDLCDRTYEITLQRGAKTMNSLHL

SEQ ID NO: 188657 - protein, 181 aa, Glycine max
  Coding DNA Sequence Number=SeqID_71879
  Homolog annotation: Hit_ID=Q9ZWR4; Match level="QueryCoverage=26%, HitCoverage=5%, E-value=6e-11, Identity=69%"; Hit description =Importin-beta2
  Subcellular localization annotation: CTP_CleavageSite=23; ConfidenceScore=5.29e-01
MPTTLPPSSSSSMPPLSPPSPINLFTKSQNILIMPLPSLSLLPKVDDEANLKTDMDGLTGVNEVNVFIPSDKIVFVTIGFNVQKCHSNKPKQNCQFMHNGMMAAEMKNVSFEWTFAITVGVVGDVCRGFEEKSGAELAADIYAADDNMTEYTNCLTNGILEAYSGILEGFKGSPKTQFLMS

SEQ ID NO: 188658 - protein, 252 aa, Glycine max
  Coding DNA Sequence Number=SeqID_71880
  Subcellular localization annotation: CTP_CleavageSite=63; ConfidenceScore=5.03e-01
MATAETKIKGMKIEHPKPKTSLCLCCFGSFHSKTPTTGSEHKAKQKSGSSSWFPWQRIRFRVKNSMAKTVPLEGSEFHEIDKLKLKLKLKDNKVHSSRWKWKSKSKSDLLSKSQSNSTPSQTPSKSQKNRGNNIAGYTRQQSKTSSPGKVVPHAVSLQAWTWKQGKHKQLQNAERYNPVIVAASLVVITLVSMIVWGRLCSIICTTAWPYLIPTLAKLLKTTSRIPLVFQTTWFWIPTWTRIKSSHDVAISL

SEQ ID NO: 188659 - protein, 180 aa, Glycine max
  Coding DNA Sequence Number=SeqID_71881
  Gene Ontology: Mol. function=hydrolase activity; Biological process =chromosome segregation
  Homolog annotation: Hit_ID=Q1RSQ6; Match level="QueryCoverage=75%, HitCoverage=61%, E-value=4e-57, Identity=83%"; Hit description=Metal- dependent phosphohydrolase, HD region
  Pfam annotation: Domain name=HD; Domain location=26-134; Score=27.9; E_value=2.2e-05; Accession=PF01966.12; Description=HD domain
MEIERLRRNAEALVEKTMKGNDASHDAAHVWRVRDLALSLAKEEGLSSNPHSMEIVELAALLHDIADYKYLRDPSEEKIVENFLDEEGVQEDNKFKILKIIKGMGFKEEVSGSGNSEGFPEFGVVQDADRLDAIGAIVTGILKHPIGLLIPLERQTDREIEREREREALEDKRKSDRCDK

SEQ ID NO: 188660 - protein, 88 aa, Glycine max
  Coding DNA Sequence Number=SeqID_71882
  Gene Ontology: Mol. function=serine carboxypeptidase activity; Cellular component=cellulose and pectin-containing cell wall; Biological process=proteolysis
  Homolog annotation: Hit_ID=Q1EP77; Match level="QueryCoverage=74%, HitCoverage=13%, E-value=1e-17, Identity=63%"; Hit description =Serine carboxypeptidase (Carboxypeptidase D), putative
MLLTFWTLLFSFLLTTASAAAGREYSGEEAPQQEADRVKNLPGQPPVKFRHYAGYVKLRPNEEKALFYWFFEAQEDPSQKPLVLWLNG

SEQ ID NO: 188661 - protein, 387 aa, Glycine max
  Coding DNA Sequence Number=SeqID_71883
  Gene Ontology: Mol. function=serine carboxypeptidase activity; Cellular component=cellulose and pectin-containing cell wall; Biological process=proteolysis
  Homolog annotation: Hit_ID=Q9LEY1; Match level="QueryCoverage=98%, HitCoverage=81%, E-value=1e-139, Identity=61%"; Hit description =Serine-type carboxypeptidase II-like protein
  Pfam annotation: Domain name=Peptidase_S10; Domain location=1-379; Score=531.7; E_value=7.9e-157; Accession=PF00450.12; Description =Serine carboxypeptidase
MQQGPGCSSIAFGAAREIGPFLVQDKERVKLNKFSWNRVANIIFLEAPIGVGFSYTNNSKDLHELGDRVSAIDNYAFLIGWFKRFPNFRSHDFYITGESYAGHYVPQLADLIYEGNKDTKKGSYINIKGFMVGNAVINDITDIVGLVDYAWSHAIISNQVFAGLTRDCNFSVENQTRSCDLQIAKLLGAYSDIDIYSIYSPICLYDYQRPLSAKLVVAPHLLTRHDLWRTLPSGYDPCAEDLVGKYFNNKDVQKALHANITNLSYPYSLCSSVIEKWNDSPKTILPVIQKLLRAGLRIWIYSGDADGRVPVTSTRYSIEKMRLKVKKEWRAWFVKSQVAGWTEEYEGGLTFATIRGAGHQVPVFAPEQALSLFTHFLSSQTLPSSRF

SEQ ID NO: 188662 - protein, 136 aa, Glycine max
  Coding DNA Sequence Number=SeqID_71884
  Gene Ontology: Mol. function=DNA binding
  Homolog annotation: Hit_ID=Q1SFS3; Match level="QueryCoverage=94%, HitCoverage=25%, E-value=2e-11, Identity=26%"; Hit description =Lambda repressor-like, DNA-binding
MDQVQCQSFSKVYGKIWDLAMIEVSVEVIAALTQYYDQPLRCFTFWDFQLAPTIEEFEGILGCPIGGRKPYLFFGYYPSVAKVARVVKISERELDRVKQSRNGVVGIPRKFLEEKTETLTSQGELESFMDVLALLV

SEQ ID NO: 188663 - protein, 95 aa, Glycine max
  Coding DNA Sequence Number=SeqID_71885
MDELCKGGRQSPASPSGGGGASQLEPDQGANNSNVHRAQEEETGTDQIPKPSPASIPDDSMPSTPASELEQPISQDSLVAQVLDLNEHAQEESQE

SEQ ID NO: 188664 - protein, 104 aa, Glycine max
  Coding DNA Sequence Number=SeqID_71886
MSRETNEVEFMGLGATATIDVEEPSSNTKGKRQGSTSSGTHSHKIEEKEGITTSLDKMANSFDRMVEKMDGKVNDEDIQEVLRETTLIPDLNRQQWAKAIKWLL

SEQ ID NO: 188665 - protein, 114 aa, Glycine max
  Coding DNA Sequence Number=SeqID_71887
MKILKGYTKNLHRPEASIVERYIAEEAIEICSYYIEKAKPVGLPESRRDDSASRIFPLDLMMKSTQFQVKKRLSHEVLKVTVELSSSVGLSAHLLLSTASVRFAQQKNMSEHQY

SEQ ID NO: 188666 - protein, 83 aa, Glycine max
  Coding DNA Sequence Number=SeqID_71888
MTVLTVYLTQTMKSPTFRQAVRIVTQQKVHNELKIHFGMMPHIITISTGLILMRRTFAVWRCRQPLMLAKNYMLAWNLIVKMR

SEQ ID NO: 188667 - protein, 103 aa, Glycine max
  Coding DNA Sequence Number=SeqID_71889
MELDDVAPCGACRPWIFFINGVLFFLNFNGSGMHTPIYAKFMKDLLAKKRRIMDDEISLFVNYVFECIIYFARAIIAWPEDRPNFQEEDEDMVDLVDYFIGGD

SEQ ID NO: 188668 - protein, 95 aa, Glycine max
  Coding DNA Sequence Number=SeqID_71890
MARSSRIEYLLCNQSWHQSSALRVEYLTTLWKISSKSKKKMEEGFSTNKLPMFKSVKYDYWIESPCRACRPWIFFINGVLCFLKINGSGMEKEER

SEQ ID NO: 188669 - protein, 69 aa, Glycine max
  Coding DNA Sequence Number=SeqID_71891
  Pfam annotation: Domain name=zf-CCHC; Domain location=29-46; Score =9.1; E_value=0.032; Accession=PF00098.13; Description=Zinc knuckle
MATRLGMKTLMRKSAKVTTSVHPTRSRELECLMCSGIGHMACQCPRWKTLTNELKEKEMKEDELRENEM

SEQ ID NO: 188670 - protein, 189 aa, Glycine max
  Coding DNA Sequence Number=SeqID_71892
  Gene Ontology: Mol. function=RNA-directed DNA polymerase activity; Cellular component=intracellular; Biological process=RNA-dependent DNA replication
MMEVVKGEVSPMQCVPKKWGTTVMQNEQHELIAVRKLNEAPRKDHFPFPLSSKCLKNGYSGYLQILVAERDQGKTTFTCPYGTFAYRGMPFGLCNALTTFQRVSHASIELNPAKVEVIAEFFLKLYYLVLSKIVVFIDHFTIKFLLSKQEAKPWLIRWILLLQESNMEIKGKKGPKNLDPQSHSLQMMG

SEQ ID NO: 188671 - protein, 99 aa, Glycine max
  Coding DNA Sequence Number=SeqID_71893
MAKGAREGLRVDLGPWANGVSSHLFSFSIPLPLNFKKQWTPLMKKIQGLLAPQELHHNLDKLLRYSKCPLDRSSNGYEGNVYVQDEDTIICYFYGKVGH

SEQ ID NO: 188672 - protein, 143 aa, Glycine max
  Coding DNA Sequence Number=SeqID_71894
  Subcellular localization annotation: CTP_CleavageSite=27; ConfidenceScore=5.72e-01
MATPPVSSPPPSPPPPPPPSDASASPSTMKRTRKATRLRSLATRPPGVERLVVNVYPAIGKADGPQKKKLRTYLGIVARDKPTKTVWITLFVKNTALARRNRPSFVRHAETLLGCAEKGTGHPEAKHCPPPPPPGWSRGVFKI

SEQ ID NO: 188673 - protein, 206 aa, Glycine max
  Coding DNA Sequence Number=SeqID_71895
GSTAVHNIPLSHGQVKVGVEDVKDVEALVPVPTDEVTLVGQALNTFLAWLAHLVKLSEQVAVSPAKPPERSNPEVDDPLYLMTLTIPKLFLKPLQVMWDATVFGVFNQDFPLYIKHEDLSKIAHGGQCLNISSIQRSGQSQFDSESYIKSWMQSSKRDVYLGAYLNGHWQMVVILPKENLVVCALKGLNDTPQPKSKAVARWIVVN

SEQ ID NO: 188674 - protein, 66 aa, Glycine max
  Coding DNA Sequence Number=SeqID_71896
NVYTDNHSGISARQHDSKVSMTDRVSAEDDVNLRVSTGLSAAIDEGCRMTTLAAAYHRARRLWMTK

SEQ ID NO: 188675 - protein, 85 aa, Glycine max
  Coding DNA Sequence Number=SeqID_71897
  Gene Ontology: Mol. function=racemase and epimerase activity, acting on carbohydrates and derivatives; Cellular component=integral to membrane; Biological process=carbohydrate metabolic process
  Homolog annotation: Hit_ID=Q6IVK3; Match level="QueryCoverage=58%, HitCoverage=11%, E-value=4e-18, Identity=82%"; Hit description =Putative UDP-glucuronate decarboxylase 3
MGFMGSHLVDELIAIGDNMIVVDNFFMGRKENMMHHFGNPRFELIQHDVIEHSTRCRVLEDTLVPLDPEIKKKYRYNNDLRKKQK

SEQ ID NO: 188676 - protein, 136 aa, Glycine max
  Coding DNA Sequence Number=SeqID_71898
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=79%, HitCoverage=24%, E-value=7e-12, Identity=48%"; Hit description =Pathogenesis-related transcriptional factor and ERF
  Pfam annotation: Domain name=AP2; Domain location=43-134; Score=48.4; E_value=2.4e-11; Accession=PF00847.10; Description=AP2 domain
  Subcellular localization annotation: CTP_CleavageSite=64; ConfidenceScore=5.74e-01
MAKQQTHKINASTNNNISTTNTVTAKVKRTRRSVPRDSPPQRSSIYRGVTRSGTDGLADTKLICGTRIAGMSHRTRKDDKFPFLVLWQWFFTYHTSVYLGAYDDEEAAAHAYDLAALKYWGQDTILNFPVKFYQTY

SEQ ID NO: 188677 - protein, 82 aa, Glycine max
  Coding DNA Sequence Number=SeqID_71899
MIGGGSTVINNDSWWSPMVNGGGGGDWGCWVRVWGRKGEKNVCFTLLDIFITCKTHSGELAQLKFAWASSGRIMLKHILLLL

SEQ ID NO: 188678 - protein, 229 aa, Glycine max
  Coding DNA Sequence Number=SeqID_71900
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=98%, HitCoverage=63%, E-value=3e-56, Identity=56%"; Hit description =Pathogenesis-related transcriptional factor and ERF
  Pfam annotation: Domain name=AP2; Domain location=24-89; Score=100.3; E_value=5.8e-27; Accession=PF00847.10; Description=AP2 domain
MEGQSREEYIGSLRRKSSGFSRGVSKYRGVARHHHNGRWEARIGRVFGNKYLYLGTYATQEEAATAYDMAAIEYRGVNAVTNFDLSRYIKWLKPNNNNTTVNSNLIDSNPNCETNFTSNSNQQQGFNFFNRQESFNNEEAAMTQPRPAVATSALGLLLQSSKFKEMMEMTSATDLSTPPSESELPSCTFPDDIQTYFECEDSHRYGEGDDIMFSVLNGFVPPMFHCDDF

SEQ ID NO: 188679 - protein, 141 aa, Glycine max
  Coding DNA Sequence Number=SeqID_71901
  Gene Ontology: Mol. function=double-stranded RNA binding; Cellular component=intracellular
  Pfam annotation: Domain name=dsrm; Domain location=34-100; Score =35.4; E_value=1.9e-07; Accession=PF00035.15; Description=Double -stranded RNA binding motif
MKDSFLLIRILVEDYPVTCHRGSWFSAGKISPIFKSIMNEYAHKLHVEQPTYNNDKQLLGGVLPAFITSLVFNGTSYTGGPAGTKKDVEQSAAKAAILSIMGILPCDSSSGTSLAEIIRSKSIFYDAVLSDIQDFNHVSNM

SEQ ID NO: 188680 - protein, 59 aa, Glycine max
  Coding DNA Sequence Number=SeqID_71902
MQDDAATTTMIAAAIADGVTIVGFHGNCHRGLNGLQENEEVKRKNKVQLTSLGTTKKQP

SEQ ID NO: 188681 - protein, 117 aa, Glycine max
  Coding DNA Sequence Number=SeqID_71903
MRVRLASFFTGAAAASFLGLYTLHKDYKVAHQSFTQQMNILEMPIIHVRMLQLIVASVCLVNMVPCCCYVDVFCNGYSSAVLWLLFKSYSTDPELENGGKMAFSACYRLDVHISSFD

SEQ ID NO: 188682 - protein, 40 aa, Glycine max
  Coding DNA Sequence Number=SeqID_71904
MFNADPSFPNVPTLITEQIQKECGVWGGVLDECILVSKVR

SEQ ID NO: 188683 - protein, 81 aa, Glycine max
  Coding DNA Sequence Number=SeqID_71905
MELEQLDVKTTVLYGRLEKDILMQQPKGFEVEGKENFAYRLKSLYHRLKNLISSLGFLEEKAIATSSICSHKHPVGSSDDE

SEQ ID NO: 188684 - protein, 360 aa, Glycine max
  Coding DNA Sequence Number=SeqID_71906
  Gene Ontology: Mol. function=DNA binding
  Homolog annotation: Hit_ID=Q9LW00; Match level="QueryCoverage=70%, HitCoverage=91%, E-value=1e-29, Identity=35%"; Hit description =Arabidopsis thaliana genomic DNA, chromosome 3, P1 clone: MSJ11
  Pfam annotation: Domain name=MBD; Domain location=80-153; Score=22.7; E_value=0.00017; Accession=PF01429.10; Description=Methyl-CpG binding domain
MASSVEKESGASEETFSLELPAPPGWKKQEPPSMLQIVTEWDLSGIAIFLAQSWDQQSPATLEALVFGAPGPPAAICGKNHGVLQLLIRLHHCRTAAFIPKKAGTPKKNEIVFTAPTGEEINNRKQLEKYLKAHPGGPAVSEFDWGTGETPRRSTRISEKAKATPPTESEPPKKRTKRSSASQKETSQEEKEEETKEAEMQEVDDTTKDDNDIEKEKDVVMENQDGKSVEDTDVNKSTHSGEAKAGEYVEVPIEEEKSNAADGELPALKDKVDDKVFLRKDEEKIEQPQEETKEYRRTGVPEKSETCTTADKTVEVEGVNKEVRSTRQFEVGIIEGTKVNSDQINKKAEAELTVNGNLGS

SEQ ID NO: 188685 - protein, 100 aa, Glycine max
  Coding DNA Sequence Number=SeqID_71907
MNKNLGSLISSQISLIAQHDSSRLGFLALITALCKARGVTSDSLTFESLSPTINLAYIKKNFWNLDDPSVTFRGTQPTSGPAPDHAELAECGPLAAGYER

SEQ ID NO: 188686 - protein, 88 aa, Glycine max
  Coding DNA Sequence Number=SeqID_71908
MGARDESIMHKGNKNPDPVNDPVHAHSGPVLVQMMDPVKEAGPKLVQMAQALWPLECPPVDPAEAPGLRRPHPLPKEKAGLLARPSTE

SEQ ID NO: 188687 - protein, 151 aa, Glycine max
  Coding DNA Sequence Number=SeqID_71909
MTIFVFAGQRARLPLTRLFLDSKKGANDHICLRMPSDLIVCLWMTRTLSHMKDKVRTLSPMKDKVRTLSPKKDKDFDPSKGEDFESSEGEDFESSEGENFEPSKGKDFEHSEGENFESSDDEDFEPSKDENFESSNGEDFEPSKGEEFESS

SEQ ID NO: 188688 - protein, 105 aa, Glycine max
  Coding DNA Sequence Number=SeqID_71910
MKVGSSSSSDSFSDSSSEESSKLRGWGKLLDADFEDDSLEATNIQCMSSPSSIVNNSYLHVRRLSDAIIPRKGPVTRAISKRLQEDWARAAEEGPRVLMNLRVDF

SEQ ID NO: 188689 - protein, 66 aa, Glycine max
  Coding DNA Sequence Number=SeqID_71911
RAKDREGKQVGVSRISTSNDDEGDLGWEGFLGLCAWFESESDPFLFLGSDDGLASPPAFDEMALQT

SEQ ID NO: 188690 - protein, 105 aa, Glycine max
  Coding DNA Sequence Number=SeqID_71912
MEPSSRVTQLKGATFVKMGIANNFLNAISSNAGGEAKPKRSQPRNKLPTKTKDPPPSSDPKPYTLAKKPKNQPSSDPKKRKGSDSDSNHAHKPKKPTIRIKPFLP

SEQ ID NO: 188691 - protein, 70 aa, Glycine max
  Coding DNA Sequence Number=SeqID_71913
MAVSKLGMMQRVPLSVGFQRRTMAVYGGYWWLWVMEKVLGALEMVLEERRRRNGIFPKLIGLQGSKCTSD

SEQ ID NO: 188692 - protein, 51 aa, Glycine max
  Coding DNA Sequence Number=SeqID_71914
MERNEIEAELENSRKSLTDKMMLDASHIQKKDSSILGDLNHFLIAQEEEMS

SEQ ID NO: 188693 - protein, 315 aa, Glycine max
  Coding DNA Sequence Number=SeqID_71915
MKPHWMISGTQQTTCPSSESREEPKKKKLTSSDDSFKKTFNAIPQQIIRMDPSQKNLSLWVQWSRNVNIFTFITRFLPSNFVDLNPSKIELDMIDAYPPHLHIRRSTNIKIVYDRNCPSLPVCNEGKKKNFNLVQFTNYKRDWKNLLKNNKLIKRKLDSHDAHASWNQTIWFDTKKSSISNSGDVPIDDHKDSIEVLCPTKVYHFDDTFACFIKNPEDGFISRLAKLPIIFNKTIFDQNKMGEEEFTACDMHQSKDIAPINYIALAVVTKEQIQEMMAQALLKQQEETKQELLKERKKTKLYLQAFAEQQQFENK

SEQ ID NO: 188694 - protein, 322 aa, Glycine max
  Coding DNA Sequence Number=SeqID_71916
  Homolog annotation: Hit_ID=Q6X0N8; Match level="QueryCoverage=22%, HitCoverage=9%, E-value=5e-28, Identity=80%"; Hit description =Putative spermine/spermidine synthase
MVVVEAVAALEVVVDVATGIDNDVIVVEDLAVTAVVGAEWQRQQLVGLEVAVDVDTVGLPHADGEVGGAEINFASRTISFSSYGKRSLDGCGALLPSLGCLIPEDKAEEERGSMELATTVVAAPKKVRGALAENHGIQFQANEIESESMEAWAVARLAWAAARLAWAAARLSMAASRRSRLAAEGSPSAIEERQRRGIQSTFVNKRTEALILELHGGHVHDAPSHEGTVVNVAAEHIGDDDLGEVNVGDGGVADVVEVLGEAGVAAAWDEELKRERSGLLGFPECLPGDGHGGENVNDLNGSLVENVFGDIALVPLTKAMET

SEQ ID NO: 188695 - protein, 253 aa, Glycine max
  Coding DNA Sequence Number=SeqID_71917
MYRRNQAITYPPGPHISRATDIKIVVDKVCPRIPLRDEGKKREFKIYHYAEMPSRSTKVEVETTQGIGVLYLVAKGINNVDQQDFIQVLHLVKMYPFDDARMCFTEDIEDYDFVDRLKNHPIVFNEIVYDLTKMKRTSNIIKVFERDEKEKGIEVQAEVVATITKVVDDAIVNEVIIDLTNTAVMEEESSSNADKANKMSMLGVVDAPKVRPPPSVQQPPVIEQPLTTNVPSSPTKPLPPPADQPPPPPAVQE

SEQ ID NO: 188696 - protein, 86 aa, Glycine max
  Coding DNA Sequence Number=SeqID_71918
  Gene Ontology: Mol. function=oxidoreductase activity, acting on single donors with incorporation of molecular oxygen, incorporation of two atoms of oxygen; Cellular component=chloroplast
  Homolog annotation: Hit_ID=Q208P3; Match level="QueryCoverage=96%, HitCoverage=13%, E-value=3e-37, Identity=83%"; Hit description =Dioxygenase RAMOSUS5
MPPRRLLSHYKVDSRRNRLLTVSCNAEDMLLPRSNFTFSEYDSNFNVVQKQVFRIPDHLMIHDWAFTDTHYIVFANRIKLDVLGKN

SEQ ID NO: 188697 - protein, 182 aa, Glycine max
  Coding DNA Sequence Number=SeqID_71919
  Gene Ontology: Mol. function=RNA-directed DNA polymerase activity; Biological process=RNA-dependent DNA replication
MCQAMWGDTTVSWEVQPAINSTGGLLCMWTENRFTLQRKVAGNGFICLTGLWIKKALQLHIVNIYSPCDMQSKRILWENIKQLKIANQGGLWCIMGDFNNIKDPVERMGVCQRGVEGSSIREFNEWIDDMEVVEAPWIGRKFTWSKFVDWGPKPFQILDCWLLDKSFKSIVKECWLSQQQSG

SEQ ID NO: 188698 - protein, 187 aa, Glycine max
  Coding DNA Sequence Number=SeqID_71920
  Subcellular localization annotation: CTP_CleavageSite=74; ConfidenceScore=5.74e-01
MPINIAFSLSLCKTFFLPFSLTRPPFQNLQTLITFSFLTQILSNKVQTSSFFNSLQTPLIKIYQKCIKWQTHLRSARVQLQPPPLQAKCHHDTSGDSLAPPNPSISSPRSLTLFSSDEQRQRVPNPYVDMPHVAENKEQEAKMIWEIANNLGVTGIEEQGRIVEKFMQMGDRDKKEAEKVGNRSHNS

SEQ ID NO: 188699 - protein, 93 aa, Glycine max
  Coding DNA Sequence Number=SeqID_71921
MEESNRENNKDHISQSRGSALDGEEHIGEWRNPIGKITMITFASQEGPLLTVKTTLENGGFHRENNQDNISQSRGFPPDREKHVGKRKIPSGK

SEQ ID NO: 188700 - protein, 182 aa, Glycine max
  Coding DNA Sequence Number=SeqID_71922
  Gene Ontology: Mol. function=nucleoside-triphosphatase activity; Cellular component=protein complex; Biological process=protein catabolic process
  Homolog annotation: Hit_ID=Q1SKI7; Match level="QueryCoverage=69%, HitCoverage=33%, E-value=1e-55, Identity=83%"; Hit description=AAA ATPase; 26S proteasome subunit P45; Nucleic acid-binding, OB- fold
  Pfam annotation: Domain name=AAA; Domain location=76-182; Score=14.3; E_value=1.8e-05; Accession=PF00004.19; Description=ATPase family associated with various cellular activities (AAA)
ERETGKPIITGRHKGDFYVLSPMPESYFSNRFKFGSANIWHQHLGHPQIKELRESIELPLMNPELFLQFGIKPPKGVLLYGPPGTGKTLLAGLLPVVSSAIIDKYIGESARLIREMFGYARDHQSCIIFMDEIDAIGGLRFCEGTSADREIQRMLMELLNQLDGFDQLGKVYFIPESHLTWS

SEQ ID NO: 188701 - protein, 139 aa, Glycine max
  Coding DNA Sequence Number=SeqID_71923
MDRLVSNIKSFNRTWQPKVSTIFESKNLTSITHAKLFRKLWEYEMDMTRMGEHEAKEKKSRDLALKSSIPSSCESDEVNAKGSEMFFYSGALRTMLRKVYRTVVRVENSEEFLKPIRMMKFTPFEYLVLGKILKNMAST

SEQ ID NO: 188702 - protein, 211 aa, Glycine max
  Coding DNA Sequence Number=SeqID_71924
MLLNISSVEKLWSLGLRVGWSWEKGVERWREDAKAIVMICGGEEQQQLFFNDYNNVYKATIFPHNVGLGVTRQTLVFQMLMLLYAVEYFNMLTLDLSLDPSINYPSFNMLALERIEKEKEEAFKIHEQKILQLQSDYEKEVEKLIRQISKSVVFTFLLSQSVDFASVATCPFAGERGEAHGCAFQRRKNARSRHQRLFVENVGKIEGNRSK

SEQ ID NO: 188703 - protein, 241 aa, Glycine max
  Coding DNA Sequence Number=SeqID_71925
  Pfam annotation: Domain name=zf-CCHC; Domain location=94-111; Score =14.0; E_value=0.0048; Accession=PF00098.13; Description=Zinc knuckle
  Subcellular localization annotation: CTP_CleavageSite=31; ConfidenceScore=5.12e-01
MWDTLALTYEGSSQAKASSTPKESSSRHVSRSSSKAVNVDIPNDEFNDEGSNKDDQLALISRKIKNMWKKRSGSNWKGSKKLHRERKEKKKSSIICYERKKPGHFKTKCPNLDKSAHKKRYFKPKDRKVLISTWAYLDDTLFDEETKEEEEAYHCLMADITLEGSDSESDEELKTTKLHLENEEICKERSSLLEDLQRLKNQLEGLQIVYTTLNKLHDHLIKERCNLFERMFIVNTLKFPS

SEQ ID NO: 188704 - protein, 99 aa, Glycine max
  Coding DNA Sequence Number=SeqID_71926
MLSPTMPTLDLSDGTTLCDSYSNSLGMTLIECLLDLPSLTIRPPRSMRIWEILEMMRISRHPRLLSTGMFAMKRYLRERWFHPMRNEIPQEMKATFSRI

SEQ ID NO: 188705 - protein, 133 aa, Glycine max
  Coding DNA Sequence Number=SeqID_71927
  Subcellular localization annotation: CTP_CleavageSite=62; ConfidenceScore=5.50e-01
MGHYFILDFPHPIIPPVMIHPLHQITPRTPQPPPKTTMSSPPAVASSVEPPSSSRNHRTGVVAAGTAVVRWNDLVTPINLFEYGLAFLGVAYYKHSKLQALKAKEAQKKTAQADEEEGRLLEDKDDKRNDQQN

SEQ ID NO: 188706 - protein, 84 aa, Glycine max
  Coding DNA Sequence Number=SeqID_71928
  Gene Ontology: Mol. function=protein serine/threonine kinase activity; Biological process=protein amino acid phosphorylation
  Homolog annotation: Hit_ID=Q67UT0; Match level="QueryCoverage=72%, HitCoverage=15%, E-value=9e-20, Identity=67%"; Hit description =Putative serine/threonine protein kinase
MAPEVIRCKPYNEKCDVYNFGVILNELLTGNYLYVETKYGPTKIVMEVVEGKLRPKLSCDDVGQLETREIEGALHPVDKILFES

SEQ ID NO: 188707 - protein, 203 aa, Glycine max
  Coding DNA Sequence Number=SeqID_71929
  Gene Ontology: Mol. function=DNA binding; Cellular component=oxygen evolving complex; Biological process=DNA integration
  Homolog annotation: Hit_ID=Q1SJY5; Match level="QueryCoverage=50%, HitCoverage=10%, E-value=5e-34, Identity=63%"; Hit description =Integrase, catalytic region
  Subcellular localization annotation: CTP_CleavageSite=27; ConfidenceScore=5.00e-01
MTTQDGHGLCSLLTRMSPLRSSLNFVRGFKMKKKYALLQLEVIMVESLKMRVFIYFVKRMKFFIISLLLEHLNKMVLLRERVGHCKKLPEPCSMITLHLNIYGLKFKTGRRHWTTDRIIYKSKCAQSSNRIDSRRKRTYLTDSKEELPRSQIIRDPSTKVKKRGSLRQQGYTSLISKVEPKHINDVMEDENWVKATQEELEQF

SEQ ID NO: 188708 - protein, 254 aa, Glycine max
  Coding DNA Sequence Number=SeqID_71930
MDMACIYTNNCSMNNNKSEVDNTEVLLFGDKGTFVDDGLLGVLIHSFEDEEDLVFVEEFVDDGNIVDVVHSSQSLHVPRNVDVLLNLLLPICLLEIPPIESFWNMTLIGLLPIVLVCVSFPDAPYDLCNRIHGQHYFFAKNLGHNGLLVLEVKSFQHFNVEEVFNENSELFLSVDVGGVCGDDEHGKSSVFSRACHALSFVLPVSFMVADELAPPLWCLFRATAAAMVASRRSTMHQWHQGGAPPSVVASHIAS

SEQ ID NO: 188709 - protein, 448 aa, Glycine max
  Coding DNA Sequence Number=SeqID_71931
  Gene Ontology: Mol. function=nucleic acid binding
MRACGWGWCMRDCFLLWLYIIVAVDVDAYSNLDNDTWSYYEALALVICLGYQCSQLRLWWKLIEVNFEDGLKQFSDDKHALELEEYAVNNNGEANLYVEHLSVNQPQYISYEELLQLAHAFLDEDEGERNGAHVDENDGAEVGHEDVQHVVQMLKLVLRWRGEEAPKGGTDGGVGPYENDVVDDGGSQNVVNESGDVVCHNENGADNVMSTGQFEDEDDSFSPSTSKASDEDIDDDTEFVDDMGSADNTGACLAHFAFDLPNMDDVGDDVDANYMSEELDNGSKSDEDGNFRPRRSIGFGPHELCKEFKFRLHMQFSSLTQFKEAIMEHFVLNEKEVIFIKNIKKGARVVCSQKCGFLCLVSRVGRTETFEVKTLTDEHTCPRVFNKKNAKSKWVARQILDRLKSNPHMTMNEVVDDIRSRYATSITSVTSYKARQIALAIVEGDAIK

SEQ ID NO: 188710 - protein, 107 aa, Glycine max
  Coding DNA Sequence Number=SeqID_71932
MKGITEGVNNINIADSYKKNRIQVSNTMNPLLQDIGFDLCFSKRELPLPHLFPTLLPSYSGSINLFGLSLCLLKFLVVAVKVLLIERVRSVENEHAMEAGGAGERGN

SEQ ID NO: 188711 - protein, 84 aa, Glycine max
  Coding DNA Sequence Number=SeqID_71933
MGMPARLRSPFPVLHGDETGTTMRQPEDGVDLLCTASQDGDDDFILWGRIGDDNGLHGKASGFEEAGEELEMYHEGSTEGADSE

SEQ ID NO: 188712 - protein, 141 aa, Glycine max
  Coding DNA Sequence Number=SeqID_71934
  Gene Ontology: Mol. function=catalytic activity; Biological process =cellular metabolic process
  Homolog annotation: Hit_ID=Q1SZ11; Match level="QueryCoverage=60%, HitCoverage=35%, E-value=4e-28, Identity=68%"; Hit description=NADPH HC toxin reductase-related
MGILRSLGEEKRVKGDSRDLCLFWDGAQDNQVAYQSLKFLEELDGKIPIVHVEDVCEAHIFCAENWSINGRFLVASSYASSVDIANYYLQAYPEFHLNHKSKKGYNMGINEVDRQWVFMYKYDLKMILDDCIRCTRRIGNL

SEQ ID NO: 188713 - protein, 66 aa, Glycine max
  Coding DNA Sequence Number=SeqID_71935
  Homolog annotation: Hit_ID=Q1RYZ9; Match level="QueryCoverage=67%, HitCoverage=9%, E-value=2e-11, Identity=62%"; Hit description =Glycoside hydrolase, family 1
MLRQVCGFYVQMSNFTKEEFVHILRRQCTAKEGGRGPSVWDTFTHKYPDKIKDGSNSDIAIGSYHH

SEQ ID NO: 188714 - protein, 90 aa, Glycine max
  Coding DNA Sequence Number=SeqID_71936
MRGFNGKKKDLIANIYGLDKFWESMAMAMTMVLASKIFCSDEDFVCQLEKIFSTIVHLISIRIHKTYGVGAYFCGVSIYGLEFVKFNIKS

SEQ ID NO: 188715 - protein, 154 aa, Glycine max
  Coding DNA Sequence Number=SeqID_71937
ERRSECEQYLLRWLKESDREVYIGPYFHQAHWQLVVLCPRQHVVVWFCSLRRKPDMHIKATINSSVMTKLKTTLSPETKAVAPKWIEVKSHVQTGCYECGYYVMHWIWNIIASDIKSDWSMQQLSAAIVPPSLALQQLTEQMKCPQSLDGCLVE

SEQ ID NO: 188716 - protein, 165 aa, Glycine max
  Coding DNA Sequence Number=SeqID_71938
  Gene Ontology: Mol. function=DNA binding; Biological process=DNA integration
  Homolog annotation: Hit_ID=Q1RSC7; Match level="QueryCoverage=81%, HitCoverage=54%, E-value=4e-25, Identity=38%"; Hit description =Integrase, catalytic region
PDKVTQVSKSEKAESRFSYEEYQEYLKLKSEKPSNQAQPSSVPCFSITCISQSIEGRNPWILDSGASDHIFCNKSSFSSFSLPKIPHLVTVANGSKEHGTGRLIGEGHESRGLYYFESSPPGSCFATSRPKLLHDRLGHPSLPKLKIMVPSLKNLRVLDYVLGFI

SEQ ID NO: 188717 - protein, 162 aa, Glycine max
  Coding DNA Sequence Number=SeqID_71939
  Gene Ontology: Mol. function=sugar porter activity; Cellular component=nucleus
  Homolog annotation: Hit_ID=Q1SNI6; Match level="QueryCoverage=90%, HitCoverage=42%, E-value=8e-39, Identity=64%"; Hit description=Sugar transporter superfamily
MVFLKIHDLLFLFTGKKNEDCSEKSVSKTRQRSSVQQQERCALVDISNDSPIAGLANGKDIIETPLSSMAKKKRVKKTMKTPGSGEALLRGQVKTLLQRVEEEAVISKLSMEIVAPFLKLANSSPMSLLAPTPANTPQVPNLSEVALVSPPSSVVEEQLISR

SEQ ID NO: 188718 - protein, 168 aa, Glycine max
  Coding DNA Sequence Number=SeqID_71940
MKRWIKEERDPSIKFIVVHAPERGIARCIQHIQHEYLCVRNSLKSRKKRQGGWLGLGVMPLADGGTMATRDERARIVGSKRASHVTLNFFFIVLKDVAKGTQGMANGAKGVSAYDATQIKGWRRAFWWWRSWIQKQPQAVFYAARCGNHTCCCHQRQKNHQNNNHSSS

SEQ ID NO: 188719 - protein, 331 aa, Glycine max
  Coding DNA Sequence Number=SeqID_71941
  Gene Ontology: Mol. function=DNA binding; Cellular component=nucleus; Biological process=regulation of transcription, DNA-dependent
  Homolog annotation: Hit_ID=Q70RD0; Match level="QueryCoverage=69%, HitCoverage=94%, E-value=2e-52, Identity=45%"; Hit description=MYB10 protein
  Pfam annotation: Domain name=Myb_DNA-binding; Domain location=104 -151; Score=47.3; E_value=5.2e-11; Accession=PF00249.21; Description =Myb-like DNA-binding domain
  Pfam annotation: Domain name=Myb_DNA-binding; Domain location=157 -202; Score=50.2; E_value=7.1e-12; Accession=PF00249.21; Description =Myb-like DNA-binding domain
  Pfam module annotation: Pfam domain module=Myb_DNA-binding::Myb_DNA -binding; Domain location=104-151::157-202
  Subcellular localization annotation: CTP_CleavageSite=62; ConfidenceScore=5.05e-01
MVAIMLVISVTMMVVVVVFVVVVVAASYGSENDGNGGSGVVVTMTKIVLMVVALVVMMVVVVAMMIAELEGQKVNMVGVKNSYKVSLQCKKAPILMEGSSGVRKGAWSQIEDNLLRDCVNLHGEGKWHLVPKRAGLNRCRKSCRLRWLNYLKPNIKRGDFSEDEVDLMIRLHKLLGNRWSLIAGRLPGRTSNDVKNYWNTYMRRKVHSHKKDNNIEKQADEAKPIVKHHEVIKPVPRTLSKTSPWLQGKFVNSSKVGVSEEGATSISGSAGNWWETLLDDKEDNAVNNNNTCFFGGADGEFNLWSEELTSIDCDFVTQGESWSDFLLDLQG

SEQ ID NO: 188720 - protein, 116 aa, Glycine max
  Coding DNA Sequence Number=SeqID_71942
MEGSSVKYNNVEKQADEAKSTVKQHEVIKPVPRTLSKAYPWLQGKLINSSKVGVSEEGATSISGSGNLWETLSDDKEDSEEGNNNKCFFGGEDGALDLWGEELNSIACDFLTQGET

SEQ ID NO: 188721 - protein, 644 aa, Glycine max
  Coding DNA Sequence Number=SeqID_71943
  Gene Ontology: Mol. function=protein serine/threonine kinase activity; Cellular component=integral to membrane; Biological process=protein amino acid phosphorylation
  Homolog annotation: Hit_ID=Q8LP72; Match level="QueryCoverage=94%, HitCoverage=96%, E-value=0.0, Identity=63%"; Hit description =Receptor-like protein kinase
  Pfam annotation: Domain name=LRR_1; Domain location=111-133; Score =14.2; E_value=0.47; Accession=PF00560.23; Description=Leucine Rich Repeat
  Pfam annotation: Domain name=LRR_1; Domain location=135-157; Score =16.3; E_value=0.11; Accession=PF00560.23; Description=Leucine Rich Repeat
  Pfam annotation: Domain name=LRR_1; Domain location=159-180; Score =10.7; E_value=2.9; Accession=PF00560.23; Description=Leucine Rich Repeat
  Pfam annotation: Domain name=LRR_1; Domain location=182-204; Score =12.1; E_value=1.5; Accession=PF00560.23; Description=Leucine Rich Repeat
  Pfam annotation: Domain name=LRR_1; Domain location=206-230; Score =4.4; E_value=43; Accession=PF00560.23; Description=Leucine Rich Repeat
  Pfam annotation: Domain name=LRR_1; Domain location=476-497; Score =3.0; E_value=80; Accession=PF00560.23; Description=Leucine Rich Repeat
  Pfam annotation: Domain name=LRR_1; Domain location=87-109; Score =4.9; E_value=34; Accession=PF00560.23; Description=Leucine Rich Repeat
  Pfam annotation: Domain name=Pkinase; Domain location=350-639; Score =115.3; E_value=1.8e-31; Accession=PF00069.15; Description=Protein kinase domain
  Pfam annotation: Domain name=Pkinase_Tyr; Domain location=350-639; Score=42.1; E_value=4.7e-15; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=111 -133::135-157::159-180::182-204::206-230::476-497::87-109::350 -639::350-639
ECEAQLSDPQSVTMAGKTQTHYFLLLFLFLISINAKLDLYPSDYKALLTLQKDLGVNGQVSATLACETEGVFCERRKLSGKETYALRITRLVFKSNNLNGVLSPSIGRLTELKELSLSDNNLFGRLPPQIFDCRKLQILDLANNLFSGPVPPELSSLTRLRVLDISTNRLSGNLNFLKYFPNLETLSVADNLFTGRVPPSVRSFRNLRQFNFSGNRFLEPSLQSSSPETILSRRFLLDGDGDVPAPAPAPAPNNSNKKKKSNASSGAAAAPGPAPNNHKHKKSRRKLLGWILGFVAGAVAGILAGFVFSLMFKLALALIKGRGRKAGPDIYSPLIKKAEDLAFLEKEEGMASLEIIGRGGCGEVYKAELPGSNGKMIAIKKIIQPPKEGAELAEEDSKVLNKKMRQIRSEITTVGQIRHRNLLPLLAHVSRPGCHYLVYEFMKNGSLHDTLSKVEVGEFELDWLSRHKIALGVAAGLEYLHLNHNPRIIHRDLKPANILLDDDMEARIADFGLAKAMPDYKTHITTSNVAGTVGYIAPEYHQILKFTDKCDIYSFGVILGVLVIGKLPSHEFFQHTEEMSLVKWMRKILSSENPKEAIDTKLLGNGYEDQMLLVLKIACFCTMDDPKERPNSKDVWCMLSQIKH

SEQ ID NO: 188722 - protein, 590 aa, Glycine max
  Coding DNA Sequence Number=SeqID_71944
GDAHSSTMVLLNYISSYAWHAKVVLTLAAFAVIFGEFWLVAQLSAENTLAKSVALLKQLPDIAENFMSMKPHFEALIRLVKAAMDVTMCIVEFKELPSEYISEDTPPMSVASTHIPIASYWVIRSIVACSSQISSFIGMRNESISSTTEAWELSSLAHKVSSIYEHLKNQLVLCYQYIDDKRHIEAFHNLIRLFETVHVDNMKILRALIYAKDDVLPLVDGTAKSRVSLEVLRRKHVLLLISDLDLSQEEILVLDNLYKDARARGDTQYEMVWIPIVDKATWNDMSKQKFEYLQSLMAWYSVYDPFIIEPSAVKYIKEVWNFSKKAILVALDPQGRLSSPNAVHMIWIWGNLAFPFTSEKEESLWKQEIWSLELLVDGIDPTVLEWMTEGKLICLYGGEDLEWIEKFTATAISVAKAGKFELEMAYAGKSNAKERMQKMIKTFTTRKFSYFWPNVTSIWFFWTRLESMLYSKLLHGRTVEKDEIMSEVMTVLSFDGSDRGWAIFCRGATEMARAKGDSALRCLQDFDKWKGRIEEDGVVHAINDYLNKNKPPHHCNRLILPGSTGGIPQKVVCAECGRQMEKYFMYRCCV

SEQ ID NO: 188723 - protein, 519 aa, Glycine max
  Coding DNA Sequence Number=SeqID_71945
  Gene Ontology: Mol. function=hydrolase activity; Biological process =aromatic compound metabolic process
  Homolog annotation: Hit_ID=Q9FFZ1; Match level="QueryCoverage=82%, HitCoverage=89%, E-value=1e-157, Identity=62%"; Hit description =Arabidopsis thaliana genomic DNA, chromosome 5, P1 clone:MAC12
  Pfam annotation: Domain name=Abhydrolase_1; Domain location=178-445; Score=39.6; E_value=1e-08; Accession=PF00561.10; Description =alphabeta hydrolase fold
  Subcellular localization annotation: CTP_CleavageSite=29; ConfidenceScore=5.22e-01
MEILSYGSGPCSQAVDSKWKLVDKCLNSRQSRFPSVGNGGVYYTNTISRSGSVRFHDTNKELQRDFGSLSALEGSKRTNCKAYSESCDGYVIGGEEDVADIAGVEEPATNKVVIPGLPDGSNGAPISSCFWEWKPKLNVYYEKAGCENVDSPHVLFLPGFGVGSFHYEKQLRDLGRDTRVWALDFLGQGLSLPFEDPAPHYNKEGVTSDGNASSWGFGDETEPWATKLVYSIDLWQDQVRYFIEEVIGEPVYIVGNSLGGYVALYSAARNPHLVKGVTLLNATPFWGFLPNPIKSPGLAKFFPWAGTFPLPTNVKRLTELVWEKISDPASIAEVLNQVYAENSTNVDSVFSRIIETTRHPAAAAAFASIMFAPRAELSFSEALSGCRKSNVPICLMYGKEDPWVRPLWGHQVKRQVPEASYYQISPAGHCPHDEVPEVINFLLRGWIRNLESEGSISLPLLEGLDSLKQANARELEFIREGSTKSVMVRFYESTFSLWDRIRSYINHRSKLRNSATKSQ

SEQ ID NO: 188724 - protein, 69 aa, Glycine max
  Coding DNA Sequence Number=SeqID_71946
MSEISTKIRRGRVQMKKNQIILMSHRRYNAKLSAASYKEGFVKYNYIVSGNLFMVEKGVGRLILGELEK

SEQ ID NO: 188725 - protein, 49 aa, Glycine max
  Coding DNA Sequence Number=SeqID_71947
MMVVIWWPSNDDSVKGLGEWVCVVVAMPARRSDSSVVAGSWRKEPWVGA

SEQ ID NO: 188726 - protein, 108 aa, Glycine max
  Coding DNA Sequence Number=SeqID_71948
MASRLEILQYLLGKTVCGLLYDSLAGFDDGYEEVQAVVMSDEGTEFRYINRRLEDDVELEQCAQRAIARSVREAKLGANIIMQGHLVHIRRLSAWSLKLAVLCMYAKR

SEQ ID NO: 188727 - protein, 549 aa, Glycine max
  Coding DNA Sequence Number=SeqID_71949
  Gene Ontology: Mol. function=long-chain-alcohol O-fatty -acyltransferase activity
  Homolog annotation: Hit_ID=Q84XY7; Match level="QueryCoverage=59%, HitCoverage=90%, E-value=6e-85, Identity=47%"; Hit description=Wax synthase isoform 3
  Pfam annotation: Domain name=MBOAT; Domain location=250-518; Score= -31.5; E_value=0.00048; Accession=PF03062.9; Description=MBOAT family
MNSDFRSFAAQYPLQPICSSFVDRWMYQRVDNKNQPSQTINFYLKLSQNKTVLANGFSMTGNNVPEAPLGGKTYASLVETWHVSFSVLIIFEENHFICRLRIGHACFQQQVYIADVQVKRNQSLYIGIKKATIVDYVISLEIIRNFKKVTIINWQYHAANYEKPEQFVNYGRRLKEKDDLTWLIHFCFHKAARLEREIVMEGDMMNLIKVCPSVVISLCYCYWIRKLVPPGIKRLVFLLPIICLYIFIPLSFSSVHLTGTIGFFLAWLANFKLLLFAFDMGPLSSHPLISLPRFVAVACFPIKIQQNQPRQNGKTPHPNPSSMIRYAIEGLALGVLLKIYDYSDRIHPKAIMCMYCFHIYFLLEIILAMVAAMARSMMGLELEPQFNDPLSSTSLQDFWGRRWNLMVTSILRPTVYDPTLKAAVNVVGPKWAPLPAVFGTFVVSGLMHELILFYMGRLQPTFWMTWFFVLHGIFLTVEIAFKRALTARCRLPRFVSGPLTVGFVLATGISLFLPEFIRCQIDVKAFQEYAELGQLLNNLTCGIFHNSNL

SEQ ID NO: 188728 - protein, 135 aa, Glycine max
  Coding DNA Sequence Number=SeqID_71950
MEEFSLQVGWPGVQPSSHGGGDVATYPSAGGRHGAHGAHGAHGCIFHGRKMRGVATNVYSRKTSENPERYGLRTLSVKGSGVVFTHGEGNRGRSLPPNSPRRARLLPPEATLPRKYSGRPKFKIPKLLFAPPLFR

SEQ ID NO: 188729 - protein, 116 aa, Glycine max
  Coding DNA Sequence Number=SeqID_71951
MEKTSGGCHQCLFKKNVRKTKRGLRILKRRVRELFTHREGKGHLVQGKLTQASQLLRLEGTSSPWRADCLRLKLSHGPSKPDARMGEFRSRKFQKMTILPLSLWLLFPDLTIKHQP

SEQ ID NO: 188730 - protein, 51 aa, Glycine max
  Coding DNA Sequence Number=SeqID_71952
  Subcellular localization annotation: CTP_CleavageSite=12; ConfidenceScore=5.07e-01
MGRPWCPRSLCGASASSAYASRFRASPPLPPEQGKSRLRARPPALGNPEEL

SEQ ID NO: 188731 - protein, 118 aa, Glycine max
  Coding DNA Sequence Number=SeqID_71953
  Gene Ontology: Mol. function=ribonuclease H activity; Cellular component=mitochondrion; Biological process=DNA integration
RVALMLMLCQILLSTKRAEATLSDVIGAIEPKASNGHPFILVAIDYFTKCVEAASYASLMRSVVIRFIKKEIICRYGLPRKIIIDNATNLNNKMVREMCEDFKIQHHNYMPYRPKMNG

SEQ ID NO: 188732 - protein, 128 aa, Glycine max
  Coding DNA Sequence Number=SeqID_71954
  Gene Ontology: Mol. function=ribonuclease H activity; Biological process=DNA integration
MCTFYVASTIDVLRKGPTSFVTEGRIARSAMVDAQDELKHEERVLPIKKKSLSFEAQDSLKEINLGTNDRPRTTKASGLLVEKDKNHIVKIITKYNDFFAWDYHEMLGLSRDLVEHEFSIREGFKPHR

SEQ ID NO: 188733 - protein, 140 aa, Glycine max
  Coding DNA Sequence Number=SeqID_71955
MEQFMLGDIPFDPAMLMSVWLSLAKLARDPTVFDTSRQLLNHIMEQLADLVEHEHLNKRVVDLITELGRIKKELAELNPKITLLNSKLKGSLHQLVQLYALVNSLDLNNNHILHQQKGLWKDLNASETSITEDRKEGDDL

SEQ ID NO: 188734 - protein, 114 aa, Glycine max
  Coding DNA Sequence Number=SeqID_71956
  Homolog annotation: Hit_ID=Q8LM74; Match level="QueryCoverage=63%, HitCoverage=4%, E-value=5e-07, Identity=41%"; Hit description =Putative retroelement
MRKYFGIQLKPMETPMYKKPYQEWVDHMMMPLPKGYKTLDFSTFSVDLMNMRKMVDKLTIDFIERFRKAKSRCLVQLLEVECAAMAAMAIKISSYLANSYEFTSPLILCELTLE

SEQ ID NO: 188735 - protein, 243 aa, Glycine max
  Coding DNA Sequence Number=SeqID_71957
MAADNMHPQLKEKLVAQEYVNVDEENVEAFEEEAKIIVAEILWGKPYSCHFKLVGKGATEMVVDTGPSPKKPKDPSQGLPYLKGCSPQNQQEVPEIDDNPIPHSKRKVVEFNVKNGIKTLRNTINNEGNNPSRMIKPSTKIEERKVLPKKNQQIEDSLLEAWLDDDELLGSEINVISLTPSDFWASSSQNERLDGDVFYEEIEGATIGDSEANKRIVITFNQPTLEMTKLLKPLYVKAYINVV

SEQ ID NO: 188736 - protein, 56 aa, Glycine max
  Coding DNA Sequence Number=SeqID_71958
  Homolog annotation: Hit_ID=Q9C641; Match level="QueryCoverage=78%, HitCoverage=5%, E-value=1e-13, Identity=80%"; Hit description =Probable elongation factor G, mitochondrial precursor
MSLGVPVCKQTVNWYIEPLPAGSSTKFEFENLLVGQAIPSNFIPAIEKGFKEAANS

SEQ ID NO: 188737 - protein, 151 aa, Glycine max
  Coding DNA Sequence Number=SeqID_71959
MAYVKKEASKLSLIGVFFYKKLTRWKPPKTPTPPGSFIKRMLWKQSFQAYFDDAKNSSQESRFKSSLINTGLKRLTAFGFIARSGFASWLITGLKRLTDFGFIARSGYNFLVVITGLKRLTTFGFIARSGHNFLVVITEDKGGDSFVVHCL

SEQ ID NO: 188738 - protein, 208 aa, Glycine max
  Coding DNA Sequence Number=SeqID_71960
  Subcellular localization annotation: CTP_CleavageSite=31; ConfidenceScore=5.44e-01
MVLGTFPHHPTPAFIAKMGRSLPPSSPRRASCFLTKVTEAPLCHFIAKWGRWLPPNSPRQAGLLPPEATKCPESSRWAQMGAMLVVATYPFTSERGEAHRRENNLNDRLKLVKNGRKETEIEQNKNESQETRNELKVSDLETYPLKNEERMKNGGKPSRICLRKRLGSITEAPRLGFSSRKQFFSPKTAEIHHQGDPGPLEQPPSAYL

SEQ ID NO: 188739 - protein, 119 aa, Glycine max
  Coding DNA Sequence Number=SeqID_71961
  Gene Ontology: Mol. function=DNA binding; Cellular component=oxygen evolving complex; Biological process=DNA integration
  Homolog annotation: Hit_ID=Q1SKN1; Match level="QueryCoverage=95%, HitCoverage=7%, E-value=1e-25, Identity=50%"; Hit description =Integrase, catalytic region
MVIPLGFEVARTSTGINLCQRKYALDVLTNTGMLGSKPVSTSFDYTTGLYQHYGFPLSAEDASSYRRLIAHQQAASQILRYIKGSLGAGIFFPTNSSIQLKGFSDSNWADYIDTKRSIT

SEQ ID NO: 188740 - protein, 182 aa, Glycine max
  Coding DNA Sequence Number=SeqID_71962
  Gene Ontology: Mol. function=RNA-directed DNA polymerase activity; Cellular component=mitochondrion; Biological process=RNA-dependent DNA replication
MLTRFISKSLQHALPFFKLKRKGTKLKWDEKCEATFQKVKEKLPPPPMLVRLEVGETLYLYLVVANKAISVALSPRNIGAIVLLESLYGLIIEQALTFAFPTTNNQAEYEACISRMRLEEGLGAKKIKSWMNPIATYLVDGKLPSDNKKARKLQMMTLAYWQKFTREAVDITWVESLWSEKH

SEQ ID NO: 188741 - protein, 428 aa, Glycine max
  Coding DNA Sequence Number=SeqID_71963
  Homolog annotation: Hit_ID=Q1SS26; Match level="QueryCoverage=49%, HitCoverage=25%, E-value=8e-12, Identity=23%"; Hit description =Unnamed protein product; no similarity, hypothetical start
MEKSEKKNFSEKKMKKAYITWDDNDMESSEDSENEEINLCLMAKSYESDEEPHSRSRASFIPNLQILISSSILHQNTSRKAQSSSFSLLFRFHRLKFTKTSSNGRIIEEEKGIILHHHHGPSEAPTTPIHPPLSSPRSSTLFSSNDQRLRYLSQFSSKIILDPKYLDIDFFNDETFNCYQVFQNSGLVDFMSLKLPYYPELVKVFYCNLKIQDDIISSEVHGISMIIDQSLFFSLTKLPNQGASFEGTIVDDWKFDYSSYDACRMVCNDQAEMTGRLLARSLTFDNRIMHYIIVRILLPQSSNLAQASEEDLILMWAFLIGRQIDWAHLVRYRMHKALRANAPLPYPQLVTLFLCHFQIPLDDEPFVQVKRSFAIGVDERIPSPPTQRDDSALMTEVLSVLRGLRTYVEEDVGYIRQSFDLPPPPPPS

SEQ ID NO: 188742 - protein, 166 aa, Glycine max
  Coding DNA Sequence Number=SeqID_71964
  Subcellular localization annotation: CTP_CleavageSite=59; ConfidenceScore=5.23e-01
MDGGFQSSIADKGLSHISSSPAHRRWYRSSEVNRRFNPIVKSCPTPEAILGKNRKKPPTTSHVGGPPLLMFLNCGKWRFLRSYCRSLTKEEFLKIQVDLATTRAYTSLEVVEEHKKVFHWFRSYNVMTTSNSDNSSFDKDSIWTMSGEASEPTYNMIIPPIPLRME

SEQ ID NO: 188743 - protein, 187 aa, Glycine max
  Coding DNA Sequence Number=SeqID_71965
  Gene Ontology: Mol. function=DNA binding; Cellular component =endoplasmic reticulum membrane; Biological process=DNA integration
  Homolog annotation: Hit_ID=Q1S785; Match level="QueryCoverage=98%, HitCoverage=26%, E-value=1e-27, Identity=40%"; Hit description =Integrase, catalytic region
MPKLDESFIDIRLDEGIGPLIEQYPETDVSNQVTEQPQEEREPTRLILRKNHPECQIIRDPSTPQPKSKQKDLSENKLVELPQGKKAVGGKWVFRNKLDKAAKVVRNKARLVVKGYLQEEAHKKLRPYQMDVKSAFLNGVIQEEVYVEHPLGLRVTLFHTMFSNSTKHCIDISKLPKIGMNILVHFL

SEQ ID NO: 188744 - protein, 411 aa, Glycine max
  Coding DNA Sequence Number=SeqID_71966
MKGIIVDPEWVVLVVKMAMGGLVVGLEEWVEHLLVVEVGVRGVGSFGVISHHLIPRVELEALFLPFIIDGQSWENSVRHHLDVSASTNVESNGISWDTLVSSKKGYPELLWHLGAEPHIQQMKYGCDCTSSIEVKSLAHVVFGWGLQLLLHVDPSNGNLDVLIGERGFLVCTSGGLDGLASNSCLPLLWKGQGDDWLIMPLLLLDNKNGLVPSDVNFHYLQVDNTKVLLFGNKSSLADDGVLGVLVQSFKDMEYLVFPEEFVHEGGIVYVITPPKVFMFFGLLLVFLVCASFPSAPSDLCDGLHGQHNFLSKNLGHNGLPVLKLSVPLEHPNEFWVYQLWIVEVATNFTKKQSQDLPAYNVEEVFNVNNRFSINVDGNGVCGVDGCVLARIVKIDCCPNFSEFIRECEQFL

SEQ ID NO: 188745 - protein, 176 aa, Glycine max
  Coding DNA Sequence Number=SeqID_71967
MIQGESKGCARSDLENTCKPRVALRILGKLPSPKIDKKRKRDKKLLDPEFTNPKNAPISKVQSKEEKNPEGSRIDSVEIFTTYQYDGSNWVEIEPKTDKYSLDSKEEEAPRLGEKPQGSRNEYVNQAENYVCLFSDKNVDKDKAYKEQLGNTNVPTTKNVLHHDKAIDMENIVIVE

SEQ ID NO: 188746 - protein, 89 aa, Glycine max
  Coding DNA Sequence Number=SeqID_71968
MFPQSQRYLSANSASPLCYTDRTRGFITGNKLLINELGPTASDALEVRPKNIVWDMVPNVLIQFLLQELAELVHMATYGYVEDETWQFC

SEQ ID NO: 188747 - protein, 67 aa, Glycine max
  Coding DNA Sequence Number=SeqID_71969
MDRFGRIVVQIRNLNPEVALHSMLLVLRPGKFVDSLCKQKASQQHGRVTRTSQRLHLNGGDVKVQKR

SEQ ID NO: 188748 - protein, 52 aa, Glycine max
  Coding DNA Sequence Number=SeqID_71970
MVVGGGLELSKGVSHLRLDRVLTIGEKRVREIICHPSSPVANDNAFVLLYQS

SEQ ID NO: 188749 - protein, 55 aa, Glycine max
  Coding DNA Sequence Number=SeqID_71971
MFRLGKVILAPAVNHLIDIGTDHGAISGIIKIFEWVVATTTQGVTRVDARTHINM

SEQ ID NO: 188750 - protein, 77 aa, Glycine max
  Coding DNA Sequence Number=SeqID_71972
MGSLATVRCSEGEGTGIERCGGRRRQTRYADGGVTVADVFECREDVLRWARSVAHEHGFVAVIFVGSSGLRIIKKGG

SEQ ID NO: 188751 - protein, 102 aa, Glycine max
  Coding DNA Sequence Number=SeqID_71973
MIVDMLQVFYYEKITGYTPSSFVDLVFAGKRIEVGQKRGKFDHPALTNKKPGANREDEKEEGTHAVTTVPTWPNLPPAQQCHYSANISPSNYHHTINHKGHP

SEQ ID NO: 188752 - protein, 85 aa, Glycine max
  Coding DNA Sequence Number=SeqID_71974
MQSSSQKQPVLSMEEFLSQVAWPGVRPSPLGGGEASAAQEPVPEEDEPIPPEPFFYETDPASAQEEVASPKPVPQSSPALVLDDP

SEQ ID NO: 188753 - protein, 40 aa, Glycine max
  Coding DNA Sequence Number=SeqID_71975
MCIDYTDLNKACPKDAYPLPNIDKLVDSASKFQRIISNWA

SEQ ID NO: 188754 - protein, 80 aa, Glycine max
  Coding DNA Sequence Number=SeqID_71976
MEKEDQSRISWDDKSDFCVLKINGIKTIVKSYLPIKDAYVHLGIDGLLNILINMLSYREISKDLQLRYISFTTLHILIDQ

SEQ ID NO: 188755 - protein, 308 aa, Glycine max
  Coding DNA Sequence Number=SeqID_71977
AVKSNHQLSSKVENTATEKDKLAKVITDSEAWLQESESKLEKSELRVSKEKKANKQLEEELLVFKKEVGFFAKLLDEEEITVVEEDAGEEQGDGANFDFHLVEGLANQSGGTSYLRISSLIWAFGYTRCSSKGEGLQGRALGETWQRRGSPRADLRFDELWTRDAFVLGFGEDLGFVEPLEKRDSPRVNLGFDEPLEKRDSPRADLGFDDPLEKRYSPRADLGADLGFVNPLKKQDSPWADLGGSPRADLSFNKPLDKQDSPRADLGFDEPLEKQDSLRVDLGFDEPLENRPVTCLSWVLSRLTKGRP

SEQ ID NO: 188756 - protein, 242 aa, Glycine max
  Coding DNA Sequence Number=SeqID_71978
MLVELETKDEVQKMTKIKEEANKLRASRRYNTKVQPRAFQPGNLVWRVRGLPLVSLDKTQDRHVTGRFSKGSSNPRSTLSESCFSKGSSNPRSALGPPLVSLYKTQDRRITGQFSKGSSNPRSAHGESCFFKGLTNPRSALGSSNPRSALGEYLFSKGSSNPRSALGESRFSKGSSNPRFTLGESRFSKGSTNPRSSPKPRTNASLVQSSSNLRSALGEPLRCQVSPLQKSKEHKKPKVCPW

SEQ ID NO: 188757 - protein, 104 aa, Glycine max
  Coding DNA Sequence Number=SeqID_71979
MKARSTSDSMTQACQPLEGGGLIIRSLIVCPLRGGAANGNDLSVYQGLLNRALESLPPIPMVAQITLVQTGGLDKLDKPVLTLIEVTTIRDRGSSNMEQPKAKA

SEQ ID NO: 188758 - protein, 150 aa, Glycine max
  Coding DNA Sequence Number=SeqID_71980
  Subcellular localization annotation: CTP_CleavageSite=40; ConfidenceScore=5.23e-01
MILPPSASRGARRSGGGDVRVSPRNKRSHSVVLPSSLPVVAGYEWVRDNVLKYRSSITSAVSIVALECQLKLAKMVIQSCGSDDFPFLRATSGKIGWVSLNSASKKLFEFNSNTFCHFKDHFFKVLVTNVVVDGLALMFSQDEEPRFPFY

SEQ ID NO: 188759 - protein, 124 aa, Glycine max
  Coding DNA Sequence Number=SeqID_71981
  Subcellular localization annotation: CTP_CleavageSite=66; ConfidenceScore=5.05e-01
MSGSAFGFIGRPGYCCCSCSFNSSFPAFLEGFYLSSFFGYYTDLFGRPCHSSTFHCCCTRAEGGVTAAGASEILPLSSSTFPISTSDVLASAPPSPFSRPSVSLDHVYTSRDTDLIWSIGYMPK

SEQ ID NO: 188760 - protein, 215 aa, Glycine max
  Coding DNA Sequence Number=SeqID_71982
  Gene Ontology: Mol. function=nucleic acid binding; Biological process= DNA integration
  Homolog annotation: Hit_ID=Q1SJY4; Match level="QueryCoverage=82%, HitCoverage=45%, E-value=3e-18, Identity=30%"; Hit description=Zinc finger, CCHC-type
CLEETIQMEDNNGQFITEGTFLQMEDNNGLFIITDGDILIPRPEAEWTNDDLAIMELTPKAKYTLTCVLSKNEYKKICRQKTAKEIRDSLSINYEGTMDVRLRKVTTLTRHCESFAMKDEELVDDMFGRLQVWEPKTTTIQEVRDLKNLAWDKFLGILRVNEVHLQKKDHLQKKDYVALKFGEISFRRKEKKNLSKTLKVQMAESDGLENSYPKL

SEQ ID NO: 188761 - protein, 102 aa, Glycine max
  Coding DNA Sequence Number=SeqID_71983
MIGTNNQGFSPKTDNNTKSNGPIFEHKPSERKIYPPVTSNSKFHLVVHKPIFHKKANYYKGKEPMAEDNEANALRQYDRLKAHYLGLELDKKPPTDEVHHVV

SEQ ID NO: 188762 - protein, 358 aa, Glycine max
  Coding DNA Sequence Number=SeqID_71984
  Gene Ontology: Mol. function=protein dimerization activity
  Homolog annotation: Hit_ID=Q2R3V9; Match level="QueryCoverage=63%, HitCoverage=32%, E-value=3e-08, Identity=23%"; Hit description=HAT family dimerisation domain containing protein
  Pfam annotation: Domain name=zf-C2HC_plant; Domain location=69-124; Score=53.3; E_value=8.2e-13; Accession=PF07567.3; Description =Protein of unknown function, DUF1544
MGGPIKERRGTCSRMILINDSDDDYHVLPRKCGKSDDRNDNPPSEKLFLENVASLAGSALVKPNGDNLDMAWEWNSLKDISNKRAVTCDFCLKTTNGGITRAKKHQIGLEGDVSACKKIPPSIKLKIKQAYEKKKAVKFGLEEENDDDEVEATEEINLRAGKRRAKGSITQGSIHGHMNTLKIIELSNKLTLGMAKRKTCIRDASIKKARAKANRCIAQFIRENEIPFEVACSKGFKMMIEAVGDYGQQLNPPSYHKLRAPLLKEQSELTKEKHKPHEIEQTQYGEAIEDEPVVEPLRLTCGVVDDAIKLGEPSRLTIEAPIEEEKEEAKQEENPKPKPEINKRYARKSRRDNALVQV

SEQ ID NO: 188763 - protein, 60 aa, Glycine max
  Coding DNA Sequence Number=SeqID_71985
MVKGESGDNVALYDSELLSLEMGWDLMESCSSGGKLRVPLVKPDDDSMDAKFVALVFKSI

SEQ ID NO: 188764 - protein, 63 aa, Glycine max
  Coding DNA Sequence Number=SeqID_71986
MSAQREAITIPQDKTQTQANKRNMGLKVSVEEVRDVDARVPVPIQEDKHGPKGPVKPNDDPLY

SEQ ID NO: 188765 - protein, 68 aa, Glycine max
  Coding DNA Sequence Number=SeqID_71987
MVNINPSTGRGSGSHKEKFHTYLGMVARKKIPIVHNSWKTIPESPKNMIWDDILGKFDIPEVSALKKK

SEQ ID NO: 188766 - protein, 218 aa, Glycine max
  Coding DNA Sequence Number=SeqID_71988
  Gene Ontology: Mol. function=DNA binding; Cellular component=nucleus
  Homolog annotation: Hit_ID=Q1RWS5; Match level="QueryCoverage=95%, HitCoverage=62%, E-value=8e-28, Identity=42%"; Hit description=SBP
MEFGGNMFRLGNRDQNGNTNNNGNAFAWDSWENPTNSNNNNNNNNNSSRLVNAFHIPVASGIPSMDDGSVHVILHETAGLASAVMFLPQNGGVLGHRQQQHPYGGDGSHVHPDPHLMSLKLGKRHYFEDTSGSGSVVGAATFGGGLVFGDKRGKGYSSGGGAGVKAAGFAAATVPRCQVEGCHVALLNAKDYHRRHKAWNKGFANSVAGPNSLIIFLK

SEQ ID NO: 188767 - protein, 88 aa, Glycine max
  Coding DNA Sequence Number=SeqID_71989
MSKEVDMNVETEDEPAVAYEIGFVTVIVRSDTNIGMRERTSFVLIGCERSGQYRVKKKDLLRIMTGSRKCGCPIKPHGRLVVGGKGWM

SEQ ID NO: 188768 - protein, 33 aa, Glycine max
  Coding DNA Sequence Number=SeqID_71990
MAHERVDISVLVVDNDDTSLAIVANVLNSLGYK

SEQ ID NO: 188769 - protein, 273 aa, Glycine max
  Coding DNA Sequence Number=SeqID_71991
  Gene Ontology: Mol. function=monooxygenase activity; Biological process=electron transport
  Homolog annotation: Hit_ID=Q1T1B4; Match level="QueryCoverage=77%, HitCoverage=51%, E-value=1e-18, Identity=25%"; Hit description =Cytochrome P450
MAARFSAINSRNAALHLVERSEGESQESLLDDRRERAHPPADHKNGESPTINILSNIKGRVNALPCRTFKAKYYPRRNFMGASLGNNPSFVWQSLFSSKMVLKDGFRWRIGNGKDIDVWGTTMALEGRKMLASQPQSWKEGATLKNLLRTRDRLRTTRGVSCPIICPLSNTNVESTAHIFAMCHYLLWDGKQESDEEVIHRGDMLFYDWSRAKNYYPTENTRTKLAVNSTWSPPAAGAFTCNVDASFFMDVNVTGMRLSVRDDRGSHVVSRTE

SEQ ID NO: 188770 - protein, 54 aa, Glycine max
  Coding DNA Sequence Number=SeqID_71992
  Gene Ontology: Mol. function=DNA binding; Cellular component=nucleus; Biological process=regulation of transcription, DNA-dependent
  Homolog annotation: Hit_ID=Q1RWS5; Match level="QueryCoverage=72%, HitCoverage=12%, E-value=3e-15, Identity=97%"; Hit description=SBP
  Pfam annotation: Domain name=SBP; Domain location=1-38; Score=4.0; E _value=0.006; Accession=PF03110.5; Description=SBP domain
MNFLIFRFHVVSEFDDSKRSCRRRLAGHNERRRKSSHDSVARNSSQAVYTLLGV

SEQ ID NO: 188771 - protein, 108 aa, Glycine max
  Coding DNA Sequence Number=SeqID_71993
MVSPKPLYLGHASHRAGRARVSQQPRAQPKPVIPKLNEEVCSDTKAVDADIEGEDVDSINPMVDQRTQKQTQLPVRFQHFEMLSNNAVNVEGDLMHFALLVDIEPIDY

SEQ ID NO: 188772 - protein, 528 aa, Glycine max
  Coding DNA Sequence Number=SeqID_71994
  Gene Ontology: Mol. function=two-component response regulator activity; Cellular component=nucleus; Biological process=two -component signal transduction system (phosphorelay)
  Homolog annotation: Hit_ID=Q9ZWJ9; Match level="QueryCoverage=43%, HitCoverage=36%, E-value=4e-28, Identity=32%"; Hit description=Two -component response regulator ARR2
  Pfam annotation: Domain name=Myb_DNA-binding; Domain location=101 -151; Score=27.2; E_value=5.7e-05; Accession=PF00249.21; Description =Myb-like DNA-binding domain
MSADGRSTVISKSFANGAAQYILKPFSADDFKDIWRYAKKLSIQNNEGGSVPGDNTSIQDVNSATSSNMNKRKRKYCPRMSSQMNKEGQSEESSRLVKKPKVVWTTYLHNRFLLAIKQIGLEKAVPKTIVRVMNVPNLTRENVASHLQKYRIFLKKVADKGLLEGLSNRDLRSRFASGLSASMINDIQAKREKSRVPAQQFIKRIEHQSGYGGIANVVKPYNNVSSVTNTPLGRLHQFPHPCHKGLNLNTMLHNQRHGSSSNQARLGAQYSSFGSNARANNIQQNMLGSYANQPYYAQSSYNNAGVVFPSDGVMGHGLMNFTNGLRGGMNHGANQFMYPNYGSFGNNHNLSNGQGVFASTSNAGEGCSRELPKENIQGNLTLPQQQLQGNVAENDIGTSIGENNFNQLNEDDFSDLFMMLDEMDLNETGENHNANDFLKSDFSISNHAVESLEKSNRVCEVIINPTEGTSNMPDETSTSSNKSSNKMGGDDEHANMEPLDRFVMNDVSSGNNSATDEASQHTKKCSCY

SEQ ID NO: 188773 - protein, 97 aa, Glycine max
  Coding DNA Sequence Number=SeqID_71995
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=62%, HitCoverage=25%, E-value=4e-23, Identity=80%"; Hit description=MADS -box protein 3
  Pfam annotation: Domain name=K-box; Domain location=39-97; Score =17.6; E_value=1.5e-05; Accession=PF01486.8; Description=K-box region
MRFADEFMFMLSDGLLETVGILFMFTIYTTTTTKTIEQYHRSSFTPQDEHVECETQSWYQEVSKLKAKYDSLQRTQRHLLGEDVGPLNIKELQNLEK

SEQ ID NO: 188774 - protein, 55 aa, Glycine max
  Coding DNA Sequence Number=SeqID_71996
MGLWVGFYRGKVMFCLAMIGYLGKFGGSADFEPLAKLILWLSKPSAKRSSSWLSA

SEQ ID NO: 188775 - protein, 316 aa, Glycine max
  Coding DNA Sequence Number=SeqID_71997
  Homolog annotation: Hit_ID=Q1SP02; Match level="QueryCoverage=26%, HitCoverage=18%, E-value=7e-09, Identity=40%"; Hit description=IMP dehydrogenase/GMP reductase
  Pfam annotation: Domain name=DUF1723; Domain location=95-144; Score =61.8; E_value=2.3e-15; Accession=PF08330.1; Description=Protein of unknown function (DUF1723)
MVRTRGLGRALNRVIGRVIGREQQRPTTFARSQWEATPVVEDVQHVDHAVDKERPELKLSSYGRKVEKFGRPAPDIEGLVAATRLSPLITCSLDTSDRGLISAFVERWHKETSSFHLSVGEVTITLNDVAFLLHLPITGVFHNFEALHMDEVMLLLVELLEHFPSLTSCIAAEDYHERKPRPYGDHRTFREFELIALLFGHTIPPHPTASTLCIEDINDRWIQFSEYLAPLGDPPRHPPVLHDDAFIEPDIPQHPVATTAMDEAPIDAPTHVEQPRHALDACQAIIERLERLLNLRIVIEGTKAYTVMEDSLRIAR

SEQ ID NO: 188776 - protein, 460 aa, Glycine max
  Coding DNA Sequence Number=SeqID_71998
  Homolog annotation: Hit_ID=UPI0000162A17; Match level="QueryCoverage =17%, HitCoverage=30%, E-value=2e-10, Identity=68%"; Hit description =DNA binding / protein binding / ubiquitin-protein ligase/ zinc ion binding
MLFKFHDDPTVNESEIVIFLRQAVICLDGDGCKVRNGLATIEGDSDLDTSIACDSCDICICDKFITNTVRSIVKSNRCLLLTGIMPSVWDLILKVHQTVHGYAPVSKGTSNSVERTTVECNADDHNSNSECHAKDSFSGKVSVSVADTGETVVVVSMVNQTIWVPATSEKILLPFEVGGYPMTESCILMSDTNGQQSGEVKTETNTLRIMEEEELELSLSNNISCSVTSKSLVHNDLKKSVRGARDDPSGFDGTKLFDESLTKTSPSKIESEMGLQLGLSVGSFLSDKNETKDQATDVLCLSSEECFLKAFIPVFKPYNVDNKIISGDEIEANACKDNAKVAEREDVKMLWDEAHCALVLTPHAYYTLTDDSNMDTRPNTNTNALTCDEQVYIKADDGDVKPELPEEDDKSELPEEDDKSELPNEIGQKKIRATGSQMTSTNDSADAHLLENAQKCTREN

SEQ ID NO: 188777 - protein, 259 aa, Glycine max
  Coding DNA Sequence Number=SeqID_71999
  Gene Ontology: Mol. function=transferase activity; Cellular component= chromatin; Biological process=DNA integration
  Homolog annotation: Hit_ID=Q1SXA8; Match level="QueryCoverage=99%, HitCoverage=22%, E-value=1e-56, Identity=39%"; Hit description=Zinc finger, CCHC-type; Polynucleotidyl transferase, Ribonuclease H fold
MERKNRSLEEGARTLLNETRLPKYFWANVVHTVCYTLKKVLIRPILKKTPYELYKGREPNTLHLRVFGCFQEKDFVLEDDIKAEEIKQSKEISTTMPKELPREWRTQKDISLDNINGEISKGVSMSSRLRILCNNMAFVSQVEPRNIDEAFCDEHWLMAFHEELFVCDLVPKPTSHKSTETKWVFRNKLDESGIIARNKPRLVAKGYNQEEGVDYDKTYALVARLFQIDVKSAFLNGHIEEVYVDQPPGFVDHEHPDYD

SEQ ID NO: 188778 - protein, 89 aa, Glycine max
  Coding DNA Sequence Number=SeqID_72000
MGDKTKFDSLKANEGEYVTYEDNNKGNILDIGNTYMLNIDCVTSSHLTCFISNDDIIWLINVKFMRNWAILQGSLTQARYRPLKPGQIE

SEQ ID NO: 188779 - protein, 90 aa, Glycine max
  Coding DNA Sequence Number=SeqID_72001
LVEWILPTPTPYGLVELVQVIEVSSSEEDLEEDPEELPPEPAADAPDFPEDDEDPLPNVDSPEDIMSASEADSTEESGPGGTANSDDSSS

SEQ ID NO: 188780 - protein, 261 aa, Glycine max
  Coding DNA Sequence Number=SeqID_72002
GLVVSNDSSWLSPVVWAMEEEVGGVGRKVARLGEFYSNKFYCFGRYNNQQKGIDFGETYVPLARVEVVRLLLAYAYVMDFKFEEAKLHGESKVIQRGYIYLGLTENKRGYISCGSVLVEGTSTRFKENKGEYIPCGSLLVKGFLQAKLLPWSPSEENKPWDISPSNKYCKELLKKFEMDKSKKVATPMATNCYLSADEKEKSIDQTKYTVKKIMKYLRGALDVGLWYPKGVEISLVGYLASDFVGCKLCWTSGLSYLKKRG

SEQ ID NO: 188781 - protein, 117 aa, Glycine max
  Coding DNA Sequence Number=SeqID_72003
PQHQKPGTELLPPSPFHLKIMVRTRGLGRALGHVTGRGDRDDSDDAPQRRRPIASARRQRVAVTVAHDEPVVPAPDVEANVFSDDPMAPADSEDIVADIPADTGAKAAEDEHEGFLG

SEQ ID NO: 188782 - protein, 120 aa, Glycine max
  Coding DNA Sequence Number=SeqID_72004
  Gene Ontology: Mol. function=aminobutyraldehyde dehydrogenase activity; Cellular component=chloroplast; Biological process =metabolic process
  Homolog annotation: Hit_ID=Q8VWZ1; Match level="QueryCoverage=66%, HitCoverage=16%, E-value=3e-27, Identity=72%"; Hit description =Aminoaldehyde dehydrogenase
MFIVFYESLLYAEKVEEGTKVIIFNSKKLRFLTHFYLRQITEKKDEPGKLEVIDYGEPLDEAPADLDDVIDCFNYYAKLAEGLDAKQNAPVSLPMETFKSYVHKEPIGVVALITPWEKDS

SEQ ID NO: 188783 - protein, 165 aa, Glycine max
  Coding DNA Sequence Number=SeqID_72005
MVKRGHEVPSVKRIQRGPAKQKTLTLKYTKLRFSSFNLGWWPGCILNKAEVQVLAVAKSFSMPSLFSGDDTNTIAGGVGGNSSVSNISGDGNNGDKDDSNSSGNTNVGGDDNGVMLMTKRIVVTVTTMVVVSVSMIVITIMIMLMLGTTRILVLMVMIVVLVLVV

SEQ ID NO: 188784 - protein, 109 aa, Glycine max
  Coding DNA Sequence Number=SeqID_72006
MTRGHPFVDHIMEADLPLGLKPLNLERYDRATDLDEHLDAFFTKANLCTNDDAILCRVFPMALKGASLTWCGGLPPMSIDKFDTFVERFNSQYATSHLHRMTFAPLASL

SEQ ID NO: 188785 - protein, 224 aa, Glycine max
  Coding DNA Sequence Number=SeqID_72007
  Gene Ontology: Mol. function=ribonuclease H activity; Biological process=DNA integration
MTTFGQGQLSSHGASKLAWTKGLIPTLIIYKPSLGDQDGVFDVDSCDDTADKGPKPIEEFVKLQLRPKLEQRMQTSLFKWQPFDMPGIHPNIICHKLAIYSQAKPVSQKKRKMGEEQHKAVKKKGHALWPKKCKSYISKTNGPDLQTTYRTKCRGLCDNMVVKSRNVSQHVAGLKEVFGEICNYDMRLNPKKCTFRVAEESSWVHDHTSGNRSQPRKMHNHTSV

SEQ ID NO: 188786 - protein, 442 aa, Glycine max
  Coding DNA Sequence Number=SeqID_72008
MESEGRTWLFIMFDMSSGSLIVEVVTLTNLRIAGLSSPPAWTNIVRIKIDRLSRVSVLFIPSSRGSCCAHHGSMQFLLGIMGFLPYTSSLSNCLIHFKEGLPIGDSSSEESPHGASDSGSSSFERLVDPGLAGKGGSRPCEGYQVNLWFRSPLPCNSYFFFHYTGYINTLGSSCFSSSLFYGGAITKRWYDAIGVLENFPSPSSALPPSALTILPSVMPSSSSRPGVSLDHRSLDIFKENGQRHNEALNKITSFEVEVTKWRAIAWTLWRVEHPKVANTIVALAKLVSTRLDGNEVFKRCKDLFKERNDLATKVERASKEKEKLNVTVAESAKVITDLQAQLRELELTMSSFQTKMKEFKLKESKEKEEKKKLEENLLMCKREGLDLGLFGPFKDMKDDQLFEEEEIAAGGKDNGKEEDDMANILSFSPKATRSYSSRKLNQ

SEQ ID NO: 188787 - protein, 681 aa, Glycine max
  Coding DNA Sequence Number=SeqID_72009
MNRNVIQGVLKKHGVSSVRRTIGGTYKTKVSDTQGDNHDRCESCRFVKLVKTPAWTSVAQTVSAKLSKEDIFFILQVKFDMSVQHTHVTLAYMSLEEWTHIGDAVCGANFQDTFPFTMSFISDSAIGMGRSDSGASIQQLLMEREFIPIAAPPRRGHTMKLLIAIPLSLSGSWTHAVLEGVLLVPGARMSGGGDARVPPITGVAALRLANLEDSCKMVFQACGSDDFPFLKTVSGCPPFFIVYRCLFEVLGLLLPLNSFECATLEHLNVAPSQLHPNSWVVGRAFKDRFFKVLATDVVAHRLPLMVPLPDLLTLVERVDKAILEKLLATLDARAILSFPSVNDPLAALYGKIFYHVSFLFDVGPAGGIVSPFVVKPPIGERGQPATRVDPNDDEVVEAIGLMSDLGHPSIASSQGPLSAPLAMQATSTTHAPLTSPCVPTQEADVAKWKVTTRNVWRVERPKVANATVTFVEVIRSNHQPSSEVGDVLAMLLRTKLDSDEDELAKVVVDLQAQLKESESKPEEFELGASKEKKANKELEEELAIYKAVRQVRFFTKNLDLGLFDPFKDVKNGELLHEEEIAVIEKDANGEIGHLDKSEILEASCHSSGLANQSGGISFCLEEPRPFDYAHHSFKRVSLPCSPRENIRFVEPLEMRDSPREDLGFDEPLEKRDSTRVDLVFD

SEQ ID NO: 188788 - protein, 165 aa, Glycine max
  Coding DNA Sequence Number=SeqID_72010
MRVELEMKDEVQEIARIKFTLGKSRQTQDERVPGQISKDSLNPRSTLGESRQTQNKRDPGRISKGLSNPMSALGESHPTQDEHVLSRISKGPPLVSLTRPRMNVSLIKSPKAHQTQHLPLVSLAKPKMNVSLVKSPKAHQTQGPPLVSLAKPRTNASLVKSPKAS

SEQ ID NO: 188789 - protein, 127 aa, Glycine max
  Coding DNA Sequence Number=SeqID_72011
MAARGGYRLLWVVKNGFLGFGTCAWRVCLAIKDVQRCYFTNPNGKNMQTWVANIKSKFEVIEISWHYRGQVLDLAGQHRHGKEGQWKWHMCTKYTGINKAHPKDAYPFPIIEKLMDGAPDFQNVGAI

SEQ ID NO: 188790 - protein, 109 aa, Glycine max
  Coding DNA Sequence Number=SeqID_72012
  Homolog annotation: Hit_ID=Q1S6B9; Match level="QueryCoverage=64%, HitCoverage=14%, E-value=8e-16, Identity=56%"; Hit description =Senescence-associated
MWKTFPLENDVIAAKSPFVPPEATEEVLLWIPGVILNLIDKDYNVDLACSDFFGILFWLGDKVVSVYMRVADEIQWLLAKDTTVVKGSGPDEEEEDMPNYDLTVTAYAV

SEQ ID NO: 188791 - protein, 226 aa, Glycine max
  Coding DNA Sequence Number=SeqID_72013
  Gene Ontology: Mol. function=RNA-directed DNA polymerase activity; Biological process=RNA-dependent DNA replication
MTNNDAFRQLQAHIAKMEYRHEEELRKLKAHHDELEACTNKTLDDHNILHAHCHEGQTNQRHPFVHCIMEVNLPLGWKPLKLERYDGTTNPDEDLDAFLTQANLYTNDDVILCQVFPTSLKGVVFMWYGGLPPRSIDNFNTLVECFSSQYATSQSHRLTSVALTSLRQAGNESLHKFMDRFNRLTVQIINLNPKVVLHSMLLALRPSKFVDSLCKKPPNNMDELWE

SEQ ID NO: 188792 - protein, 407 aa, Glycine max
  Coding DNA Sequence Number=SeqID_72014
  Gene Ontology: Mol. function=protein binding
  Homolog annotation: Hit_ID=Q6K620; Match level="QueryCoverage=98%, HitCoverage=65%, E-value=2e-15, Identity=25%"; Hit description =Leucine-rich repeat-like protein
  Pfam annotation: Domain name=LRR_1; Domain location=114-137; Score =3.0; E_value=77; Accession=PF00560.23; Description=Leucine Rich Repeat
  Pfam annotation: Domain name=LRR_1; Domain location=139-161; Score =3.8; E_value=55; Accession=PF00560.23; Description=Leucine Rich Repeat
  Pfam annotation: Domain name=LRR_1; Domain location=163-185; Score =4.2; E_value=46; Accession=PF00560.23; Description=Leucine Rich Repeat
  Pfam annotation: Domain name=LRR_1; Domain location=208-230; Score =2.6; E_value=93; Accession=PF00560.23; Description=Leucine Rich Repeat
  Pfam annotation: Domain name=LRR_1; Domain location=232-252; Score =11.7; E_value=1.9; Accession=PF00560.23; Description=Leucine Rich Repeat
  Pfam annotation: Domain name=LRR_1; Domain location=344-366; Score =8.9; E_value=6.1; Accession=PF00560.23; Description=Leucine Rich Repeat
  Pfam annotation: Domain name=LRR_1; Domain location=369-390; Score =5.6; E_value=25; Accession=PF00560.23; Description=Leucine Rich Repeat
  Pfam annotation: Domain name=LRR_1; Domain location=89-112; Score =11.1; E_value=2.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=114-137::139-161::163- 185::208-230::232-252::344-366::369-390::89-112
MKSESELVGFCIEAACESRESVDKWRMQSRSLDRLPSHLADSLLRRLIARRLLYPSLLEVFKHSAEEVDVRGDNSVDAEWMAYLGAYRHLRYLNLSDCHRVSTSALWPITGMSSLQELDLSRCFKVNDAGINHILSIPNLERLRISETSVTAKGVKLLASLKNLSLLDLGGLPVDDVALTSLQFSTASDVAAVKDCFMSLYSSQVLKRLHYIDLWGSKISNKGASVLNTFPKLTYLNLAWTSVTKLPKLSFLEYLNMSNCTIDSILEDDKAPLAKLILSGAMFMNEAEALLYANTNFLSFLDVANSSFHRFFFLSKMKVIEHLNLSSCMMGDDSVEMVACAGGNLKSLNLSGTRVSSAGLGILAGHVPHLEILSLSQTPVDDTAISFISMMPSLKDVDLSNTNIKGI

SEQ ID NO: 188793 - protein, 135 aa, Glycine max
  Coding DNA Sequence Number=SeqID_72015
  Homolog annotation: Hit_ID=Q2HZY2; Match level="QueryCoverage=41%, HitCoverage=46%, E-value=6e-19, Identity=84%"; Hit description=Endo -1,4-beta-glucanase precursor
MCSPCDSLVVGKVARSLGFKEEKALAQSLAIVMASEGKSGEQKKKKQREHANKLFHVVTETWDNPTKLGGNPLRKEGSFKKRKREREYGDWKLRSSRLYILWRGGKKEVAANCNADVPDDMRMGQWHVALQNGGR

SEQ ID NO: 188794 - protein, 71 aa, Glycine max
  Coding DNA Sequence Number=SeqID_72016
MQANAANTNGGTCANVDSPTIGSCDTHSMKPMPPIQMAGHANVDSPTIGSWETKVATTQASLGHCSCIGGG

SEQ ID NO: 188795 - protein, 52 aa, Glycine max
  Coding DNA Sequence Number=SeqID_72017
  Homolog annotation: Hit_ID=O64438; Match level="QueryCoverage=100%, HitCoverage=21%, E-value=4e-15, Identity=73%"; Hit description=ARG10
MVLGFYGKRKSYDAKGCFYSTAVGGLRCYENPKNKITAVPAEEEDIWGAFFK

SEQ ID NO: 188796 - protein, 104 aa, Glycine max
  Coding DNA Sequence Number=SeqID_72018
MYTYIHTVLIGDDPVRAKIKDFIVPSSRISFSTIVAYRHFKMKRNFDVVSDNDSSIFDMCTEFKPKWFEMLENIYQKLVIPVGQLINREFEGDEDNTTWQWMNN

SEQ ID NO: 188797 - protein, 149 aa, Glycine max
  Coding DNA Sequence Number=SeqID_72019
  Gene Ontology: Mol. function=transferase activity, transferring hexosyl groups; Biological process=metabolic process
  Homolog annotation: Hit_ID=Q8S342; Match level="QueryCoverage=60%, HitCoverage=22%, E-value=8e-24, Identity=64%"; Hit description =Putative anthocyanidine rhamnosyl-transferase
MVWNSKPRLGTIVEGIEPQGSWWGFDSLWLDLCGGDHGLNSRVLEVKKMGYSIPKNERDGSFTSDAVANLIRLVMVEEEGRIYMEKVKNVKDLCKIIGKPVRVTLFCENAPTIWDQHRLKGALKPGIFTPKAYTPKSALGPLPPDSGPT

SEQ ID NO: 188798 - protein, 128 aa, Glycine max
  Coding DNA Sequence Number=SeqID_72020
  Homolog annotation: Hit_ID=Q9FJ29; Match level="QueryCoverage=70%, HitCoverage=40%, E-value=2e-28, Identity=67%"; Hit description =Arabidopsis thaliana genomic DNA, chromosome 5, TAC clone:K16L22
MAMANGKGGKALSLICCNHIPNHDILGNMETRQIRKGINGAVRDETLLQLTVPTKFVQGSKDALCPLEKLEATRKKMKVPNELHVIDGGDHSFKIGKKHLQANNSTQDEAEDVAVQAIAAFFFRSLEG

SEQ ID NO: 188799 - protein, 115 aa, Glycine max
  Coding DNA Sequence Number=SeqID_72021
METCGIVYNKIIRNEEKAFLKSKSNSLSLHSAPHYFRQLSLSLTLPFSSSSFSIEAPSKASTFGHHFYPKSQKEGIFGVVKCVATSGTSKIQGFCDDVCDVYMLKLLMETVRDEG

SEQ ID NO: 188800 - protein, 67 aa, Glycine max
  Coding DNA Sequence Number=SeqID_72022
MESSASALHKVSAEAREAKETRNHTEKNGDLTNSSEKDYDFDTSLTGVLPSLSATYELLINSFQHFQ

SEQ ID NO: 188801 - protein, 157 aa, Glycine max
  Coding DNA Sequence Number=SeqID_72023
  Homolog annotation: Hit_ID=Q0WWY1; Match level="QueryCoverage=57%, HitCoverage=20%, E-value=3e-16, Identity=49%"; Hit description =Regulator of chromosome condensation-like protein
MTETKAAEDAKEMVLLEEEKCAKKMVCMWGYLPRASLKKSPILSLVPVNLSDPSLVGDSWKDVCGEKGKLITWGSMDDEGQSYLILGKHGPDPQSHLAFCVCEDPTSSSLLVPHPHHRRTRPIITHIVASLPLIEHPIAEPTPPLSQTLSHVAFSSL

SEQ ID NO: 188802 - protein, 140 aa, Glycine max
  Coding DNA Sequence Number=SeqID_72024
MMREGQQHGMVRSYWILLNPLNPRPNTRIINRSNSPYTTRIFVRVSSKPTNHSKYTGKCGKPRCPGCHLYPAWKLHLKHEGTHGRKVIPREEVVMKIRVVVDARGESTTITEGFFRDRGSNMKTKIWSLKKFCLFTCPTP

SEQ ID NO: 188803 - protein, 146 aa, Glycine max
  Coding DNA Sequence Number=SeqID_72025
MTNSSENTAPDTTIITTDATTIQTNEKPTMHIEHLFLIEDSKRIGLEVMQSYPPRVLDRRLQEDWARAAKEGPGVLMNLRHPLQDSYPRHILGGEAPSSMDFIEAQRSILYRSSTSKLPSRRYFNDPELRYPELIGMFWRNAQLKD

SEQ ID NO: 188804 - protein, 257 aa, Glycine max
  Coding DNA Sequence Number=SeqID_72026
MIPLLQHHLPYHPSQPLLMLVLLLLSHFSLPSYNFEFITLKDLLLDSNYRGGGISVINSLRTSIDNCYITHFTTNGILVQSGHETYIRNSFLGRHIIAGEDKNERDFSGTGISLQGNDNAVTDVAILSAAIGLMVTEDPVQLHISSSFFLGDANIAPKSKNGVVNGVDIVDQVIVDKNIARGMKLTATVAKMSMQGNGTSWSVDFNNVLLFPNLIKNVQYSLSSKGSSFPNALRNVSENCVVIETNEAVVVNQSALS

SEQ ID NO: 188805 - protein, 105 aa, Glycine max
  Coding DNA Sequence Number=SeqID_72027
MARQKVTERLGESAIGEDSFIRNGRFRVKHHGHGCGGSNKLRWTSQCQLQSPLGSCVNVNPYPKALASCAPFPLTLAGASSPSFSSFHNVPQLLHFPPSHLLRLP

SEQ ID NO: 188806 - protein, 140 aa, Glycine max
  Coding DNA Sequence Number=SeqID_72028
MEREMIIMIIDTLPVFYYEKMVAYMPSSFVDLVFVGERIEVGLRRCKFDYPTLMNRKPGANGENKKEGGTHVVTVVPTWPNFPPAQQYQYLANISTGGVNSNLAPLTFQILPPEGGCFWRKQPGSPGRAGWQAPPLFCYK

SEQ ID NO: 188807 - protein, 88 aa, Glycine max
  Coding DNA Sequence Number=SeqID_72029
  Homolog annotation: Hit_ID=Q1SYE0; Match level="QueryCoverage=42%, HitCoverage=3%, E-value=3e-08, Identity=76%"; Hit description=HASTY
MSRSHNQELGRAQNKHDSEKKKKDAAHDDIDDWELPHVDEKYFKGIADTMGCLQREGRLLQGEHNLLGEAFLADTMGYLVKYVAKILQ

SEQ ID NO: 188808 - protein, 188 aa, Glycine max
  Coding DNA Sequence Number=SeqID_72030
MHYIFCRILLPRSANPAQASKKDLILLWVLQIGRQIDWAYLVYYCMHKALRANAPLPYPQLVTLFLQHFHVPLDDEPFVKVKRSLAIGAAVIASFGYQKDMNGQWVQKQDLPPTVPDERTPSPPPQKDSSSSLLHDVLTELRELWAFVDSCHHQKGGEYECMSIKVLMMPRCKQHKITSCQNSRSRER

SEQ ID NO: 188809 - protein, 127 aa, Glycine max
  Coding DNA Sequence Number=SeqID_72031
  Homolog annotation: Hit_ID=Q8GZZ6; Match level="QueryCoverage=41%, HitCoverage=16%, E-value=1e-08, Identity=50%"; Hit description =Putative phosphate/phosphoenolpyruvate translocator protein
MLERESAWYNILLTEESLSIPIARADVDADADVVTTTTQERYLPVSFDQAIDATMPFFTTILAFFITCKKETGEVYLALLLVVFGIVVVSNNEAEKTSPPLSLSGVMETAEALGGTLGFLLAAFANK

SEQ ID NO: 188810 - protein, 297 aa, Glycine max
  Coding DNA Sequence Number=SeqID_72032
MGFVTWWEKYYSGRSVGDTTIMISRLESGFTQPTVENIRSNLQARGKTIMTKKIAETSRADVRPKKPTGVKIQEWKQEEKSHKKDDSTETTTTSKRSKRVVIEFDEEKDASLISNEEEERPLVRKRKSPETSTKSADQTEAGDFQAQMPKKKKKVKQIEPEPSVTVEGGEPVRKKKKKTKSSKEQGENQPVDVQPPSTDAGGAETETTPSIAEMGNLVEQPDLPQEHPTVEVQQNVSVEEIPSCARTSPAPETDAVNVEEQGEGQGIGPSSPQGSSQRSSSEEHFSDEEAIQEAEAG

SEQ ID NO: 188811 - protein, 67 aa, Glycine max
  Coding DNA Sequence Number=SeqID_72033
MDILVSDSNHFAQHESQSLSVTADHDPLLGLPLTPTKRQTFQDCDDEPGISQISPAQLSSNKLKKHA

SEQ ID NO: 188812 - protein, 136 aa, Glycine max
  Coding DNA Sequence Number=SeqID_72034
MSEAAPQQHSLQQETDGAAEPVLTHSTTSVIENEAMEDTGPQQTNPSEDIPHARGPRILGVEDMGLQDGKGVEMTLENEEGANNNSAEQNGQQGNDAGQTATKENADGDGDITLDDAKNANEEPGTSAKGDEQPKP

SEQ ID NO: 188813 - protein, 144 aa, Glycine max
  Coding DNA Sequence Number=SeqID_72035
  Homolog annotation: Hit_ID=Q4WQF4; Match level="QueryCoverage=99%, HitCoverage=44%, E-value=3e-31, Identity=49%"; Hit description=COP9 signalosome subunit 7 (CsnG), putative
MISILTQWETRCGDVISDIEAEIARIKTDSAKRRAKEQARAVLFEKTLSNWGSDGGESNPRFPGSKKQSWHGGAKGGSSGFVGNKREFSGDDFDDGYWDNGADGAYDSQFSTSKMDIDQGAGSSATGSAGAGARHAKRVLGRKS

SEQ ID NO: 188814 - protein, 74 aa, Glycine max
  Coding DNA Sequence Number=SeqID_72036
  Subcellular localization annotation: CTP_CleavageSite=50; ConfidenceScore=5.49e-01
MEGNKQKGTSSSFTSELFGSKESRPSSSSGIFGSIFSPPSSKVLGRESLRSELSGKIANETWSSKICIQETIMK

SEQ ID NO: 188815 - protein, 134 aa, Glycine max
  Coding DNA Sequence Number=SeqID_72037
  Gene Ontology: Cellular component=mitochondrion
  Homolog annotation: Hit_ID=Q1SP96; Match level="QueryCoverage=99%, HitCoverage=18%, E-value=1e-38, Identity=64%"; Hit description =Villin headpiece
MYRICKTALLNHELLRDNNSERLFEALTVMISDILGACLTNLPLVISTKCLNSTIEEREDTVRHAVYILGKTKKIIEMLEKRAFPRVNFCRGTFIEDWRLMHKESNLLHFVPSSMENDTHTDPPKSSDLYLDVD

SEQ ID NO: 188816 - protein, 111 aa, Glycine max
  Coding DNA Sequence Number=SeqID_72038
  Gene Ontology: Mol. function=microtubule binding; Cellular component =membrane; Biological process=protein transport
  Homolog annotation: Hit_ID=Q8S926; Match level="QueryCoverage=78%, HitCoverage=72%, E-value=3e-38, Identity=84%"; Hit description =Autophagy 8e
  Pfam annotation: Domain name=APG12; Domain location=24-106; Score= -28.2; E_value=0.07; Accession=PF04110.4; Description=Autophagy protein Apg12
  Pfam annotation: Domain name=MAP1_LC3; Domain location=21-106; Score =200.8; E_value=3.2e-57; Accession=PF02991.6; Description=Microtubule associated protein 1A1B, light chain 3
  Pfam module annotation: Pfam domain module=APG12::MAP1_LC3; Domain location=24-106::21-106
MYIGGISLVIVLNCLSMCLKVIVEKAERSDIPSIDKKKYLVPADLTVGQFVYVIRKRIKLSAEKAIFIFVDNVLPPTGAIMSAIYDEKKDEDGFLYVTYSGENTFGDLTSH

SEQ ID NO: 188817 - protein, 125 aa, Glycine max
  Coding DNA Sequence Number=SeqID_72039
  Gene Ontology: Mol. function=RNA-directed DNA polymerase activity; Cellular component=chromatin; Biological process=RNA-dependent DNA replication
MDPKDEKKTKFIIESTNFCYKVMSFGLKNVRATYQCLMDKVFQVQLGRNLQVYVDDMVVKFDNLTTHLANLEEVFGQLRKYNMRLNPEKCVFGVEGGNFLGFMLTHWRIHANPDKCQTTLGMRSP

SEQ ID NO: 188818 - protein, 143 aa, Glycine max
  Coding DNA Sequence Number=SeqID_72040
MEQPANHHNKDIHAQVPKMQRHYAEEVVALQCEKPTGRDNLRLTRLKEEKLRTSPSLVTRLPLNSVDSFDTLATCFGTQFATSQPHRLTLCKKPAFDLDELRTRAAKYMQMKELVKYRNQVRADVILAKKDNDKPSSNKARDD

SEQ ID NO: 188819 - protein, 112 aa, Glycine max
  Coding DNA Sequence Number=SeqID_72041
  Homolog annotation: Hit_ID=Q9FGK0; Match level="QueryCoverage=94%, HitCoverage=85%, E-value=1e-38, Identity=72%"; Hit description =Arabidopsis thaliana genomic DNA, chromosome 5, P1 clone:MNJ7
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKIPFVSLLL

SEQ ID NO: 188820 - protein, 101 aa, Glycine max
  Coding DNA Sequence Number=SeqID_72042
  Subcellular localization annotation: CTP_CleavageSite=40; ConfidenceScore=5.55e-01
MKGMHMTQMQSRNAGARGIVSFLDTTSRGSKVPQLESPTVATYPSAGGRRVTRGMRVPRKEYARSRHRRLFEENVGKTGKDAIYELLSERFGSCIYARGRY

SEQ ID NO: 188821 - protein, 52 aa, Glycine max
  Coding DNA Sequence Number=SeqID_72043
  Homolog annotation: Hit_ID=Q1SYR3; Match level="QueryCoverage=75%, HitCoverage=1%, E-value=4e-13, Identity=90%"; Hit description=RNase H, putative
MAPLILQSLENDKVFLDCIRIHGTRELIPIHSRKSQCTTRESSLDDLWAFVH

SEQ ID NO: 188822 - protein, 213 aa, Glycine max
  Coding DNA Sequence Number=SeqID_72044
  Gene Ontology: Mol. function=nucleoside-triphosphatase activity; Cellular component=integral to membrane; Biological process=transport
  Homolog annotation: Hit_ID=Q1SFG2; Match level="QueryCoverage=95%, HitCoverage=31%, E-value=4e-95, Identity=81%"; Hit description =Glycoside hydrolase, family 10; AAA ATPase
  Pfam annotation: Domain name=ABC2_membrane; Domain location=68-211; Score=-13.0; E_value=0.0074; Accession=PF01061.14; Description=ABC-2 type transporter
VTSRKDQWQYWAHKEEPYSFVTVKNFAEAFQSFHIGQQLGDELANPFDKSKCHPYALTTKNYGVKKKELLKACASREFLLMKRNSFVYIFKATQLTYLAILTTTLFLRTKMSRNTLADAEAYMGALFFTVTVALFNGISELNMAVMKLPVFYKQRDQLFYPSWAYSFPPWILKIPITLVEVFIWECIAYYAIGFDPNIGRQEETMIIAPQLCY

SEQ ID NO: 188823 - protein, 131 aa, Glycine max
  Coding DNA Sequence Number=SeqID_72045
  Gene Ontology: Mol. function=zinc ion binding
  Homolog annotation: Hit_ID=Q1SXA1; Match level="QueryCoverage=98%, HitCoverage=52%, E-value=1e-13, Identity=58%"; Hit description=Zinc finger, SWIM-type
  Subcellular localization annotation: CTP_CleavageSite=52; ConfidenceScore=5.42e-01
MYVALVLMVSMLTSNNNMRTRHVKFLQFATVTPPFIQPNREISSGPNLSRVNCFLDQEPCVASIELKNNVSLPWPCFILAYKLGQMKKSHASVVSPSTRAKAIGRILLLSSCATATMKVPLYLPYNHVPST

SEQ ID NO: 188824 - protein, 121 aa, Glycine max
  Coding DNA Sequence Number=SeqID_72046
  Subcellular localization annotation: CTP_CleavageSite=37; ConfidenceScore=5.36e-01
KAFFLVVSPKARQTQGPPLVSFASPKARQIQGPSLVSLAKTQNEHVPGPKLVKPKEHNKTQGLPLVSIPTKTQGMPLVSPLLWNYDEHSLKSKLHKAKQTITRLVSKTFNRVEIILSRHWP

SEQ ID NO: 188825 - protein, 64 aa, Glycine max
  Coding DNA Sequence Number=SeqID_72047
MVESSKKRKGSSSTLFSSDEQRLRQGAPFEGTIIDDWKFDFSSHDAHRMVCNDQADMTGRLLAK

SEQ ID NO: 188826 - protein, 36 aa, Glycine max
  Coding DNA Sequence Number=SeqID_72048
MAETSKKGKGTSSRSQRVYMYIPGRSMYIGGERYAG

SEQ ID NO: 188827 - protein, 71 aa, Glycine max
  Coding DNA Sequence Number=SeqID_72049
MSSCFLRFTTWTSISDRSSGKFGNKPKTQNGGELINLGGALQPWAHLGQSGSFYIKQPAGMGEHVTSGLSH

SEQ ID NO: 188828 - protein, 108 aa, Glycine max
  Coding DNA Sequence Number=SeqID_72050
  Subcellular localization annotation: CTP_CleavageSite=54; ConfidenceScore=5.01e-01
MPISPCKSISWSVSSRHGMPVPPPPPRQGHIIIGIAPARHPVDPKKSNRVLELSSSNYGSLSVLRSVCRPQQSHQTPLPIELSSRSTAPPGRRRAKHHSSIGMAGSGQ

SEQ ID NO: 188829 - protein, 201 aa, Glycine max
  Coding DNA Sequence Number=SeqID_72051
MAPEDLEQLMQQIRDQLEESIIEKVTRQLMLSFSQMQFQFQSQMQSQGLALPPEPEVGPSTARVSTKESCVNPSGNDPDTDDSDKCRLYIEENPPRLVVLGKVYEGSITIHNIPLLHDQVKVGFKEVRDADAPIPVPTKEVKLVEQTLNTFLAWSTHLVKHLSEQGAMGPAKPADRPDHDVDDPLYLMTLTIPQLFLKPLQ

SEQ ID NO: 188830 - protein, 60 aa, Glycine max
  Coding DNA Sequence Number=SeqID_72052
  Subcellular localization annotation: CTP_CleavageSite=28; ConfidenceScore=5.16e-01
SVSFLASRVVSTEKGPGITIGKSRRTARRAYGGRRLGCRRLRPFKGIFPLAGVGRVKIGK

SEQ ID NO: 188831 - protein, 194 aa, Glycine max
  Coding DNA Sequence Number=SeqID_72053
  Homolog annotation: Hit_ID=Q1T193; Match level="QueryCoverage=26%, HitCoverage=19%, E-value=3e-07, Identity=53%"; Hit description=RNA -directed DNA polymerase
MTLVEYSESSENTLTCLSSLQQACPVSTQAFIVIGWPYVKTPSLLPRGRERLVKKGAKQCNKKMAKLTIIGFILLLLADLKEVFGQLIKYNMRLKSENRGHKCGAGAGGRKGVESGKLCKLGTARSEDKLRGEFEEVQVTHISQEVNDKTDELAQLATSPEPRQLKTFILHSVLKPNVSGKECLLVKEAPIGWK

SEQ ID NO: 188832 - protein, 138 aa, Glycine max
  Coding DNA Sequence Number=SeqID_72054
APETSARNIKQTTLWHRRPFSTFKNPFIPSVMEATLPSNWKNLIIDKYDYTIDSNEHLDVYITQVSLYTTGTKSSVGLCKKPTSDLNKLCTRLAKYMQMKELAEYWNQTWVDVVSAKRDDDKPSSSKARDEGRRDWPP

SEQ ID NO: 188833 - protein, 138 aa, Glycine max
  Coding DNA Sequence Number=SeqID_72055
MGMGDTKEDVQRMFLADKTATIMKKVTEKENGSFFVVSMHCMPFPFLFAVMFFSFWSFGDTVSVVSNTQTETDSYDLIDHIIHHFTKNPNFSRAASPPFVHYLSCTPPSTLGEPVMPPPTTKLTKGGTTCFIKSEETQ

SEQ ID NO: 188834 - protein, 176 aa, Glycine max
  Coding DNA Sequence Number=SeqID_72056
MEIMTIVPPLSTTSCHHCRLRHPTIAINRHYRVVQPLLLVSLSLYLGSRKEDNIHSASLARSKAFHFPNAQALAHKLRSLFHVITLIPEQVRQLHTMHSPQLLGLNIADRVGLLKEIDFGDEGEKGRKGRRGEGEKGLEGAVAAVDNGGGATWSMVVVVVISVGEGEKGKKEKEKK

SEQ ID NO: 188835 - protein, 166 aa, Glycine max
  Coding DNA Sequence Number=SeqID_72057
  Pfam annotation: Domain name=DUF948; Domain location=74-154; Score= -23.9; E_value=0.042; Accession=PF06103.2; Description=Bacterial protein of unknown function (DUF948)
  Subcellular localization annotation: CTP_CleavageSite=44; ConfidenceScore=5.44e-01
MAVITSRAPFSVRVSTSTTSTPLAGDTIPALVMSEQQTPNLQSRVAAAPSIAVARNLGFRPTPELGLLSHLFVLSMAFGAFFSVAVFSIPTLIAFGRLGASVKKLSKVVSEEVPGTLHSLKLSSMELNDLTQQLSSLRHKIAGISKGKQDSSTARSRSFRKGNPAS

SEQ ID NO: 188836 - protein, 348 aa, Glycine max
  Coding DNA Sequence Number=SeqID_72058
  Gene Ontology: Mol. function=RNA-directed DNA polymerase activity; Cellular component=exocyst; Biological process=RNA-dependent DNA replication
  Homolog annotation: Hit_ID=Q1T5K4; Match level="QueryCoverage=77%, HitCoverage=35%, E-value=2e-34, Identity=30%"; Hit description=RNA -directed DNA polymerase
EANASEAKIRVWQWEVYGGLFVEIYALVDDMDELHQRLCNEMLVDSEHRRLLVSEFWRKVQAKEKPMEGRPVLDDVVFKYPGLDGFNFSFFQVGWEFLWDDLMTFVMEFFSLGVLPKAATSSFVALISKKDHPHFFPGRCILDVVVVANELVDIVKQSKRGCFMFKIDFKKAYDLVSYDFLDYMMNQMDFDDTWRKRGDSLAPFLFLMVEKGLHGLAEKAREMGDFKSLRLSLMVEFSLLQYADDSIIIGEPYYGNLLAVKAILCGFELVSGLREGFMDIASNFLHCSLSNVLFQYLGILIGVSPRRALKALNACYSHIGEYSKEAKADEGLGMKNLATFDASLLDKW

SEQ ID NO: 188837 - protein, 359 aa, Glycine max
  Coding DNA Sequence Number=SeqID_72059
  Gene Ontology: Mol. function=endonuclease activity; Cellular component=integral to membrane
  Homolog annotation: Hit_ID=Q0M5N8; Match level="QueryCoverage=91%, HitCoverage=100%, E-value=1e-142, Identity=75%"; Hit description=AP endonuclease 2-like:Xylose isomerase-like TIM barrel
  Subcellular localization annotation: CTP_CleavageSite=86; ConfidenceScore=5.86e-01
MACPPGAVSAQIPSMRCSDPASVPLSAKSSKARSVTRMMWSRMKAAPSRAPSSGCFRQHSHSSTAHPGKSYWANLEKIALKSIWPSPSAGAVLRVLDVEDADARVVAIDEPQIVHLLQQQVAGVVQDLRARVVIDHVEEAFEGRTVVQVLPRVDLEAQVHAAGVIRIEDGAPAAAEFGEGFFHQAGRALRPGIEIGPRQCAGERGMRGQPQALAGLGRQQQLLHCPGMARGRVAALFRWCESVKQAVIRRMDRDQLPLQMGGQFSDLHAMPGQHAGKVVSVRLAACGLGQVEQVGRAGRHLYAKIAQACGPSGQRVQPIKRSCVADELRQEQRWTLERLQRDSPSMLSIALSYQGLTHD

SEQ ID NO: 188838 - protein, 64 aa, Glycine max
  Coding DNA Sequence Number=SeqID_72060
  Gene Ontology: Mol. function=nucleoside transporter activity; Cellular component=integral to membrane; Biological process =nucleoside transport
  Homolog annotation: Hit_ID=Q1QZI6; Match level="QueryCoverage=91%, HitCoverage=16%, E-value=1e-13, Identity=75%"; Hit description =Nucleoside:H+ symporter precursor
MSRLGAMMFLQFFIWGAWFVTLGQRQPGGDGVPQPVHRRHRRAVPGRPDRGSLLRRAAHPGGIL

SEQ ID NO: 188839 - protein, 327 aa, Glycine max
  Coding DNA Sequence Number=SeqID_72061
  Gene Ontology: Mol. function=two-component sensor activity; Cellular component=membrane; Biological process=two-component signal transduction system (phosphorelay)
  Homolog annotation: Hit_ID=Q4K817; Match level="QueryCoverage=70%, HitCoverage=64%, E-value=7e-31, Identity=36%"; Hit description =YaiC/YhcK/ArdA family protein
  Pfam annotation: Domain name=GGDEF; Domain location=163-322; Score =195.3; E_value=1.5e-55; Accession=PF00990.12; Description=GGDEF domain
MRSWATGWGDPHCFDHARTPGRCAGVEPAAAQCAGLARARPRADPSLTAARGGPVPLHGDRFLLWRWAGSPSWGSAWCPVRCSPRCWSPTKIAAGGVKLAVRATLALAVGFALTWWGLGFPYQPVSSQRTIVLSVPFLFVYGIGLSILSWQLARRVKSQNRQLKRLSRMDPLVELANRGFLIVRAQQALDKAQGQGGFACLLMLDVDDFKRINDSHGHRAGDEVLRHIASTLRAFARPGDTPARLGGDEFVVLLQDCAPIDAMHVAERVRLQLLEAARQATPGIEFSVSIGIAATPRGGSVEDWLALADRALYHAKRQGKNNASYGE

SEQ ID NO: 188840 - protein, 152 aa, Glycine max
  Coding DNA Sequence Number=SeqID_72062
MIQRQVGVEEVKDAEAPVPVPTDEVTLVGQILKTFLAWATHLVKHLSEQAVVSPAKPPKSLDHEPLQVMWDDSLFGLFNSDFPLYIKHEDLSKIAHGGQCFSISVIQLWILHLTETSMRAGNSDVYGFLEPQSIQRSGQSQFESKSYIKSWM

SEQ ID NO: 188841 - protein, 43 aa, Glycine max
  Coding DNA Sequence Number=SeqID_72063
MERNLVFATRDDVLHWARSVVYDIGFVAMIMRLDTNTGKRGKT

SEQ ID NO: 188842 - protein, 84 aa, Glycine max
  Coding DNA Sequence Number=SeqID_72064
  Subcellular localization annotation: CTP_CleavageSite=50; ConfidenceScore=5.16e-01
MADTVDSPLDYLQLQGSTNPNFSFTYLLFKNPKRYTKKKVPRATRKEKVGAMAVRGRSPKKLLHERLDYGSSIDDLRCTKPTFN

SEQ ID NO: 188843 - protein, 271 aa, Glycine max
  Coding DNA Sequence Number=SeqID_72065
MEDMIKTKAKALEDMARANHGCNKLRDEEIKLRNKEIDLQIIYKILLPPASARRQRAAAVVVENVEHVDHVANEVHEKPLEPIMDHERTELKLACHGRKTDNKGLLSTFAERWHKKTSAFHTFDAIDVEEGSDLLVELLKVNRQEANDETEQCRGTYGCTLFANKSATHISVVFLNTFCDLGQYGGYSWGAAVLIHIHQLERVVRQFGYVQTIPPLLTASSSSIEEVGKPPRHPLVVHEDTFIVPNPPILLVHSTAMPGPLAPAAANADIP

SEQ ID NO: 188844 - protein, 761 aa, Glycine max
  Coding DNA Sequence Number=SeqID_72066
  Gene Ontology: Mol. function=protein kinase activity; Cellular component=integral to membrane; Biological process=protein amino acid phosphorylation
  Homolog annotation: Hit_ID=Q6YW99; Match level="QueryCoverage=95%, HitCoverage=93%, E-value=1e-135, Identity=39%"; Hit description =Putative receptor-like kinase RHG1
  Pfam annotation: Domain name=LRRNT_2; Domain location=25-66; Score =54.9; E_value=2.7e-13; Accession=PF08263.3; Description=Leucine rich repeat N-terminal domain
  Pfam annotation: Domain name=LRR_1; Domain location=118-140; Score =17.3; E_value=0.055; Accession=PF00560.23; Description=Leucine Rich Repeat
  Pfam annotation: Domain name=LRR_1; Domain location=142-164; Score =18.5; E_value=0.025; Accession=PF00560.23; Description=Leucine Rich Repeat
  Pfam annotation: Domain name=LRR_1; Domain location=166-185; Score =2.1; E_value=1.1e+02; Accession=PF00560.23; Description=Leucine Rich Repeat
  Pfam annotation: Domain name=LRR_1; Domain location=187-209; Score =13.0; E_value=1.1; Accession=PF00560.23; Description=Leucine Rich Repeat
  Pfam annotation: Domain name=LRR_1; Domain location=210-232; Score =12.2; E_value=1.5; Accession=PF00560.23; Description=Leucine Rich Repeat
  Pfam annotation: Domain name=LRR_1; Domain location=70-92; Score=2.2; E_value=1.1e+02; Accession=PF00560.23; Description=Leucine Rich Repeat
  Pfam annotation: Domain name=LRR_1; Domain location=94-116; Score =16.9; E_value=0.075; Accession=PF00560.23; Description=Leucine Rich Repeat
  Pfam annotation: Domain name=Pkinase; Domain location=451-744; Score =30.7; E_value=2.2e-10; Accession=PF00069.15; Description=Protein kinase domain
  Pfam annotation: Domain name=Pkinase_Tyr; Domain location=462-744; Score=-18.5; E_value=2.5e-11; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::Pkinase::Pkinase_Tyr; Domain location =25-66::118-140::142-164::166-185::187-209::210-232::70-92::94 -116::451-744::462-744
MSLLFPTLIISLVILLVTVNQCCALSRDGVLLLSFKYAVLNDPLYVLANWNYSDETPCSWNGVSCSNENRVTSLLLPNSQFLGSVPSDLGSIEHLQILDLSNNSLNGSLPSSLSQASELRFLNLSNNLITGEVPESLSQLRNLEFLNLSDNALAGKLPESFSNMQNLTVASFKNNYLFGFLPSGLRTLQVLDLSSNLLNGSLPKDFGGDNMRYLNISYNRFSGEIPTEFAAEIPGNATVDLSFNNLTGEVPDSTVFTNQNSKSFNGNFNLCGEITKNPCPIPSSPSSEPKASAPISPPAIAAIPKSFDDSPLAPTGQKQRGLKQGTIIGIVVGDIIGVGILAMLCVYVYRLKKKKDAESTKKKNEAAITRSRSESSSSTTSESRGFTRWSCLRKRTEEEDSSETTSSSESEVEGATAATHDNNNNNNTGTLVTVDGERQLEVETLLKASAYILGATGSSIMYKAVLEDGTSLAVRRIGESGVERFKDFENQVRLIAKLVHPNLVRVRGFYWGHDEKLIIYDFVPNGCLANVRYRKVGSSPSHLPWEIRLKIAKGVARGLTYLHEKKHVHGNLKPSNILLGNDMEPKIGDFGLERIVTGDTSYKAGGSARIFGSKRSTASRDSFQDMTFGPSPSPSPSSISGVSPYHAPESLRNLKPHPKWDVYSFGVMFLELLTGKIVVLDDMGQGPGLLVEDKNRALRMVDMVIRADMEGREEALLAYFKLGYSCVSSIPQKRPPMKEALQVLEKISSSFSSSSSYHYSV

SEQ ID NO: 188845 - protein, 91 aa, Glycine max
  Coding DNA Sequence Number=SeqID_72067
MDEFRDELVKGEDDDDDESLSDYCETQFSTNNMNNPVVQFNKYSEENHESTTSSPKQTWFKRCGDNSDGNDQRESGNNGVKVQENEGFKVS

SEQ ID NO: 188846 - protein, 233 aa, Glycine max
  Coding DNA Sequence Number=SeqID_72068
MGYIESDHVQHDVPYQVEEMSHVNEVIEVESICALQDLVGGVEEVDPTNLLRNEEDSNNLNGESKNIEQDNEGELEDEFEICDQVVLTLPNPIHMIQVGNGQLQRKDDMWPPDVAPTPSPPLTEARPSSSHVNARGPSPVPTSTPSPSSVDARRLSPVPTPTPSPSPPVGNMPTNEDAINLAMEDPPLNDRPMVTLINGAFHPSKVTAKAVTLSIRQQFGQPWPTWGAIPKDH

SEQ ID NO: 188847 - protein, 88 aa, Glycine max
  Coding DNA Sequence Number=SeqID_72069
MGEDHPSPYDYYIYIVQIFCQRGHWLNVKQCRKEYLDVAEDDHVYRFKSLEKLPLVSLAWFTKDESKSSFLKRCKESGNAEIVYCEAI

SEQ ID NO: 188848 - protein, 131 aa, Glycine max
  Coding DNA Sequence Number=SeqID_72070
MAFVHILIGFHRAHDECPSFPKLHFHKHPSVLQLITTEIGITGHDSSTPPTRKHLVMLNSPSSPHHHQEAVRTVRAGGEVHGGDEELRGGAVEGADEDRAKIVVAKALGEGVGGVAAEDGEGEAVRQGGDG

SEQ ID NO: 188849 - protein, 470 aa, Glycine max
  Coding DNA Sequence Number=SeqID_72071
  Gene Ontology: Mol. function=protein dimerization activity; Cellular component=nucleus; Biological process=transposition, DNA-mediated
  Homolog annotation: Hit_ID=Q1S5E6; Match level="QueryCoverage=75%, HitCoverage=45%, E-value=3e-83, Identity=48%"; Hit description=HAT family dimerisation domain, putative
  Pfam annotation: Domain name=zf-BED; Domain location=113-161; Score =45.3; E_value=2.1e-10; Accession=PF02892.5; Description=BED zinc finger
MYPRSNASFNMQTLMQIRQWHFLKVAHWLINHQTIEASNTQSNNEEVQTMNVTYGNSERQDESNNDGCSNVEKAQKKRKHGEAAPLAPPSTNPTPTNPIAGEPGKSKPCRPRSWAWDHFSKDESCTTQKRAKCNWCKKSYVVDTHKNGTSSIINHLVNLCKKFPRESIPSQQILSFQQMKKEDGKGTGSILSSVHFDVEACRATLARMIIVDELPFKFVEGEGFLHFMSIVQPKLPIPGRITTARDCWSIYTNEKHKLKSVFKNSNQSVSLTTDCWTSVQNMSYFCLTTHFIDENWMLHKIILNFFQVKNHKGETIGRKIEKCLESWIIGRVFTITVDNASSNDVAISYLKNRMENWNTHPLKGEHMHVRCCAHILNLVVNDGLKEYHPSISSRIRNAVRYVRASPSRMERFKICISEARILDKSTMQLDVPTRWNSTYIMLESALKFQKAFKRLGEKCAECDIARWYPN

SEQ ID NO: 188850 - protein, 67 aa, Glycine max
  Coding DNA Sequence Number=SeqID_72072
MVPPVEPEVAPFGACVSIKGNCVNPLGIYDGSTIMHHVPLGNELDKQVLEGPTKPVDKPKPDDDTIY

SEQ ID NO: 188851 - protein, 45 aa, Glycine max
  Coding DNA Sequence Number=SeqID_72073
MGWARQDRPLARYQFGEARVYFLKGWVARQPTFRWDGSACSTRQV

SEQ ID NO: 188852 - protein, 73 aa, Glycine max
  Coding DNA Sequence Number=SeqID_72074
MTKKSPEMRRGVDEEGKRCGGGVRFRYKGSPGQGSTTTVVLVRASHQVELSTLIPIIVQPRGVNIEKIYTNGS

SEQ ID NO: 188853 - protein, 67 aa, Glycine max
  Coding DNA Sequence Number=SeqID_72075
MEWFYMISHPFMTPAQLGDPPRHPPVVHDDTFVEVDVPQQPVATTTMDEAPANAHADVGHPQRVVEA

SEQ ID NO: 188854 - protein, 207 aa, Glycine max
  Coding DNA Sequence Number=SeqID_72076
  Subcellular localization annotation: CTP_CleavageSite=47; ConfidenceScore=5.13e-01
MGKWFSENWMRFFVVPVVLRFGDNTKKGITLGTQHKCCAATPFFFFRSSPTVGAACHSIAVVLAFSFVAIMVRTRGLGRASSRIIGRTLGREVSRDANEGPQQKRPTTSTRRQREGACVAEDVKHVDHVVEELHKQPGEAPVDDVVSDAEGVPGGPHDTSVLMDYVHYVAVTIWNEEEPELKLSSHGNKVEKFGRPAPEIEVLMAAT

SEQ ID NO: 188855 - protein, 66 aa, Glycine max
  Coding DNA Sequence Number=SeqID_72077
MNPLTKLIFGLTEEEEEQAPLELDIDALESVLYHENEIPICEPSKNNEGDENLDTMVFQVESGDGG

SEQ ID NO: 188856 - protein, 189 aa, Glycine max
  Coding DNA Sequence Number=SeqID_72078
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=89%, HitCoverage=23%, E-value=2e-22, Identity=37%"; Hit description =Putative Na/H antiporter
MESAYPIRALNRHLLRTAPCSVRILVERENLTRNNPSTSVSFYSVGIVFIEGPDDREALAYAIHMAYHSNVKVTMLRLMEPHKKSRQLINIDPDGDLIHKFMVDYLQIKRHDYREEVLRDSEGMVSIIRSLEGCYDLILVGRRQERESSLFSRLTEWNEYPELGYIANMLCLRIQLLMGLCWWYNNKIG

SEQ ID NO: 188857 - protein, 70 aa, Glycine max
  Coding DNA Sequence Number=SeqID_72079
MWPKASAKDPGRSVHFAPHKHTQHPTYERGPKQVPKTLEETASQVWMISLRLKGSSRCGVSTRTMAVCGG

SEQ ID NO: 188858 - protein, 61 aa, Glycine max
  Coding DNA Sequence Number=SeqID_72080
MDVEEASAPKEGKPVLVILAGAPGSGKSTFCEEVIRVSTRPWVRICQVWFTSFYVFDEMSH

SEQ ID NO: 188859 - protein, 321 aa, Glycine max
  Coding DNA Sequence Number=SeqID_72081
  Gene Ontology: Cellular component=integral to membrane; Biological process=transport
  Homolog annotation: Hit_ID=P74867; Match level="QueryCoverage=71%, HitCoverage=78%, E-value=2e-85, Identity=67%"; Hit description=Inner membrane transport protein ybiF
  Subcellular localization annotation: CTP_CleavageSite=38; ConfidenceScore=5.31e-01
MAIFQPVAGAFFPPSRFIRWKFRPKSGDVCTSFPSQTGAGSAAGCRITDRHAVAAGRRIAGEIAISHRRCAWHYRAASGTGHAHPVRDFQTLAPALQCKAAQTAADVWTGAGLHELPVLSLDPHRAAGRSGGAGVSRPADAGAGRRTPSAGFSLGAAGGHRPVVPAADWSWPEPYRSHRRAAGRGCRRLLGGLYSGGPAGRRRTRPGHGGNGLADRLSDFCAARSDLCRTRYLAVGNSAAGVAHSPALQRHSLLAGNDGADASAGAHFRHADESGTGDGGALRHAVPRRAADAAAMAGAAGDYRRICWLDAHHETESGTYK

SEQ ID NO: 188860 - protein, 130 aa, Glycine max
  Coding DNA Sequence Number=SeqID_72082
MYMMRLSTLNEYGSGVIDILIGSVCHIGWCKVGSQAICMMIKMQGSCMSGVIDILIGSVCHIVFVLQRKMQGSCMSKRENKRNDTSITMPWRDAYAMHDMNAFTDTRARKILSSYLRIWGRSAPCVQLRR

SEQ ID NO: 188861 - protein, 135 aa, Glycine max
  Coding DNA Sequence Number=SeqID_72083
  Gene Ontology: Mol. function=nucleic acid binding; Cellular component= nucleus; Biological process=type I hypersensitivity
  Homolog annotation: Hit_ID=Q5N8W4; Match level="QueryCoverage=54%, HitCoverage=24%, E-value=3e-30, Identity=82%"; Hit description =Putative RRM-containing protein SEB-4
  Pfam annotation: Domain name=RRM_1; Domain location=1-59; Score=12.4; E_value=0.01; Accession=PF00076.12; Description=RNA recognition motif. (a.k.a. RRM, R
MKKYFEQFGEILEAAVITDKATGRSKGYGFVTFHEPEAAMRACVDPAPIIDDGKANCNLASLGVQRSKPSTPKHVFIRTNYDGNINMLQREVSTKSTYTEAQSYNEDMKLTSNSTPTMAARLSYSMVAAMGLRSP

SEQ ID NO: 188862 - protein, 60 aa, Glycine max
  Coding DNA Sequence Number=SeqID_72084
MANNYLKGIVNSALKGLDDTPQPMSKAAAKWIIVKYFNDARPLEPKRLKALRIQWAQYYL

SEQ ID NO: 188863 - protein, 139 aa, Glycine max
  Coding DNA Sequence Number=SeqID_72085
MVWVTWWFGEGHMGNIRVSGATLMVVWVLAMRSSRGARGEGCLGDGLMQGGKREENWEIEEKEEVMENSRMRAENRPRREEEVGKEEGRMVPVESWKEGEVRKSVDCDEEGGGGGGGGVVIAIAGVVHEFGRWRCNSRV

SEQ ID NO: 188864 - protein, 183 aa, Glycine max
  Coding DNA Sequence Number=SeqID_72086
MGNSLRCCLACILPCGALDLIRIVHLNGYVEEITRPITAGEVLKANPNHVLSKPSSQGVVRRILILAPETELKRGGIYFLIPAASLPAEKKKRHMKHVKHVSGNHGGDDSSNKNAVIKKGGIAGVVAADCGSLGWRASQKTSFFPVAGAGIWLAGGDWEPKVVQHLKLLKYNMTFSLSMYASI

SEQ ID NO: 188865 - protein, 105 aa, Glycine max
  Coding DNA Sequence Number=SeqID_72087
MHVSHLCPLKESINWSRLKRYKFYFQEMSTGDEPKYRLESQLRLMIVLLGFHSIVNNSGDNLSSKKIYGRNNREEKKVGLSRNIGDLTTLLKQESWHILLDLFLI

SEQ ID NO: 188866 - protein, 74 aa, Glycine max
  Coding DNA Sequence Number=SeqID_72088
MVCRQVMVVAVVDLAINGVGKMDKDQQMYDSIMSGEVDMNEQNEDEAGVNEEHVDCSNAFNTSQAFAPRDDVLH

SEQ ID NO: 188867 - protein, 71 aa, Glycine max
  Coding DNA Sequence Number=SeqID_72089
MVRVRSRVNVASEDDEYVGLHDLIIVRNLGVLHGLKLAGEVEVVGPSGDAGAMTGSSWRQKGHTIEERRKG

SEQ ID NO: 188868 - protein, 349 aa, Glycine max
  Coding DNA Sequence Number=SeqID_72090
  Gene Ontology: Mol. function=oxidoreductase activity; Cellular component=integral to membrane; Biological process=electron transport
  Homolog annotation: Hit_ID=Q69QN3; Match level="QueryCoverage=98%, HitCoverage=96%, E-value=7e-96, Identity=52%"; Hit description =Putative oxidoreductase, FAD-binding
  Pfam annotation: Domain name=3HCDH_N; Domain location=4-156; Score= -113.6; E_value=0.079; Accession=PF02737.8; Description=3-hydroxyacyl- CoA dehydrogenase, NAD binding domain
  Pfam annotation: Domain name=DAO; Domain location=6-324; Score=185.0; E_value=1.8e-52; Accession=PF01266.14; Description=FAD dependent oxidoreductase
  Pfam annotation: Domain name=FAD_binding_2; Domain location=6-308; Score=-150.7; E_value=0.092; Accession=PF00890.14; Description=FAD binding domain
  Pfam module annotation: Pfam domain module=3HCDH_N::DAO::FAD_binding _2; Domain location=4-156::6-324::6-308
MDQPKRVVVCGGGVIGVCTAYFLAEKGAAVTLIEKSDVACAASGKAGGFLALDWCDGGPLEELARASFNLHRSLSEELEGPRSYGYRALTTLSLTVTESEGSSSATSTLPSWVDGPARGAKTIGTTETTAQVHPRLFTRTLIDRAVEKHGVKVEIAKLERLVVAEGRVGSVVLEGGRVLEADSVVLALGPWSKPSSITPHALFLSYYSSKRGKSLDPEVYPRPTGEVYICGMSKEEEVPDDPEEIRGNPESIAMLKKVAKTVSSYLGEGVARMKAEQACFLPCTDDGVPVIGEVPGVKGCYVATGHNCWGILNGPATGAAVAELVIDGHSSIVDLKHFSPARFLGRRKA

SEQ ID NO: 188869 - protein, 84 aa, Glycine max
  Coding DNA Sequence Number=SeqID_72091
  Pfam annotation: Domain name=zf-CCHC; Domain location=47-64; Score =12.7; E_value=0.0079; Accession=PF00098.13; Description=Zinc knuckle
SHSVHYVIHQGIQGARKKFVKKHDKGKWPLKINDSPIQIQNKTSKSNNCHFYGKSGHFQKNFPKWIPYNPNHKPKRTSSSWGIE

SEQ ID NO: 188870 - protein, 130 aa, Glycine max
  Coding DNA Sequence Number=SeqID_72092
MYVDGTYVEKDWSVDVDELSYIDIKNMLEKMGYKKYKCICNGYKLVEIYLEHLIDVPVIDEGEVQGDGEVQGEGEVQSEVQGEVQGEAAVEFGDEDGETDKLDTPPGNEEEGVEREKFPRFRMPEDDANA

SEQ ID NO: 188871 - protein, 99 aa, Glycine max
  Coding DNA Sequence Number=SeqID_72093
MKPHGLGGTRPHLKIRFVPRQCNNGPELLESRPQVRATVLALLVQCILVECRAPSSICELRWTLEMITIVEVARVRLRPVATAGLASAAAPALACNTSQ

SEQ ID NO: 188872 - protein, 48 aa, Glycine max
  Coding DNA Sequence Number=SeqID_72094
MVPKKLLTKRARKATAREGSSAALHAEIEFEGNRFQTEEHQRRFEAIK

SEQ ID NO: 188873 - protein, 44 aa, Glycine max
  Coding DNA Sequence Number=SeqID_72095
MVVPVSLGEPLSKVRDTRLPPRSASLTSLAGGGVVIEASPYHPP

SEQ ID NO: 188874 - protein, 176 aa, Glycine max
  Coding DNA Sequence Number=SeqID_72096
  Homolog annotation: Hit_ID=Q9AVI1; Match level="QueryCoverage=45%, HitCoverage=45%, E-value=4e-21, Identity=78%"; Hit description =Putative senescence-associated protein
APLTSLSEIPKLPVNARNPRHVRFDALPFAIKGERIRFLHARLVLPLHRPRSLNSSFFLAPSFSIPIRFVVVVVVVVFLFPSLTNHHDVDEQAEEEPDPEREEEELVAAVIDTALKSYAREGRLPVLGNNTTGFALYCPHLGSDALSPWDRIGSHGVRNFMLCKKPEGVADVDGDA

SEQ ID NO: 188875 - protein, 171 aa, Glycine max
  Coding DNA Sequence Number=SeqID_72097
  Gene Ontology: Mol. function=nucleic acid binding; Cellular component= oxygen evolving complex; Biological process=DNA integration
MTIVRFVLSLAASQGWHLHQLDVNTAFLHGDLNEKQLKHSLDAKFSIKDLGILKYFLGFEVARSTSDTGLLAAKSSSLPMDPTLKFRKSSGIPLSDPIVYRRLVGRLLYLTHTRPDICYAIGKLSQYLKSPTNIHMQVAHHILKYLKGTAGRGLFFSSSSFTSLTGFSDSD

SEQ ID NO: 188876 - protein, 243 aa, Glycine max
  Coding DNA Sequence Number=SeqID_72098
  Homolog annotation: Hit_ID=Q1SD42; Match level="QueryCoverage=59%, HitCoverage=16%, E-value=7e-07, Identity=31%"; Hit description=RNA -directed DNA polymerase
MAEALHVQNSPSNQGVIEGNFDASIVDGKGTGLGVIFRNEFGEVKAAATKFLPICVEVHIAEALVFRWAIESAAYLMLNPVVFESDCLRLVSAWSSRNSNSNSYFAGIIKDCAVLLSNSSFKVLTHMNRSANRAADGAKLAFLAFESYWIGDVPPQIGDFVQDGVRPDGHFSFFIYSSQGHIFKTLSKGAGGDFKDGAGEAKHRVSNYLQINSAGGSQSGSGKTSLLAALGSQLGEKLKHNLQ

SEQ ID NO: 188877 - protein, 120 aa, Glycine max
  Coding DNA Sequence Number=SeqID_72099
  Subcellular localization annotation: CTP_CleavageSite=73; ConfidenceScore=5.29e-01
MKPKYTLLFVFLSDYMNTLSLKLDPPSIRFTSIPSCRIHLRWRMTFFSSIRQMLVTVAPPQQQPRTRLPWRISAAIALNGAVRGDERIFHASNPVAHCNGRSGRVVFNIVMNHSRISHCS

SEQ ID NO: 188878 - protein, 74 aa, Glycine max
  Coding DNA Sequence Number=SeqID_72100
MDWMHEIEDDEGHWAKRASTAKYSFSVLSAIEESDRALISRTHAKREISALNATVIFSQAQRIIGTKLKSTYSR

SEQ ID NO: 188879 - protein, 169 aa, Glycine max
  Coding DNA Sequence Number=SeqID_72101
MNIFVRRKSGTKSNRRGNPTEGIATLGGVHPRTVRNNEDGTMVVRPWLFYLLSEQNTNAIMELSVLLKTKGIPRLIASCQRTVATSRRTSKTNDRCLFTRTIDREMIFALGVKKNTSQSNHEHRENARKHTIQRNRENMKLTLTPTATLAARLIASGSDNEESRRGELR

SEQ ID NO: 188880 - protein, 166 aa, Glycine max
  Coding DNA Sequence Number=SeqID_72102
  Homolog annotation: Hit_ID=Q1S2Y9; Match level="QueryCoverage=86%, HitCoverage=96%, E-value=2e-34, Identity=50%"; Hit description=Wound- induced protein WI12, putative
  Pfam annotation: Domain name=WI12; Domain location=67-166; Score =93.3; E_value=7.2e-25; Accession=PF07107.2; Description=Wound -induced protein WI12
MKIIPGSKAEPEKFSGTVTEHENRNRETVKLVYKALLRDADTEKLAKVVRAELEWWYHGPPHCQHMMKVLTGESTTAQKAFKFRPRRIRAVGDRVVVEGWEGAGEYWVHVWRFKHGIITQLREYFNTLITVVHRVSEDGDEARLWRSTNRVRVRVHGSLPDLVLSI

SEQ ID NO: 188881 - protein, 163 aa, Glycine max
  Coding DNA Sequence Number=SeqID_72103
  Homolog annotation: Hit_ID=Q9XES3; Match level="QueryCoverage=57%, HitCoverage=97%, E-value=4e-17, Identity=47%"; Hit description=Wound- induced protein WI12
  Pfam annotation: Domain name=WI12; Domain location=69-163; Score =89.3; E_value=1.2e-23; Accession=PF07107.2; Description=Wound -induced protein WI12
MFTCVPELANSQSQECLEEYVERNTRVVTELYKALTSKDPETLHGLVTQDLEWWFHGPPCHRHHLVPWLTGSSPSSKALVPQHMVGFGPVVIAEGFDDDHLVWWVHAWTVTADGLITQVKEYVNTSVTVTLLSQQVLPNASKCQCIWQSRLCDESVPGLILPI

SEQ ID NO: 188882 - protein, 433 aa, Glycine max
  Coding DNA Sequence Number=SeqID_72104
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-48, Identity=29%"; Hit description= UPI00006A17C9 related cluster
LHALAFRGLHVLLFKGLYTLAFIGLHVLLFRGLHTLAFRGLHVLTFKGLHALAFRRLHALSLRGLHALTLTRLHVLAFRGLHVLAFRALHVLAFRRLHALTYGGLHVLHFKGLHALEFRGLHVLLFKGLRALPFRGLHVLAFRWLHALAFKGLHVLAFRGLHALAFRGLHVLTFRRLHALLYKRLHALTLRGLHVLAFRGLDVLAFRGGLHALAFRGLHAHAFSGLHVLTFQRAARPLLQRVTCPHYKRTTRLHATFRRLHVLAFRGIHVLAFRGLHSIAFRGLHALDFRGMHALAFCGLRILTFRWLHALAFKGLHALTIRGVHVLALRGLHDLAFRRLHALTFRGLHVVAFRGLHTLAFSGLHVLTFRGLHAFAFRGPHALTFRGLHVLAFIVLHALSVSRLHALTLRGLHILAFRGLHVLTFRGLHVLTF

SEQ ID NO: 188883 - protein, 164 aa, Glycine max
  Coding DNA Sequence Number=SeqID_72105
  Gene Ontology: Mol. function=RNA-directed DNA polymerase activity; Cellular component=extracellular region; Biological process=RNA -dependent DNA replication
  Subcellular localization annotation: CTP_CleavageSite=55; ConfidenceScore=5.17e-01
MNLNTSGQRLCSSSHDFTKLISKNNPKSRTFPIHDRSIKITFDIFQIVLANSETLASISRSPNLKQSANFENKESSGTEMMSPSTEANQMCLTSSDKRIAWETVSTHFPHRGYISSNINTLLFKFLGTGKTFLQARQRKFLQLGIIFICQIFFQISPESLLEEA

SEQ ID NO: 188884 - protein, 226 aa, Glycine max
  Coding DNA Sequence Number=SeqID_72106
  Gene Ontology: Mol. function=RNA-directed DNA polymerase activity; Cellular component=extracellular region; Biological process=RNA -dependent DNA replication
MLLGVKLAVAHGKYLGLPSLIGRDGSMVELFNDRRVSNSMGGLAYWNLDVSVDPNMISSSGNSFDGGLFSVKSGYYQALESNVNPYASSSRLSGDIWKKIWQIKMIPNCKNFLWRACKNVFPVPKNLKRRVLMFDDMYPRCGKCVETVSHAILLSEEVKHIWFASVLGDIISVPEDSLFSKFADCLRLGDLDMLARVSELARTIWKISKFGEVMAAATKSLPTCVE

SEQ ID NO: 188885 - protein, 100 aa, Glycine max
  Coding DNA Sequence Number=SeqID_72107
MIQYHSYVLSAAPDVWNYNTSSSDSVLIKKIIQIRDFIISKELSTEEANKRIQSWSTNEQLLVGKAYEYIRGNLSKFGLTFVIWLFSVGVSLLYSALLTL

SEQ ID NO: 188886 - protein, 209 aa, Glycine max
  Coding DNA Sequence Number=SeqID_72108
MHNGQKIKSVVAIMNDGCSVRASAKIYVYLLQNERNNDSTTRTALTRMRGGANGGHDVKSFTILTLNEGKNDISILSVMGGDERWLTGGGAMAMSRLMLERVKGSTEVYFCGNNNNDNDNSDNCGGNGGTSTRVGGGGSVDVGGDDVSDANGHGSGVVGGSDTSASSGTNVDGGCGGAMLVVVVVSVSMVLMLVPVVVAIVAMGRIIVK

SEQ ID NO: 188887 - protein, 90 aa, Glycine max
  Coding DNA Sequence Number=SeqID_72109
  Gene Ontology: Mol. function=transition metal ion binding
MGCEELNQAHLYILNNTQEVIPYKEAHKEFVKISHSKMTKKQVNGNTSVKVDDMGFTLIDLNRVAYSDEPFIMAEQEKQVFYVRDLCSSR

SEQ ID NO: 188888 - protein, 225 aa, Glycine max
  Coding DNA Sequence Number=SeqID_72110
MERRNLHKRVANLQDGIIDVAVVKEFYANLYSPEDQSPKQVRVRGYLIKIDANILNTFLETAIVLEEGETLPTYSRFMRMRIDPQEFAARLCIPGRGFVLNVEGHPWKLLRKDLTTLAQTWSVFSYNNLTPTSHTSNLNMDRVRLVYGLVTDMDMNIIALISSQISTIAQMNFRGARKVTARPADIPCSSAPPAPSTSTTPTPAPPTSATLAPAAQDSQRFEAML

SEQ ID NO: 188889 - protein, 99 aa, Glycine max
  Coding DNA Sequence Number=SeqID_72111
MSSSIIVLVYLNERIFQSDDDIRFEGPKKAIQIKRGKYIALQICDDENVETMIESFQQQQEMGVIELCIEVDVVSASALNVANSLLSCGNNIAGNESKV

SEQ ID NO: 188890 - protein, 174 aa, Glycine max
  Coding DNA Sequence Number=SeqID_72112
MVTLGTFSSPWAHLGPLENLKVKQPAQLGEQVTSKGSNQLAWASCHTTSSPHERCTIGGNHRAFHRMRVERKDKELKGSSNDIISSYHKLLKSRTQGITWLPKLKGLSGEEAKIAEESEEVQALKAELKKTRVVKEKLETTITRVRKDCDELKDINMTTVKALERETKRARREE

SEQ ID NO: 188891 - protein, 147 aa, Glycine max
  Coding DNA Sequence Number=SeqID_72113
  Homolog annotation: Hit_ID=Q1SFR5; Match level="QueryCoverage=87%, HitCoverage=25%, E-value=2e-08, Identity=27%"; Hit description =Integrase, catalytic region
MAFFAISQHLAHPNRMRTTILEEAIHVKFNDTVPDKEISKLDESIVDLRLKDGIRPLISTDQPVEADTSSQSLEQPQPEEVKEPTRGILKKSHPESKIIGDPRSKVQTITSLINQGHITLISKVKPKHIDDAMEDEHQVKAMHEELD

SEQ ID NO: 188892 - protein, 203 aa, Glycine max
  Coding DNA Sequence Number=SeqID_72114
  Gene Ontology: Mol. function=RNA-directed DNA polymerase activity; Cellular component=intracellular; Biological process=RNA-dependent DNA replication
MNLKIKEEVKKQFDAGFLAVARYPEWVTNIVPVPKKDGKDNFCLPHINVLVDNTTNFAMFSFMDGFSGYNQIKMAMEGKEKMTFVTLWGTFCYKGMSFGLKNNRATYQRAMVALFHDMMHKEIKVYVDDMVAKSKTEEEHLVNLRKLLERLRKYRLRLNLSKCTFGVKSRKLLGFIISQKGIEVDPDNVKAILEMPKPCNEKQ

SEQ ID NO: 188893 - protein, 113 aa, Glycine max
  Coding DNA Sequence Number=SeqID_72115
MKTGVKIIHASGISGSIAYNWSRPNMKTGAKIIHASSCYGKVPVTRKGCLWLSGTYLFTSVGMMVAEVRSTITDIHEDLGYFQQTVETLSANTWIKGRCCVKQHGETQILSVV

SEQ ID NO: 188894 - protein, 123 aa, Glycine max
  Coding DNA Sequence Number=SeqID_72116
  Gene Ontology: Cellular component=intracellular
  Homolog annotation: Hit_ID=P49199; Match level="QueryCoverage=45%, HitCoverage=25%, E-value=4e-18, Identity=76%"; Hit description=40S ribosomal protein S8
MSDTSKVLLAWSTLDCHTIMEMKILVAVLTYFSMVMTINIDCNACYRKVKRALLNMLDGEAATEEVKKSNHVLRKLEKQKQNQVLDPHIEEKFGGGRLLACISSRPGQCGCADRSKNKGFPSF

SEQ ID NO: 188895 - protein, 82 aa, Glycine max
  Coding DNA Sequence Number=SeqID_72117
  Homolog annotation: Hit_ID=Q1STG1; Match level="QueryCoverage=34%, HitCoverage=32%, E-value=3e-09, Identity=93%"; Hit description =Hypoxia induced protein conserved region
YSNNGGFGKEVVGEVKRKIESFTGQSTRLCLFKGCNNSQNGITGRQAQAPYCWCLWLSGISGSIAYNWSRPNMKTGVKIIHA

SEQ ID NO: 188896 - protein, 143 aa, Glycine max
  Coding DNA Sequence Number=SeqID_72118
MGNSLRCCLACVLPCGALDLIRIVHLNGYVEEITRPITAGEVLKANPNHVLSKPSSQGVVRRILILSPETELKRGSIYFLIPESSLPENKRHAGKGSIGGDSVMLIILHYHKGTSKSLTKVLKRRDRRAGIAGKAASEYGGLI

SEQ ID NO: 188897 - protein, 715 aa, Glycine max
  Coding DNA Sequence Number=SeqID_72119
  Gene Ontology: Mol. function=solute:hydrogen antiporter activity; Cellular component=integral to membrane; Biological process =regulation of pH
  Homolog annotation: Hit_ID=O22920; Match level="QueryCoverage=96%, HitCoverage=84%, E-value=1e-125, Identity=35%"; Hit description =Putative Na/H antiporter
  Pfam annotation: Domain name=Na_H_Exchanger; Domain location=2-373; Score=90.7; E_value=4.4e-24; Accession=PF00999.11; Description =Sodiumhydrogen exchanger family
MAYYLVFLFQWSHQAGIILGPLFLGQHNSSYEMIFSTPSQMTLTTFAEFGMIIHFFKMGVQINPKLILKIEKQAVTIGLIGHMSAIALGGVIFNIVKVMYPEGIKDTDVHVLVISSSVTTFPVISGFLAEMNILNSEIGRMAISTSMVSDSCMWILYFVVINSAKAVEQQTYIPVTEIAVTICYFSILFFFLRPLVIWISNRNPQGKPMTESHFLSIICILLFVAFSASVAGQPPFLVAFCFGLILPDGPPLGSVLAERLDTIGSTLMVPSYCTITGLRTNVPSLVKSKTITIQVILIATYVGKFVGTILPSLHFQIEFWDSFALALIMCCKGLVDLCMLNMLLNSKAIEELPFTLAIFTMVVVTGFASIVVHYIYDPSRRYKAYIRKTIKGGQHEPDIKILVCVHNEENVYPIINLLQASNPTKATPISVFVIHLMELSGRAISTLTKSKSTNKSSQHIKNVFDQFQMHNKEGVMLQCFTAITPYVSMHDDICYMAMDSKSNIVIMPFHKQWSMDGNVEYSNASIRILNQNVLKKAPCSVGIFIDRSQMRGKLLIIYEKSLCEIAMVFLGGGDDQEALAYSLRMAQHPNVRLTVFWVTIKMQDNQRKTKNPYIDLMEHIRYSSYHEGKVTFKEEIVEDGAGTTQVIRMIEGHYSLVIVGRHHMADSPCTLGLTEWCDIPELGPLGNLLATSDFTFSVLVVQQQPPFNYEFQYIT

SEQ ID NO: 188898 - protein, 212 aa, Glycine max
  Coding DNA Sequence Number=SeqID_72120
MGDAKCTQYYCWCTQHLKPVLLLLEPLRPSSSASIVVRAPWCLLLLQPRWLCSPHRHCRALQKIDDRWMYYSDHLASAGEICLVLGQYAPKYMDWFFIISHPFMIATQQSDPPRHPPAMHDASFVKPHIPQVPKPPAAAPTHPCSHVDQPRHAMDVCHAITERLERLLNLRIVTAGTKTHEVMEECIRIARGVTEEGNVYVRSRRRRHTDQP

SEQ ID NO: 188899 - protein, 134 aa, Glycine max
  Coding DNA Sequence Number=SeqID_72121
  Gene Ontology: Mol. function=binding
MDGVVQYFCRFGHLACFTSDVEMFVEVLTTDKKAELLEKLMKTRDSLSAPLTKTLGLSISFFKIKQLLLGDMSKSSASDLEVSCVQMFEMYCKNLPLSKDMDPQESMHGEELLSMICNILVQGVLEWEETYKEI

SEQ ID NO: 188900 - protein, 492 aa, Glycine max
  Coding DNA Sequence Number=SeqID_72122
  Gene Ontology: Mol. function=binding
MLLPSAAMPSAICICKFLTRRHNLLSAIDNTDGGNSVRILNSEGNMVIEFVQFKDRLQHSSQYLVARVETSILQLKQNADNIEEEEGVLQSLKCGIQFLELSKEVGSKSLTFNEDLQSRPWWTPTSEKNYLLDYNLVLFSNVSVIDDCYIKLNGWLPSVSGPFEGISYYPREILTKDRETSLKRVIEKKSLLPRMIYLSIQSASASIKEHVEVNGSVTPDIISELKLLLECYAQLLGFSLTEAIEVVMGFSNGERSCVVSDSNLIDWLNFTVFLNAWSLSSHELVQPDGNGCRPRIWNILDSMLEKYILEKVRFQEPQLCSPWSGMELLMQLVTEPLAWHGLVIQSCLRSCFPSGKKKKKSGLAYQSSMNLTKAITDSVVHLSHVLEDVLTWITEWNKRPEDEHLENILLLLRKDGHNDGPGEVFHILETFISSMNDAELGDRISQSLKSWSPADVFRKMMTGKLKVLTEFSAICESKLKLFNSMKQQIAQL

SEQ ID NO: 188901 - protein, 243 aa, Glycine max
  Coding DNA Sequence Number=SeqID_72123
  Gene Ontology: Mol. function=nucleic acid binding; Cellular component= membrane; Biological process=DNA integration
  Homolog annotation: Hit_ID=Q1S326; Match level="QueryCoverage=97%, HitCoverage=69%, E-value=7e-42, Identity=39%"; Hit description =Putative receptor kinase-related
MVVIRHCPLHQLDIKNAFLHGELQQEVYMDLPPGFTAFGGSHLADHFVFSLHSPFGMCISLVVYVDNIIIIGDDFDDIPPAQIPCTQPISDQDLGPLKYFLGIENALDILTETDMLDCRPSDTPMDPNFKLLPYQRNHWKTWEDIDNFHWDAVMHILQYIKNALGCGLLYEDKGNAKIVRLIVRQKDTKFICDNQAALYIASNLVFHERTKHIEIDCHFVREKVLSGKVTTDFVRSNDRGPIH

SEQ ID NO: 188902 - protein, 119 aa, Glycine max
  Coding DNA Sequence Number=SeqID_72124
MSVTPLFGYWCEGAVTGGVVGVQMVTCQKGAARGGMSEVGQKGTPEGGGSSVGVELEKKWHGGDQKGCAVAREDCQWTEAVRMEVADGWWSSELEFEVTSGRLLVWRQLHEGDWERKRT

SEQ ID NO: 188903 - protein, 54 aa, Glycine max
  Coding DNA Sequence Number=SeqID_72125
EALSANLLRFLNSWKYAKRAYCAKPELLSKALSAACCAKPQMFTVPYNFKLGLA

SEQ ID NO: 188904 - protein, 90 aa, Glycine max
  Coding DNA Sequence Number=SeqID_72126
MGRLSSTIEIPHKRHRQNDRHTPDFYVSDNYRCHRNPSYDSYDRHTERHHCLSELPEHKNLRHTNRTYNENVIPKKFGHGNTTYLDRDLI

SEQ ID NO: 188905 - protein, 146 aa, Glycine max
  Coding DNA Sequence Number=SeqID_72127
MSLEDHINFHCRLPASPLPPQKGYHCFCPTVKWYLVSIDVAFFESTPFFSASVDNIASLHAPSIFSNPAPIVVPTPCVVPNPAIVVAPPPLIIYQQWLQLPLAIPPTDLAKSCPTPNVPPPMSPVHELPIALRKGIRYSRNPNSSS

SEQ ID NO: 188906 - protein, 126 aa, Glycine max
  Coding DNA Sequence Number=SeqID_72128
MMKVYGKTSLQAECESNALFNVIMATDPTSPPQSDGQSEATSKRSRTTTRLRTLTLRTVDQPRPAVYVDPATGRASGPMREKFHSYLGVVAREKVPIIHNNWKDVPETLKEIVWNDILRTAQGQFK

SEQ ID NO: 188907 - protein, 986 aa, Glycine max
  Coding DNA Sequence Number=SeqID_72129
  Gene Ontology: Mol. function=transferase activity; Biological process= response to oxidative stress
  Homolog annotation: Hit_ID=Q9SS68; Match level="QueryCoverage=99%, HitCoverage=99%, E-value=0.0, Identity=70%"; Hit description =Putative phosphoribosylanthranilate transferase
  Pfam annotation: Domain name=C2; Domain location=267-347; Score=6.4; E_value=0.059; Accession=PF00168.20; Description=C2 domain
  Pfam annotation: Domain name=C2; Domain location=422-506; Score=43.5; E_value=7.1e-10; Accession=PF00168.20; Description=C2 domain
  Pfam annotation: Domain name=C2; Domain location=577-669; Score=82.6; E_value=1.2e-21; Accession=PF00168.20; Description=C2 domain
  Pfam annotation: Domain name=C2; Domain location=9-94; Score=93.1; E _value=8.4e-25; Accession=PF00168.20; Description=C2 domain
  Pfam annotation: Domain name=PRT_C; Domain location=832-986; Score =321.3; E_value=1.8e-93; Accession=PF08372.1; Description=Plant phosphoribosyltransferase C-terminal
  Pfam module annotation: Pfam domain module=C2::C2::C2::C2::PRT_C; Domain location=267-347::422-506::577-669::9-94::832-986
MAEGSGRRLMVEVCNAKNLMPKDGQGTASAYAIVDFDGQRRRTKTKSRDLNPQWDETLEFIVHDKDSMTSETLEVNLYNDKRTGKRSTFLGKVKISGSTFVKSGSEAIVYYPLEKRSVFSQIKGELGLKVWYVEEDPPETENAGEEKAESAPPATEEKLPENSQEGEKKEDKAEETQDEEKKEDENKPKEESKEEEKPKEEAPEAAVPPPEVENPPIAQTEKPKPPKEKHVEVQKRADLNVSDHELRSLRGDRSRSAYDLVDRMPFLYVRVVKAKRAKPETGSTVYSKLVIGTHSVKTRSESEGKDWDQVFAFDKEGLNSTSLEISVWSEEVKEGDEKSESSLGTVSFDLQEVPKRVPPDSPLAPQWYTLESETSPANDVMLAVWIGTQADEAFQEAWQSDSGGLIPETRAKVYLSPKLWYLRLTVIQTQDLQLGSEGPEAKARNPELYVKAQLGAQVFKTGRASPGSANPTWNEDLVFVAAEPFEPFLVVTVEDVSNSKTVGHAKVHVSSIERRTDDRTDSKSRWFNLASEDEYTGRIHVRVCLEGGYHVIDEAAHVTSDVRASAKQLAKPPIGLLEVGIRGAANLLPVKTKDGTRGTTDAYVVAKYGPKWVRTRTIMDRFNPRWNEQYTWDVYDPCTVLTIGVFDNGRYKRGEDGKPNRDCRVGKIRVRLSTLDTNRVYVNSYSLTVLLPGGAKRMGEIEIAVRFSCSSWLSLMQAYASPILPRMHYVRPFGPAQQDILRQTAMRIVTARLARSEPALGQEVVQFMLDSDTHVWSMRRSKANWFRVVGCLSRVATLLGWVDGIRTWVHPPTTVLVHVLLSAIVLCPYLVLPTVFMYAFLILLLRFRYRQRVPQNMDPRMSYVDMVSLDELDEEFDGFPTTRPAEVVRIRYDRVRALAGRAQTLLGDMAAQGERLEALFSWRDPRATGLFAVLCLVMSLLFYAVPFRGVVLVAGFYYLRHPRFRDDMPSIPANFFRRLPSFSDQI

SEQ ID NO: 188908 - protein, 220 aa, Glycine max
  Coding DNA Sequence Number=SeqID_72130
  Homolog annotation: Hit_ID=O22181; Match level="QueryCoverage=32%, HitCoverage=80%, E-value=2e-08, Identity=49%"; Hit description =Expressed protein
VGVVGKGRKGWGEQGLQDQQDVLVCQALPSTLSHKIPPPPSFHLNYEIVEVVYAQPSLTPCCSWKEVSGRPARLVAPSRPTLPNPVPPSLPPSHVMSCVAIMGNASNGEAYSRPLSIIETEKSVTGGEVVDFFDWLSLGAMKDSGPSPGVGHKFTNSETLGGIKDSGPSSGGPGHQFTNSQTLGGIKNSGPSPGGEGHKFTNSETLGEMKDSGPSPGQGH

SEQ ID NO: 188909 - protein, 57 aa, Glycine max
  Coding DNA Sequence Number=SeqID_72131
MGNSSKDNDSATSADASAGDIPPSNSGVYSEGEKVQKTEIRKSEWKYFVHYLGWSKK

SEQ ID NO: 188910 - protein, 117 aa, Glycine max
  Coding DNA Sequence Number=SeqID_72132
  Gene Ontology: Cellular component=membrane
  Homolog annotation: Hit_ID=Q9FGG3; Match level="QueryCoverage=72%, HitCoverage=23%, E-value=1e-07, Identity=37%"; Hit description =Nodulin-like protein
MLFKRFKFLSVRSFSSKGVIVTGICYWLQVCTIETKGPVFTAMFTPLALIITAIFSALLWKETLYLGSVGGTVLLVVGLYSVLWGKIKESVKEGVKGENLEVEETKEEPRLECIVQH

SEQ ID NO: 188911 - protein, 484 aa, Glycine max
  Coding DNA Sequence Number=SeqID_72133
  Gene Ontology: Mol. function=indole-3-acetate beta-glucosyltransferase activity; Cellular component=cytoplasm; Biological process=metabolic process
  Homolog annotation: Hit_ID=O22182; Match level="QueryCoverage=97%, HitCoverage=98%, E-value=1e-113, Identity=44%"; Hit description =Putative glucosyltransferase
  Pfam annotation: Domain name=UDPGT; Domain location=7-480; Score= -69.4; E_value=4e-07; Accession=PF00201.9; Description=UDP -glucoronosyl and UDP-glucosyl transferase
MSVDERVNVLMVSMALQGHMNPMLKFAKHLISKGVHVTIATTEDGRHRMLKKTKPSNANSNNSNNKNNLKFSDNSGIELVFFSDGLSLGFDRSDTESLVNTTREKGSTNFSTLLTGLTKVRKYACVVVNPFVPWAIDVAAEHGIPCAMLWIQASATYSIYYRYLKNINSYPNLEDPNEKVHLPGLPPFEVKDIPSFILPSTPYHFRHLIRGLFEALNKVNWVLGASFYEIEKEIVNSMASLTPIYSVGPLVSPFLLGENEKSDVSVDMWSAEDICLEWLDNKPDSSVIYVSFGSLLVLSQKQVDNIAAALKNSNKAFLWVVKPGGSNDDDVVAAELPNWFLDETNYKEKGLVVKWCPQEKVLMHPSVACFISHCGWNSTLETVVTGVPVIAWPFWTDQPTNAMLIENVFRNGVRVKCGEDGIASVEEIERCIRGVMEGKSGEEIKKRAMELKESAQKALKDGGSSNKNINQFITDLIAWNSARA

SEQ ID NO: 188912 - protein, 100 aa, Glycine max
  Coding DNA Sequence Number=SeqID_72134
MADSGTIFCSSLLLCFNIPNSHGISGRHKWRGKAMGGAAEEEGEKWMSMGRAIKGWVKNHVSSHFREREREDNKQNGGGCWSREIHKFHLLCSRFTGPSY

SEQ ID NO: 188913 - protein, 57 aa, Glycine max
  Coding DNA Sequence Number=SeqID_72135
MDNGSQLFYQPNLLCGIKPNDAMRDNNNENVDGEDTNIQAQPSYLDFSSYFIVDKIF

SEQ ID NO: 188914 - protein, 104 aa, Glycine max
  Coding DNA Sequence Number=SeqID_72136
MTDLREVSTASNHLSATHHGAWWCLEEEDEGASPNYSLVSEKMESSQKYDVVYKVVELQLEESRRKSIICTHFFPSSLSIFSLTNVINALLHDIKTVLFLGCEK

SEQ ID NO: 188915 - protein, 119 aa, Glycine max
  Coding DNA Sequence Number=SeqID_72137
  Gene Ontology: Mol. function=drug transporter activity; Cellular component=membrane; Biological process=multidrug transport
  Homolog annotation: Hit_ID=Q1SB90; Match level="QueryCoverage=66%, HitCoverage=16%, E-value=1e-12, Identity=49%"; Hit description=Multi antimicrobial extrusion protein MatE
MAKYFSLMLQSSDSELCFRLFGMVTELRILRGQNSRQLSTYTSILCLAFLHWHSLFTLDEEVIALTTIMLPIIGHYELGNCPQTTMAALSKKLMVKRVSLSLGLRDGMPQSMIPPSRPG

SEQ ID NO: 188916 - protein, 89 aa, Glycine max
  Coding DNA Sequence Number=SeqID_72138
IALGESSISEGKDSLLIPEHTEIIASSLLSRCPHRSEIQSIALAEVESCGYVMLGSVDSYGHLIVSKLDASGEAVVLWCQFRNKDMFLD

SEQ ID NO: 188917 - protein, 154 aa, Glycine max
  Coding DNA Sequence Number=SeqID_72139
  Gene Ontology: Mol. function=structural constituent of ribosome; Cellular component=ribonucleoprotein complex; Biological process =translation
  Homolog annotation: Hit_ID=Q9SWS9; Match level="QueryCoverage=81%, HitCoverage=81%, E-value=1e-34, Identity=61%"; Hit description =Ribosomal protein S26
  Pfam annotation: Domain name=Ribosomal_S26e; Domain location=1-134; Score=232.4; E_value=9.9e-67; Accession=PF01283.9; Description =Ribosomal protein S26e
MTFKRRNGGRNKHGRGHVKFIRCSNCGKCCPKICARHFNFQQLTFCARSVKQDKAIKRFLVRNIVEQAAVRDVQEACVYEQYTLPKLYVKMQYCVSCAIHSHVVRVRSRTDRRKRDPPQRFIRRRDSLDKTCVIVLMHGNGSSKTNGDDIESDI

SEQ ID NO: 188918 - protein, 107 aa, Glycine max
  Coding DNA Sequence Number=SeqID_72140
MKLSVLLLVFLTVLAATRPSLVNCRVLSPQKNTEKAPHEPLKVIRFLINLVMAEKANTSEGNMSNRVLAENKFQTMSSGPSRRGSEEEKVYWWKKIEFGSVWQFKSK

SEQ ID NO: 188919 - protein, 108 aa, Glycine max
  Coding DNA Sequence Number=SeqID_72141
MVLLIVLNCSFVQTAVARSFCKTIDIYDQDIHIRTLRPLWYPTSLNFLQDGVNGNQSSTLAITEGSQWLKASLDSMVRLLLCDLEVTSSNLGNNLFVCGGKTTCIYPP

SEQ ID NO: 188920 - protein, 54 aa, Glycine max
  Coding DNA Sequence Number=SeqID_72142
MASVDFFFKSDFKNSECSKHMMGDVSKFTTISPKKGGHVTYGNNNISKISKEDN

SEQ ID NO: 188921 - protein, 785 aa, Glycine max
  Coding DNA Sequence Number=SeqID_72143
  Gene Ontology: Mol. function=solute:hydrogen antiporter activity; Cellular component=integral to membrane; Biological process =regulation of pH
  Homolog annotation: Hit_ID=Q1HDT2; Match level="QueryCoverage=94%, HitCoverage=93%, E-value=1e-145, Identity=35%"; Hit description =Cation/H+ exchanger
  Pfam annotation: Domain name=GntP_permease; Domain location=78-418; Score=-345.5; E_value=0.082; Accession=PF02447.7; Description=GntP family permease
  Pfam annotation: Domain name=Na_H_Exchanger; Domain location=76-448; Score=95.9; E_value=1.2e-25; Accession=PF00999.11; Description =Sodiumhydrogen exchanger family
  Pfam module annotation: Pfam domain module=GntP_permease::Na_H _Exchanger; Domain location=78-418::76-448
MTRVFPVQRLLQASNNGLLQKGLINPAHILPQNMVNITINNSTFSYPILCHSVQDSHSVAIFYGDNPFVHSFSLVMFNLMIITAITSIFRILLKPLKQPLIISQIIAGVIVGPSFLGGIRWFQSNMETESTKFLIKNLGKMGFMFFVFVYGVKMDPTLLKKSGKLHLSTSLIGIIIPITIVVAVALSMKKITDKQEAMIPSLGAIAGYLGVTSFPVLYIILKEFNLLNSDMGRFALYTALIGDTLGMIFVVFVEKGETKMLTTLWPIMTWINNNTPQGHPVQQSFVVAILLGVFVMGFVTDMFGIAICNGPLFLGLVIPDGPGVGATLVKKAETIMSDLLLPFSFIMVGSYTDFYAMSASGWSSLSPLFVMVVTGYIIKFISIWIVLYFWRMPLRNGLAVSLIMSLRGHVELILFVAWMEKKILKVPAFTLLIIMTVAVTATCSPLINILYDPTKPYMVSQRRNIQHNPPDQELRIVLCILDTEAINGLIRLLDISNPTSSSPFSISVVRLTELVGRSSPLFIDHEKQQVPPIYQWTNTINVLEHHQELKGMSMQLHFFTSVAPKQSMFRDICELALEQEASLIILPFDSADVHDHAARAVNSQVLNNAPCSVAIFVDKGLLEINKIGSSIRRTPYRFAVLFLGGGDAREALVYADRMVANQDVFLEVVRFLPENFLRYNDIERKLDDGIVTWFCVKNEMTQRVVYREVLVRNGEETIERIQDMNDGAFDLFIVGRKHGINPILLTGLSEWSESEDLGLIGDYISSADFFGSASVLVVQQQILRG

SEQ ID NO: 188922 - protein, 139 aa, Glycine max
  Coding DNA Sequence Number=SeqID_72144
  Homolog annotation: Hit_ID=Q5EEQ0; Match level="QueryCoverage=95%, HitCoverage=86%, E-value=2e-42, Identity=64%"; Hit description=Zinc finger protein
MEDDGSNSIRRMSSRTRKAALARLDALENDNAGFEIADANNDDDDASLDEEDQFYMQKKQSKGTKRKTRQAKALEARRAPRTFLELLHEANLESLPPHVPSYWKAAVGPPSSTSRRHFCTVCGFSANYTCVRCVFTSTV

SEQ ID NO: 188923 - protein, 81 aa, Glycine max
  Coding DNA Sequence Number=SeqID_72145
MCLPGKGTRGEQVTDAQDFGWQSKREDHFRSWFPFFSCFLGDKSALFRHRLGKVYGELGLWLMACRTDGHDICQGVGMVQR

SEQ ID NO: 188924 - protein, 57 aa, Glycine max
  Coding DNA Sequence Number=SeqID_72146
MTGKVNLGLNFRMSIRTCSKAWAEQMRKMSDKGESKSHFQGKLGVEGSNLESEEFLP

SEQ ID NO: 188925 - protein, 158 aa, Glycine max
  Coding DNA Sequence Number=SeqID_72147
  Gene Ontology: Mol. function=transporter activity; Cellular component= mitochondrial inner membrane; Biological process=transport
MNSGTIDFVEENGNGSDSDANSDDAPEYYQPISAVDDDGSSDDEHDGELRHVPNGFAVHVMVKNGISSLDLNDIAEKSSSDEEEEQEEEEEERREDFERALREEENRRNAPLTIENATRVMDVMRRESFAGVVPDWAARDPNDRWVDQLRRLRQSSNT

SEQ ID NO: 188926 - protein, 372 aa, Glycine max
  Coding DNA Sequence Number=SeqID_72148
  Gene Ontology: Mol. function=catalytic activity; Cellular component =mitochondrion; Biological process=protein amino acid dephosphorylatio n
  Homolog annotation: Hit_ID=Q9AVI0; Match level="QueryCoverage=80%, HitCoverage=93%, E-value=3e-98, Identity=68%"; Hit description =Putative senescence-associated protein
  Pfam annotation: Domain name=PP2C; Domain location=76-281; Score= -39.7; E_value=0.0012; Accession=PF00481.12; Description=Protein phosphatase 2C
  Pfam annotation: Domain name=SpoIIE; Domain location=98-323; Score= -37.3; E_value=0.1; Accession=PF07228.3; Description=Stage II sporulation protein E (SpoIIE)
  Pfam module annotation: Pfam domain module=PP2C::SpoIIE; Domain location=76-281::98-323
MAVCEGEGVLRLKRETMAIPMLRAAMISHSQSQPLIHSISAIYETAKRRKRVVFSSSSSELNPVIRYTTHVLFVKWLSPGLFFLKVNTGGEDAFFVSNYNGGVIAVADGVSGWAEEDVDPSLFPRELLANASNFVGDEEVNYDPQILIRKAHAATFSTGSATVSIVAMLEKNGTLKIANVGDCGLRLIRNGHVVFSTSPQEHYFDCPFQLSSERVGQTYLDAAVCNVELIQGDTIVMGSDGLFDNVFDHEIVPTIVRYKDVAEAAKALANLASSHAMDSNFDSPYSLEARSRGFEPPLWKKILGMKLTGGKLDDITVIVEDKVLIAEITREGFALSILRQLNFGDALRNKDLFIEVSSPALPVVLHALRKAV

SEQ ID NO: 188927 - protein, 121 aa, Glycine max
  Coding DNA Sequence Number=SeqID_72149
  Gene Ontology: Mol. function=transferase activity, transferring hexosyl groups; Biological process=metabolic process
  Homolog annotation: Hit_ID=Q1SIP8; Match level="QueryCoverage=88%, HitCoverage=36%, E-value=7e-09, Identity=29%"; Hit description =Probable indole-3-acetate beta-glucosyltransferase T27E13.11- Arabidopsis thaliana
MDEIANALHDSNVRFMLVTRGETPWLKEIYGHMGMVVAWRGHRVKKDDKLDTSMRRDEIVVLLRKFMELDSDAGRDMRKRAKELQHMAQLAITKNGSSEIEAFMKNMVESGTSIIQVQNGI

SEQ ID NO: 188928 - protein, 179 aa, Glycine max
  Coding DNA Sequence Number=SeqID_72150
  Homolog annotation: Hit_ID=UPI000066ACC5; Match level="QueryCoverage =71%, HitCoverage=75%, E-value=1e-28, Identity=47%"; Hit description =hypothetical conserved secreted protein
MLVADEEAKERTMQKLAGIMLLGCMSVSAAQAADLSFQNAQGNIEVVPGKPTFVHKLHYRKLYDEKPFPDAVIYYYSNGVYKILSQGENHYGLYVMQGSVEDQSYTIRYISAPSKDWGNKTAFHQLTFVNGAQAKVFIQNAITDTGEQIAQQNGEFLLQDQDPAHAAADSWDDDLKIKR

SEQ ID NO: 188929 - protein, 214 aa, Glycine max
  Coding DNA Sequence Number=SeqID_72151
  Gene Ontology: Mol. function=phosphopantetheinyltransferase activity; Cellular component=enterobactin synthetase complex; Biological process=macromolecule biosynthetic process
  Homolog annotation: Hit_ID=Q8GFC6; Match level="QueryCoverage=52%, HitCoverage=47%, E-value=2e-14, Identity=40%"; Hit description=NrgA
  Subcellular localization annotation: CTP_CleavageSite=51; ConfidenceScore=5.13e-01
MTAPLPRQTRLFVTTATGPDLIVQGAKSCSIISHHTSFMLRIRMRKNSCTQASAKWSWRMILAAMISSAWRATDEELRYPAKSLTRSSLFGLLCPRLTAETPLPLPACGFITAAGHTAESLSLAWCRFDRQQWHAALPAQWQLPLPSALQQAASKRKIEYLASRWLVRQQLAQLGITDFVLHNAPDRSPCWPAGIRASLSHSHDCVVMAATREA

SEQ ID NO: 188930 - protein, 286 aa, Glycine max
  Coding DNA Sequence Number=SeqID_72152
MALRKLPSKRSRKDTTREGSSAATQADTNLTSINFGAQSISSALRPSRDGHSSERGRHWASLVTPMAKFDPEIVMEFYANAQPTKKGVRDITPGSVSTIRGGDMSLALMRRPLPSYCAYRGKISPIPLQGDGNGDYETPYAPGKVQQGPRVSRADYGPLLVLRSGEAPQQPGDGQPQAADAPPSPPESTSAHLQSTLYASRAGIPALIHGVATYPFAGERGEAHGKPVMKNILDSGVIFTFEEGISTSHVDKHEAHAPTYPPSQRKSNLRSSFKRGESSGSFYLKG

SEQ ID NO: 188931 - protein, 142 aa, Glycine max
  Coding DNA Sequence Number=SeqID_72153
  Gene Ontology: Biological process=metabolic process
  Homolog annotation: Hit_ID=UPI00005F6FD0; Match level="QueryCoverage =54%, HitCoverage=50%, E-value=2e-28, Identity=67%"; Hit description =COG3558: Uncharacterized protein conserved in bacteria
MIYMILAITAGTIRRADVKALHQRRASCTASALAQCNKAATGRVALRAVAWHELCSVDGGLNISETQLAQARMIVRASASRPVNQPRFSANRQIVDAGEALNHQTIGTKVPVFIAVAAEPVAAVIAPLIGKTHRQLIVVPRP

SEQ ID NO: 188932 - protein, 65 aa, Glycine max
  Coding DNA Sequence Number=SeqID_72154
MKGRLVVVEVTESGEAERDKQETVVVLVGEKERDELTDDLQPQQQSLPPSGRGDGECERPRDELG

SEQ ID NO: 188933 - protein, 78 aa, Glycine max
  Coding DNA Sequence Number=SeqID_72155
MGAKYLEAVKQRLHAINNGPWTTLGYDTWPTPKQFEAAIAWHGDWLDFQAEAGSAGTSRGGDKAQDDQDIADLIDFLL

SEQ ID NO: 188934 - protein, 192 aa, Glycine max
  Coding DNA Sequence Number=SeqID_72156
  Homolog annotation: Hit_ID=Q2RBM1; Match level="QueryCoverage=27%, HitCoverage=29%, E-value=4e-07, Identity=50%"; Hit description =Expressed protein
MSHSVDEQLSFLRSLIQARSFCDSTLRFLESLLVSKDVKSLIEVRSSLTHLLRSESLSVIRSIAAKTVHDKLLVLDFFVRAFSLVGDQQSCLALRYEALVMREHKSASCQWLQVSPAEWLSFVENAVHNGFHAVAEKACEIALSCLGNNDDLKHGRDPVPENLKAVISEITRLRNCAMASVASRSGISSLIH

SEQ ID NO: 188935 - protein, 504 aa, Glycine max
  Coding DNA Sequence Number=SeqID_72157
  Gene Ontology: Mol. function=nucleic acid binding; Cellular component= intracellular
  Homolog annotation: Hit_ID=Q00ZH4; Match level="QueryCoverage=20%, HitCoverage=37%, E-value=3e-16, Identity=44%"; Hit description=[R] KOG1995 Conserved Zn-finger protein
  Pfam annotation: Domain name=RRM_1; Domain location=370-450; Score =28.6; E_value=2.1e-05; Accession=PF00076.12; Description=RNA recognition motif. (a.k.a. RRM, R
  Pfam annotation: Domain name=zf-RanBP; Domain location=142-173; Score= 37.3; E_value=5.3e-08; Accession=PF00641.9; Description=Zn-finger in Ran binding protein and others
  Pfam module annotation: Pfam domain module=RRM_1::zf-RanBP; Domain location=370-450::142-173
MSGAYGQDGGGSAPPSYGASGGYGSTGGGAGGGGSYGGGGYGGGGGGGGYGGSDGGGGGGYGAKGSGNGGGYGGNDGGGYGGRGGYSGNDGGGYGGRGGGGGGGQGGRGGGGYGGRGGGGGFQGGDRGGRGGGRGGGRGGGRDGDWRCPNQSCGNLNFAKRVECNKCGAPSPNPNSSNDRGGGYNRGGGGGGGYGNNRGGRGNDYNSGGGRSGSYDGGRGNDYNSGRSGSSDGRGGSYRGNQGREDGGYGQVPAPTAQSYGGGAGGNYPPTYSSYGGGNASYGTEAVPPPASYTGGPNSYPPSYGGNVGGYGGDNQGDGRSGGRSGPPTGYDSTYGAGNRGGFGGSSAEPPAAVRQCDENCDDTCDNSRIYISNLPPDVTIEELRELFGGIGQVGRIKQKRGYKDQWPWNIKIYTDDNGNNKGDACLAYEDPSAAHSAGDYDLRGYKISVAMAEKSAPRAPPAYNQGGNRGGYGGDRRRDNYRDGGGGSGPDRRDHYGNRSRPY

SEQ ID NO: 188936 - protein, 140 aa, Glycine max
  Coding DNA Sequence Number=SeqID_72158
MSHAIRLDRSLKAGGPFARHPLDCPWMTKNNHLRYFHLPPDAWVRINRCCLSTDNHLGISACHLTHGYIRLPPEAWVRIRRCCLCTDNHLGISACHLTHGSGSTNVVRPKESQPEGVDISGKGRDDHIGLRLSIRLGVSK

SEQ ID NO: 188937 - protein, 45 aa, Glycine max
  Coding DNA Sequence Number=SeqID_72159
MVKSRNQLNLGTTRDHIMFERKRRQLMAERFIALSAIIPGLKVSA

SEQ ID NO: 188938 - protein, 471 aa, Glycine max
  Coding DNA Sequence Number=SeqID_72160
  Gene Ontology: Mol. function=RNA-directed DNA polymerase activity; Cellular component=chromatin; Biological process=chromatin assembly or disassembly
  Pfam annotation: Domain name=rve; Domain location=254-380; Score=8.5; E_value=0.0012; Accession=PF00665.16; Description=Integrase core domain
FDDLKIAMTTTPVLSLPDFTIPFVVETDASGTGMGVILMQRSHPIAYFSKQFYPKLLRSSTYICELHAITSAVKRWWQYLLGHTFVILTDHKSLRELMVQPVQTPEQHVYLAKLLGYNYSIQYKVEHSNMVADALSRQTDIDHTTTMFSILSIPRPKFLDDLKIELASSEEFNDLTTRVTKDPEQHLMFILRDGLLLYKGRIWINRDNNFIALLLEEFHKSPLDTQQFIKRCVDCLQTKYIPQKPTGLLQPIPPPSRAWEDLALDFITGLPNSQGAIVIMTIVDRFSKGAHFGSLPSHFTTHTVAQLFIDSICKFHGFPRSLIFYRDPIFISKFWKELFRLCGTKLRMSTAYHPQIDDQTKGYNTTCHSSTNLTPFEVTYGKPPPTITDYLPGSSSMEAVDFLLSSRQHLFETLRQKLECTQVKMKQLVDTHRREATFNIEDWVYVKLRPYRQTSIADKYQKLSKRFYGPY

SEQ ID NO: 188939 - protein, 79 aa, Glycine max
  Coding DNA Sequence Number=SeqID_72161
MRGSFLGFGLEEDSAIQARNKRSQILFCWLMVRSMLEVVVGISDLIRHDGGIMEKLALLFYYSKKAQSLPCIEEVYVKT

SEQ ID NO: 188940 - protein, 718 aa, Glycine max
  Coding DNA Sequence Number=SeqID_72162
  Gene Ontology: Mol. function=RNA-directed DNA polymerase activity; Cellular component=chromatin; Biological process=one-carbon compound metabolic process
  Pfam annotation: Domain name=Chromo; Domain location=608-656; Score =10.6; E_value=0.054; Accession=PF00385.14; Description='chromo' (CHRromatin Organisation MOdifier
  Pfam annotation: Domain name=rve; Domain location=367-523; Score =111.3; E_value=2.9e-30; Accession=PF00665.16; Description=Integrase core domain
  Pfam module annotation: Pfam domain module=Chromo::RVT_1::rve; Domain location=608-656::2-162::367-523
MADSICSKTNIDRMEEAIAKLASNQHHVTSKLDDIIQCLTTCITVKDRFPIPTIDELLDELGDVSKTAFRTHHGHYEFLVMPFGLCNAPSLFQATKNSAFSPYLRKFIIIFFDNILIYSSFLPEHLAHLEKAFAVLLAGGFFLKYSNCSFAQTHIEYLGHMVSNNGVHLVPTKIEAIRNYPTPRSIRALRSFLGLSGFYRRFIQGYASIVAPLTKLLVKDQFQWIAAAQRAFDDLKHTLCSAPVLELPDFSQPFVVETDASGVGMEAQVYLAHLPRFDYSIQYRSGKSNAAADALSRIPENYTGQLFTLIVPHLVFMEDLKKHRIWLPKGFSFIPLLLEEFHSTPNGGHMGIAKTVAQVTQNIMWQVLACPWEDLSLDFIGGLPSFRGSSVILVVVDRFSKRVHLGMLQSTYTAFIVAHLFLDIVVKNHGMPHSLVSDRDPLFLSKFWQELFKLSGTKLRMSSAYHPQSDGQTEVLNRVIEQYLRSFVHQRPSSWGKFLLWAEWPYNTSIHTATGMTPYEVTFGKKPSSIPPYLPGTSNIDAVDDFFTSREAIFTIARKKLLKAQHTMKHFADTKRREVQFKVGDMASVIPIPVDSLPSNSVDNEPVITPLVILATKWASSSDGPELLALVQWQGLLLEDTSWESWTELKEEYHLEDKVLSDVAGDVMKQQQNKTEMQPNKKHTNTDKKQTNTHLRDKRELCKPHNLEDFVTSFWTKR

SEQ ID NO: 188941 - protein, 180 aa, Glycine max
  Coding DNA Sequence Number=SeqID_72163
  Gene Ontology: Mol. function=hydrolase activity; Biological process =metabolic process
  Homolog annotation: Hit_ID=Q0ZPV7; Match level="QueryCoverage=76%, HitCoverage=45%, E-value=3e-21, Identity=39%"; Hit description=CXE carboxylesterase
MILTWTIDIVTDVAPVCGLVMWVNVEKEYLQFKKWYKNDEGLRAIEEENGVEALKIQGLILCQALFGDTKRTGSELRPENNPFIPLCVTSTDLMWELALPIGANRDHEYFNPRAGNVVEKLDKMREHGWRELAQLMKKRSRMQVVKDFEEEGFRGIELLEPSKAKHLIALVKGFIYSICA

SEQ ID NO: 188942 - protein, 180 aa, Glycine max
  Coding DNA Sequence Number=SeqID_72164
  Gene Ontology: Mol. function=hydrolase activity; Cellular component =nucleus; Biological process=metabolic process
  Homolog annotation: Hit_ID=Q0ZPV7; Match level="QueryCoverage=89%, HitCoverage=47%, E-value=2e-49, Identity=61%"; Hit description=CXE carboxylesterase
  Pfam annotation: Domain name=Abhydrolase_3; Domain location=78-180; Score=-23.0; E_value=3.4e-06; Accession=PF07859.3; Description =alphabeta hydrolase fold
MSNQPIDPYQYLQIFRNPDGTFTRLNDAVPCTPPSSDPTLSVLTKDITINQQNNTWLRLFLPRTALSSNSNPKKLPLIVFFHGSGFVRLSAASTMFHDFCVEMANTAEAFVASVDYRLAPEHRLPAAYDDAVEALRWIACSEEEWLTQYADYSKCYLMGNSAGATIAYHTGAIPDYEEME

SEQ ID NO: 188943 - protein, 319 aa, Glycine max
  Coding DNA Sequence Number=SeqID_72165
  Gene Ontology: Mol. function=structural constituent of ribosome; Cellular component=intracellular; Biological process=translation
  Homolog annotation: Hit_ID=Q9FN19; Match level="QueryCoverage=89%, HitCoverage=46%, E-value=1e-36, Identity=66%"; Hit description =Arabidopsis thaliana genomic DNA, chromosome 5, TAC clone:K8K14
  Pfam annotation: Domain name=LisH; Domain location=7-33; Score=47.7; E_value=3.9e-11; Accession=PF08513.1; Description=LisH
MASISSAELNYLVYRYLQESGFTHAAFTFGYEAGINKCSIDGNLVPSGALVTFIQKGLQYFEMEANLSNCDADLEEDFSFLQPLDLITKDVHELRQMISERRKKLQKERKKEFEKEHEGERVRVREKDRREREKEVEKDRRERDKEVEKDRREREKEVEKDRREREKEVEKDRREKEKEVEKERRERQKEVVKDREKVENDKEREQQHGDQTVRKMVIDHEDRVPVVKLEENGAVGGPESMDISTTSTSQLFEIPSSDVTILEGHTSEVKCVLVHGALQDLFLHQEAAVAEQLSIVAVVDPKAGRIAASHSGWDSSAIC

SEQ ID NO: 188944 - protein, 329 aa, Glycine max
  Coding DNA Sequence Number=SeqID_72166
  Gene Ontology: Mol. function=hydrolase activity, acting on ester bonds; Cellular component=cellulose and pectin-containing cell wall; Biological process=lipid metabolic process
  Homolog annotation: Hit_ID=Q4U0W1; Match level="QueryCoverage=90%, HitCoverage=78%, E-value=1e-122, Identity=68%"; Hit description =Lanatoside 15'-O-acetylesterase
  Pfam annotation: Domain name=Lipase_GDSL; Domain location=1-307; Score=256.3; E_value=6.3e-74; Accession=PF00657.12; Description=GDSL- like LipaseAcylhydrolase
METFLLDYSGKKLEYPNLVPQICLPHIHTQALGLPFLSPYLQSIGSNYKHGANFATLASTVLLPNTSLFVTGISPFSLAIQLNQLKQFKTKVNQVYEQGTELPSPDIFGKSLYTFYIGQNDFTSNLAAIGIGGVQQYLPQVVSQIASTIKEIYNLGGRTFLVLNLAPVGCYPAFLVELPHNSSDIDEFGCLVSYNNAVVEYNNMLKETLRQTRESLSDASVIYVDVYAVLLELFRHPTSHGLKYGIKACCGYGGGDYNFDPKAYCGNSKVINGSRVTSTACIDPYNYVSWDGIHATEAANKLTTFAILNGSYSDPPFPFHERCDLQPIG

SEQ ID NO: 188945 - protein, 168 aa, Glycine max
  Coding DNA Sequence Number=SeqID_72167
  Gene Ontology: Mol. function=hydrolase activity; Biological process =metabolic process
  Homolog annotation: Hit_ID=Q0ZPV7; Match level="QueryCoverage=98%, HitCoverage=49%, E-value=4e-40, Identity=48%"; Hit description=CXE carboxylesterase
  Pfam annotation: Domain name=Abhydrolase_3; Domain location=1-151; Score=-74.1; E_value=0.0069; Accession=PF07859.3; Description =alphabeta hydrolase fold
MSSCYLMGSSVRATIAYFMGLRAIDMARDLEPLKIRGLILCQVFFGGTQRCESEIRLKDDEVVPLCVIDMFWELALPVGVNRDHEYCNLRVEKWVGKLGMMKELGWRVLVSGNDGDPVIDREKDLVVLLEEKGVDVVSDFDIDGCHGVEYADESKANQLILVVKRFVS

SEQ ID NO: 188946 - protein, 270 aa, Glycine max
  Coding DNA Sequence Number=SeqID_72168
  Gene Ontology: Mol. function=structural constituent of ribosome; Cellular component=intracellular; Biological process=translation
  Homolog annotation: Hit_ID=Q9FN19; Match level="QueryCoverage=84%, HitCoverage=57%, E-value=1e-100, Identity=56%"; Hit description =Arabidopsis thaliana genomic DNA, chromosome 5, TAC clone:K8K14
  Pfam annotation: Domain name=WD40; Domain location=107-143; Score =33.4; E_value=7.8e-07; Accession=PF00400.22; Description=WD domain, G-beta repeat
  Pfam annotation: Domain name=WD40; Domain location=144-190; Score =32.7; E_value=1.2e-06; Accession=PF00400.22; Description=WD domain, G-beta repeat
  Pfam annotation: Domain name=WD40; Domain location=194-232; Score =51.1; E_value=3.6e-12; Accession=PF00400.22; Description=WD domain, G-beta repeat
  Pfam annotation: Domain name=WD40; Domain location=44-103; Score =20.5; E_value=0.006; Accession=PF00400.22; Description=WD domain, G -beta repeat
  Pfam annotation: Domain name=eIF2A; Domain location=60-251; Score= -83.9; E_value=0.0092; Accession=PF08662.1; Description=Eukaryotic translation initiation fact
  Pfam module annotation: Pfam domain module=WD40::WD40::WD40::WD40::eIF 2A; Domain location=107-143::144-190::194-232::44-103::60-251
MVLSCVVNQKVSIPRHTVKFVKYRPKGSLNKISKDIQTHYPNKGELKSTLSKHTGPIFALKWNKKGDYLLTGSVDQSPTLDVDQRNNVSFVTSSTDNMIYVCKIGETRPIKTFAGHQGEVNCVKWDPTGSLLASCSDDITAKDTYLPDLREHSKEIYTIRWSPSGSGTNNPNHKLVLASASFDSTVKLWDVELGKLMYSLDGHRHPVYSVSFSPNGNYLVSGSLDRYMHIWSLRDGKIVKTYTGNGGIFEVCWNKEGDKIAVVLLIIQFA

SEQ ID NO: 188947 - protein, 322 aa, Glycine max
  Coding DNA Sequence Number=SeqID_72169
  Gene Ontology: Mol. function=structural constituent of ribosome; Cellular component=intracellular; Biological process=translation
  Homolog annotation: Hit_ID=Q9FN19; Match level="QueryCoverage=89%, HitCoverage=56%, E-value=1e-130, Identity=62%"; Hit description =Arabidopsis thaliana genomic DNA, chromosome 5, TAC clone:K8K14
  Pfam annotation: Domain name=WD40; Domain location=147-185; Score =33.8; E_value=6e-07; Accession=PF00400.22; Description=WD domain, G -beta repeat
  Pfam annotation: Domain name=WD40; Domain location=189-236; Score =41.7; E_value=2.5e-09; Accession=PF00400.22; Description=WD domain, G-beta repeat
  Pfam annotation: Domain name=WD40; Domain location=240-278; Score =52.0; E_value=2e-12; Accession=PF00400.22; Description=WD domain, G -beta repeat
  Pfam annotation: Domain name=WD40; Domain location=282-319; Score =16.5; E_value=0.096; Accession=PF00400.22; Description=WD domain, G -beta repeat
  Pfam annotation: Domain name=WD40; Domain location=32-70; Score=41.2; E_value=3.4e-09; Accession=PF00400.22; Description=WD domain, G-beta repeat
  Pfam annotation: Domain name=WD40; Domain location=74-111; Score =10.4; E_value=2.2; Accession=PF00400.22; Description=WD domain, G -beta repeat
  Pfam annotation: Domain name=eIF2A; Domain location=119-297; Score= -88.5; E_value=0.018; Accession=PF08662.1; Description=Eukaryotic translation initiation fact
  Pfam module annotation: Pfam domain module=WD40::WD40::WD40::WD40::WD4 0::WD40::eIF2A; Domain location=147-185::189-236::240-278::282 -319::32-70::74-111::119-297
MVNTVGNGSFVYKDMLIYSAPQIAITRYRAESELKSTLSKHKGPIFSLKWNKKGDYLLTGSCDQTAIVWDVKAEEWKQQFEFHSGPTLDVDWRNNVSFATSSTDNMIYVCKIGETRPIKTFAGHQKANSLRYFIGMRYSYWTSVYITSAKSPFCIFQGEVNCVKWDPSGSLLASCSDDITAKIWSMKQDTYLHDLREHSKEIYTIRWSPTGPGTNNPNHKLVLASASFDSTVKLWDVELGKLMYSLDGHRHPVYSVAFSPNGDYLVSGSLDRSMHIWSLRDGKIVKTYTGNGGIFEVCWNKEGDKIAACFANNTVCVLDFRM

SEQ ID NO: 188948 - protein, 263 aa, Glycine max
  Coding DNA Sequence Number=SeqID_72170
  Gene Ontology: Mol. function=hydrolase activity; Cellular component =integral to membrane; Biological process=hypersensitive response
  Homolog annotation: Hit_ID=Q8LAS9; Match level="QueryCoverage=85%, HitCoverage=82%, E-value=3e-81, Identity=57%"; Hit description =Diacylglycerol pyrophosphate phosphatase, putative
  Pfam annotation: Domain name=PAP2; Domain location=63-213; Score =148.2; E_value=2.2e-41; Accession=PF01569.12; Description=PAP2 superfamily
MVFQSTGSKLALSHMHDWLILLLLAAMDGALNMIEPFHRYIGKDMMRDLMFPFKEDTIPMWGVPVGLMFSSLITGVITDSIKDAVGRPRPNFFHRCFPDNIPVFDKDNGDVLCTGIKAVIKEGYKSFPSGHTSWSFAGLGFLSWYLSGKVRVFDRRGHIGKLCLVLLPLLIAALVGITRVDDYWHHWTDVFAGGLIGLTVSSICYLLLFPLPTHPHGWAPHAFFLMMRESDSPSQRGSQTPDTTRLDEFPLQMAEMESGTRYM

SEQ ID NO: 188949 - protein, 723 aa, Glycine max
  Coding DNA Sequence Number=SeqID_72171
  Gene Ontology: Mol. function=hydrolase activity, hydrolyzing O -glycosyl compounds; Cellular component=membrane; Biological process =carbohydrate metabolic process
  Homolog annotation: Hit_ID=Q9FGH4; Match level="QueryCoverage=61%, HitCoverage=92%, E-value=1e-158, Identity=64%"; Hit description =Putative glucan endo-1,3-beta-glucosidase 9 precursor (EC 3.2.1.39) ((1->3)-beta-glucan ...
  Homolog annotation: Hit description=endohydrolase 9) ((1->3)-beta -glucanase 9)
  Pfam annotation: Domain name=Glyco_hydro_17; Domain location=27-350; Score=228.1; E_value=1.9e-65; Accession=PF00332.9; Description =Glycosyl hydrolases family 17
  Pfam annotation: Domain name=X8; Domain location=369-451; Score =131.4; E_value=2.4e-36; Accession=PF07983.3; Description=X8 domain
  Pfam module annotation: Pfam domain module=Glyco_hydro_17::X8; Domain location=27-350::369-451
MPTTTFSCFLFTFLIITSSIACVAGAVGVNWGTMASHPLPPHKVVKLLKSNSITKVKLFDANSDVLQALSGSNIDVSVGVPNTMLRSLNSSKKAADSWVHDNVTRYMPNVGSVTRIEYVAVGDEPFLKIYNEQFHPFLIGAAMNIQAALKKAKLDSKVKVVVPCSFDSFESGFNLSSGVHLRPDINKTMIELLTFLDKHGSPFFVTISPFVTHLQTKNISLDFSLFKETARPHNFSHKTYKNSFDLSYDTVVTVLSTAGYPNMDIVVAKIGWPTDGAVNGSSYLAETFIKGLINHLHSNLGTPLRPHKPPLETYIMSLLDEDQRSIASGNFERHWGLFTFDGQAKYHMDLGQGSKSLVNAQNVEYLSSKWCVVNNNKDLSNATASALEACASADCTALSPGGSCFNISWPSNISYAFNSYYQQHDQRAESCDFGGLGLITTVDPSMDHCRFPIEIRVSHSEFHRMCNFLQCFLYSTSQTQRAKRISFSRSQGTLDRIMSGAYGQDGGGSAPPSYGASGGYGSTGGGAGGGGSYGGGGYGGGGGGGGYGGSDGGGGGGYGAKGSGNGGGYGGNDGGGYGGRGGYSGNDGGGYGGRGGGGGGGQGGRGGGGYGGRERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 188950 - protein, 54 aa, Glycine max
  Coding DNA Sequence Number=SeqID_72172
MCHACEHNRFRPFRLLMSEVNARKNRRKEGKEGHILPMESNKSEKQKARHGGTT

SEQ ID NO: 188951 - protein, 157 aa, Glycine max
  Coding DNA Sequence Number=SeqID_72173
  Gene Ontology: Mol. function=oxo-acid-lyase activity; Biological process=folic acid and derivative biosynthetic process
  Homolog annotation: Hit_ID=UPI00005F9C1F; Match level="QueryCoverage =86%, HitCoverage=29%, E-value=5e-43, Identity=64%"; Hit description =COG0147: Anthranilate/para-aminobenzoate synthases component I
  Pfam annotation: Domain name=Anth_synt_I_N; Domain location=2-123; Score=81.1; E_value=3.4e-21; Accession=PF04715.3; Description =Anthranilate synthase component I, N terminal region
MLLTSGHAEHADNRFDILTADPRVTLTTRGDSTAIDDGTGISHSTADPLQLVQQQLDALGIRPAFDANLPFQGGALGLFGYDLGRRFETLPQRAQQDLHTPDMAVGIYDWALIADHHRQTLTLIAQHDAEQRWQWLQGAGGAAAQTLCPDQRLGRPI

SEQ ID NO: 188952 - protein, 228 aa, Glycine max
  Coding DNA Sequence Number=SeqID_72174
  Homolog annotation: Hit_ID=P0AEB7; Match level="QueryCoverage=44%, HitCoverage=90%, E-value=5e-36, Identity=71%"; Hit description =UPF0076 protein yoaB
  Subcellular localization annotation: CTP_CleavageSite=83; ConfidenceScore=5.06e-01
MRPPITGVHHVFRSSGFIARTTAAGSGTYSGTDGRRHVQRAGDCAGGAGNSPEPSGRSDSGALRRGRRRRIAPARIHQAGLHRAAYRRITRRDPRIPGAVHRGKVLFVYQENGGVENFAFIRTHARQDAVNHRQRVGGLRFRIVIQILRHAGVIHGLVMYNRFGHAVLGINTRNGHTVLLYFCCVSLPYPMAGCHLLWSPAVNPDIITVVLRAIGEDVWQTILQRMAR

SEQ ID NO: 188953 - protein, 241 aa, Glycine max
  Coding DNA Sequence Number=SeqID_72175
  Gene Ontology: Mol. function=cobyrinic acid a,c-diamide synthase activity; Cellular component=membrane; Biological process=selection of site for barrier septum formation
  Homolog annotation: Hit_ID=P0AEZ3; Match level="QueryCoverage=76%, HitCoverage=68%, E-value=7e-81, Identity=84%"; Hit description =Septum site-determining protein minD
  Pfam annotation: Domain name=CbiA; Domain location=7-141; Score=-9.2; E_value=0.00044; Accession=PF01656.13; Description=Cobyrinic acid a,c- diamide synthase
  Pfam annotation: Domain name=MinE; Domain location=164-235; Score =144.2; E_value=3.4e-40; Accession=PF03776.5; Description=Septum formation topological specificity factor MinE
  Pfam module annotation: Pfam domain module=CbiA::MinE; Domain location=7-141::164-235
RTEQLYILPASQTRDKDALTREGVEKVLNDLAAMDFDFIVCDSPAGIETGALMALYFADEAIITTNPEVSSVRDSDRILGIISSKSRRAENSEEPVKEHLLLTRYNPGRVTRGDMLSMEDVLEILRIPLVGVIPEDQSVLRASNQGEPVILDANSDAGKAYADTNTANIAKERLQIIVAERRRGDSEPHYLPQLKRDILEVICKYVKIDPDMVTVQLDQKGDDISILELNVTLPETEDVPK

SEQ ID NO: 188954 - protein, 144 aa, Glycine max
  Coding DNA Sequence Number=SeqID_72176
MSEIEDVQEHMNADIEVVKDRMAAMMEAMLSMKKIMKVNTTAVATTNAATKVDPTHLSGLNQVNPPVSNIVGQGGEALGSTGGTYFVQVQNKHSFPPYGLPPTIHHLMLYALPMTMSITPLPYSLRANNPNLVRHRSLNPWGDT

SEQ ID NO: 188955 - protein, 60 aa, Glycine max
  Coding DNA Sequence Number=SeqID_72177
MNAKRKEDMDGEQGHNDVHHHTRPHHLVNRARHDLGPPRRRAPPQIGGCSSTCPPTPTPD

SEQ ID NO: 188956 - protein, 51 aa, Glycine max; identical to SEQ ID NO: 186326
  Coding DNA Sequence Number=SeqID_72178

SEQ ID NO: 188957 - protein, 93 aa, Glycine max
  Coding DNA Sequence Number=SeqID_72179
MKKILGLQAPMELASGEGNDMLLRETLSPNEVMNDNAHYGPVNETNSYPWSPSYLEGESLSQFTIQLVLSLVTVPPSKVKDLLKQCLTQMKDL

SEQ ID NO: 188958 - protein, 84 aa, Glycine max
  Coding DNA Sequence Number=SeqID_72180
MVLAVYLMPNSLTSTLETHLYLEPTVSFSGAELEAEEIYETLGVVRRPCMYLKSGTNTTFEWQIRSKCWRVESPSLTKISEFFS

SEQ ID NO: 188959 - protein, 426 aa, Glycine max
  Coding DNA Sequence Number=SeqID_72181
  Gene Ontology: Mol. function=carboxypeptidase activity; Cellular component=proton-transporting two-sector ATPase complex; Biological process=ATP synthesis coupled proton transport
  Homolog annotation: Hit_ID=Q654T8; Match level="QueryCoverage=64%, HitCoverage=61%, E-value=1e-73, Identity=51%"; Hit description=Leaf senescence protein-like
  Pfam annotation: Domain name=DUF231; Domain location=320-426; Score= -19.5; E_value=4.3e-06; Accession=PF03005.6; Description=Arabidopsis proteins of unknown function
GHTDLGSNGLLHFTPSSLSQIQNQPKTEKMRMDYLKQKFPFSHKNFFLKSLLTIFFLGLAFCILFFDSLSPQISPVLESPFPEKVPLPEPQNPPQTSTVLEHVPEQPPVPEHAPEPPPVLEHVRETEDQLSPTDSKKCYNFSGDWVRVTLMKAVTSLFFFVPHCPEALRYANIVSHQNCLKNGRPDREFLYWRWAPRDCDLPQLDPERFLYMMWSKAWALVGDSISLNNVQSLLCILAKVEQLVSFYHDEEYKCKSWRFPSYNFSMSLIWSPFLVEAAIFEDENGVSSSEVELHLDKLDSKWTDQYLDFDYISFSIGKWFLKSAIYYENDTILGCHSCPKKNLTELGFNFAYCNALKLVMNFIVSSNHKGIFLRTFTPDHFENMEWLNGGTCKRTTPIKGEMEMKYLRKMLRDVELDEVGKAATEA

SEQ ID NO: 188960 - protein, 195 aa, Glycine max
  Coding DNA Sequence Number=SeqID_72182
  Homolog annotation: Hit_ID=Q9FJ33; Match level="QueryCoverage=77%, HitCoverage=55%, E-value=2e-21, Identity=42%"; Hit description =Arabidopsis thaliana genomic DNA, chromosome 5, TAC clone:K16L22
MEKSREEKLRQVWDCGSTLYDSYELNSFKRQLNTAIANSPSNRRTLSMSHLPERCLSSQPQPQPPMSNNKSFRFSRTFQKLLRFVFKSRNKLRISSTRSTSNNISTFQVAEKYSNDRFYVVYDKSEPVLSTIPELPEFEVGVLSPDITSFVRKSASERFMATASIVNWVGDAYMGGGASIFRPMGNGRSGLSTTK

SEQ ID NO: 188961 - protein, 171 aa, Glycine max
  Coding DNA Sequence Number=SeqID_72183
  Gene Ontology: Mol. function=transferase activity, transferring hexosyl groups; Biological process=metabolic process
  Homolog annotation: Hit_ID=Q8S342; Match level="QueryCoverage=88%, HitCoverage=40%, E-value=3e-36, Identity=44%"; Hit description =Putative anthocyanidine rhamnosyl-transferase
MDVESNTYQKWIRLVLVYIKMLVNTRFEDDKDNATWQRMKEWLDNQECGSVLVRHGPWDKDVLQLPKKFEERTKGCGIVCIGWAPQLKILSHVEIGGFFTHFGWTSMMEAIQNEKPIFLLMFLEDQGLNTKLLKEKKMRYLIPRDELDGSLMSDAVIDSIRLVMVEDEERI

SEQ ID NO: 188962 - protein, 92 aa, Glycine max
  Coding DNA Sequence Number=SeqID_72184
MKNQLNAGSLLQSPLVCDKPDNVNQPKSIALKVSYNHDPKLWSDDTTRVEATPNPLIGSYDQDGGYPLDCTCRFLCCCHVLLKEMQVMLIML

SEQ ID NO: 188963 - protein, 397 aa, Glycine max
  Coding DNA Sequence Number=SeqID_72185
  Gene Ontology: Mol. function=RNA-directed DNA polymerase activity; Biological process=RNA-dependent DNA replication
  Homolog annotation: Hit_ID=Q2HRL0; Match level="QueryCoverage=28%, HitCoverage=21%, E-value=1e-28, Identity=45%"; Hit description=RNA -processing protein, HAT helix
  Pfam annotation: Domain name=AT_hook; Domain location=5-17; Score =14.7; E_value=0.067; Accession=PF02178.9; Description=AT hook motif
MVGSKRSRGRPPKTVSPVPVNPPSPVAPPEMESEIHDEDEDGDLANSKQGPANGSETVAQETLIKEQDGIGRKLWVDVISGNINPAKGRVMQYVAPKVVDGEIDVKIEDEDVAPELKFWETTLILYILGGDISMYMLKNFMEKAWNFVSLPDMYYHDDGYFMLRFKSHADMDAVLMKGPYTIRNMPLILQEWRPDFDLKKDMLSTIPIWVKLPKLPLHLWGETSLNKIDSAIGIPLVTDECTTHRLRVSYARILLEVDITQKMLDEITITDNKGLKRKQPIEYEWRPKFCEKCQTIGHQCDGAAKHKIWKPKPKKVDPDKPPKAEKNSTLVKTLIRDKGPNIIDVEDGGCWTVVNKSRDKRKGKDATESSSTLQCLNGFEALGALNGPQGSYDRGPC

SEQ ID NO: 188964 - protein, 817 aa, Glycine max
  Coding DNA Sequence Number=SeqID_72186
  Gene Ontology: Mol. function=RNA-directed DNA polymerase activity; Cellular component=nucleus; Biological process=RNA-dependent DNA replication
MQQGPWCAVGDYNNVAKSQDRVGGKLVTEAEYEDLQAMMDATGLSEMDSSGEIFTWTNKQADNPIYSRIDRILANIDWFQTHSDANLTILPPPMYLIITSFICLSLFMLEKEISSDSTTAGWMQWVFIVLWKDVGTNLLEALQCRGCAREKLDQAQQDLRNNIMDAPRIEEVKRLTDEVIHWNEMEEKMLMQRSKIDWIRAGDGNNAFFHAYLKSRQNAKRIKVIHKDDGTILTTHKEITQEVLAFYGKLMGHDSISLQHVDIYALRRGDHLTMVQREDLVRPVTVKEIEDALNGISDLKLPEVDGYSSKFFKSCWNIVKEDVVNAAQEFFAQDQLFLPFNQTVVTLVPKSDNASTVKEYKPIAVCTTFYKIMSKILTARLNKVLPSVVSLSQAVSYELLNGYAKKGGTPRTMIQLDLQKAYDMIDWPKEALGKGILFLPCLVMMEYLNRLLVKLQLDPNFNHHAKCEKLGITHLTFADDVLLFCRGDVMSLEMMLHVINKFSTTTGLVVNPNKCRIYFGRVDGTTKNKIQQISSYEEGQLPFRYLEVPLTSKKLNIKYYLSLIDKIMTRIQHWTSKLLSMAGRVQMVNCTITAIVQFWMQCLPIPMSVINKIDSMCRSFVWSGSTEITRKSHIAWNSVCRPKGQGGLNIFNLKPVWDELLNSERFKMKKAYDKMMEADRVHWSGLMRKNCARPRAIHTTWLACHGRLGTKDRLVRFGMITDKICSLCKEVEETQNHILFSYKVATDIWSNVLNWIGIDHVPQEWPLELDWLLNLTNRKGWRAYLLKLSVTETIYGIRIHKNSWIIGSPCTHLAFEK

SEQ ID NO: 188965 - protein, 138 aa, Glycine max
  Coding DNA Sequence Number=SeqID_72187
MEDKIIWGASGDGMFTASSFCLQMAHCLLVWHSLNMDGEPSFYAATCVDWLVNNINSPPRVEMLLFFKTSSDVINVIQQSMPLKAMKSVRWEASNFPFIKLNTDGSSSMDAFLQAHVLWEGNSSAIWLNTLVIADRLK

SEQ ID NO: 188966 - protein, 111 aa, Glycine max
  Coding DNA Sequence Number=SeqID_72188
  Gene Ontology: Biological process=regulation of transcription
  Homolog annotation: Hit_ID=O80933; Match level="QueryCoverage=98%, HitCoverage=15%, E-value=6e-13, Identity=41%"; Hit description =Putative SCARECROW gene regulator
  Subcellular localization annotation: CTP_CleavageSite=51; ConfidenceScore=5.14e-01
MNPHLTGFSGSTNQSFPILQNQRFDNGPRFENLFFDQSRNFDLQCDPNLIPANTPSSSTVTHEEHSPEDCDFSDAVLSYISQILMEEDLEDNTCMVQDSLDIQAAEKSFYE

SEQ ID NO: 188967 - protein, 139 aa, Glycine max
  Coding DNA Sequence Number=SeqID_72189
MEKACSIELIQLSRKNPPPPRADKSRTRIPRMERVMNTSGVENVVELESPRRQNHKRKVTPRDPASWGKRYVHNLKLVMAIEAEKKSTRSMPHITFTNEDFGDIDRCHNDPMVINIEMPNFLATEFWMTPLPVKEDKSG

SEQ ID NO: 188968 - protein, 146 aa, Glycine max
  Coding DNA Sequence Number=SeqID_72190
MAHQCTSEVLLTIHEQRCLNDVIYERVEPILHPMNLLSDRKSSFPPRHVNFIGLWQMVSMGLPSLGCLFASWHSSPFAGRDQGMIVKHLTQDVNHGCWAPIFRGIVVFVIIDDNDAVKGKVFPSPMMGTKCSYHIWQEVAHGGAPL

SEQ ID NO: 188969 - protein, 602 aa, Glycine max
  Coding DNA Sequence Number=SeqID_72191
  Gene Ontology: Mol. function=protein-methionine-S-oxide reductase activity; Cellular component=nucleus; Biological process=regulation of transcription
  Homolog annotation: Hit_ID=Q7X9T5; Match level="QueryCoverage=91%, HitCoverage=74%, E-value=1e-168, Identity=55%"; Hit description =SCARECROW-like protein
  Pfam annotation: Domain name=GRAS; Domain location=203-509; Score =432.0; E_value=8.1e-127; Accession=PF03514.5; Description=GRAS family transcription factor
MNDGVGGYDFSGDYGNCPDTNGDLMSIFTNQFLPPNSGSFPAHSLHGDGISHSSYNPSNSVEGLVNSSKSIIQVPDLNSESESIWQFQKGVEEASKFLPSANGLFANLSEPEPKEGKDELSFKVEKEEGEYVNGGSKGRKHPQIDEADDEENRSSKQAAIYSEPTLRSDMADIILLHSTGDGKDHFVARREALQNKTQKSVLPKGQSKASSSGKGRGKKQGGRKEVVDLRTLLFLCAQAVAADDHRNANELLKHIRQHSTPFGDGNQRLAHIFADGLEARLAGTGSQIYKGLVGKRTSAANYLKAYHLYLAACPFRKISKFTSNITIRESSAQSMKVHVIDFGIFYGFQWPTFIQRLSWRAGGPPKLRITGIDFPQPGFRPAERILETGRRLAAYAEAFNVPFEYKAIAKKWDTIQLEELEIDRDEFLVVTCFYRGKNLLDESVVVDSPRNNFLTLIRRINPKLFIHGIMNGAFDAPFFVTRFREALFHYSSLFDMLETIVPREDWERMLIEKEIFGREALNVIACEGPERVERPESYKQWQARILRAGFVQQSFDRRTVKMAMEKVRGSYHKDFVIDEDSQWLLQGWKGRIIYALSCWRPA

SEQ ID NO: 188970 - protein, 124 aa, Glycine max
  Coding DNA Sequence Number=SeqID_72192
MTKETSLLARLMKSKYHLHGPLWEARKGYRQSFTWTSIWEAKWILEEGCVWSIGDGRFADWVEFAIDITDEDSRAMVSAILWAIWYIRNRLVFQNRRMEIQHVLSKMAPVLPSGKTLQWLKNQT

SEQ ID NO: 188971 - protein, 128 aa, Glycine max
  Coding DNA Sequence Number=SeqID_72193
  Gene Ontology: Mol. function=electron carrier activity; Cellular component=anchored to membrane; Biological process=electron transport
  Homolog annotation: Hit_ID=Q9LLZ7; Match level="QueryCoverage=75%, HitCoverage=48%, E-value=9e-15, Identity=39%"; Hit description =Phytocyanin homolog
  Pfam annotation: Domain name=Cu_bind_like; Domain location=36-120; Score=103.9; E_value=4.6e-28; Accession=PF02298.8; Description =Plastocyanin-like domain
MAVKMHLSFFILATIGCMPLVSVSSTTHVVGHKLGWNLPSYPGFYDDWAKKQTFVVGDVLLFQYHPGQNTVVQVDKNDYDHCTTRNILHTYFRGNSSATLEKPGDYFYFSSVGKHCDFGQKLHVTVSQ

SEQ ID NO: 188972 - protein, 935 aa, Glycine max
  Coding DNA Sequence Number=SeqID_72194
  Gene Ontology: Mol. function=protein kinase activity; Cellular component=nucleus; Biological process=protein amino acid phosphorylation
  Homolog annotation: Hit_ID=Q0WP97; Match level="QueryCoverage=83%, HitCoverage=66%, E-value=0.0, Identity=51%"; Hit description=COP1 like protein
  Pfam annotation: Domain name=WD40; Domain location=530-569; Score =1.3; E_value=26; Accession=PF00400.22; Description=WD domain, G-beta repeat
  Pfam annotation: Domain name=WD40; Domain location=581-619; Score =20.1; E_value=0.0078; Accession=PF00400.22; Description=WD domain, G- beta repeat
  Pfam annotation: Domain name=WD40; Domain location=623-662; Score =29.1; E_value=1.5e-05; Accession=PF00400.22; Description=WD domain, G-beta repeat
  Pfam annotation: Domain name=WD40; Domain location=666-704; Score =12.4; E_value=1.3; Accession=PF00400.22; Description=WD domain, G -beta repeat
  Pfam annotation: Domain name=WD40; Domain location=709-746; Score =31.6; E_value=2.7e-06; Accession=PF00400.22; Description=WD domain, G-beta repeat
  Pfam annotation: Domain name=WD40; Domain location=758-796; Score =4.7; E_value=10; Accession=PF00400.22; Description=WD domain, G-beta repeat
  Pfam module annotation: Pfam domain module=WD40::WD40::WD40::WD40::WD4 0::WD40; Domain location=530-569::581-619::623-662::666-704::709 -746::758-796
MCLWVKKQKRKDRGSVDVECSMDVNHEDLYCWKAEHSGIDTQMDSKALPSSSLKTAKSPHNSTGPGSGGSDTDGVTLREWLKSRHCKGSKTDHLSIFRKIVDLVDGSHSEGVAMHNLYPSHIKLLPSNQVMYLGLPTQKKILDSIANSEVLQLENSFIRKRLSEKVISASLNLRSKKQKFNENARVAGDWSQCPPRTDLNLQIANDIKVNAVGSQDYCNEYKEDIQFSKHNMQSMSRIPHIFNAGQLQLNSLNERLEDKWYASPEGGCTTSSNIYCLGVLLFELLNDFDSERAHIAAMSDLGRRILPSVFLSEYPMEAGFCLWMMHPEPSSRPTIRVAPMLNVTGWGGVRFHQEHHTTGFNSTEILQSEVINGMREVYFEELSLSLNQDDAESELLLHFLISLEEQKHMDSNKLAEEIRCLESDVKEVERRHDLRKSLLPSSLQNDSSLQIENVSLLKESSSSETLPPVSTISNANELRLMKNMCLLESAYFSMRSKIKLPETDTATHPDKDILRNHDNWCVAQKDMEQHKTTDTLGAFFDGLCKSTRYSKDEDYFAAAGISKKIKIFEFNALFNDSIDIHYPVVEMSNRSRLSCVCWNNYIQNYLASTDYDGAVKLWDANTGQGFSGFTEHEKRAWSVDFSLVCPTKFVSGSDDCSVKLWSINEKKSLATIRNVANVCCVQFSTHSSHLLAFGSADYSAYCYDLRNLRSPWCVLAGHRKAVSYVKFLDSETLVSASTDNMLKIWDLNKTSPVGLSTSACSLTLSGHTNEKNFVGLSVADGYIACGSETNEVFAYYKSLPMPVTSHRFGSIDPISGKETDVDNGLFVSSVCWREKSDMVIAANSSGCIKVLQMRFWDQIGDEVVYTCLDILNGEGDPTGMNKTFTVLIPKVKNPVKGSEFRPITLCNVLFKLITDNALIAYECFHYTRIKDRGKR

SEQ ID NO: 188973 - protein, 730 aa, Glycine max
  Coding DNA Sequence Number=SeqID_72195
  Gene Ontology: Mol. function=motor activity; Cellular component =myosin complex; Biological process=SRP-dependent cotranslational protein targeting to membrane
  Homolog annotation: Hit_ID=Q2PEP6; Match level="QueryCoverage=77%, HitCoverage=95%, E-value=1e-57, Identity=26%"; Hit description =Putative myosin heavy chain-like protein
  Pfam annotation: Domain name=KIP1; Domain location=12-84; Score=3.9; E_value=0.072; Accession=PF07765.3; Description=KIP1-like protein
  Pfam annotation: Domain name=PspA_IM30; Domain location=137-336; Score=-53.9; E_value=0.023; Accession=PF04012.3; Description =PspAIM30 family
  Pfam module annotation: Pfam domain module=KIP1::PspA_IM30; Domain location=12-84::137-336
MTNHHSKESIKFFGSLIDPENVEDLQRTKTDIENNISKILELIKNKSHSKEDDENHKHSTSGTELVGLIEDLYKKQQSLYAIYDCVIEEFEKVVSRKRIKKVAMSSSDSDSEYFSPEEVDGIKRKSEKEYYSVSYLGTLKQESDRGDCTDEVPKIEATKFEEQLTSLAKEVESLSQQKKNLELQVESQTHEVKHLTLKNIELYDQVSELELLLKREKGVVSDLQTQLNNSESQANLAKSNVANLMAKINELELETKSLQTQKNQMGEKIKCDKNEALTQREDLMEQLNAMQQRLDYIENEKRELEVEMESQREQISQHLIQIENVKDKLSEMRSVEHNMVEEKEGFLEKLKDLELNLEIQNNQKNELEEKLRATSYEVKQLADENKALQDRNHELRTTMTQKGEEISIFMREHENHKNGASMEVMALKEKLNGMRLELDTMREQKNKLELQNERSQKEYAESLAKVETLNTNLATQIDDQAKTIERVNEENKQAKIVYSKLKLIQVTAERKMNELAEEFRRKMEDNIRLLHQRIHVAEQLNNENKYSCKVTKQRYEEENKNLGLKIASYKEEKTTRVPIGFELVALNRLDLVVEKVEEHMSRMARMRCEVEFVKDWMRERNGEVKEQRENVDCLRELLNKKEEQELVLRENVWKLEANVSKEGGEKLNLRKQVSQLEKKVGKLDKILKEKDEELISLGEKKREAIRQLCFVVEFHRDRYNYLKDMVAKKG

SEQ ID NO: 188974 - protein, 111 aa, Glycine max
  Coding DNA Sequence Number=SeqID_72196
MTRSKSGDLHPYDLEIDKTFHRLSRNNRSRSVVVHVSVVFDSNVVHTKFIVDSISDFVSEPVFIAFDSKKNSVDITVDNNQTLKELATPDVVYQPWCIQYPETKVKIHTSI

SEQ ID NO: 188975 - protein, 174 aa, Glycine max
  Coding DNA Sequence Number=SeqID_72197
  Gene Ontology: Mol. function=transcription factor activity; Cellular component=nucleus; Biological process=regulation of transcription, DNA-dependent
  Homolog annotation: Hit_ID=Q8L701; Match level="QueryCoverage=65%, HitCoverage=35%, E-value=5e-30, Identity=58%"; Hit description =Putative Ap2 domain protein
  Pfam annotation: Domain name=AP2; Domain location=106-173; Score =126.4; E_value=8.1e-35; Accession=PF00847.10; Description=AP2 domain
MASSSIKNTHHLNRTKLFMEEDTLLKKKRHYPKLIRIRVTDADATDSSSDDDEPSVSSTRRRVKYFVNEITIQGGGGGGGCVNVVSRKRRFKAGAGAPSCRRRTGAKKFRGVRQRPWGKWAAEIRDPLRRVRLWLGTYDTAEEAAIVYDNAAIQLRGADALTNFVTPPRENRKT

SEQ ID NO: 188976 - protein, 341 aa, Glycine max
  Coding DNA Sequence Number=SeqID_72198
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=98%, E-value=8e-67, Identity=49%"; Hit description =Integrase, catalytic region
  Pfam annotation: Domain name=Chromo; Domain location=231-283; Score =12.7; E_value=0.031; Accession=PF00385.14; Description='chromo' (CHRromatin Organisation MOdifier
  Pfam annotation: Domain name=rve; Domain location=31-196; Score=54.7; E_value=3e-13; Accession=PF00665.16; Description=Integrase core domain
  Pfam module annotation: Pfam domain module=Chromo::rve; Domain location=231-283::31-196
DIKCFVQECSICQQTKPSTHRPAGLLQPLPTPTGVWEDISMDCITHLPQSHGYIVILVVVDRYSKGTHLGALPTTYSAFKVASLFMDIVCKHHGFPKSIISDRDPVFHSFFWRELFWLSGTHLRMSTAYHPQSDGQTEVMNRMTPFEVIYGKPPPALPQYLQGTSTSEAVDSLISSHQEIHEKLQRRLSKAHETMKRFADAKRWDVTFTTGQWSVSNKSGIDLNYQMKHEFIPSFIILSSGNTMLNNSTFPPTRFVLIQWEGQPPEDTTWEKWPDIRDTYHLEDKVVFEGEGIVSNSLQDDEGAESNEPHQEPVQEPHQEPVQGRSKCSASRPSYLQDYET

SEQ ID NO: 188977 - protein, 576 aa, Glycine max
  Coding DNA Sequence Number=SeqID_72199
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=96%, HitCoverage=86%, E-value=0.0, Identity=61%"; Hit description =Putative receptor kinase
  Pfam annotation: Domain name=LRR_1; Domain location=112-133; Score =9.9; E_value=4.1; Accession=PF00560.23; Description=Leucine Rich Repeat
  Pfam annotation: Domain name=LRR_1; Domain location=134-156; Score =17.3; E_value=0.054; Accession=PF00560.23; Description=Leucine Rich Repeat
  Pfam annotation: Domain name=LRR_1; Domain location=41-63; Score =15.0; E_value=0.27; Accession=PF00560.23; Description=Leucine Rich Repeat
  Pfam annotation: Domain name=LRR_1; Domain location=65-86; Score =13.5; E_value=0.77; Accession=PF00560.23; Description=Leucine Rich Repeat
  Pfam annotation: Domain name=LRR_1; Domain location=88-110; Score =18.3; E_value=0.028; Accession=PF00560.23; Description=Leucine Rich Repeat
  Pfam annotation: Domain name=Pkinase; Domain location=275-556; Score =75.1; E_value=2.2e-19; Accession=PF00069.15; Description=Protein kinase domain
  Pfam annotation: Domain name=Pkinase_Tyr; Domain location=274-556; Score=44.2; E_value=3.5e-15; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=112-133::134-156::41- 63::65-86::88-110::275-556::274-556
MCDSWTGVTCNVDKSKVIAIRLPGVGFHGTIPPDTISRLSALQTLSLRSNVITGHFPSDFSNLKNLSFLYLQFNNISGPLPDFSAWKNLTVVNLSNNHFNGTIPSSLNNLTQLAGLNLANNSLSGEIPDLNLSRLQVLNLSNNSLQGSVPNSLLRFPESAFIGNNISFGSFPTVSPEPQPAHEPSFKSRKRGRLSEAALLGVIIAAGVLGLVCFVSLVFVCCSRRVDEDEETFSGKLHKGEMSPEKAVSRNQDANNKLVFFEGCNYAYDLEDLLRASAEVLGKGTFGTAYKAILEDATMVVVKRLKEVAAGKKDFEQHMEIVGSLKHENVVELKAYYYSKDEKLMVYDYHSQGSISSMLHDISLLQRSLTQEESKRGEDRVPLDWDTRLKIALGAARGIARIHVENGGKLVHGNIKSSNIFLNTKQYGCVSDLGLATISSSLALPISRAAGYRAPEVTDTRKAAQPSDVYSFGVVLLELLTGKSPIHTTGGDEIIHLVRWVHSVVREEWTAEVFDLELMRYPNIEEEMVEMLQIAMSCVVRMPDQRPKMSEVVKMIENVRQIDADTHSSSGNQVST

SEQ ID NO: 188978 - protein, 62 aa, Glycine max
  Coding DNA Sequence Number=SeqID_72200
MQKLLGRKCSTQYYAFAEIATDKMYSSIIKQMFYSTATRDGTVVMQPVEGRHTMSKSMVIVK

SEQ ID NO: 188979 - protein, 300 aa, Glycine max
  Coding DNA Sequence Number=SeqID_72201
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=99%, HitCoverage=22%, E-value=1e-85, Identity=52%"; Hit description =Putative retroelement
MCVDYRALNSVTICDRFPIPMIDELLDELGHASWFSKLDLRQGFHQILMHEPDVKKTVFRMHRGHYEYRVMPFGLCNAPSTFQAAMNSLLTSFLWRFATVFFDDILVYSQFYLKRTKCLFAQTQVEYLGHLVSNRGVKPEPSKVRTMVQWPLPTSPKELGAFLGLTGFYRKFIKNYMLIAAPLNSLLGKEAFNWSLTANSAFEQMKTAMTSAPVLALLDFDKPFIVETDASDTGMGVVLMQKGHPLCFDLRPGTSCNRLGRAKMASIPARAFVHHLNRSQELLRTNVTGRPNSRIALLSI

SEQ ID NO: 188980 - protein, 71 aa, Glycine max
  Coding DNA Sequence Number=SeqID_72202
GDGWTVFGTNAGTGRSMLQLQVSGEEEGVIGRVGRTEKLSNAGLKEIMGTTAVYEDSKVGVVNNTDKAKGL

SEQ ID NO: 188981 - protein, 111 aa, Glycine max
  Coding DNA Sequence Number=SeqID_72203
KKKEEVETRVVITERAGRTKSVSYLCFPLISDESWIASGGSNPAHLGELGGNLLPLFPINRLKGAVLRIPDAPENPSRGASVTLPRGFRKQIREGFPPLFTVLHPFFVLQR

SEQ ID NO: 188982 - protein, 127 aa, Glycine max
  Coding DNA Sequence Number=SeqID_72204
MAMLIFKQFSIQCDRFENVREWWCQTLISSIDDHLLIFWFLLAELSCLTPVVVQSIRFFNVSVNNAENTHKGGQKGHSKAFPDPRVTQASPWLIWAPRKLRAKVTSLPGRAELTWASCCSTSSPHFL

SEQ ID NO: 188983 - protein, 135 aa, Glycine max
  Coding DNA Sequence Number=SeqID_72205
MLVATPVHFPFLEDTPLGFASPSRRKVGCDRWQWRLSYPNFVWGLLFDGMQPLVDRFEKLDPLGPSRMFLQKAVASGGSNLARLGELGGKLLPYFPINRGRSEGERGSALLVLRNHLKLVRKIVFVKKIQAEALP

SEQ ID NO: 188984 - protein, 116 aa, Glycine max
  Coding DNA Sequence Number=SeqID_72206
GVVDKNGAFAPTYPQFDMRNSDMTTLVSACQSDLGSPNDEVRITARCLRMPMDSQVTIAKVRGEKVASAQDFGWQSKEEHHFKSWFPFLPYLVHISRLTVNGSSFLGDPSATSSEG

SEQ ID NO: 188985 - protein, 71 aa, Glycine max
  Coding DNA Sequence Number=SeqID_72207
WATHCDSSNSSLGMMLMGGPLDLPFAKTIKVYEDVGDFSNDEDLTPSMIAFYRGVCGEEISKGKVVSSDKE

SEQ ID NO: 188986 - protein, 103 aa, Glycine max
  Coding DNA Sequence Number=SeqID_72208
MAHLQPRLSNATMMVLEETTGKLQADIRKSISRRKSKGQGPSDDESHEGTNTGDPTIDIEQEASWTEDEEDEDVGLPPELEKIIARENQEMRPHQEETELIDL

SEQ ID NO: 188987 - protein, 189 aa, Glycine max
  Coding DNA Sequence Number=SeqID_72209
  Gene Ontology: Mol. function=chromatin binding; Cellular component =chromatin; Biological process=chromatin assembly or disassembly
  Homolog annotation: Hit_ID=Q8S6H8; Match level="QueryCoverage=97%, HitCoverage=36%, E-value=7e-34, Identity=43%"; Hit description =Putative retroelement
  Pfam annotation: Domain name=Chromo; Domain location=139-189; Score =25.5; E_value=0.00018; Accession=PF00385.14; Description='chromo' (CHRromatin Organisation MOdifier
  Pfam annotation: Domain name=rve; Domain location=1-143; Score=-6.1; E_value=0.019; Accession=PF00665.16; Description=Integrase core domain
  Pfam module annotation: Pfam domain module=Chromo::rve; Domain location=139-189::1-143
MDFIEGLPSSFGKQVIFIVVDRLSKEAHFMALSHPYTAADKAQCFLDHVFKLHGFPDTITSDRDPVFVSHFWKEFMSLQGIQARSNAKLTPKYYGPFPVEDKIGPVAYKLKLPLGSMKFNGTATAGNFSPSPLLDTSQKEPAAIIDRMTVKRGNCAVTKVLVQWKHQLPEDATWELFYDSKQKFPHFNP

SEQ ID NO: 188988 - protein, 226 aa, Glycine max
  Coding DNA Sequence Number=SeqID_72210
  Homolog annotation: Hit_ID=Q5XM22; Match level="QueryCoverage=44%, HitCoverage=75%, E-value=2e-27, Identity=55%"; Hit description =Resistance-like protein HAAS-2
MRCQAQRWIVAARAYLLHLVSCTLFANKSATYVHVVHLDAFHDLGQSGGYAWGVATLVHMYDQLDEASRTTTRQIASAGSMSTSLVHQFVTDDTYQETSPRASWWLTSKAHMNGITGAPYRARCDALTITYVSWLPYTEHRGVRAFELISSFQGQLRWGPMVVTARPERVVSADYMEWFFRISHPFMIPTQAGDQPRDAPAADPEEYIQSPSPQVPVAFDPPRHVV

SEQ ID NO: 188989 - protein, 465 aa, Glycine max
  Coding DNA Sequence Number=SeqID_72211
  Gene Ontology: Mol. function=transferase activity, transferring hexosyl groups; Cellular component=integral to membrane; Biological process=metabolic process
  Homolog annotation: Hit_ID=Q8S342; Match level="QueryCoverage=99%, HitCoverage=99%, E-value=1e-153, Identity=56%"; Hit description =Putative anthocyanidine rhamnosyl-transferase
  Pfam annotation: Domain name=UDPGT; Domain location=9-463; Score= -89.8; E_value=4.2e-06; Accession=PF00201.9; Description=UDP -glucoronosyl and UDP-glucosyl transferase
MAGDEEKLTIVMFPWLAFGHMIPNLELAKLIARKGHQVSFVSTPRNIQRLPKPSPNTLINFVKLPLPKIQNLPENAEATTDIPYDVVEHLKVAYDALQEPLKRFLESSKPDWLFYDFVPFWAGSIASKLGIKSAFYSICTPPFSGFLGPPSSLMGKDSLRQKPEDFIVSPPWVPFPTTVAFRYFEIMRIVDSLSAENNTGVSDAYRYGASAENCDIVVIRGCTEFQPEWFQVLENIYRKPVLPIGQLPSTDPVGGEDTDTWRWVKDWLDKHARGSVVYVAFGSEAKPRQDEVTEIALGLEKSKLPFFWALRLQRGPWDPDVLRLPEGFEERTKALGVVCTTWAPQLKILGHMAVGGFLTHSGWTSVVEAILNEKPLVLLTFLSDQGINARVLEEKKMGYSVPRNERDGLFTSDSVAESLRLVMVEEEGRIYRERIKEMKDLFVNRERQNMYIDNLLRTLTSSLKC

SEQ ID NO: 188990 - protein, 284 aa, Glycine max
  Coding DNA Sequence Number=SeqID_72212
  Gene Ontology: Mol. function=RNA-directed DNA polymerase activity; Cellular component=chromatin; Biological process=chromatin assembly or disassembly
MEEHLNSIMESRFVELTASMQQTIHGMFQQRQQDSPTASNPPRDLCEDPMADLMKLRQTGSIIEYHEEFDSIVSRVDLSDEHQLSCFLGGLKQEVQMIVQMFQPNSVQKAYSLAKMYESSFSITQPKPFVKNQKSSFVSKPPFFPNPPRSTNPLTINPSTKPQTPKHLTPAYMIHVLEIEDEEEGSGPQEPDANVIPLTQGANPVNKRPYKYAKQQKDIIDGLIQDYLKSGIIKKSDSPYASPIVLVGKKDGAWRLCVDYRDLNKATVKNKFPISLVEDLLDEL

SEQ ID NO: 188991 - protein, 148 aa, Glycine max
  Coding DNA Sequence Number=SeqID_72213
MTLQKRRVITYKKLHFDDGNDDDNKRRFEFNSDEKASGAREATGEGAWGIRCFLSVCCLRWCTCIVYEYTVKFSDFSLLEKKREQRITYLEGERFLREWKQGRIGNEEEETNKKNQGRSNKELAPTKEEEQQQQGRRSVNEGRSDSYG

SEQ ID NO: 188992 - protein, 79 aa, Glycine max
  Coding DNA Sequence Number=SeqID_72214
MKIEKPTITVRENEQNESVRENKSVNGSSMRLRTRARVRKDAKNARSLAITLKARMKCLGSDTTTNPYSTVSIDDNQQW

SEQ ID NO: 188993 - protein, 510 aa, Glycine max
  Coding DNA Sequence Number=SeqID_72215
  Gene Ontology: Mol. function=acyl-CoA dehydrogenase activity; Cellular component=integral to membrane; Biological process=electron transport
  Homolog annotation: Hit_ID=P33224; Match level="QueryCoverage=99%, HitCoverage=95%, E-value=0.0, Identity=71%"; Hit description=Protein aidB
  Pfam annotation: Domain name=Acyl-CoA_dh_1; Domain location=281-436; Score=109.6; E_value=8.8e-30; Accession=PF00441.14; Description=Acyl- CoA dehydrogenase, C-terminal doma
  Pfam annotation: Domain name=Acyl-CoA_dh_2; Domain location=300-425; Score=-5.9; E_value=0.00087; Accession=PF08028.2; Description=Acyl -CoA dehydrogenase, C-terminal doma
  Pfam annotation: Domain name=Acyl-CoA_dh_M; Domain location=173-228; Score=51.8; E_value=2.2e-12; Accession=PF02770.9; Description=Acyl -CoA dehydrogenase, middle domain
  Pfam annotation: Domain name=Acyl-CoA_dh_N; Domain location=43-169; Score=102.8; E_value=9.8e-28; Accession=PF02771.7; Description=Acyl -CoA dehydrogenase, N-terminal domain
  Pfam module annotation: Pfam domain module=Acyl-CoA_dh_1::Acyl-CoA_dh_ 2::Acyl-CoA_dh_M::Acyl-CoA_dh_N; Domain location=281-436::300 -425::173-228::43-169
IHQPSPLSNSNLFTGDSALCEAVVREGAGWDREWLASVGLQLGSAESLELGRLANAQPPELLRYDARGERLDEVRFHPAWHLLMQGVCASRLHNLSWQPDVQGSAMVARAARFILHAQVEAGSLCPVTMTHAAIPLLQTHLPAPYADWHDRLLSDRYDAHHLPGSQKRGLLIGMGMTEKQGGTDVLSNTTRAEPPGTRTPGEPWRITGHKWFFSVPQSDAHLILAQTAAGLSCFFLPRLLPDGTRNAIRLERLKDKLGNRANASAEVEFQDAFGWLLGEEGDGVRLILKMGGMTRFDCALGSHGQMRRALAIALHHAGQRQVMGKSLSDQPLMRAVLAQQALQLEGQTALLLRLARAWSTPASAHERLYARLFTPAAKFVICKAGMPFVAEAMEVLGGIGYCEESELPRLYREMPVNSIWEGSGNVMCLDVLRVLGRHAEVLSMLQDEFDAVKGSNRHFDRCWRQLRLQLGNLREEQARQCRGAAESGRTAAGRQLVRALSLIAPGTGAE

SEQ ID NO: 188994 - protein, 178 aa, Glycine max
  Coding DNA Sequence Number=SeqID_72216
  Gene Ontology: Mol. function=signal transducer activity; Cellular component=membrane; Biological process=signal transduction
  Homolog annotation: Hit_ID=Q8P9I4; Match level="QueryCoverage=58%, HitCoverage=13%, E-value=4e-21, Identity=53%"; Hit description =Chemotaxis protein
  Pfam annotation: Domain name=MCPsignal; Domain location=1-120; Score=- 43.4; E_value=2.2e-05; Accession=PF00015.11; Description=Methyl -accepting chemotaxis protein (MCP) signaling domain
AARAGEHGKGFAVVAAEVRALAQRSANAAKEIDGLIASSIDKVAAGHALSEQTRDAMSHIVSHIEQVKTLMGEINIAAQEQAAGIVRAHSAAPESERPPSDPAARADGLHLSHLPVFRSHHAYAYSAAGPAAERLCRTAHHATTPASAHYSGAGDHPRAKLWPAEAWHRQRPFTRLAG

SEQ ID NO: 188995 - protein, 152 aa, Glycine max
  Coding DNA Sequence Number=SeqID_72217
  Gene Ontology: Mol. function=DNA binding; Biological process=DNA integration
  Homolog annotation: Hit_ID=Q1S785; Match level="QueryCoverage=52%, HitCoverage=10%, E-value=8e-18, Identity=54%"; Hit description =Integrase, catalytic region
  Pfam annotation: Domain name=rve; Domain location=1-131; Score=0.0; E_ value=0.0059; Accession=PF00665.16; Description=Integrase core domain
MIGKIIGNIYMLNIEHASFHELSCLVIQNEKGLNIISIRSDHGGEFQNEYFENFYEKNGIHHNFFAPRTPQKNGVVERKNRSLEEGARTHLNETKLPKYFWADAKMKMQVFKIRILLLKMKPKLKSLDKAKKSLPHLLKTSLENEELKKISP

SEQ ID NO: 188996 - protein, 356 aa, Glycine max
  Coding DNA Sequence Number=SeqID_72218
MASNPSRAQKKAKSSKRKQDECSQATLNRLDTWFTNESKKKDYKMIYAIKNMRIPKYLDLEWFSQQGFNFPNLLEAQGLSKLVQMKGTFYPELVKVFYTCAHVDLEGNLFSTGNGVEMVIDTAIWKEVANLDMGGVCKFDEIVDGYNKMQTYRGMLLDPTRNLRNHLRVGGLTTKDIMLVYLITYILTLRSSNHAKVMDDNLQAVYGLKSGIKMNWVLLIEDIMLKSRRLVDYEFPYVILALRFIDYNSIRLFLNSCNNSSMALLNRFTSSNLEGMSAPLTNKGGSCPYKALKGDILAEISKLLDSSNKLLSIGWLLQYAHMYEDERQCSSLIGSAFLNNFFQKRLIKSLSLSNTI

SEQ ID NO: 188997 - protein, 102 aa, Glycine max
  Coding DNA Sequence Number=SeqID_72219
  Gene Ontology: Mol. function=RNA-directed DNA polymerase activity; Cellular component=membrane; Biological process=RNA-dependent DNA replication
MVEWPRLKDARGLRGFLGLIGEEAIHAFEELKATIRKLPILTLLDFSKSFILETNASGTGLGTFLLQEEKPLAFWSKTLSYRAQLKSVYERELMAIVFAVGQ

SEQ ID NO: 188998 - protein, 96 aa, Glycine max
  Coding DNA Sequence Number=SeqID_72220
MGHSVPRDEQDGSFTSDSVVDSLMLKKPKLMSYGLGFSTKIASNTMNDLFNFDKVQKASVLMEGGVIRLNYIGNDLVIIRGIDMDNAQQLMYLNDD

SEQ ID NO: 188999 - protein, 1021 aa, Glycine max
  Coding DNA Sequence Number=SeqID_72221
  Homolog annotation: Hit_ID=Q9FNB4; Match level="QueryCoverage=39%, HitCoverage=30%, E-value=1e-10, Identity=26%"; Hit description =Arabidopsis thaliana genomic DNA, chromosome 5, P1 clone:MSH12
MPVSGHEETGVKSYAGKFSGLIAGVPIKKRRFPTIQPSSAPVSEEPYSLTEETELQRKENSSTSQGPTLPNAAGAPIKKRKFPYLQPSLEEASRSEESDPLRKEHSSTSPGSTLSPSSSGLSDANGIPALEDKKASTDVTNANMVQSNSCFLTPKREQSNVRTQSCTLDVMDSKEKILSQGSNKKLESQIIKGNPELLLAAKEGLALSIGADVSKQNVQDICKQETPLVSGSPGLSLSLKEHVLPAVASMENDGNRQKTEKAESVSLELSLSKEDCSTHSLNTDAKTDSDTTCVQSNRANWDLNTTMDAWEESGTEAGLVKTSIDGLKITDGSLDEKQLVCSTGMTLPTSVVSVKPMCEESHKEAFTFPSGPCGQQFKFLDSSILSLTPIQKYTEEPSRLSVKLNSGSAIPNVSLSSLASTVGDANTSSFRLVKPEPFDESSKKDLKEANASPVGSLDSVAVKQELVQPSTANSSKLSNVSNLMKVDAASVKLEPNHEGSQEGSNAALSKMDQLNKDLRQGSDNSSPSLAMPVMPETTQISAEADCAPVKPLYTKELSTSENIVSQIENSSLTDGVDVEKVCHGVCLNAEQVTIETVAMPMVGNGSKLNDPGLQTFSVRTEEENAADRDACRLKLMNEPPPVPRGNGEGCVSDEEKITLSTDMLEDDSYGSDCESDENRAVTIGVDTERYVEDDDYEDGEVREPLDPSTAEDTICEVREVEHPDCSNFVNKQMEKGMVSGDCPTSYQLVENDNITAIQSEINNEVVDMDIEMHERSGKVIDKSVCVQESLDDEKSNIAAHGANVLQMKALDLLDGKNVCEALVAESPSNQATNGSHGVDFQCADEVVKTADIVKQTDLDFETMEVSANADDAAKDVNNGGNPGRIIVLSRATSSSSPGKTRPISGRSLSSRAGRDVLSDSLDGDKLHRGRDEVFIDGPHKFSRERHQDISPRNSRFNFVRGRGRLNSRLDSVRSEWESDREFSGEFYNGPSQFRGPRPKYAPAFADTDMEYNNVAPDGSYV

SEQ ID NO: 189000 - protein, 48 aa, Glycine max
  Coding DNA Sequence Number=SeqID_72222
MDIGESVIVNEIRNDGGRRKVRPDKAKIPRMGGTLGYMNSKIVQRASI

SEQ ID NO: 189001 - protein, 695 aa, Glycine max
  Coding DNA Sequence Number=SeqID_72223
  Gene Ontology: Mol. function=phosphogluconate dehydrogenase (decarboxylating) activity; Cellular component=mitochondrion; Biological process=pentose-phosphate shunt
  Homolog annotation: Hit_ID=Q9FFR3; Match level="QueryCoverage=66%, HitCoverage=94%, E-value=0.0, Identity=85%"; Hit description=6 -phosphogluconate dehydrogenase
  Pfam annotation: Domain name=6PGD; Domain location=384-681; Score =685.2; E_value=4.8e-203; Accession=PF00393.9; Description=6 -phosphogluconate dehydrogenase, C-terminal domain
  Pfam annotation: Domain name=NAD_binding_2; Domain location=217-380; Score=181.9; E_value=1.6e-51; Accession=PF03446.5; Description=NAD binding domain of 6-phosphogluconate dehydrogenase
  Pfam annotation: Domain name=vATP-synt_E; Domain location=16-230; Score=331.4; E_value=1.6e-96; Accession=PF01991.8; Description=ATP synthase (E31 kDa) subunit
  Pfam module annotation: Pfam domain module=6PGD::NAD_binding_2::vATP -synt_E; Domain location=384-681::217-380::16-230
MNDADVSKQIQQMVRFIRQEAEEKANEISVSAEEEFNIEKLQLVEADKKKIRQEYERKERQVEIRKKIEYSMQLNASRIKVLQAQDDVISSMKEAASKELLNVSHHHHLNLLSHHHHEYRNLLKDLIVQCLLRLKEPSVLLRCRKDDLHLVEHELDSAAQEYAEKANVDPPEIIVDNQVYLPPGPTHHNSHDLYCSGGVVLASRDGKIVCENTLDARLDVVFRKKLPEGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 189002 - protein, 41 aa, Glycine max
  Coding DNA Sequence Number=SeqID_72224
MDWASEVNLYKRTAQHSTGDLGAFGRRENTNGSCRSPLFAT

SEQ ID NO: 189003 - protein, 271 aa, Glycine max
  Coding DNA Sequence Number=SeqID_72225
  Gene Ontology: Mol. function=ATP-dependent helicase activity; Cellular component=mitochondrion; Biological process=iron ion homeostasis
  Homolog annotation: Hit_ID=Q9LIG6; Match level="QueryCoverage=77%, HitCoverage=65%, E-value=3e-83, Identity=75%"; Hit description=NifU -like protein 4, mitochondrial precursor
  Pfam annotation: Domain name=Nfu_N; Domain location=68-154; Score =195.8; E_value=1e-55; Accession=PF08712.1; Description=Scaffold protein NfuNifU N terminal
  Pfam annotation: Domain name=NifU; Domain location=207-270; Score =102.8; E_value=1e-27; Accession=PF01106.8; Description=NifU-like domain
  Pfam module annotation: Pfam domain module=Nfu_N::NifU; Domain location=68-154::207-270
  Subcellular localization annotation: CTP_CleavageSite=38; ConfidenceScore=5.38e-01
MRSTIVLRLGRRARIPFQRALATQSNNNNTLVFIPLPRCLSATRSFHFQRNSPFGFSSGHGQRRSMFIQTQPTPNPSSLMFYPGKPVMEVGSSDFPNPRSAMNSPLAKSLFAIDGVTRVFFGSDFVTVTKSEEAAWEFLKPEVFAAIMDFYSSAQPLFLDSQAAAAMDTAIHQVLKIYIRSQHRLLKGKFKPFFLSAKDDSETVAMIKELLETRIRPAVQDDGGDIEYRGFDLDTGIVKLRMQGACSGCPSSSVTLKSGIENMLMHYVPEK

SEQ ID NO: 189004 - protein, 750 aa, Glycine max
  Coding DNA Sequence Number=SeqID_72226
  Gene Ontology: Mol. function=nucleoside-triphosphatase activity; Cellular component=integral to membrane; Biological process=response to nematode
  Homolog annotation: Hit_ID=Q69FB5; Match level="QueryCoverage=94%, HitCoverage=96%, E-value=0.0, Identity=70%"; Hit description =Stigma/style ABC transporter
  Pfam annotation: Domain name=ABC2_membrane; Domain location=444-654; Score=183.8; E_value=4.1e-52; Accession=PF01061.14; Description=ABC -2 type transporter
  Pfam annotation: Domain name=ABC_tran; Domain location=142-332; Score= 136.0; E_value=1e-37; Accession=PF00005.17; Description=ABC transporter
  Pfam module annotation: Pfam domain module=ABC2_membrane::ABC_tran; Domain location=444-654::142-332
MSSRIVAENALSLTNIVTPPYFDLMELDDLTRRPSAGDMPTLGQLLKHVGDVRKEASGDGSETPVHHALDIPGIEPRSLPFVLSFSNLTYSIKSRRKMSLSSIFPRRSNRLGAVAEAPTVGESMFTRTKTLLNDISGEARDGEIMAVLGASGSGKSTLIDALANRIAKGSLKGTVALNGEALESRLLKVISAYVMQDDLLFPMLTVEETLMFAAEFRLPRTLSKSKKSARVQALIDQLGLRNAAKTVIGDEGHRGVSGGERRRVSIGTDIIHDPILLFLDEPTSGLDSTSAYMVVKVLQRIAQSGSIVIMSIHQPSYRILGLLDRMIFLSRGQTVYSGSPSQLPLYFSEFGHPIPETDNRTEFALDLIRELEGSPGGTKSLVEFNKSWQSMTKHHQEKEEERNGLSLKEAISASISRGKLVSGASNTNPNPSSMVPTFANQFWVEMATLSKRSFLNSRRMPELIGIRLGTVMVTGFILATMFWQLDNSPKGVQERLGFFAFAMSTTFYTTADALPVFLQERYIFMRETAYNAYRRLSYLVSHALVALPALAFLSLAFAAATFWAVGLDGGISGFLFYFLIIFASFWAGNSFVTFLSGVVPHVMLGYTIVVAILAYFLLFSGFFINRDRIPSYWIWFHYLSLVKYPYEAVLQNEFDDPVKCFVRGVQIFDNTPLGSVPEPLKVKLLETMSSTLGTKITTSTCLTTGADILQQNGVTDLTKWNCFWITVAWGFFFRFLFYLSLLLGSKNKRS

SEQ ID NO: 189005 - protein, 487 aa, Glycine max
  Coding DNA Sequence Number=SeqID_72227
  Gene Ontology: Mol. function=protein binding; Cellular component =nucleus; Biological process=protein modification process
  Homolog annotation: Hit_ID=UPI00004BB0D8; Match level="QueryCoverage =45%, HitCoverage=27%, E-value=2e-55, Identity=50%"; Hit description =leukocyte receptor cluster (LRC) member 8
  Pfam annotation: Domain name=SAC3_GANP; Domain location=214-409; Score=226.1; E_value=7.9e-65; Accession=PF03399.6; Description =SAC3GANP family
MSLAQDSLLPKFKKSPRRSKSRWEPMPEEKPVDNPMLISNDTVKYSNWVPNEKDRKVAVENKESKDGLRNTKFSPLLQRLSSKALQRPFKKQRLTDASIASENGDASSDSDKEQSLTAYYSAAMVFSDTPEERKRRENRSKRFDLGQGRRTENNHSRKKHAGGGSFYNRRASALVLSKSFDDGASKAVEDIDWDALTVKGTCQEIEKRYLRLTSAPDPATVRPEEVLEKALLMIQNSQKNYLYKCDQLKSIRQDLTVQRIRNQLTVKVYETHARLALEFGDLFEYNQCQSQLQTLYAEGIEGSDMEFAAYNLLCVIMHSNNNRDLVSSMARLSHEAKKDEAVKHALAVRAAVTSGNYIAFFRLYKAAPNLNTCLMDLYVEKMRYKAVNCMCRSYRPTLPVSYISQVLGFSTGVATNGVSDERETDALEECSEWLKAHGASIITDNNGDMLLDTKVSSSNLFVPEPEDAVAHGDANLAVDDFLARAPL

SEQ ID NO: 189006 - protein, 528 aa, Glycine max
  Coding DNA Sequence Number=SeqID_72228
MANEGSNAETLAPAEPHLFENRHVDANQHHPTSYVPTTTGSEAAPWTVHSSTGNGVYSNPTYQYDQHPQPPGRSIQDCQNVSSVAGNSSNLGTANVTQDYNAYASYPSSSNPYGYGSMGYSGYYNNYQQQPNHTYSQPVGAYQNTGAPYQPISSFQNTGSYAGSASYSSTYYNPADYQTTGGYQNSSGYGNQATMWNSGSYSSHPYTNYTPDSGGSYSSGTATTSVQYQQQYKQWADYYNQTEVSCAPGTENLSVTSSSTLDCPIPAVTSGYATPNSQPPQSYPPFWRQESSSSSIPSFQPATVNSGDRDGYWKHGAQSSQIQQTNPIQPNYQSPLDLKSSYDKFQDQQKTVSSQGTNLYLPPPPPPPLPSQLVNLAPVQSVSSPDAKRPKAEKDSSTTSSAPKPVYIAVSLPKPSEKISSNDAANSILKPGMFPKSLRGYVERALARCKDDKQMVACQAVMKEIITKATADGTLNTRNWDMEPLFPMPDADVINKEYAVSCFPLVFVFLVFANFQGLINYYFFFQFS

SEQ ID NO: 189007 - protein, 801 aa, Glycine max
  Coding DNA Sequence Number=SeqID_72229
  Gene Ontology: Mol. function=RNA splicing factor activity, transesterification mechanism; Cellular component=spliceosome; Biological process=nuclear mRNA splicing, via spliceosome
  Homolog annotation: Hit_ID=Q6K476; Match level="QueryCoverage=59%, HitCoverage=100%, E-value=1e-160, Identity=61%"; Hit description =Putative U4/U6-associated RNA splicing factor
  Pfam annotation: Domain name=PRP3; Domain location=413-794; Score =588.9; E_value=4.9e-174; Accession=PF08572.1; Description=pre-mRNA processing factor 3 (PRP3)
MDDIEKPEKRSRDRHSERHRDSDEHRHHRSDRNHKRDHKSRDTEGSKDKDRAYERESSRSKVKRDEEREYSHSHKRKEREHSEDMDFLDNKIRVSDERRERRKFGDKVKKEEDDAEEEDGGDNVRAVHEAKVKEEVTNFKDTASLQNGALGSPASVPPETSLTPPSSIPIKVSSNFTTNENKGLSITRSHEVAGKSSTDGPSSTAGKTGSFSIDALAKAKKALQMQKELSEKLKKIPQLNKSSTQTLQGSSNLGSKTESTMPSSNAGVALITSTSASMGHVANMSISASTASANPPATATSATGTATLPNFEAVRRAQELAARLGFRPDPQFAPLINTFPGQNQMVTDVAIPQKPTKAPVLRLDAQGREIDEHGNVVNVTKPSNLSTLKVNINKQKKDAFEILKPVLDVDPESNPHFDATMGINKTKLLRPKRMNFQFVEEGKWSRDAETIKLKSKFGEAQAKEHKAKQAQLAKAKAAPDINPNLIEITERVVIKEKPKDQIPEIEWWDVPLLHSGNYGDIDNGTIGEDKLKMEKITFYVEHPRPIEPPAEPAPPPPQPLKLTKQEQKKLRTQRRIAKEKERQEMIRQGVIEPPKPKVKISNLMKVLGTEATQDPTRLEKEIRSAAAEREQAHIDRNIARKLTPAELREKKERKLFDDPNTVETLVSLYKINDLSHPKARFRVDVNAQENRLTGCAVICDGISVVVVEGGNKSIKRYGKLMLRRINWTDVSKETEENEDSDDDKPINKCVLVWQGSVAKPSFNRFSVHDCITEAAGRKVFVDAGVPHYWDLAVNYVEDEAV

SEQ ID NO: 189008 - protein, 75 aa, Glycine max
  Coding DNA Sequence Number=SeqID_72230
  Subcellular localization annotation: CTP_CleavageSite=45; ConfidenceScore=5.10e-01
MACKVFDNNNICIKSDLCACGGVAVFFKFRVLTYGRETRNSSSPYSSTVQSLLLISGRALSLYQVPRRSCLPQRK

SEQ ID NO: 189009 - protein, 267 aa, Glycine max
  Coding DNA Sequence Number=SeqID_72231
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1KSH9; Match level="QueryCoverage=79%, HitCoverage=86%, E-value=4e-78, Identity=73%"; Hit description=PP2c
  Pfam annotation: Domain name=PP2C; Domain location=55-267; Score= -7.7; E_value=1.7e-05; Accession=PF00481.12; Description=Protein phosphatase 2C
  Subcellular localization annotation: CTP_CleavageSite=66; ConfidenceScore=5.38e-01
MISNSDLVEPATATATAVATTASSSNEDQAAPPAAPNIVMSLGSRFSLQRRNGRFSYGYSSFKGKRSSMEDFFETKISEADGQTVAFFGVFDAAAVSPLWFAVVWFVYDGGHGGSRTAEYLKSNLFKNLSSHPDFIKDTKTAIVEAFKQTDVDYLNEEKGHQRDAGSTASTAVLLGDRIVVANVGVIPEWLHVELAQVDAMSVMCIVPLSIDHKPDRSNERQRIEQAGGFIIWTGTWRVGGVLAVSRAFGNKLLKPYVVADPEIQVA

SEQ ID NO: 189010 - protein, 356 aa, Glycine max
  Coding DNA Sequence Number=SeqID_72232
MATTFFACDPAEDDYIDMEVNSYTNFFCHSQSHPQPREFEFQMSSIVQEKETTTSPADELFYKGKLLPLHLPPRLQMVEKLLQNSPTPFDKENDIFEEFYSTPLATTYTTPTAGTPFESCNISPSDSCQVSRELIPEEYYNFDYPTDTSGFVAENQKKSWTKKLKQSSLGSKLKASRAYLKSWFGKSGCSYETYATSTKVADEGSVSKARENLNKHVQVAKKNAYGQIHRDRYQPSNSVMRSYKEKTSEDRSNQHRRSFSVGIKLLSGNKSSSTSSISGSTSFSFSNKSYGCQARQLLKRCSSANSEIENSIQGAIAHCKKSQQMFSSKKTASEVGIYSMFASRTSVCEDHERVEL

SEQ ID NO: 189011 - protein, 69 aa, Glycine max
  Coding DNA Sequence Number=SeqID_72233
  Subcellular localization annotation: CTP_CleavageSite=58; ConfidenceScore=5.03e-01
MYLFKKFFLNFFTVLELLFHNKCPSHPRNPTRKGRRGKVVVQHREEGVGLNVVEDEVVAVTGEGGAIMT

SEQ ID NO: 189012 - protein, 53 aa, Glycine max
  Coding DNA Sequence Number=SeqID_72234
METMQHRQYFYSKNKLELSHHYAETTSKKDKSNPMNTNVFSHTDEVVPLAHTH

SEQ ID NO: 189013 - protein, 148 aa, Glycine max
  Coding DNA Sequence Number=SeqID_72235
MKARKMGSRYIIMKKCPTNDKKLRILKRMGSSLGVSKRAEQQEVDDAAKVIEVLVDLHISGALNETEEQDVSFIESNATEANKLVQTSQLEPASKQIDTSNEATSLRKELLDVIVVFSSNSDVALSSLTGNHVQEKLNLDLTKQKEET

SEQ ID NO: 189014 - protein, 50 aa, Glycine max
  Coding DNA Sequence Number=SeqID_72236
MDKRLNVFRSGATRTGSVAVRTGRGTHFKRCKVKTSLTDGVNWVLNHCNI

SEQ ID NO: 189015 - protein, 190 aa, Glycine max
  Coding DNA Sequence Number=SeqID_72237
  Gene Ontology: Biological process=response to biotic stimulus
  Homolog annotation: Hit_ID=Q9SDR7; Match level="QueryCoverage=94%, HitCoverage=96%, E-value=7e-71, Identity=70%"; Hit description =Dirigent protein
  Pfam annotation: Domain name=Dirigent; Domain location=16-186; Score =296.0; E_value=7.2e-86; Accession=PF03018.5; Description=Dirigent -like protein
MELTTRLVSVILFLLVIRVGCSASPHHWRKKRVGEPCKKLVFYFHDIIYNGHNGKNATSAIVGTPAWGNRTILAGHNHFGDVVVFDDPITLDNNLHSPPVGRAQGFYIYDKKDIFTAWLGFSFVFNSTQLRGTINFAGADPLMNKTRDISVIGGTGDFFMTRGVATLSTDAFEGEVYFRLRADINLFECW

SEQ ID NO: 189016 - protein, 64 aa, Glycine max
  Coding DNA Sequence Number=SeqID_72238
  Homolog annotation: Hit_ID=Q1RT13; Match level="QueryCoverage=60%, HitCoverage=4%, E-value=4e-10, Identity=79%"; Hit description=Beta-1, 3-glucan synthase, putative
MEMEKAQATSNMKSFVVGDISASRRSEAAKFAQLWNEVICSFREEDIISDRKGFEAKLFSCFFS

SEQ ID NO: 189017 - protein, 275 aa, Glycine max
  Coding DNA Sequence Number=SeqID_72239
  Gene Ontology: Mol. function=nucleoside-triphosphatase activity; Cellular component=membrane; Biological process=lipoprotein transport
  Homolog annotation: Hit_ID=Q8ZFR4; Match level="QueryCoverage=80%, HitCoverage=95%, E-value=1e-92, Identity=76%"; Hit description =Lipoprotein-releasing system ATP-binding protein lolD
  Pfam annotation: Domain name=ABC_tran; Domain location=78-264; Score =236.0; E_value=8.1e-68; Accession=PF00005.17; Description=ABC transporter
  Pfam annotation: Domain name=SMC_N; Domain location=62-268; Score= -105.9; E_value=0.00071; Accession=PF02463.9; Description=RecFRecNSMC N terminal domain
  Pfam module annotation: Pfam domain module=ABC_tran::SMC_N; Domain location=78-264::62-268
MVQGASAGIIGALLGTLLGVLLASQLNNLMPVIGLFLDGAALPVDINVWQCRDLCKRYQEGSVQTDVLRNVAFSLQPGELTAIVGSSGSGKSTLLHLLGGLDAPTSGDVVFDGKSLNAMSSAAKAELRNRELGFIYQFHHLLPDFSALENVAMPLLIGKTGKAEAEARAREMLAAVGLEKRAAHRPSELSGGERQRVAIARALVNRPRLVMADEPTGNLDARNADAIFELLGELNVQQGTAFLVVTHDLNLAKRLSRQMEMRDGQLSDHLTLGAI

SEQ ID NO: 189018 - protein, 116 aa, Glycine max
  Coding DNA Sequence Number=SeqID_72240
MTHSETWHVHSRIRIPKDYTHRRLLEYKVHSAYLAVDFFSCNASTHSVIAGKPESAFAGFGRKGWAEDTMSADVINKEGREYNLEVVDGAKRIATLFARAYLWLTDCHAQNAAEDK

SEQ ID NO: 189019 - protein, 683 aa, Glycine max
  Coding DNA Sequence Number=SeqID_72241
  Gene Ontology: Mol. function=protein serine/threonine kinase activity; Cellular component=membrane; Biological process=regulation of transcription, DNA-dependent
  Homolog annotation: Hit_ID=Q9AXB2; Match level="QueryCoverage=79%, HitCoverage=81%, E-value=1e-179, Identity=58%"; Hit description =Disease resistance protein-like
MDARFKNFLGFAANHSANAFKILGSSMQIEGRGADYHGTDTILRLDSPGSSIPTSVPSSKGTKRKWDLIDGCMGQRVDSSLSLGLGRSSSSSDSKGSSAAACTAMSSAKDIDEESSMDIELDFFLHLGSEKVQSHKKPVNSNLKTLELQPKFDLELSLSTGPCESDITSVHLNPSPLQLNMEIPLTFSGTQNTDEGSTSCSWQPGIVLPSSKMSSNTGTNFLLSQSSKQFDHSPIVVDLSSTGPKSSVTCTSGLTQQQQPLHRPGNSKTCQVEGCGKGARGASGRCISHGGGRRCQKPGCHKGAEGRTVYCKAHGGGRRCEFLGCTKSAEGRTDFCIAHGGGRRCSHEGCTRAARGKSGLCIRHGGGKRCQRENCTKSAEGLSGLCISHGGGRRCQVPGCTKGAQGSTMFCKAHGGGKRCTAPGCTKGAEGSTPYCKGHGGGKRCTYQGGGVCTKSVHGGTNFCVAHGGGKRCAVPGCTKSARGRTDHCVRHGGGKRCKFEGCGKSAQGSTDFCKAHGGGKRCSWGHPGSEYGIQQDGPCNSFARGKTGLCALHSGLVHDKRVHGGISLGSVVQDPHSSKADELKQVLIDKNMDVNMMKIGSSLGAAATCSDFEQLEAATAHVSVKEGGHLPMSVVVPEGRVHGGSLMAMLTGSSSRGSSSGRGLVSDPSEPIKGYPMPQSWI

SEQ ID NO: 189020 - protein, 80 aa, Glycine max
  Coding DNA Sequence Number=SeqID_72242
VEGISSEFQEPMDLRSNPFQRGGDDAILSPQRALDRRLQEYWARYAGEDLRVLMSLMVDATMVERVDDDFVERWEHMMKH

SEQ ID NO: 189021 - protein, 88 aa, Glycine max
  Coding DNA Sequence Number=SeqID_72243
MEYSLLCYHLQDQMTSPMLPPPLYIDAIVIKWEHDDVLDVDHFSEFLHWRRMLDVVIPFKSLSLFPNVATSSADFDSSSKDIDATLFL

SEQ ID NO: 189022 - protein, 96 aa, Glycine max
  Coding DNA Sequence Number=SeqID_72244
MGPKSTLRMMRILGPSLVSLAQSCWSLLSNDLGGILAIENYMKIDTHYKERIENEGMTLNSVRIHPLMSSHKYQHNHHLHCSSSRMSEDSLRVDDT

SEQ ID NO: 189023 - protein, 96 aa, Glycine max
  Coding DNA Sequence Number=SeqID_72245
MYSCIHVTQGVTCTGGMVRKPIELTKGRPWVLQAFWRINQRIFQPGFWVPFSCIRVTLWSDTYWRCSGVFLHTCHPWSGTYWRCDVMLLHTCHFVQ

SEQ ID NO: 189024 - protein, 234 aa, Glycine max
  Coding DNA Sequence Number=SeqID_72246
  Gene Ontology: Mol. function=peptidase activity
  Homolog annotation: Hit_ID=Q9FF45; Match level="QueryCoverage=80%, HitCoverage=61%, E-value=2e-76, Identity=73%"; Hit description =Arabidopsis thaliana genomic DNA, chromosome 5, P1 clone:MUP24
MVTSLALCLAANEVFKVIGYGWVVPWNAMTILQVMLLWTTAFWFIGSWMIPFAAHITGFSKESLTFRGQALFSLVTDVTEGLAGVAILLRCLSRFRPLPPDWFKFSLKGYWQLDVITGCLMFPLVNRLSQFNLDLLPLLPSTPVTLSSVEQSIMARDPVAMLLYATVVSVCAPVWEEIVFRGFLLPSLTKYMPVWCAILRVQCVGRISGTSMRVCALDQQFSEVNAYAYRTVPR

SEQ ID NO: 189025 - protein, 453 aa, Glycine max
  Coding DNA Sequence Number=SeqID_72247
  Gene Ontology: Mol. function=potassium ion transporter activity; Cellular component=membrane; Biological process=potassium ion transport
  Homolog annotation: Hit_ID=Q94IL7; Match level="QueryCoverage=99%, HitCoverage=58%, E-value=1e-155, Identity=61%"; Hit description =Putative high-affinity potassium uptake transporter
  Pfam annotation: Domain name=K_trans; Domain location=1-453; Score =166.8; E_value=5.5e-47; Accession=PF02705.7; Description=K+ potassium transporter
MDILFWPVFVVAALAVIVASQAVIASTFSIVQQCHAFECFPRVKAVHSRRWIPGQTYIPEINWILMIISLAATVGLGDMSNIGYAYGMAYLIVVFVTTCLTSLVINVVWNQSLVVALAFALFFGSIEILFLSSYCMKIPKGSWIPLVLSAVFMVVMYVWHYGSRKKYLFDMLNKVSMRSILTLGPSLGIVRVPGLGLIYTELATGVPASFTHFLTNLPAFYQVVVFVCVKTVPVPCVPHEERYLIGRIGPKSYRMYRCIVRNGYKDVYSHQNDFENDLVMSIAEYIQLEAEGCSGNAEGSVDGRMAVVRTSGKFGTRLRMSESAGFEEGSSINLPGALTVTSSKSPTLKKLQAMYEQESPELNTRRRIQFELLNVIYKDPRVKEELMELVEAKRAGAAYVIGHSHVKAKWNSPFLKRFAINLYSFLRKNCRSPAVGLNIPQISLIKVGMNYHV

SEQ ID NO: 189026 - protein, 73 aa, Glycine max
  Coding DNA Sequence Number=SeqID_72248
MEKKGKRTTVDAPRSLLASELIAKPEENRASGYGFERKRALSLRSFLERKKMEKSTPTVVYWDREIASNVERV

SEQ ID NO: 189027 - protein, 50 aa, Glycine max
  Coding DNA Sequence Number=SeqID_72249
MGLKVKEVMEDIIANLEWETEVVGMVMNGEILEMKVEELMEHLLVVEVGR

SEQ ID NO: 189028 - protein, 562 aa, Glycine max
  Coding DNA Sequence Number=SeqID_72250
  Gene Ontology: Mol. function=nucleoside-triphosphatase activity; Cellular component=membrane; Biological process=cell division
  Homolog annotation: Hit_ID=Q1SK92; Match level="QueryCoverage=99%, HitCoverage=65%, E-value=0.0, Identity=78%"; Hit description=AAA ATPase, central region; DEAD/DEAH box helicase, N-terminal
  Pfam annotation: Domain name=AAA; Domain location=270-455; Score =266.4; E_value=5.7e-77; Accession=PF00004.19; Description=ATPase family associated with various cellular activities (AAA)
  Pfam annotation: Domain name=AAA_2; Domain location=266-397; Score= -49.6; E_value=0.054; Accession=PF07724.4; Description=ATPase family associated with various
  Pfam annotation: Domain name=AAA_3; Domain location=270-396; Score= -8.7; E_value=0.0029; Accession=PF07726.2; Description=ATPase family associated with various
  Pfam annotation: Domain name=AAA_5; Domain location=270-402; Score =20.4; E_value=4.9e-05; Accession=PF07728.4; Description=ATPase family associated with various
  Pfam annotation: Domain name=Sigma54_activat; Domain location=260 -458; Score=-165.6; E_value=0.0011; Accession=PF00158.16; Description= Sigma-54 interaction domain
  Pfam module annotation: Pfam domain module=AAA::AAA_2::AAA_3::AAA _5::Sigma54_activat; Domain location=270-455::266-397::270-396::270 -402::260-458
MLKKLSGPILILGSRVIDSGNDYEEVDEKLNSLFPYNIEIRPPEDESHLVSWKSQLEEDMKMIQVQDNKNHIMEVLAATDLDCDDLDSICVADTMILSNYIEEIIVSAISYHLMKNKDTEYRNGKLVISSNSLSHALNIFHKGKSSRRDASKLEDHAVKSEQREEGTAMKPEVKSKNAAPVKKTEAEISTSVGKAGGEKSVPAPKAPEVPLDNEFEKQIRPEVIPANEIDVTFSDIGALDDTKESLQELVMLPLRRPDLFTGGLLKPCRGILLFGPPGTGKTMLAKAIAKEAGASFINVSMSTITSKWFGEDEKNVRALFTLAAKVSPTIIFLDEVDSMLGQRTRVGEHEAMRKIKNEFMTHWDGLLTKQGERILVLAATNRPFDLDEAIIRRFERRIMVELPSVENREKILRTLLAKEKVDNELDFKELATMTEGYTGSDLKNLCTTAAYRPVRELIQQERLKSLDKKQKAAKGQNKDVQESQGGQSILGNTQDAIDGEEEVKQERVITLGPLNMQDFKEAKNQVAASFAAEGAGMSEMKQWNDLYGEGGSRKQQQLSYFL

SEQ ID NO: 189029 - protein, 501 aa, Glycine max
  Coding DNA Sequence Number=SeqID_72251
  Gene Ontology: Mol. function=carboxylic ester hydrolase activity; Cellular component=mitochondrion; Biological process=lipid metabolic process
  Homolog annotation: Hit_ID=Q6TGC0; Match level="QueryCoverage=79%, HitCoverage=97%, E-value=1e-149, Identity=65%"; Hit description =Triacylglycerol/steryl ester lipase-like protein
  Pfam annotation: Domain name=Abhydro_lipase; Domain location=44-111; Score=71.1; E_value=3.5e-18; Accession=PF04083.6; Description=ab -hydrolase associated lipase region
  Pfam annotation: Domain name=Abhydrolase_1; Domain location=125-402; Score=1.2; E_value=0.0064; Accession=PF00561.10; Description =alphabeta hydrolase fold
  Pfam module annotation: Pfam domain module=Abhydro_lipase::Abhydrolase _1; Domain location=44-111::125-402
MARMGLLGFVALTFFILASVPRQALASSHGFYARKIFPVEPSSFKGLCSSAVTIHGYECQELEVTTKDGYILSLQRIPEGRRKVSGRETKKQPVIIQHGVMVDGMTWLMNSPEQNLPLILADNGFDVWIVNSRGTRYSRRHTSLDPSINVGLSFLDAYWNWSFDEMVTYDLPAVFDYVSKQTGQKIDYVGHSLGTLVALASFSEGKLVNQLKSAALLSPVAYLSHMKTALGVVAARSLLGEQFFTISGMAEFDPKGLPATEFVKFLCLNPEVDCTNLLTAITGDNCCLNSSVFDQFITNEPQPTATKNMMHLAQIVRSGVLAKFNYGGKSPQIYNLSNIPHDLPLFISYGGEDALADVIDVRNMLADLKFHDEDKLSVQYIKEYAHVDYIMGVNAKDLVYNGEEDDDVEDDNDGDDRDRDDDAGEAAFPNLPMVIFTFIPTGLALSLPSSTTLCKELVRHWNVHGFHGRWWSMIAASPDQEESPKDPRVGGVCSLEYARGQ

SEQ ID NO: 189030 - protein, 96 aa, Glycine max
  Coding DNA Sequence Number=SeqID_72252
MEASRRNKKLPLFHRVCCVITERKQKPSVSHFPSLNSVSDDDRCIWAVRLVTRVSMAAPSPVLQSLTRASTNKISPHCSTQICDTLDFVLCGDHHY

SEQ ID NO: 189031 - protein, 148 aa, Glycine max
  Coding DNA Sequence Number=SeqID_72253
MGEVGEVQEQMKADMEAMKEKMATMVEAMMSMKKIMEANMVAIAATSAIAKVNPMPPSDLNQMNHPTSDMVDKDLGSTDGPMMCKFKMSTPSRHMACLPTIHHPMWRTFPMRMSITPLPYSLRANNPKLIMHMSLKPWGRHMKFPTTI

SEQ ID NO: 189032 - protein, 81 aa, Glycine max
  Coding DNA Sequence Number=SeqID_72254
MDKSLKVGEDEWREKERRSTNFVPQKSPLIQDQVQDSPLSVLRCHEPMSPKSTLRLMRTLGTSLASLAQSSWSLLSNALAG

SEQ ID NO: 189033 - protein, 392 aa, Glycine max
  Coding DNA Sequence Number=SeqID_72255
MEGWKAGADATLASPDIDADTDADGPFFDLELAVPDSEEDDTNDNNNSDSASEKEFKLTLSPSTSSNDFIFNSQPNNSKPQFTASLFKSATKLRVFMLGLKKLKPNAPAAPNLKKKKLFTVKFKAEEYPIVSLFSRDNSSRPKASQNHHTDESQSSLSETLSSASEEKRLMRKYLKMVKPLYVRVSRRSEKVDVSSPESAEASTVAEKIPTVAEDSESANLKGPKQGNVALPAALRKHLGKGRSAAVAAPAPPSVSSKRRDDSLLQQHDWIQGAILHCKNSFNASTGNLLLLHYSVFPFNARLLSCHDHIIVSRDDGKCGQRSGKDGDMSSESEIFFWVKGRKGIGMGEAVSVLNKCSCDGVFGLCKIKELWILVFVGEKEQADGSFYLGIL

SEQ ID NO: 189034 - protein, 127 aa, Glycine max
  Coding DNA Sequence Number=SeqID_72256
  Pfam annotation: Domain name=Transposase_23; Domain location=37-107; Score=-4.3; E_value=0.0034; Accession=PF03017.5; Description =TNP1ENSPM transposase
MQSQGLTLPPEPEVGPSIARVSIKESCVDPLGKDPDTGDSDKCGLYIEEYPPYMVALGRVYEGSTTVHNIPLLHDQVKVGVKEIRDADAPIPVPTEEVKVIRQALNTFLAWLTYLVMRLSEQVFQCH

SEQ ID NO: 189035 - protein, 124 aa, Glycine max
  Coding DNA Sequence Number=SeqID_72257
MPRQNNFVGYTFTGINPKKFDIPKGCSIDQLKDLIKQVAPKGNPPHGIHESQVVRRLFYRQPSHLEYSEKVLEFEIIELKCDDDVLKVLVESNYWKQFVPKEILALFSKVVMENEDDVVTSLRD

SEQ ID NO: 189036 - protein, 105 aa, Glycine max
  Coding DNA Sequence Number=SeqID_72258
MQKTMLVFARQRAHLPLVDERMTKGAEDDVSLCASTGSFAPAKECLYGYPLGYFRLSPNFTEIVYAENYLCIFARHLTSRVSMTDIAEDDVNLYVSMGTLAAIDK

SEQ ID NO: 189037 - protein, 81 aa, Glycine max
  Coding DNA Sequence Number=SeqID_72259
  Gene Ontology: Mol. function=RNA-directed DNA polymerase activity; Biological process=RNA-dependent DNA replication
MAPEDMEKTTFVTLWGTLCYKVMSLGLKNAGVIYQRAMVALFHDMMHREIEVYIDDMIAKSKTEEEHLFNLRRLFERLRKY

SEQ ID NO: 189038 - protein, 224 aa, Glycine max
  Coding DNA Sequence Number=SeqID_72260
  Homolog annotation: Hit_ID=Q19QU4; Match level="QueryCoverage=91%, HitCoverage=92%, E-value=2e-29, Identity=34%"; Hit description=Plant cell wall protein SlTFR88
  Pfam annotation: Domain name=Hin1; Domain location=66-201; Score =39.0; E_value=1.7e-08; Accession=PF07320.4; Description=Harpin -induced protein 1 (Hin1)
MAQSPDQQMKPLAPFISSTQFSRQEDQFQERTSEQKIIRIRKFVLCCGCFTALVVILVVILIVLSFTVYNVKEPEVRMNSVTLLSGTFANGGATNNVTLVADIFVKNTNAFTLRFGSTSTIVYYDGVRIGEGTSPPGKAKARRTIRVNSTLEIMSKKLLEIPTLNIDLRDQFLNISSYTRIDGKVKILNIFPRKVVVEMNCTIGYNITTGSVTNGDNCLGAVDI

SEQ ID NO: 189039 - protein, 40 aa, Glycine max
  Coding DNA Sequence Number=SeqID_72261
VDRLSFYATFALSTLVVLSEYGGHPCAKHNSFLNQSACLN

SEQ ID NO: 189040 - protein, 1482 aa, Glycine max
  Coding DNA Sequence Number=SeqID_72262
  Homolog annotation: Hit_ID=Q86L37; Match level="QueryCoverage=24%, HitCoverage=21%, E-value=2e-13, Identity=24%"; Hit description =Similar to Homo sapiens (Human). TGF-beta resistance-associated protein TRAG
  Pfam annotation: Domain name=WD40; Domain location=533-580; Score =45.6; E_value=1.7e-10; Accession=PF00400.22; Description=WD domain, G-beta repeat
  Pfam annotation: Domain name=WD40; Domain location=58-110; Score =24.4; E_value=0.00041; Accession=PF00400.22; Description=WD domain, G-beta repeat
  Pfam annotation: Domain name=WD40; Domain location=584-628; Score =5.3; E_value=8.9; Accession=PF00400.22; Description=WD domain, G -beta repeat
  Pfam annotation: Domain name=WD40; Domain location=6-46; Score=6.8; E_ value=5.9; Accession=PF00400.22; Description=WD domain, G-beta repeat
  Pfam module annotation: Pfam domain module=WD40::WD40::WD40::WD40; Domain location=533-580::58-110::584-628::6-46
  Subcellular localization annotation: CTP_CleavageSite=80; ConfidenceScore=5.20e-01
MKCRSVACIWSGTPFPHRVTAVAALTEPPTPTFYTAGSDGSVIWWTLSNSTSTSPPQLKAVGVLCGHAAPITDLAVCSPVADAENGYGPSGSKFSALISACCDGFLCVWSKNSGHCRCRRKLPPWVGTPRIIRTLPSTPRYVCIACSFEASEGVIDRETKPRKPPKCTILIVDSYSLSITQTVFHGSLSIGPIRFMALVLGDDEKRNSVFVADSAGRQQTVLISEDQGESLASSLGDKGQLESSFCYEGLSGVEQIVSVLTYGNVVAFILRDRCVFRLLNGDSVIGEVSFLDSLLCLDQGSAQMYAIGGIFLESDYVGNICNANEYGNSITVQFAVWNNVGYAVIYNVLYQNDVFKCELHSDIPGTHYQPDMRLSVFFLQVNQHLVCVKSVCLNHEEPLLWRPLATIWSLHDFDDEPGRLYRQCRRISDGISFIDWFDNSSQLKGLDGLETMPTFGVSPSSDDVDNTHVDSMSNYYAYKGKVVSSSMIISENLFTPYAVVYGFLSGEIEVVRFDLFQGISLDNASSNPDEKSTACKQCFSGHTGAVLCLAAHQKMGSAKSWNFKRVLVSGSMDCTIRIWDLDTGSLIMVMHHHVAPVRQIILPPSLTVHPWSDCFLSVGEDACVALVSLETLRVERMFPGHMNYPSKVLWDGARGYISCLCQTHYGTSDATDILCIWDVKTGSRERVLRGTAAHSMFDHFCKSISMNSISGTLLNGNTSVSSLLLPIVDDARLSNSPLNRSDNLLTSTRSSPNIPNMTELNSSKTNAGKGNPVKPNSSSLIGLLSSKLPIKCSSPFPGIVSLCFDLASLMLSYPKNESMENGGGKPVNINMKQQGVQEQNPSYHNPETVEGHDLVSLFEEYLLRYSLSFLHLWSVDRELDNLLISEMKLRRPENFIVASGLQGDKGSLTLTFPAQSATLELLVAFWQDESEHVRMAARSIFHCAASHCIPLPLCNSKPTESNNMSSQTGSRDKHLGNMTEESISPKEEKQGISQDEESKILAWLESFEVQDWNSCVGGTSQDAMTSHIIVAGALAIWYPSLVKPSLAMLVVHPLMKLAMAMNEKYSSTAAELLAEGMESTWKECIVSEIPRLIGDIFFQVELSGPSLVKEISDASFSIKKTLVEVLLPSLAMADIPGFLTVIESQIWSTASDSPVHMVSLLTLIRIMRGSPKNLAQYLDKVVNFILQTIDPSNSVMRKTCFQSSMTTLKEVVRVYPMVAVTDSWTKLAVGDVIGEINNAGIRVYDMQRFLSIGIRAFHHVSWLQMSGVGGDAEIAVFAWDYVTMVKVLDASGPPGLPTLLPAATSGTMLTTAISALSFSPDGEKLSRNFVPVQCTKLIFVPPWEGFSPNSSRSSIMANILETDRQMNFQDNVRDSNHGDSPKHALHSLDLSYRLEWVEGRKASTSADSLKFLLGIFIDSIILVEAIMKELSSIYSSQPNLATEDFLLADTSILFEELDGTGSQLDGLSATSDVWMKYWEKEE

SEQ ID NO: 189041 - protein, 58 aa, Glycine max
  Coding DNA Sequence Number=SeqID_72263
MQDLYILNWSLWIRKQGIVAAAATGTAKCYTYLILLHLEAKCDDLVLLQHLIMASNLI

SEQ ID NO: 189042 - protein, 177 aa, Glycine max
  Coding DNA Sequence Number=SeqID_72264
MGGGDDVDSDSNGGDNYRSGDDNDGNSGSSIDDDNGGMTKCGIVSSGSDNDGDNDIDIDGGGSSVIIIMVVTSSGGGCHDSDGGDDKDNNTDSNANGDINDGDIDDCDGGNNNNNSDVNDNSDDCINGGGGNVRLTIYLVEFVHILGKDNFIAKFGPNSALVFTELEVPLAISVAAY

SEQ ID NO: 189043 - protein, 409 aa, Glycine max
  Coding DNA Sequence Number=SeqID_72265
  Homolog annotation: Hit_ID=Q1WK56; Match level="QueryCoverage=86%, HitCoverage=93%, E-value=1e-68, Identity=50%"; Hit description=CYC3
  Pfam annotation: Domain name=TCP; Domain location=91-320; Score =123.1; E_value=8.1e-34; Accession=PF03634.4; Description=TCP family transcription factor
MSSSTYDSSNLFPNFPSSSYPILPFLIDPENDFASHTLLDDHPLVVPAGLIHDPPLLPEETVANFAVAADCTAAMLEHDAANTNYGSHYGSSVSNFLTQKPAAATAKKDRHSKIHTSQGLRDRRVRLSSEIARKFFDLQDMLEFDKPSNTFDWLFTKSENAIKELARSKHSGSVSRGDIKYSRYPSVDSNNNNKSLVDGGDASRGRKLKWAQRDDVCVQNKKESRERARARARERTCYKMCSCSRRVQQKDSDERFPATTNTQMLHQLRSSIQPELEDQPRARWVQPYYNNPYFIDNEAPRNGFNVIEESIMIKRNMKPSSHQNLVIPRDASFNNNEFPLLPYSSTTPNWDSTNGAVNFGGISTMNLSTCFMNPCDFCVQICRASFKIFGKFLGRVHQSESTLKCSSFR

SEQ ID NO: 189044 - protein, 360 aa, Glycine max
  Coding DNA Sequence Number=SeqID_72266
  Gene Ontology: Mol. function=phosphoprotein phosphatase activity; Cellular component=nucleus; Biological process=carbohydrate metabolic process
  Homolog annotation: Hit_ID=P48488; Match level="QueryCoverage=87%, HitCoverage=98%, E-value=1e-169, Identity=88%"; Hit description =Serine/threonine-protein phosphatase PP1
  Pfam annotation: Domain name=Metallophos; Domain location=54-249; Score=156.3; E_value=8.2e-44; Accession=PF00149.18; Description =Calcineurin-like phosphoesterase
MDENLLDDIIRRLVAAKNGRTTKQVQLTEAEIRQLCVSSKEIFLSQPNLLELEAPIKICGDVHGQYSDLLRLFEYGGYPPEANYLFLGDYVDRGKQSIETICLLLAYKIKYKENFFLLRGNHECASINRIYGFYDECKRRFNVRLWKTFTDCFNCLPVAALIDEKILCMHGGLSPDLKHLDQIRSIARPIDVPDHGLLCDLLWADPDKDLDGWGENDRGVSFTFGADTVVEFLEHHDLDLICRAHQVVEDGYEFFAKRQLVTIFSAPNYCGEFDNAGAMMSVDDTLTCSFQILKSSEKKGKGGFGINTSRPGTPPHKIFKPPGALPISTVHNYLRLLNQISNFLAWLRSFGHEPIVGSNL

SEQ ID NO: 189045 - protein, 652 aa, Glycine max
  Coding DNA Sequence Number=SeqID_72267
MDAVELPLPLDVAATPKLMGSEDVASIKTVPEFPSCNKFVETQLSKNSSLLPHLEGEEVSKNTPSGNGRNFSVINSRLEGVPLQRKAAKSNRSNSSCSKRPRMSQPEDSLSPNGIEESKDISDKLGLHNLNCTSPEKNQLPKQKSNSSKRGDKRNFKVPSVKAKFESSSMKMGASIFSFTSGGNNFFGLYGLKHDFHDVTKLMEEPPLEELLRGTFDFPILSKDKGKKTSSMSDSFLNSVRKACSILQHPKPIRSQNMAEMDYSSNMKMSTCQLSSVCAIESVGNGDKEQSCTLDMSSCQKDHCSEVESTTSPLDFPLHQPKDVLERIALHPFQDLESLLLDVSKPAVTTKNGNDQRSGKQVSRRPSLPTFPWSHAFGHSRTNSDAGKLSTSRSMCQGKWSRIGVIASSTDADRSSFSNLDSFSYDQSLVPSSGSSDKRNFSSLFANLPFHQLDSSSSVPCSEISQAKAEFGGQVDTKENDERCPIILTAAQTLCEIATHLMRQSSDGILKWQRKTSLKAMKSCHYKSDEKLEETSSRPISMIGSDMVARSVEQIMPSKKPRLSIVENKNSGHSNIAKKGHIVWPISKSSRSFPSKQIRDSFVENKRTNASILKQHYMMPPPARDLDKAHDGQKQVGKVVAMDWKRGRDNTD

SEQ ID NO: 189046 - protein, 131 aa, Glycine max
  Coding DNA Sequence Number=SeqID_72268
MNAFSIFDIGASVFERVNWNWNWNWNWKMLEAMESLVNVGFTHLQSCGDSSEEESSVLPRHTKVVVTGNNNTKSVLVGLEGVVKKVDGLDAGSYKWVIEHRPVMRKMMTLNFKICRGMDQIWILSVCLKDV

SEQ ID NO: 189047 - protein, 288 aa, Glycine max
  Coding DNA Sequence Number=SeqID_72269
  Gene Ontology: Mol. function=sequence-specific DNA binding; Cellular component=nucleus; Biological process=regulation of transcription, DNA-dependent
  Homolog annotation: Hit_ID=Q9SUS1; Match level="QueryCoverage=77%, HitCoverage=75%, E-value=1e-27, Identity=38%"; Hit description =Probable WRKY transcription factor 29
  Pfam annotation: Domain name=WRKY; Domain location=135-195; Score =137.1; E_value=4.9e-38; Accession=PF03106.6; Description=WRKY DNA -binding domain
MDEFACLRDWDLEAIVRGNTGEATTMDDPNPDFSYFFSEQDELLDSFPEFSETTRVLDDLEDLYKPFYPVFHPLSPHTIVTTSPPIPIEPEQVIKASEEKVALQGLKVTAAPKCKKSKKSQNKSVVKQVTTAEGLDDAWAWRKYGQKPIKGSPYPRSYYRCSSSKGCLARKQVERSHLDPAVFLVTYTAEHSHPHPTRRNSLAGTTRKNNSLVPPPTTTRHQKKTTCSSSVQQSMDLKKEEDFLDWLEDDSAQFGDGWIPSSDLEKLIGLECQHFALDTGFTDDFPHP

SEQ ID NO: 189048 - protein, 53 aa, Glycine max
  Coding DNA Sequence Number=SeqID_72270
MPRNYWPLTRTIRQNGKNKLDPSFFVLALSPKMTCLNSTLQLPSRKRLELALA

SEQ ID NO: 189049 - protein, 47 aa, Glycine max
  Coding DNA Sequence Number=SeqID_72271
VIKLIKSILSLVTCGFSSLDFLVPDLDLDLVARVIEREWYAGKKNTF

SEQ ID NO: 189050 - protein, 152 aa, Glycine max
  Coding DNA Sequence Number=SeqID_72272
  Gene Ontology: Mol. function=nucleic acid binding; Cellular component= intracellular
  Homolog annotation: Hit_ID=Q10SE5; Match level="QueryCoverage=91%, HitCoverage=37%, E-value=7e-36, Identity=55%"; Hit description =D111/G-patch domain-containing protein, putative, expressed
  Pfam annotation: Domain name=G-patch; Domain location=15-59; Score =59.1; E_value=1.5e-14; Accession=PF01585.13; Description=G-patch domain
MAAPETPLCYVGVARQSAAFRLMKQMGWEEGEGLGKEKQGIKGHVRVKSKHDTIGIGLEKPNNWAFDTTQFDNILKRLKVQAPQSHDTDIEEKVETKPSVPVGNEHSVSKTTRPQGRYTRRERGKLVSQYSLKDLEGILVSSAPGYAIHCTS

SEQ ID NO: 189051 - protein, 177 aa, Glycine max
  Coding DNA Sequence Number=SeqID_72273
  Homolog annotation: Hit_ID=Q1S6B2; Match level="QueryCoverage=71%, HitCoverage=26%, E-value=1e-11, Identity=34%"; Hit description =Nodulin-like; Major facilitator superfamily MFS_1
MKHKELIPLVAASDGEEVKYYSVFNVTVALFLLAYGFIPGPSMLVSRVLVAVLLVMLMYSYLKNWFEQGNDVERQKENETVLAAEKAEAKIVKRTPVVGDVEHTKMEALRSMDFWTLFVSFLCGVGTNLVVVNNMVQGTFNLEEKMLLDLFNDDLSRCMMAVVSEQIMVLRGKKNIF

SEQ ID NO: 189052 - protein, 423 aa, Glycine max
  Coding DNA Sequence Number=SeqID_72274
  Gene Ontology: Mol. function=monodehydroascorbate reductase (NADH) activity; Cellular component=chloroplast; Biological process =electron transport
  Homolog annotation: Hit_ID=P92947; Match level="QueryCoverage=91%, HitCoverage=84%, E-value=1e-156, Identity=67%"; Hit description =Monodehydroascorbate reductase, chloroplast precursor
  Pfam annotation: Domain name=Pyr_redox; Domain location=184-286; Score=32.8; E_value=1.2e-06; Accession=PF00070.17; Description =Pyridine nucleotide-disulphide oxidor
  Pfam annotation: Domain name=Pyr_redox_2; Domain location=26-293; Score=98.4; E_value=2.1e-26; Accession=PF07992.4; Description =Pyridine nucleotide-disulphide oxidor
  Pfam module annotation: Pfam domain module=Pyr_redox::Pyr_redox_2; Domain location=184-286::26-293
MAAISNSLSLKHSFSLLLPLPSNSQDVRDAARTFVEHGMADGRLCIVTKEPYAPYERPALTRAYLFPPDKKPARLPVCIKGQHRTTEGFHTCVGSGGERQTPEWYKENVIEMLYEDPVKDIDIEKHTLTTSSGKLLKYGSLIIATGCTASRFPEKIGGNLPGVHYIRHVADADTLILSLEKAKKVVVVRGGYIGMEVAAAAVGWKLDATIIFPEDDLLQRLFTPSLARRYEELYQKNGVKVLKVIIGIGARPAVSPFERVGQNTDVGGIQVDGQFRTSTPGIFAVGDVAAFPLKIYNRISRVEHVDHARRSAQHCMTIFHTSIQGFLNMKEALEKCGGSSLETRAIGETVEIGNFDPKIATFWIESGKLKGVLLESGSPEEFQLLPKLARSQPLIDKAKLQNATSVEEALEIARGSLQGEAVV

SEQ ID NO: 189053 - protein, 359 aa, Glycine max
  Coding DNA Sequence Number=SeqID_72275
  Pfam annotation: Domain name=DUF793; Domain location=1-348; Score =578.8; E_value=5.2e-171; Accession=PF05633.2; Description=Protein of unknown function (DUF793)
MPATTENNQGSFLGRISIRRNQVMSMDGSHDQEVEDLELFQKHVGDRFSELLSSTNTSSGDALLSIAWLRRILDEFLCCEAEFKAVVLMGRDPSQIAKPPLDKVLPELLDRVVKSLDVCNAVTLGLDAVKNLQRLAEIAVAALDQTPLGDGQVRRAKKALSALVAAMLHDDSNAAAKGTERTRSFGRRAGNNTNSGKYKSLSWSMAKNWSAAKQIHAMISNLAAPRGAESSGLAQPIYMMSSVLVLVMWTLVAAEKIAEEWKKKEKKGNVGLLEEMQRMDKLGQSLVEFADSFQFPAEAERLDEVKKHVEELGDICKKMDEGLEPLQQQIREVFHRLVRSRTEFLLVLDQAGMLSTPAL

SEQ ID NO: 189054 - protein, 127 aa, Glycine max
  Coding DNA Sequence Number=SeqID_72276
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNKAIRERVGVAPIVEKMVENRLRWFGHVERRPVDSVVRRVDQMERRQTIRGRGRPKKTIREVIKKDLEINGLDRSMLSCLECCINNMKVTSSNLTWVIKFVREVNTVRRE

SEQ ID NO: 189055 - protein, 500 aa, Glycine max
  Coding DNA Sequence Number=SeqID_72277
  Gene Ontology: Mol. function=inositol or phosphatidylinositol phosphatase activity; Cellular component=intracellular; Biological process=abscisic acid mediated signaling
  Homolog annotation: Hit_ID=Q9LR47; Match level="QueryCoverage=99%, HitCoverage=88%, E-value=0.0, Identity=71%"; Hit description=Type I inositol-1,4,5-trisphosphate 5-phosphatase CVP2
  Pfam annotation: Domain name=Exo_endo_phos; Domain location=16-460; Score=151.6; E_value=2.1e-42; Accession=PF03372.13; Description =EndonucleaseExonucleasephosphatase family
MNLDHPRIIDVQNYSIFVATWNVAGRSPPSTLNLDDWLHSSPPADIYVLGFQEIVPLNAGNILGAEDNGPAKKWLALIRKTLNNLPGTSGSSGCYTPSPIPQPVVELNADFEGSARQKNSSFFHRRSFQTTSSGWGMDNDPSVVQPRLDRRYSVCDRVIFGHRPSDFDPSFRWGYRPSDYSRASDYSRWGSSDDDNGLGDSPSTVLFSPMSCGGAGPAFNEDGYAIPGHSRYCLVASKQMVGIYLTIWVRSELKDQVQNMKVSCVGRGLMGYLGNKGSISISMSVHETSFCFICSHLTSGQKEGDELRRNSDVMEILKKTRFPRVQGVDNENSPQTILEHDRIIWLGDLNYRIALSYRSAKALVEMQNWRALLENDQLRIEQKRGRAFVGWNEGKIYFPPTYKYSTNSDRYAGDDMHPKEKRRTPAWCDRILWYGEGLHQLSYVRGESKFSDHRPVYGIFCAEVESTHGRLKKTMSCSRSRIEVEELLPYSGGYTELSFF

SEQ ID NO: 189056 - protein, 299 aa, Glycine max
  Coding DNA Sequence Number=SeqID_72278
  Gene Ontology: Mol. function=DNA binding; Cellular component=nucleus; Biological process=regulation of transcription, DNA-dependent
  Homolog annotation: Hit_ID=Q43524; Match level="QueryCoverage=99%, HitCoverage=93%, E-value=3e-67, Identity=51%"; Hit description =Transcription factor
  Pfam annotation: Domain name=Myb_DNA-binding; Domain location=46-91; Score=50.5; E_value=5.7e-12; Accession=PF00249.21; Description=Myb -like DNA-binding domain
MTNSSDTLLLMDMSSWREVPEKAGLLRCGKSCRLRWINYLRPDIRRGRFTPEEEKLIITLHGVVGNRWAHIASHLPGRTDNEIKNYWNSWIKKKIRKTSVSSTTIAQSIDHNSSHQFNYNSNLVLDHFPNQDNNLQTKPPVQEALFSSTCPLFIFDTTDSLEPGTATDCKSSTVRAEHFHQDAVGLSSETWNSSHHQVHALPPLTVSVGLDTSNYLPPLIEHVDNMVPIEVQSCTIDEQGDIALECLQRQGLNEWVETQQQCPNFLFWDSVEGQLGGEELAPNSSNVEANTLSPFPCSL

SEQ ID NO: 189057 - protein, 67 aa, Glycine max
  Coding DNA Sequence Number=SeqID_72279
  Subcellular localization annotation: CTP_CleavageSite=41; ConfidenceScore=5.64e-01
MVCVCYSWFLPSFSSSNSLPSFASFLSFTIVSSVMSLATVLLMTVEEEMKLAEDDKGTARGETRVEP

SEQ ID NO: 189058 - protein, 128 aa, Glycine max
  Coding DNA Sequence Number=SeqID_72280
MKLDRFKCRCCYWWRDFNLLARLQFALLEGSPIPKALVICFTRNVTGPRSEYPPIVPKPTPFSHQSNKAIPWKYTLPAFGEGAATEVDSLSAKVTNITGLSGVTRSGQVFAPPHSAELPSKGKVPMTQ

SEQ ID NO: 189059 - protein, 99 aa, Glycine max
  Coding DNA Sequence Number=SeqID_72281
MKLASTKGSKCISKILGALKVTKIDNCDVSACYQTRLSQDSRGNFSSLDRQTLSLLTRETNDYVFLCMLSDSLTRLSLEGKGVDNHGVSLRVIGLAVSG

SEQ ID NO: 189060 - protein, 75 aa, Glycine max
  Coding DNA Sequence Number=SeqID_72282
MGYWVGNSILLLGEEGPHGHGTLSEHVCITFHCQSHLMQEAIREMQEVIILLLLFHKSEASLELKIVDDMLLGLA

SEQ ID NO: 189061 - protein, 397 aa, Glycine max
  Coding DNA Sequence Number=SeqID_72283
  Gene Ontology: Mol. function=protein serine/threonine kinase activity; Cellular component=nucleus; Biological process=protein amino acid phosphorylation
  Homolog annotation: Hit_ID=Q84XZ6; Match level="QueryCoverage=94%, HitCoverage=95%, E-value=0.0, Identity=82%"; Hit description=Mitogen- activated protein kinase 4
  Pfam annotation: Domain name=Pkinase; Domain location=47-349; Score =293.9; E_value=3e-85; Accession=PF00069.15; Description=Protein kinase domain
  Pfam annotation: Domain name=Pkinase_Tyr; Domain location=47-335; Score=2.9; E_value=1.2e-12; Accession=PF07714.7; Description=Protein tyrosine kinase
  Pfam module annotation: Pfam domain module=Pkinase::Pkinase_Tyr; Domain location=47-349::47-335
MTTKGSSSSAASSASGDAKIKRVLTHGGKYAHYNVYGNLFEVSSKYVPPIRPIGRGVNGIVCAAFNSETHEQVAIKKIGNAFDNIIDAKRTLREIKLLRHMDHGNIIAIKDIIRPPKKETFNDVYIVYELMDTDLHHIIHSDQPLSEEHCQKLVQYFLYQLLRGLKYVHSANVLHRDLKPSNLLMNANCDLKIGDFGLARTTSETDFMTEYVVTRWYRAPELLLNCSEYTSAIDVWSVGCILGEIMTREPLFPGKDYVHQLRLITELLGSPDDASLEFLRSDNARRYIRQLPQYRKQKFSARFPNMLPEALDLLEKMLIFDPNKRITGMHPCRILSFNAVDEALCHPYLSSLHNINDEPVCPRPFSFDFDQPTCAEEHVKELIWKESVKFNPDPPCQ

SEQ ID NO: 189062 - protein, 100 aa, Glycine max
  Coding DNA Sequence Number=SeqID_72284
MKHDKLLCWDYEIVIEIVWRQVNARRVLGWDPLWEPDELNYFEASNEVFHRHAPLELVSLGSSSSMDSFASWKNGSGMEKEEREETPLQGEDESIRSSPP

SEQ ID NO: 189063 - protein, 758 aa, Glycine max
  Coding DNA Sequence Number=SeqID_72285
  Gene Ontology: Mol. function=sequence-specific DNA binding; Cellular component=nucleus; Biological process=regulation of transcription, DNA-dependent
  Homolog annotation: Hit_ID=Q1S1R1; Match level="QueryCoverage=95%, HitCoverage=91%, E-value=0.0, Identity=77%"; Hit description=START domain, putative
  Pfam annotation: Domain name=Homeobox; Domain location=119-175; Score= 86.2; E_value=1e-22; Accession=PF00046.19; Description=Homeobox domain
  Pfam annotation: Domain name=START; Domain location=336-560; Score =292.9; E_value=6e-85; Accession=PF01852.10; Description=START domain
  Pfam module annotation: Pfam domain module=Homeobox::START; Domain location=119-175::336-560
  Subcellular localization annotation: CTP_CleavageSite=50; ConfidenceScore=5.30e-01
MSFGGFLETKQSGGGGGRIVADIPYSNNSNNIMPSSAISQPRLATPTLVKSMFNSPGLSLALQSDIDGKRDVNRLMPENFEQNGLRRNREEEHESRSGSDNMDGGSGDDFDAADNPPRKKRYHRHTPQQIQELESLFKECPHPDEKQRLELSRRLNLETRQVKFWFQNRRTQMKTQLERHENSLLRQENDKLRAENMSMREAMRNPICTNCGGPAMIGEISLEEQHLRIENARLKDELDRVCALAGKFLGRPISSLTGSIGPPLPNSSLELGVGSNGFGGLSTVPSTMPDFGVGISSPLAMVSPSSTRPTTTATTTLVTPPSGFDNRSIERSIVLELALAAMDELVKMAQTDEPLWIRSLEGGREILNHDEYTRTITPCIGLRPNGFVTEASRQTGMVIINSLALVETLMDSNRWSEMFPCMIARTSTAEVISNGINGTRNGALQLMHAELQVLSPLVPVREVNFLRFCKQHAEGLWAVVDVSIDTIRDTSGAPTFVNCRRLPSGCVVQDMPNGYSKVTWVEHAEYDESQIHQLYRPLLSSGMGFGAQRWVATLQRQCECLAILISSAVPSREHSAISSGGRRSMLKLAQRMTNNFCAGVCASTVHKWNKLNAGNVGEDVRVMTRKSVDDPGEPPGIVLSAATSVWLPVSPQRLFDFLRDERLRSEWDILSNGGPMQEMAHIAKGQDHANCVSLLRASVCYKCEPEQHVDSARDVHRRVGVACGVRAGGHSGNARRDERRRLCLRGASSVGVRHRARR

SEQ ID NO: 189064 - protein, 137 aa, Glycine max
  Coding DNA Sequence Number=SeqID_72286
MDVRWMQFSDYIAPIGQICVVYGQCLPDYMKWFYMISHPLMTPAQPGDPPRVLPVQHYDTFVKPDVSQQLVVVAAPNEPDVDVHHPRHVVRLLNLRILIEGTKVYIVTEECLSIVRSYIGQPTRGHKSRHRRHMDDH

SEQ ID NO: 189065 - protein, 352 aa, Glycine max
  Coding DNA Sequence Number=SeqID_72287
  Gene Ontology: Mol. function=nucleic acid binding; Cellular component= nucleolus
  Homolog annotation: Hit_ID=UPI0000162ACD; Match level="QueryCoverage =52%, HitCoverage=47%, E-value=2e-24, Identity=45%"; Hit description =RNA binding / nucleic acid binding
  Pfam annotation: Domain name=RRM_1; Domain location=215-311; Score =28.6; E_value=2.2e-05; Accession=PF00076.12; Description=RNA recognition motif. (a.k.a. RRM, R
MQPRARVKLWVNGTPIASSNVCNKVSSDAIHPILVQSGSLIGGLSNNPKHNKSRTSRNGAEELDLEDQEDTCGKGVAHDKAQVNPEAEKVVSESCRLFVHNLPYTATTSEEELQQHVGKVHVVVNKSTKLSKGIAYILFSGPEIARRDAPLYLEWAPLYLEWAPSNILSQSSTFKKMKMNSGIGENDVKQLKLEQNVLRISYVDIGPDRVQARTLFVKNLNFNTTDESLRKHFSENMKEGAILSVKVKKHLKNGKNVSMGYGFVEIYRLPKKFGCHSHRGFAFVEYVTPKEAENALSTLQHTHILGWHLKIERTNVDPSLDEQRAQTAAQFSRHMNFKMLLCYPRKERTSVS

SEQ ID NO: 189066 - protein, 76 aa, Glycine max
  Coding DNA Sequence Number=SeqID_72288
  Subcellular localization annotation: CTP_CleavageSite=33; ConfidenceScore=5.13e-01
MAWHPFDAIEKISLTPPSQKGKGNSPKLHSGVRGMGIRASRESWLQLESFLCRASTSLHQQCELLCQLLQEHPLPP

SEQ ID NO: 189067 - protein, 113 aa, Glycine max
  Coding DNA Sequence Number=SeqID_72289
  Gene Ontology: Mol. function=structural constituent of ribosome; Cellular component=ribonucleoprotein complex; Biological process =translation
  Homolog annotation: Hit_ID=Q5QM99; Match level="QueryCoverage=89%, HitCoverage=98%, E-value=3e-42, Identity=84%"; Hit description=60S ribosomal protein L37a
  Pfam annotation: Domain name=Ribosomal_L37ae; Domain location=12-112; Score=195.1; E_value=1.7e-55; Accession=PF01780.9; Description =Ribosomal L37ae protein family
MVLSLSLSISDTKRTKKAGIVGKYGTRYGASLRKQIKKMEVSQHSKFFCEFCGKYAVKRKAVGIWGCKDCGKVKAGGAYTLKYDLFVHFLLDSTASAVTVRSTIRRLREQTES

SEQ ID NO: 189068 - protein, 221 aa, Glycine max
  Coding DNA Sequence Number=SeqID_72290
  Gene Ontology: Mol. function=methyltransferase activity; Cellular component=cellulose and pectin-containing cell wall; Biological process=metabolic process
  Homolog annotation: Hit_ID=Q6EQ17; Match level="QueryCoverage=96%, HitCoverage=36%, E-value=2e-62, Identity=50%"; Hit description =Dehydration-responsive protein-like
  Pfam annotation: Domain name=DUF248; Domain location=1-221; Score =80.5; E_value=1.2e-30; Accession=PF03141.7; Description=Putative methyltransferase
  Pfam annotation: Domain name=Methyltransf_11; Domain location=58-153; Score=28.8; E_value=1.9e-05; Accession=PF08241.2; Description =Methyltransferase domain
  Pfam module annotation: Pfam domain module=DUF248::Methyltransf_11; Domain location=1-221::58-153
MPYNKIADRKGHQGWMKLEGQHFIFPGGGTMFPDGAEQYIEKLGQYIPISEGVLRTALDMGCGVASFGGYMLSKNILTMSFAPRDSHKAQIQFALERGVPAFVAMLGTRRQPFPAFGFDLVHCSRCLIPFTAYNASYFIEVDRLLRPGGYFVISGPPVQWPKQDKEWSDLQAVARALCYELIAVDGNTVIWKKPAGESCLPNENEFGLELCDDSDDPSQAW

SEQ ID NO: 189069 - protein, 73 aa, Glycine max
  Coding DNA Sequence Number=SeqID_72291
MACDGGDQTFFAFGGNGTQKRFMVQNEEEDPCAICINAFNSGDNAARRVCALCAVSLVVIASFDTVMISIYVL

SEQ ID NO: 189070 - protein, 384 aa, Glycine max
  Coding DNA Sequence Number=SeqID_72292
  Gene Ontology: Mol. function=methyltransferase activity; Cellular component=cellulose and pectin-containing cell wall; Biological process=metabolic process
  Homolog annotation: Hit_ID=Q1S1Q1; Match level="QueryCoverage=98%, HitCoverage=61%, E-value=0.0, Identity=76%"; Hit description=Generic methyltransferase
  Pfam annotation: Domain name=DUF248; Domain location=92-384; Score =388.5; E_value=1e-113; Accession=PF03141.7; Description=Putative methyltransferase
  Pfam annotation: Domain name=Methyltransf_11; Domain location=209 -304; Score=28.3; E_value=2.7e-05; Accession=PF08241.2; Description =Methyltransferase domain
  Pfam module annotation: Pfam domain module=DUF248::Methyltransf_11; Domain location=92-384::209-304
MAIQNCFSKKPNHQLTRLYLLSFTTFLCTITYLLGLWHHAPPSLPSLVSTTAHSNCPNSIPTLNFSATHFSPDPQAPARDFYAPPCDPSLSEYTPCEDVQRSLKFPRENLIYRERHCPPAEELLRCRVPAPFGYRVPLRWPESRDAAWFANVPHKELTVEKKNQNWVRFEGDQFRFPGGGTMFPRGAGAYIDDIGKLINLEDGSIRTALDTGCGVASWGAYLLSRDIIAVSFAPRDTHEAQVQFALERGVPGLIGVLASIRLPYPSRSFDMAHCSRCLIPWGQNEGIYLNEVDRVLRPGGYWILSGPPINWENHWKGWERTRENLKEEQDGIEKVAKSLCWKKLVQKGDLAIWQKPTNHIHCKITRKVYKNRPFCEAKDPDTAW

SEQ ID NO: 189071 - protein, 54 aa, Glycine max
  Coding DNA Sequence Number=SeqID_72293
MKEKEEEAMTELQRSFAAFSENCTWRMESIMQYSLLYSHNDSSERWEFFFPYGN

SEQ ID NO: 189072 - protein, 263 aa, Glycine max
  Coding DNA Sequence Number=SeqID_72294
  Gene Ontology: Mol. function=nucleoside-triphosphatase activity; Cellular component=nucleus; Biological process=cobalt ion transport
  Homolog annotation: Hit_ID=Q9SEI4; Match level="QueryCoverage=33%, HitCoverage=21%, E-value=2e-35, Identity=82%"; Hit description=26S protease regulatory subunit 6B homolog
MGKKRKHSEGNDAGRKFLLDGEVTIDTMADDMEFTENAVNGLMGKQIIRKNGRIKFLVDILLGLKFSMSGNFVDQPLCRQIVENLWIIKGIDLEYVNKEVGGSSALEKDIKAQGHASITSREYIGHSIGTFDKCTKTGGPFGTIKHPAELAHSANNGLDISDIGGCDIQKQDIHEAVELPPTHHELYKQIGIDPPHGVLLYGPPGTGKTMLAKAVVNHTTAAFIRVVGSEFVQKYVGEFRKHKLAWGFGWCERAIHSVTVDGA

SEQ ID NO: 189073 - protein, 48 aa, Glycine max
  Coding DNA Sequence Number=SeqID_72295
MEIFLLVTAIRFHLKMVIQSDPNPHIYFVRTFIIRKREAKFLAWPHRE

SEQ ID NO: 189074 - protein, 63 aa, Glycine max
  Coding DNA Sequence Number=SeqID_72296
MVKISARWFLVVMVEKEEEFGLKLLTNNVKINVNVFGKLMEGRIGCGVGDRSQYAIFNFSGGP

SEQ ID NO: 189075 - protein, 251 aa, Glycine max
  Coding DNA Sequence Number=SeqID_72297
  Gene Ontology: Mol. function=protein binding; Cellular component =nucleus; Biological process=regulation of transcription, DNA -dependent
  Homolog annotation: Hit_ID=Q8LKR2; Match level="QueryCoverage=78%, HitCoverage=42%, E-value=6e-81, Identity=72%"; Hit description=Actin- related protein 4
  Pfam annotation: Domain name=Actin; Domain location=1-247; Score= -35.9; E_value=2.2e-12; Accession=PF00022.9; Description=Actin
MGLSVCSYFLLCLQLKAVATSPIGGEFLTDCLMKSLESKGITIKPRYSFRRKEIRPGEFQTVDLEFPNTTESYKLYCQRVIASDIKECVCRAPDTPYDESAYSNIPMTSYELPDGQTIEIGADRFKIPDVLFNPSLVQSIPGTESFAEIAPSVRGLPQMVIESINKCDVDIRRELFSSILVMKHFISMHHFLLAGGTASMQQLKERLEKDLLEQCYRVFLNPMTPNFHYLILEGWEFGRLSVRIYSKDLCI

SEQ ID NO: 189076 - protein, 53 aa, Glycine max
  Coding DNA Sequence Number=SeqID_72298
MEQRKKYHFTLPLPRCRGAEVVNKKSAQWLSRGEVKAGLMLSDGALFVGTHGF

SEQ ID NO: 189077 - protein, 182 aa, Glycine max
  Coding DNA Sequence Number=SeqID_72299
  Homolog annotation: Hit_ID=Q9SIA8; Match level="QueryCoverage=56%, HitCoverage=23%, E-value=3e-14, Identity=41%"; Hit description =Putative disease resistance response protein
  Pfam annotation: Domain name=Dirigent; Domain location=30-178; Score =30.5; E_value=1.3e-08; Accession=PF03018.5; Description=Dirigent -like protein
  Subcellular localization annotation: CTP_CleavageSite=81; ConfidenceScore=5.45e-01
DTFNNGSAQYSEKPATTKVTGQLPFPKPLGFLPPKGGIPIPQSTPTTIPLTSSSTQTLDLSSIGFSFPTRATLQELEYGSVASIDEELLIDDGDELHKLGKAQGVCVASSEDGSSHMVAITANFLKGEFEDGLRLFGMHKTDVFESHVAVIGGTGKYYGANGYAAVKVVDKVGSSEKEGKVT

SEQ ID NO: 189078 - protein, 71 aa, Glycine max
  Coding DNA Sequence Number=SeqID_72300
MYEFSLLVRTSSTKPQFHEDIDNSNYDHDGGNDDNNNYANDIGDDNNRNVNRNSDINFHSDELIEMFRNDN

SEQ ID NO: 189079 - protein, 275 aa, Glycine max
  Coding DNA Sequence Number=SeqID_72301
  Gene Ontology: Mol. function=zinc ion binding
  Homolog annotation: Hit_ID=Q2R1H8; Match level="QueryCoverage=92%, HitCoverage=81%, E-value=1e-105, Identity=70%"; Hit description=Zinc finger, C3HC4 type family protein, expressed
  Pfam annotation: Domain name=zf-C3HC4; Domain location=23-85; Score =21.2; E_value=0.001; Accession=PF00097.15; Description=Zinc finger, C3HC4 type (RING finger)
MADHSDSSPLVPPLPLTDPSEIDLEAVPPNKSSAEFVSKLTFSFSGRDFIAPCKCKGTSKYVHRECLDHWRAIKEGFAFAHCTTCKAPYHLRVHVAADRKWRTLKFRFFVTRDMLFIFLSVQLVIASLSYLVYLIDGYQQYWLRLLWGFDSEMSFYYICGALLFFALLGLSGCFITCYDRRVRNDLAQPCRELCLCCCQPGVCADCHLPGTLCMWTDCTTCFESCGTMATECGGCLGGAGEAGLPLLFIMALIVLGLFTVNGYGNVIITYLQKGC

SEQ ID NO: 189080 - protein, 61 aa, Glycine max
  Coding DNA Sequence Number=SeqID_72302
MGKHGLSFASLEAKLSKSLGASWEGYNNHPTPLDRSIEKVVKHIIVLSPVGTILTRTYCEM

SEQ ID NO: 189081 - protein, 105 aa, Glycine max
  Coding DNA Sequence Number=SeqID_72303
  Homolog annotation: Hit_ID=Q9FJP5; Match level="QueryCoverage=49%, HitCoverage=15%, E-value=5e-13, Identity=66%"; Hit description =Similarity to dehydrogenase
  Subcellular localization annotation: CTP_CleavageSite=74; ConfidenceScore=5.09e-01
AMRMIRLVVPHMATWKQGKILNIGGVSALASGLWSGTYNASKAALHAFTDTLRGFSSSSSSSSNLPYKVDEMLRLGMKTEHVGEGLALLVLAKDRAKSIFIPIEF

SEQ ID NO: 189082 - protein, 249 aa, Glycine max
  Coding DNA Sequence Number=SeqID_72304
  Gene Ontology: Mol. function=structural constituent of ribosome; Cellular component=large ribosomal subunit; Biological process =translation
  Homolog annotation: Hit_ID=Q9C828; Match level="QueryCoverage=64%, HitCoverage=64%, E-value=9e-42, Identity=55%"; Hit description =Chloroplast 50S ribosomal protein L22, putative; 25606-24374
  Pfam annotation: Domain name=Ribosomal_L22; Domain location=74-194; Score=77.3; E_value=4.7e-20; Accession=PF00237.9; Description =Ribosomal protein L22pL17e
MEKAFAWTEGLNGINSSDSCMIKSDGISSSANLLANSSEETPVLSPLVPVSLLGSSKGEDQKQKVVTKQEKVQAVLKAIKQSPKKVNLVAALVRGMLVKDALMQLELTIKRAAKTVYQGKAKLNAFVLKPYTLQVIHSARANASHNHGLDPERLIVAEAFVGKGFYKKRLWPHAKGKSSLRVRPECRLTVVVREITAEEEAEIARLRVHNFKKRTKRQQRLVPHQLIVSNPIWGRKNKSSGKNLSATPA

SEQ ID NO: 189083 - protein, 147 aa, Glycine max
  Coding DNA Sequence Number=SeqID_72305
MSFQSFSEISSLTIDYKILFKISKCHLHGLSGFHDSKEKKSKTEFTTSYGSIATGSDSGSGSDSASGGYNIVQSSPLTTNWFNNHHNHNHRLKKTEKFLLQCRRRKIHTIHKASRVKQLEVIAATERPTTRVRLRVTVPTVVSVLRE

SEQ ID NO: 189084 - protein, 125 aa, Glycine max
  Coding DNA Sequence Number=SeqID_72306
  Gene Ontology: Mol. function=oxidoreductase activity; Biological process=metabolic process
  Homolog annotation: Hit_ID=Q9FJP5; Match level="QueryCoverage=85%, HitCoverage=31%, E-value=2e-34, Identity=62%"; Hit description =Similarity to dehydrogenase
MVAALASGPWSGTYTASKAALHALTDTLRPELGHFGIDVVNVVPGAIKSNIGDSAIASYNRMPEWKLFKPFEAAIRDRAYFSQKSKTTPTDEFALNTVAAVLREKPPAWALLYCHGYHVPFTNLC

SEQ ID NO: 189085 - protein, 188 aa, Glycine max
  Coding DNA Sequence Number=SeqID_72307
  Gene Ontology: Mol. function=metal ion binding; Cellular component =integral to membrane; Biological process=ubiquitin cycle
  Homolog annotation: Hit_ID=Q2QXP1; Match level="QueryCoverage=71%, HitCoverage=49%, E-value=7e-20, Identity=36%"; Hit description=Zinc finger, C3HC4 type family protein, expressed
  Pfam annotation: Domain name=zf-C3HC4; Domain location=90-126; Score =20.5; E_value=0.0012; Accession=PF00097.15; Description=Zinc finger, C3HC4 type (RING finger)
MLGSGTNLVTTVIGFGMSATFIVFVCTRIICGRLRGGVESRMMYEIESRIDLEQPEHHVNDPDSDPVLLDAIPTLKFNQEAFSSLEHTQLNYKEREVLRIMPKCGHTFHLSCIDIWLRKQSTCPVCRLPLKNSSETKHVRPVTFTMSQSLDESHTSERNDEIERHVEPTSTAASNSLQPTSGEQEARQ

SEQ ID NO: 189086 - protein, 166 aa, Glycine max
  Coding DNA Sequence Number=SeqID_72308
  Gene Ontology: Mol. function=RNA-directed DNA polymerase activity; Cellular component=intracellular; Biological process=RNA-dependent DNA replication
  Homolog annotation: Hit_ID=Q1T251; Match level="QueryCoverage=82%, HitCoverage=49%, E-value=8e-16, Identity=33%"; Hit description =Multicopper oxidase, copper-binding site
MMQWRRLFFDAEIDMAAKFMEDIEGLTIHPRRHDKWVWKGDPSPSGIYSVEMPYENQDRVFNDLWELQIPTKASFFAWRLIRNKLPTKTNLRRRNVEINGSMCPFCRNFEEDAAHLFFSCDRVMPLWWKSMSWINMVGAFPQTPRHRFLQHSFCRLSGIRMQRWQS

SEQ ID NO: 189087 - protein, 499 aa, Glycine max
  Coding DNA Sequence Number=SeqID_72309
  Gene Ontology: Mol. function=protein serine/threonine kinase activity
  Homolog annotation: Hit_ID=Q9FJP7; Match level="QueryCoverage=86%, HitCoverage=87%, E-value=2e-87, Identity=44%"; Hit description =Genomic DNA, chromosome 5, P1 clone:MQN23
  Pfam annotation: Domain name=DUF618; Domain location=1-66; Score =110.7; E_value=4.4e-30; Accession=PF04818.4; Description=Protein of unknown function, DUF618
MIQRIPLLYLANDILQNSKHKGNEFVTEFWKVLPAALKDVIKKGDDHGTRVVSRLIEIWEQRRVFGSRARNLKDLMLGEDAPPPLEFGKKRSRSVRIVKRDSHSIKSKLSIGGTAEKIVSAFHLVLSEQSVEDAEISKCKSSVQRVRKMEKDVDTACSVAKDPKRKTLAKELEEEENILKRCVEKLKLVEASRVALVSQLKEALHEQESELENVRTQMQVAQAQIEEACNMRRILDNEDFSQKVSVAKSAAAIAAEVADKLAASSSSQLIMTSVLSTFAAEEAKNAGLTSESTSKHEIPMTSSDPHMFRSPQQLIAAPNHSYPSVLVAQPPPLQNAAPSSQGQFHMLSNPPSQQFVQSTGGIITPYGYGSIPPLPPAPQLPTHVGAMVPLTHQTLQITPHQQIPITQQAPAPPTFRPLQPPGMVYYTNHQHSIHATLGRELANVGSKTITSLGRETLLPNILTELLIQSTDPNANGDLMNQALIPSPPKKAKNKSNRRT

SEQ ID NO: 189088 - protein, 399 aa, Glycine max
  Coding DNA Sequence Number=SeqID_72310
  Gene Ontology: Mol. function=protein binding; Cellular component =nucleus; Biological process=defense response
  Homolog annotation: Hit_ID=Q1RZ67; Match level="QueryCoverage=90%, HitCoverage=88%, E-value=5e-66, Identity=36%"; Hit description=Helix- turn-helix, AraC type
  Pfam annotation: Domain name=DUF827; Domain location=123-347; Score= -111.0; E_value=0.036; Accession=PF05701.2; Description=Plant protein of unknown function (DUF827)
  Pfam annotation: Domain name=Tropomyosin; Domain location=158-332; Score=-115.1; E_value=0.048; Accession=PF00261.10; Description =Tropomyosin
  Pfam module annotation: Pfam domain module=DUF827::Tropomyosin; Domain location=123-347::158-332
MQWHDSAVPIKMKSMVKIERMKKMSMKTGEKWLRVNLLAAEETDVKTQEDNWEAEKAPEVDQPSNSFLLLLNGIGVFSSGVLGALYKLAQKEKSTVVATIETVLREKEEELHQLKDQFELALGEASKSQIVIADLSQERDDLKEALDNESSKVNHLKHELQVTQENLAKSRNESAELENLLTLSNKLCKELELEVSKLSSELTEEHLREAQAELQDLRALEQQVSKDKESRKSLEGDLEEATKSLDEMNRNAVILSGELQRANSLVSSLEKEKDVLIKFLNDQRNACKEAQDNIEDAHNLIMKLGKERENLEKKGKKFEEELASAKGEILCLKSRINSSKVAVNNDQVQKDGVQKDGGEKKVNSSKVAVNSEQAQKDEGENKVTVSARKTVRRRKANPQ

SEQ ID NO: 189089 - protein, 705 aa, Glycine max
  Coding DNA Sequence Number=SeqID_72311
  Gene Ontology: Mol. function=nucleic acid binding
  Homolog annotation: Hit_ID=Q1SJ58; Match level="QueryCoverage=88%, HitCoverage=78%, E-value=1e-169, Identity=52%"; Hit description=RNA -binding region RNP-1 (RNA recognition motif); Protein kinase- like
  Pfam annotation: Domain name=SAP; Domain location=13-47; Score=42.1; E_value=1.9e-09; Accession=PF02037.17; Description=SAP domain
MSPKYQILHNRPINQWKVTELKDELKRRKISTKGLKDDLVKRLDEVLRLEREVDEASEKDEANGFDGHADGKKVPEAVTVDAEMVDSTDRASAKTFDTAEKGKGGFVDPIETGNVEKIQEIVDHDSDKNDKQDSVSNQVNINNSVSAMDQEVEPKGLPAGGDYANVGHEAIAHASTVETIITVTESVVTEVVASGEDTYRAEKNNEDSAAQLENEVSKAQLDGEDSKPQLDYDTKPLHEDPVPDSAVPENQVSEVNPSLGSQVKSDSISTDSLSINQKNELKDTIITDNVKLEQDIVKPEMVEEPSSRNDVPVSYDESHSMDVGGLHEKKASVEENINNVSSPDLNKTNSSDDVGYSEKLNLDRSSGDDSMEEDLPETKQIDSKFNVDELKDKVEIEKPIVKEESSTIAVGDSLSAGKDDTHQDIDISPAALTEKRKFNEVGNSEPAKRQRRWNTETVKGPDAQSTTPRPATTPRDEPITLKRSFSRSDSSATDDTPKEHIVPPSQRSPTNSLRIDRFLRPFTLKAVQELLGKTGNVSSFWMDQIKTHCYVTYSSVEEAIETRNAVYNLQWPPNGGRLLVAEYVDPEEVKMKLEPPPTQAASDSTDRAVPPAPPFSQPEPSPHLHREQHPVPVILPPPPPLSKPPPVARERLPSPPPLPEKVDPPIVTLDDLFRKTTATPRIYYLPLSEEQVAAKLSTQGKSGRQ

SEQ ID NO: 189090 - protein, 177 aa, Glycine max
  Coding DNA Sequence Number=SeqID_72312
  Subcellular localization annotation: CTP_CleavageSite=85; ConfidenceScore=5.47e-01
MAATPPRKRKNPQLPLQTAVQLFIFNTTTRPVSYLFSHNHPKPMEESKTSFSLFKKPLSWQNTCYLLRPPTTTLTPPISTKSTPSSATDGDPMQVEIVADDEETTSKCTIDKVEEKMRHCFIKNKRPKRPLLPSAAAVAEEKRVVSDDGFVGRVSDSDYDPYAMRLRALDLIYQFHC

SEQ ID NO: 189091 - protein, 70 aa, Glycine max
  Coding DNA Sequence Number=SeqID_72313
MASSWGGEAVTLARRLNLLKLRTTKLYGKRFLHLLRFFAYNHVNDPESEPVRLDAIPTLKFNQEASFQFH

SEQ ID NO: 189092 - protein, 410 aa, Glycine max
  Coding DNA Sequence Number=SeqID_72314
MQNSGVSLRVDSQHFATVHHDNPCLASMPYFGVIEEIWELNYVKFIICLFKCKWVGSNIGVQTDDFRFTLIDLKKLAYGNEPFILAKQAKQVFYVQDPFDERWSVVLHGKTIGVNVEDDDSTIDTYLSPFSTQMLPNVNGEEEALEDSKESEDDEVCEKYDISNDKWNQFCQSRKDPSWEAIQKQKIAPRVLSRGNYDFLEQNLKEDKKKKRLEEAAQFGSTDTIIDPPSPIRRNMKWKMSHTKKSSQMMYEAEKEIADRIISDSHFSVDVLTVVIGRPGHPSRARAAGANVMIKQYFGPTSRSSRTSMSMPPEDLKQLTQKIRDQQEESIIEKGLTLPPKPKVGPSAACVNTVEASFMMMNQAILMMPKAQVINSRLIQDFKIKHQKSNPRFKIQEKKLRSNKSRLHIG

SEQ ID NO: 189093 - protein, 226 aa, Glycine max
  Coding DNA Sequence Number=SeqID_72315
  Gene Ontology: Mol. function=rRNA (adenine-N6,N6-)-dimethyltransferase activity; Biological process=rRNA modification
  Homolog annotation: Hit_ID=O65090; Match level="QueryCoverage=52%, HitCoverage=35%, E-value=5e-41, Identity=69%"; Hit description =Dimethyladenosine transferase
  Pfam annotation: Domain name=RrnaAD; Domain location=69-226; Score= -87.0; E_value=0.022; Accession=PF00398.10; Description=Ribosomal RNA adenine dimethylase
  Subcellular localization annotation: CTP_CleavageSite=42; ConfidenceScore=5.44e-01
MSPSSLCSLQASPPISHALLNRHHKPAHDSTAGVRNRTPYVVSSERSSTASTRSADDYHATLKALNSKGRFPRKSLGQHYMLNADINDQLAGAAGVEQGDVVLEIGPGTGSLTNVLLNSGAFVLAVEKDKHMAALVSERFSSTGKLKVLTEDIVKCHVRSHMSSLVGSINPESRKAKAHFEPCKIWAGPDLMWTNYLGPQTALYRPAHWSSALTKNKKNKSLAKSF

SEQ ID NO: 189094 - protein, 509 aa, Glycine max
  Coding DNA Sequence Number=SeqID_72316
  Gene Ontology: Mol. function=single-stranded DNA binding; Cellular component=nucleus; Biological process=pollen development
  Homolog annotation: Hit_ID=Q64MA3; Match level="QueryCoverage=95%, HitCoverage=88%, E-value=1e-142, Identity=48%"; Hit description =Putative single-strand DNA endonuclease-1
  Pfam annotation: Domain name=XPG_I; Domain location=129-219; Score =64.7; E_value=3.1e-16; Accession=PF00867.9; Description=XPG I-region
  Pfam annotation: Domain name=XPG_N; Domain location=1-97; Score=27.2; E_value=4e-06; Accession=PF00752.8; Description=XPG N-terminal domain
  Pfam module annotation: Pfam domain module=XPG_I::XPG_N; Domain location=129-219::1-97
MGVGGNFWDLLKPYARKEGFDFLRNKRVAVDLSFWIVQPENAIKAMHVRKPHLRLTFFRTISLFCKFGALPVFIVDGSPSLLKSRARIARYFRCSGIELANLPVPEEGVSAERNRLFSSHVQECAELVELLGMPVLKAKGEAEALCAQLNSEGHVDACITADSDAFLFGAKCIIKCFCPNSKEPFECYNMSDIEAGLGLKRKHLIAISLLVGDDHDINGVRGIGLDTALHFVKAFSEDDILNRLHEIGKGNTSQIPICIKVEDNVDGNSPNRKLSHCSFCGHPGSKKDHMKFPCEYCVTKDDEEEPNFPKDEIIDMYLCNDNGYFSASDSPHIVWGNPNIEMLINFLNFHQHWEPAYVRRMMFPMISTIFLRDMTTTTVETTLFGQYEFDSVERVKMRYGYQFFVVKWKRAGVNISCKVPLKESSVQQDDAIELDEMVDLLDDFDAPEIHGDDGCSFLLTDENMDLVGAAFPAEVKRFWQEQNLKLNLRSMQEDFSIIIVAVGRRDSNM

SEQ ID NO: 189095 - protein, 181 aa, Glycine max
  Coding DNA Sequence Number=SeqID_72317
  Gene Ontology: Mol. function=nucleic acid binding; Cellular component= mitochondrion; Biological process=DNA integration
  Homolog annotation: Hit_ID=Q1SRN1; Match level="QueryCoverage=74%, HitCoverage=8%, E-value=2e-45, Identity=62%"; Hit description =Integrase, catalytic region
MVPNRTIQGNPPTTPNILIYRIPKAFTELSKVALWMTLQYKSLSIPNSIPVNTHPMQTRSKYGIHNPRLHPSLFLTHSEPKTVKQALANKDWLIAMQQEYDALLKNHTWDLVSLPPNRQAIGCKWVYRLKENVDGSINRFKARLVAKGFHQVHGFDFHETFSPAIKSVTIRIILTLALSYG

SEQ ID NO: 189096 - protein, 124 aa, Glycine max
  Coding DNA Sequence Number=SeqID_72318
IQGTNHLRILCLNTLERASFVVQVERTSTWVVILRTREGTSLVDQFRILQGYWKSQEPVVAWGLDVVKIDAKEVQDADAHVLVPTQEDKQGAEGPMKPVDRLDPNVDPLYLMALTIPQLFLKLL

SEQ ID NO: 189097 - protein, 98 aa, Glycine max
  Coding DNA Sequence Number=SeqID_72319
MFSTAEHVRVGEPGETNPIQSALHQRLQPHTPMMRSNNNFIINNQDHLAHGIIGTQLISNCLCSMSNVIQKEAQKPALRHQNTRFKSKPNYYHTRKSK

SEQ ID NO: 189098 - protein, 127 aa, Glycine max
  Coding DNA Sequence Number=SeqID_72320
MQSETEQQSWRLHVTAKANKFNFRLRFAAATHRYRPTWNLSFFRISILLKLPKFALIINSHPTNPTRGRGFFATKFTKILHRLRPRLPKKKESNAPCLKVNEIEDSKACEFSNILLSGGGNNILLPV

SEQ ID NO: 189099 - protein, 159 aa, Glycine max
  Coding DNA Sequence Number=SeqID_72321
  Gene Ontology: Mol. function=translation elongation factor activity; Cellular component=cytoplasm; Biological process=translational elongation
  Homolog annotation: Hit_ID=Q2QYK4; Match level="QueryCoverage=51%, HitCoverage=28%, E-value=8e-23, Identity=65%"; Hit description =Elongation factor P, putative, expressed
  Pfam annotation: Domain name=EFP_N; Domain location=81-156; Score =84.0; E_value=4.5e-22; Accession=PF08207.2; Description=Elongation factor P (EF-P) KOW-like dom
  Subcellular localization annotation: CTP_CleavageSite=70; ConfidenceScore=5.97e-01
MVAGTATLKLNLSDFSSPMSSFSASSSSSSFPFLLSMRTPSSSSKPRFLSQSLPSLISSLSPTAFLSSLTCAFLSGIYALTSNDIKVGTNLEVDGAPWRVLVLNCEASFNLACVALHGSEFLHVKPGKGAAFVRTKMKNYITGNTVEKTFRAGSSVNAH

SEQ ID NO: 189100 - protein, 549 aa, Glycine max
  Coding DNA Sequence Number=SeqID_72322
  Gene Ontology: Mol. function=protein-tyrosine kinase activity; Cellular component=integral to membrane; Biological process=protein amino acid phosphorylation
  Homolog annotation: Hit_ID=Q94CI5; Match level="QueryCoverage=99%, HitCoverage=99%, E-value=1e-164, Identity=57%"; Hit description =Protein kinase AtSIK
  Pfam annotation: Domain name=Pkinase; Domain location=170-445; Score=- 8.6; E_value=4.8e-08; Accession=PF00069.15; Description=Protein kinase domain
  Pfam annotation: Domain name=Pkinase_Tyr; Domain location=193-445; Score=-10.7; E_value=8.1e-12; Accession=PF07714.7; Description =Protein tyrosine kinase
  Pfam module annotation: Pfam domain module=Pkinase::Pkinase_Tyr; Domain location=170-445::193-445
  Subcellular localization annotation: CTP_CleavageSite=77; ConfidenceScore=5.19e-01
MGCFTVLKSKKKRSDPITYVKRVSHNENVPTVLPEPQTHTRSLQSAPPSFRTRVKPIQPINKVSNNRARTLSAPSTLDAAEQDALASIEYEEQEESRHRAGSMKEHRSSSPQPLPLPSPQGGCALKAIGSFKSVTSGGSSYYASGPLPLPPTGSLRNFLYEEIAAACHHFSSDRCMSECLSSTIYKASFGDDVSSSKKFEATVTRLHPSSQGLKEFINEVNTLASLQHPNLCKLLGFHAREGSEHRMLVYERLYHGSLDRLLYGRSDGPSIDWNTRMKIAICAAQGLTFLHEEGPFQAMYNEFSTANIQIDKDFSAKLSGYGCVGHIPEEEISSSSSAVGNLSMETLEKGMLTPKSNVWSFGIFLLELLTGRKNLDSRHPKEERNLVKWSRPFLADNYRLSLIMDPQLKGRFPSKAARTIADIAQRCLQKEPSDRPTMRTVVEHLKMIQDLKYSCRFPLQEPASNSGKHMSRSPSLNGIICPAPRLSFSPSPPSGIPVSVSPPRWSGGGPILLLPPRACASSLSLEELDRQESRKSSSSASRRASVEGF

SEQ ID NO: 189101 - protein, 505 aa, Glycine max
  Coding DNA Sequence Number=SeqID_72323
  Gene Ontology: Mol. function=protein serine/threonine kinase activity; Cellular component=mitochondrion; Biological process =protein amino acid phosphorylation
  Homolog annotation: Hit_ID=Q10LT2; Match level="QueryCoverage=84%, HitCoverage=77%, E-value=6e-73, Identity=37%"; Hit description =Expressed protein
  Pfam annotation: Domain name=PPR; Domain location=101-135; Score =12.1; E_value=0.27; Accession=PF01535.11; Description=PPR repeat
  Pfam annotation: Domain name=PPR; Domain location=136-170; Score =25.9; E_value=0.00014; Accession=PF01535.11; Description=PPR repeat
  Pfam annotation: Domain name=PPR; Domain location=171-205; Score =36.6; E_value=8.7e-08; Accession=PF01535.11; Description=PPR repeat
  Pfam annotation: Domain name=PPR; Domain location=206-240; Score =29.3; E_value=1.4e-05; Accession=PF01535.11; Description=PPR repeat
  Pfam annotation: Domain name=PPR; Domain location=241-275; Score =45.7; E_value=1.5e-10; Accession=PF01535.11; Description=PPR repeat
  Pfam annotation: Domain name=PPR; Domain location=276-310; Score =29.3; E_value=1.4e-05; Accession=PF01535.11; Description=PPR repeat
  Pfam annotation: Domain name=PPR; Domain location=312-346; Score =31.1; E_value=3.8e-06; Accession=PF01535.11; Description=PPR repeat
  Pfam annotation: Domain name=PPR; Domain location=389-423; Score =14.2; E_value=0.16; Accession=PF01535.11; Description=PPR repeat
  Pfam annotation: Domain name=PPR; Domain location=424-458; Score =18.1; E_value=0.033; Accession=PF01535.11; Description=PPR repeat
  Pfam annotation: Domain name=PPR; Domain location=459-493; Score =18.0; E_value=0.034; Accession=PF01535.11; Description=PPR repeat
  Pfam module annotation: Pfam domain module=PPR::PPR::PPR::PPR::PPR::PP R::PPR::PPR::PPR::PPR; Domain location=101-135::136-170::171-205::206- 240::241-275::276-310::312-346::389-423::424-458::459-493
  Subcellular localization annotation: CTP_CleavageSite=78; ConfidenceScore=5.16e-01
MPSPIPTCHHILQPRTPFLTNIATKINNDTITIRPGKTTLSFSAIKSTATTTTNDLNFEDTVTRFRIKGLVHRITALSSSNTKPQMLQILEKVPELYQTISDFNHLLMALVITRKPDICLRIFTKLPSFQLEPDCCTHSIIIRCHCEENNMDEAKRALDTALEKGFLPDAATFTVLINSLCKRGRVNKAREVFEVMGGKGYKASVHAHNCLLKGLSYVGKVDEALEMLNDMNATSLEPDVYSYTAVMDGLCKVGRSDEAMELLNEAVGMGVVPNVVTFNTLLQGYSREGRPMEGVAVLEMMKKEHDCVPDCVSYSTVLHGLLKWNQVVAALGVYKEMVGVGLEVDLRMMGTLVRRLCKRSWKDRDRGLLQGAGEVFEKMKERGLVVDQGTFEVIVQALCEGKRFDQALANLYEMVRLGYSPEVIAFDKVIQGLCDEGRVDDAVSALVLLHANGGVPNRVSYDVLIKELIEEGRLFCASNLFCAAVKLGVVPNREPDLNVIKREWE

SEQ ID NO: 189102 - protein, 165 aa, Glycine max
  Coding DNA Sequence Number=SeqID_72324
MRTHALLTLLLFSRVMFDVSDAFSVREFRKLIASDPKDNQPKDPNHAGETNKATGGSPSTNVSGPISSPVPQPQPLPKVMKNTNDDKKKDNNSAPPVSVPPPPKNDDGGDKGLDKENDKIEGMKFSHNSTTETCDGFNKCTDDGGMVACISKIGTHCSSLLLIIR

SEQ ID NO: 189103 - protein, 174 aa, Glycine max
  Coding DNA Sequence Number=SeqID_72325
  Gene Ontology: Mol. function=translation elongation factor activity; Cellular component=cytoplasm; Biological process=translational elongation
  Homolog annotation: Hit_ID=Q2QYK4; Match level="QueryCoverage=99%, HitCoverage=54%, E-value=4e-43, Identity=52%"; Hit description =Elongation factor P, putative, expressed
  Pfam annotation: Domain name=EFP; Domain location=8-62; Score=87.1; E_ value=5.5e-23; Accession=PF01132.10; Description=Elongation factor P (EF-P)
  Pfam annotation: Domain name=Elong-fact-P_C; Domain location=118-173; Score=110.8; E_value=4e-30; Accession=PF09285.1; Description =Elongation factor P, C-terminal
  Pfam module annotation: Pfam domain module=EFP::Elong-fact-P_C; Domain location=8-62::118-173
IEQADVFKETKQFTYKDGVQFVFMDLNTYEEFRLGEKEIGDRTKWLKEGMDCNLLLWNGKVIISSHNILCLSLLLQVSHRVVNEHDKPLLDHFGDKLTLEEHFLIGSMVIDVELPITIKLTVVDVDPGLKGDTAQGGTKPATLDTSAVVNVPLFVNVGDEILVDSRTGQYMSRA

SEQ ID NO: 189104 - protein, 158 aa, Glycine max
  Coding DNA Sequence Number=SeqID_72326
MARKNRVIFHVNITQSSSKSTQLTLNAGKGDCVLHMVSNIPDENFILRLPSYDKILTPVNGAYFLILMVLVFGGTWACCACRKKHHDEVPYQELEMALPESALATNVESAEGWDQDWDDDWDDNVAVKSPAAHAGSISGNGLTSRSSNKDGWENNWDD

SEQ ID NO: 189105 - protein, 67 aa, Glycine max
  Coding DNA Sequence Number=SeqID_72327
MSSIGARSAEIYVMEKRQKEKLKRMEEERVRRGEVSTEERKEISSSVGKNKVHPAPLSSPKKKTLLI

SEQ ID NO: 189106 - protein, 955 aa, Glycine max
  Coding DNA Sequence Number=SeqID_72328
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=94%, HitCoverage=94%, E-value=0.0, Identity=53%"; Hit description =Receptor-like protein kinase
  Pfam annotation: Domain name=LRRNT_2; Domain location=22-62; Score =57.1; E_value=5.8e-14; Accession=PF08263.3; Description=Leucine rich repeat N-terminal domain
  Pfam annotation: Domain name=LRR_1; Domain location=115-138; Score =19.4; E_value=0.013; Accession=PF00560.23; Description=Leucine Rich Repeat
  Pfam annotation: Domain name=LRR_1; Domain location=140-162; Score =11.3; E_value=2.2; Accession=PF00560.23; Description=Leucine Rich Repeat
  Pfam annotation: Domain name=LRR_1; Domain location=164-186; Score =8.7; E_value=6.7; Accession=PF00560.23; Description=Leucine Rich Repeat
  Pfam annotation: Domain name=LRR_1; Domain location=188-210; Score =19.7; E_value=0.011; Accession=PF00560.23; Description=Leucine Rich Repeat
  Pfam annotation: Domain name=LRR_1; Domain location=212-234; Score =10.7; E_value=2.9; Accession=PF00560.23; Description=Leucine Rich Repeat
  Pfam annotation: Domain name=LRR_1; Domain location=236-257; Score =13.3; E_value=0.9; Accession=PF00560.23; Description=Leucine Rich Repeat
  Pfam annotation: Domain name=LRR_1; Domain location=259-281; Score =8.9; E_value=6; Accession=PF00560.23; Description=Leucine Rich Repeat
  Pfam annotation: Domain name=LRR_1; Domain location=283-305; Score =16.4; E_value=0.11; Accession=PF00560.23; Description=Leucine Rich Repeat
  Pfam annotation: Domain name=LRR_1; Domain location=307-329; Score =13.8; E_value=0.61; Accession=PF00560.23; Description=Leucine Rich Repeat
  Pfam annotation: Domain name=LRR_1; Domain location=331-353; Score =11.4; E_value=2.1; Accession=PF00560.23; Description=Leucine Rich Repeat
  Pfam annotation: Domain name=LRR_1; Domain location=382-404; Score =15.9; E_value=0.15; Accession=PF00560.23; Description=Leucine Rich Repeat
  Pfam annotation: Domain name=LRR_1; Domain location=406-428; Score =15.6; E_value=0.18; Accession=PF00560.23; Description=Leucine Rich Repeat
  Pfam annotation: Domain name=LRR_1; Domain location=430-452; Score =11.6; E_value=1.9; Accession=PF00560.23; Description=Leucine Rich Repeat
  Pfam annotation: Domain name=LRR_1; Domain location=454-476; Score =6.5; E_value=17; Accession=PF00560.23; Description=Leucine Rich Repeat
  Pfam annotation: Domain name=LRR_1; Domain location=495-517; Score =19.5; E_value=0.012; Accession=PF00560.23; Description=Leucine Rich Repeat
  Pfam annotation: Domain name=LRR_1; Domain location=519-542; Score =10.3; E_value=3.4; Accession=PF00560.23; Description=Leucine Rich Repeat
  Pfam annotation: Domain name=LRR_1; Domain location=91-113; Score =16.8; E_value=0.078; Accession=PF00560.23; Description=Leucine Rich Repeat
  Pfam annotation: Domain name=Pkinase; Domain location=672-941; Score =110.5; E_value=4.7e-30; Accession=PF00069.15; Description=Protein kinase domain
  Pfam annotation: Domain name=Pkinase_Tyr; Domain location=672-941; Score=72.5; E_value=1.3e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =22-62::...
  Pfam module annotation: Domain location=115-138::140-162::164 -186::188-210::212-234::236-257::259-281::283-305::307-329::331 -353::382-404::406-428::430-452::454-476::495-517::519-542::91 -113::672-941::672-941
MCVLFLILLAPVMLVFSVDTGFNDDVLGLIVFKAGLDDPKRKLSSWNEDDNSPCNWEGVKCDPSSNRVTALVLDGFSLSGHVDRGLLRLQSLQILSLSRNNFTGSINPDLPLLGSLQVVDLSDNNLSGEIPEGFFQQCGSLRTVSFAKNNLTGKIPESLSSCSNLASVNFSSNQLHGELPNGVWFLRGLQSLDLSDNFLEGEIPEGIQNLYDMRELSLQRNRFSGRLPGDIGGCILLKSLDLSGNFLSELPQSMQRLTSCTSISLQGNSFTGGIPEWIGELKNLEVLDLSANGFSGWIPKSLGNLDSLHRLNLSRNRLTGNMPDSMMNCTKLLALDISHNHLAGHVPSWIFKMGVQSISLSGDGFSKGNYPSLKPTPASYHGLEVLDLSSNAFSGVLPSGIGGLGSLQVLNFSTNNISGSIPVGIGDLKSLYIVDLSDNKLNGSIPSEIEGATSLSELRLQKNFLGGRIPAQIDKILSHNKLTGSIPAAIANLTNLQYVDLSWNELSGSLPKELTNLSHLFSFNVSYNHLEGELPVGGFFNTISFSSVSGNPLLCGSVVNHSCPSVHPKPIVLNPNSSGSNSSISLQNHRHKIILSISALIAIGAAAFIAVGVVAVTVLNIHVRSSMEHTAAPFSFSGGEDYSGSPANDPNYGKLVMFSGDADFADGAHNILNKESEIGRGGFGVVYRTFLRDGRAVAIKKLTVSSLIKSQEEFEREIKKLGKVRHPNLVALEGYYWTSSLQLLIYDYLSSGSLHKLLHDDNSKNVFSWPQRFKVILGMAKGLAHLHQMNIIHYNLKSTNVLIDCSGEPKVGDFGLVKLLPMLDHCVLSSKIQSALGYMAPEFACRTVKITKKCDVYGFGILVLEIVTGKRPVEYMEDDVVVLCDMVRGALEEGKVEQCVDGRLLGNFAAEEAIPVIKLGLICASQVPSNRPDMAEVVNILELIQCPSEGQEELE

SEQ ID NO: 189107 - protein, 171 aa, Glycine max
  Coding DNA Sequence Number=SeqID_72329
MEDHNITGACRMSAITKMIMESMRLKTMTSSLVEIKGTNPPESRQGSNYTRLFDSAEYASLVSCVLGEELENVVSPPRCMSHLGPEVEEEVKHVSERQEWWNIVMADEKEAEEAEASAKDEGNGKKYGVIDYIESRSETRSCMIEVLDSHICVLELCNDLSLIREGTKQMS

SEQ ID NO: 189108 - protein, 420 aa, Glycine max
  Coding DNA Sequence Number=SeqID_72330
  Gene Ontology: Cellular component=membrane
  Homolog annotation: Hit_ID=Q39364; Match level="QueryCoverage=51%, HitCoverage=68%, E-value=6e-31, Identity=38%"; Hit description=Non -green plastid inner envelope membrane protein precursor
  Subcellular localization annotation: CTP_CleavageSite=41; ConfidenceScore=5.62e-01
MMSFSLDSVSVLNPKLSHSHFSLPFNRFPHSLNFHPLLKPRAVNAAVPPNGLAACYLTLHRRKPLTVAFTASPQDSEHGEIEVEKERDVHAGSEESQEAWKQALDTFREQAEKFQGVSQEAYEVYSKKTAEQLKVLADKTKNELSVAAKEITDEGKEYLSAVADSSPEVKEIVETFTSPPEDIQKLSGVRDFYVGVPYDVVCWKGTLIAVILGPALITAIKLLRHWLIGVEISHEAQIMLVKLDSPHCISWFCGIELGPKPKLCWNGVKGQAYGPQYQFPIDVIPLYNDMTSIMLTGNILLSCFSSHVPGLLLSLGGFLSFMVTGNTAAIRFGMILGGALLALSILSLKSYKKGRTSPLALKGQAAIASILFLREISSIGKGSSYFTALISGAVVAFYIFRIVLERNQQKASNLETEPGN

SEQ ID NO: 189109 - protein, 54 aa, Glycine max
  Coding DNA Sequence Number=SeqID_72331
MQRPKGSRQVHRQRKFQSCPSNSGSCDDGVADEEFVEGQWGWRSCGGGGNGQRK

SEQ ID NO: 189110 - protein, 1293 aa, Glycine max
  Coding DNA Sequence Number=SeqID_72332
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q10LU3; Match level="QueryCoverage=74%, HitCoverage=75%, E-value=0.0, Identity=70%"; Hit description =Phospholipid-translocating P-type ATPase, flippase family protein, expressed
  Pfam annotation: Domain name=Hydrolase; Domain location=303-784; Score=34.3; E_value=4.3e-07; Accession=PF00702.16; Description =haloacid dehalogenase-like hydrolase
  Pfam annotation: Domain name=Hydrolase_3; Domain location=507-805; Score=-88.4; E_value=0.054; Accession=PF08282.2; Description =haloacid dehalogenase-like hydrolase
  Pfam annotation: Domain name=WRKY; Domain location=1131-1193; Score =108.0; E_value=2.8e-29; Accession=PF03106.6; Description=WRKY DNA -binding domain
  Pfam module annotation: Pfam domain module=Hydrolase::Hydrolase _3::WRKY; Domain location=303-784::507-805::1131-1193
DGYEDWRRHRSDRNENNRESLVLQSGDFRSKKWKKIQAGEVVKIFADETIPADMVLLGTSDQSGLAYIQTMNLDGESNLKTRYARQETASAVASEACDVFGVIRCEQPNRNIYEFTANMEFNGLKFSLSQSNIVLRGCQLKNTDWIIGVVVYAGQETKAMLNSAASPSKRSRLETYMNRETLWLSIFLFIMCLVVAIGMCLWLVRHKNQLDTLPYYRKRYFTNGPDNGKKYKYYGIPMEAFFSFLSSVIVFQIMIPISLYITMELVRLGQSYFMIEDRDMYDACSGSRFQCRSLNINEDLGQIRYVFSDKTGTLTENKMEFQRASVHGKNYGSSLPMVDNTAAAADVIPKRSWKLKSAIAVDSELMTMLQKDSNREEKIAAHEFFLTLAACNTVIPILGDDEFSSIGTNEVNEDIRRIDYQGESPDEQALVSAASAYGYTLFERTSGHIVIDVNGEKLRLDVLGLHEFDSVRKRMSVVIRFPDNAVKVLVKGADTSMFSILENGSESNNNIWHATQSHLNEYSSQGLRTLVVASRDLSGAEHEEWQSRYEEASTSLTDRATKLRQTAALIESNLKLLGATGIEDKLQEGVPEAIEALRQAGIKVWVLTGDKQETAISIGLSCKLLSGDMQQIIINGTSEVECRNLLADAKAKYGVKSSSGGCRNQKHKTNAGHGDLDIPNGSKSLSFPKCNPGNEEGTDAPLALIIDGNSLVYILEKELESELFDLATSCRVVLCCRVAPLQKAGIVDLIKSRTDDMTLAIGDGANDVSMIQMADVGVGICGQEGRQAVMASDFAMGQFQFLKKLLLVHGHWNYQRVGYLVLYNFYRNAVFVMMYILCTAFSTTSALTDWSSVFYSVIYTSIPTIIVGIQDKDLSHRTLLQYPKLYGAGHRQEAYNMQLFWITMMDTVWQSLVLFYIPLFTYKDSSIDIWSMGSLWTIAVVILVNVHLAMDINRWKGYTRLFNHILSETDLLVANKMMPPVTMTSMATGWNFRGKVPLNFGACAHCNKDWNMENLGGSSRRKAIEELLRGRDSAQQLKSVINGTYDDGSATPFAQQLVKEVLMSFTNSLLFLHNNPTSESHHVFNVQVWDSPKSEDSQESNCKSSTIKEPRGCYKRRRTEQTWEKESEAPIDDGHHWRKYGQKEILNAKFPRNYYRCTHKFDQGCQATKQVQRVQEEPILFKTTYYGHHTCKNSANPDIILDPMSPSSSSKFLSFDNSFSTPSKQECPFLSSSNNFPSSSSVKRECKEEVPPSISSNDYLISSDLTFDSSPRHHVTLSSTLDSEYKSVDISDV

SEQ ID NO: 189111 - protein, 109 aa, Glycine max
  Coding DNA Sequence Number=SeqID_72333
MTGLMRGLRRTNTITIHNCNISIDAALFQQQNCHGMGACIWDHHGRFITCSNDKVYIQLESRVLGKLKLKTLYSTEKGSSKFHFLISKCKNLISFIPNLKISENIFHFK

SEQ ID NO: 189112 - protein, 159 aa, Glycine max
  Coding DNA Sequence Number=SeqID_72334
  Gene Ontology: Cellular component=membrane
MASVLALILIVNLFFTSFIYFNHLAQKSCDRVIGEPTIDSKHQFSPDLHLHGVVVHRGAPWKAEIGQWLASCDVVTKEVNITEILGGNSCKNECSGQGVCNRELGQCRCFHGYAVIVVILELTVFLNLVTDSKFLQTVLEAEHLSQIYVPPAMILPPNG

SEQ ID NO: 189113 - protein, 665 aa, Glycine max
  Coding DNA Sequence Number=SeqID_72335
  Gene Ontology: Mol. function=transferase activity; Cellular component= membrane
  Homolog annotation: Hit_ID=Q10R19; Match level="QueryCoverage=85%, HitCoverage=95%, E-value=0.0, Identity=60%"; Hit description =Exostosin family protein, putative, expressed
  Pfam annotation: Domain name=EGF_2; Domain location=132-158; Score =25.0; E_value=0.00026; Accession=PF07974.3; Description=EGF-like domain
  Pfam annotation: Domain name=Exostosin; Domain location=205-583; Score=168.5; E_value=1.7e-47; Accession=PF03016.6; Description =Exostosin family
  Pfam module annotation: Pfam domain module=EGF_2::Exostosin; Domain location=132-158::205-583
MDALSNYNWNATIKVPQKLHLGNGFPPYALPLVTKQEPCASVEKAQNIQIDHCQCHVAFNLSNASSEPDGPMEVDWTKLDQDVFTTNGNKSGWCNVDPDEAYTGKVQFKGVCECQYDGLGGWFCEVSVQSTCINQCSGHGHCRGGFCQCDNGWYGVDCSTPSVMSSVWEWPNWLRPAQIDVADNQHFDEKVINAKAVVAKKRPLIYVYDLPPVFNSLLLEGRHFKQNCVNRLYDVYNATIWTDELYGAQIALYESILASPHRTLNGDEADFFFVPVLDSCLIDRADHAPHLSTQVVKYIMVILDEKSTICYRVYTLKNNNPTECGIMLIITSLSNILIGTAHQEGTTSGQFFSWDEGACYAPKEIWSSMMLVHWGNTNTKHYHSTTAYCPDNWDGIPSDRRGFHPCFDPEKDLVIPAWKVTHVHVLSSKLWAWPLEKRKTLFYFNGNLGPAYPYGRNEWYSMGIRQKLAEEFGSKPNKEGKLGKQRAKDVVVTAERSENYEVELASSVFCGVLPGDGWSGRMEDSVLQGCIPVIIQDGIFLPYENVLNYDSFAVRIPEDEIPNLIKILRGINDTEIKFKLANVQKIWQRFLYRDSVLLEAERQKTAFGHVNDWAVEFLKLIEDDVFTTFIQVLHYKLHNDPWRRHQVGLKKKFGLPDQCLLSSSK

SEQ ID NO: 189114 - protein, 367 aa, Glycine max
  Coding DNA Sequence Number=SeqID_72336
  Gene Ontology: Mol. function=adenylosuccinate synthase activity; Cellular component=chloroplast; Biological process=purine nucleotide biosynthetic process
  Homolog annotation: Hit_ID=Q1SHX2; Match level="QueryCoverage=92%, HitCoverage=69%, E-value=1e-160, Identity=83%"; Hit description =Adenylosuccinate synthetase
  Pfam annotation: Domain name=Adenylsucc_synt; Domain location=64-350; Score=360.9; E_value=2.1e-105; Accession=PF00709.11; Description =Adenylosuccinate synthetase
  Subcellular localization annotation: CTP_CleavageSite=35; ConfidenceScore=5.44e-01
MNTISSLTLDSHAICNPQRSISLRQVRPTTRNVVVCSAKPVAPPPTKLAAADTSGCRIGELSQVSGVLGCQWGDEGKGKLVDILAQHFEIVARCQGGANAGHTIYNAEGKKFALHLVPSGILNEDTLCVIGNGVVVHLPGLFKEIDGLESNGVSCKGRILISDRAHLLFDFHQVVDGLREAELAKSFIGTTKRGIGPCYSSKVNRNGLRVGDLRHMDTFPQKLDLILSDAALRFKDFNYGPYMLREEVEKYKRYAERLEPFIADTVLVMNDAIEQKKKILVEGGQATMLDIDFGTYPFVTSSSPSAGGICTGLGIAPRVLGDLIGVLTYTFPPSINTPLQDGPCPQGQVEENSLHFISKGLLHPLLP

SEQ ID NO: 189115 - protein, 778 aa, Glycine max
  Coding DNA Sequence Number=SeqID_72337
  Gene Ontology: Mol. function=oligopeptide transporter activity; Cellular component=integral to membrane; Biological process =oligopeptide transport
  Homolog annotation: Hit_ID=Q1SHX0; Match level="QueryCoverage=98%, HitCoverage=99%, E-value=0.0, Identity=85%"; Hit description =Ribosomal protein S2; Oligopeptide transporter OPT superfamily
  Pfam annotation: Domain name=OPT; Domain location=77-741; Score =773.9; E_value=1e-229; Accession=PF03169.6; Description=OPT oligopeptide transporter protein
MERGANNKKLSPLSSEQFISLTTPLVDLEKEAEASSTGVSQERVIEDAEKDEFQVDDCPIEQVRLTVPITDDPTQPALTFRTWVLGLASCVFLAFVNQFFGYRTNPLKISSVSAQIITLPLGKLMAATLSTKPIRVPFTKWSFSLNPGPFSLKEHVLITIFATSGSSGVYAISIITIVKAFYHRNIHPVAAYLLALSTQMLGYGWAGIFRRFLVNSPYMWWPANLVQVSLFRAFHEKEKRPKGGNTRLQFFFLVFVVSFAYYTIPGYLFQAISTISFVCLIWKDSITAQQIGSGMNGLGIGSFGLDWNTVAGFLGSPLAIPGFAIINMLIGFVLDIYVLIPLAYWSNLYDAKKFPLISSHTFDSTGATYNVSRILNPKTFDIDLNSYNNYSKIYLSITFAFEYGFSFATLTATISHVALFHGEMILQMWRKTTRALKEQLGDVHTRIMKRNYEQVPEWWFVTILILMVVIALVACEGFGKQLQLPWWGILLSLTIALVFTLPIGVIQATTNIQTGLNVIAELIIGFIYPGKPLANVAFKTYGHVSMVQALGFLGDFKLGHYMKIPPKSMFIVQLVGTVVASSVYFATAWWLLTSIENICDEELLPKGSPWTCPGDDVFYNASIIWGVVGPKRMFTKDGVYPGMNWFFLIGLLAPLPVWLLSKKFPNHKWIQLINFPIIIAGASNIPPFRSVNYITWGIVGIFFNFYVYRKFKAWWARHTYILSAALDAGVAFMGVALYFALQSNGIFGPTWWGLDADHCHLAKCPTAPDVHAKGCPLL

SEQ ID NO: 189116 - protein, 434 aa, Glycine max
  Coding DNA Sequence Number=SeqID_72338
  Gene Ontology: Mol. function=nucleoside-triphosphatase activity; Cellular component=membrane; Biological process=translation
  Homolog annotation: Hit_ID=Q1SHW6; Match level="QueryCoverage=97%, HitCoverage=60%, E-value=0.0, Identity=80%"; Hit description=AAA ATPase; DEAD/DEAH box helicase, N-terminal
  Pfam annotation: Domain name=AAA; Domain location=235-381; Score= -25.7; E_value=0.019; Accession=PF00004.19; Description=ATPase family associated with various cellular activities (AAA)
  Pfam annotation: Domain name=DEAD; Domain location=219-395; Score= -48.5; E_value=0.07; Accession=PF00270.19; Description=DEADDEAH box helicase
  Pfam annotation: Domain name=ResIII; Domain location=215-434; Score= -37.6; E_value=0.066; Accession=PF04851.6; Description=Type III restriction enzyme, res subunit
  Pfam annotation: Domain name=Zot; Domain location=234-394; Score= -66.3; E_value=0.098; Accession=PF05707.2; Description=Zonular occludens toxin (Zot)
  Pfam module annotation: Pfam domain module=AAA::DEAD::ResIII::Zot; Domain location=235-381::219-395::215-434::234-394
MATGTGSKKKASPLSLEQFISITAPLLDLEKEAEISSSIATGASRNLDTAQKRGSTILNLKCVDVQTGLMGKSLIEFQSTKGDVLPAHKFGTHDVVVLKLNKADLGSPALGQGVVYRLKDSSITIAFDDIPEDGLNSPLRLEKVANEICIQHPSPIPSHSEEPLGNGVTYRRMKDALIQLSKGVHKGPASDLIPVLFGERPPTVSKKDVSSTPFNKNLDHSQKEAVSKALSSKNVFLLHGPPGTGKTTTVVEIILQEVKRGSKILACAASNIAVDNIVERLVPHRCVKSFVDTLYSFMMTFSARVKLVRVGHPARLLPQVLDSALDAQVLRGDNSGLANDIRKEMKALNGKLLKTKDRNTRKDIQRELRTLSKEERKRQQLAVTDVLKSADVILTTLIGAFSKKLDSTSFDLVIIDEAAQALEIACWIPILKVV

SEQ ID NO: 189117 - protein, 208 aa, Glycine max
  Coding DNA Sequence Number=SeqID_72339
MLTPTTGVPKLRPRSGRTPLQLKNSPADPIQPSAKLKSKPYFEISLIDKENNPIAAVAVPPAVPPETSLAEELSAVKKKLERMRADKERTEKILNEKHALLDAWMKEMEERGENQKNFEIEVDRLFRLKELKYRCMRVSPMRTLREKEQGKIVNEAPSQSSEVKTEETMASESESESESESVGGECQVLQSPGSACSQTHTTHTKSDS

SEQ ID NO: 189118 - protein, 75 aa, Glycine max
  Coding DNA Sequence Number=SeqID_72340
MELKMREIASLMRRKARKEKIEESCRKICSVWTKRLKLRMGGMYKVRGKAEKATANASCSIIGERERERERECEE

SEQ ID NO: 189119 - protein, 256 aa, Glycine max
  Coding DNA Sequence Number=SeqID_72341
  Homolog annotation: Hit_ID=Q10LV0; Match level="QueryCoverage=20%, HitCoverage=15%, E-value=4e-14, Identity=67%"; Hit description =Expressed protein
  Subcellular localization annotation: CTP_CleavageSite=51; ConfidenceScore=5.92e-01
MPDFLATNPLTFSAAESPRFPFLNSRPTLTPRTQLNPNSRVLFSPKPSKTSCNNKSVSLALSSRSNEGPSRGYGFYNELEFEDRNEETLGLEINPVVAEDSQSETESLPFDGVEGDDNYKGEDDLVRVQGDADGDGDGLKKDYDDDDDQGENEKFGGKLRVRRGKQWMVLFVEVRPNLLSGDSEKFLLEDISQIGDVVLVQDESVIDNEFKMVGLETLLTLVVDLGEDYKANTFSIHLKPIQVHIGLVTGVICKPD

SEQ ID NO: 189120 - protein, 425 aa, Glycine max
  Coding DNA Sequence Number=SeqID_72342
  Gene Ontology: Mol. function=hydrolase activity, hydrolyzing O -glycosyl compounds; Cellular component=lysosome; Biological process =carbohydrate metabolic process
  Homolog annotation: Hit_ID=Q5ZP79; Match level="QueryCoverage=98%, HitCoverage=98%, E-value=0.0, Identity=80%"; Hit description=Alpha -galactosidase 1 precursor
  Pfam annotation: Domain name=Melibiase; Domain location=18-367; Score= -54.4; E_value=9.6e-13; Accession=PF02065.9; Description=Melibiase
MERRVGYEVLVALVTLLVFSLTCVTASPSGPTKLQDHVKQFRGNLLANGLGRTPPMGWNSWNHFSCQINEKMIRETADALVSTGLSKLGYTYVNIDDCWAELNRDAKGNLVAKKSTFPSGIKALADYVHSKGLKLGIYSDAGYFTCSKQMPGSLGHEFQDAKTFASWGIDYLKYDNCNNDGSKPTDRYPIMTRALMMAGRPIFFSLCEWGDLHPALWGAKVGNSWRTTNDINDSWESMISRADMNEVYAEYARPGGWNDPDMLEVGNGGMTKNEYTVHFSLWALSKAPLLLGCDVRNITKETMEIVANKEVIAVNQDPLGVQGKKVRMEGDEEMKQYIITVIGDPFGQIWAGPLSGYRVAVVLLNRGPWKISITANWDDIGIPPKSAVEARDLWEHKTLMRPFVDKLTATVDPHGCKMYVLKPLA

SEQ ID NO: 189121 - protein, 207 aa, Glycine max
  Coding DNA Sequence Number=SeqID_72343
  Gene Ontology: Mol. function=small conjugating protein ligase activity; Cellular component=proteasome complex (sensu Eukaryota); Biological process=protein modification process
  Homolog annotation: Hit_ID=P35132; Match level="QueryCoverage=99%, HitCoverage=100%, E-value=1e-70, Identity=68%"; Hit description=SUMO- conjugating enzyme UBC9
  Pfam annotation: Domain name=UQ_con; Domain location=5-201; Score =198.9; E_value=1.2e-56; Accession=PF00179.16; Description=Ubiquitin -conjugating enzyme
MASKRILKELKDLQKDPPTSCSAGPVAEDMFHWQATIMGPADSPYAGGVFLVTIHFPPDYPFKPPKVAFRTKVFHPNINSNGSICLDILKEQWSPALTISKPVSTPKGCVVSHLTVLLVVPLWPKLCSIAEVHSVCSCDAEFRVGRKKMTLSVTILGSGVVLLSICSLLTDPNPDDPLVPEIAHMYKTDRAKYEATARSWTQKYAMG

SEQ ID NO: 189122 - protein, 666 aa, Glycine max
  Coding DNA Sequence Number=SeqID_72344
  Homolog annotation: Hit_ID=Q5QLZ3; Match level="QueryCoverage=38%, HitCoverage=44%, E-value=5e-46, Identity=44%"; Hit description =Gastric mucin-like protein
MSMLLALHNKILLHQSPMQAKLEVEVNSKMVKEGSTRSPQKQHNTRDKGTSIPCHYYGEGEEGRRRESGAEKEAMWILLRMMSGRNAREYLLGSLNHHRRGHSFNGVANNNNYRDDNLDLFSNNRRSLSLAASSDDSSDVSVKLGRLSIGTAKPVKSGIDDLLSSTEGGKHDYDWLLTPPGTPVFPSEGESQTTLAPPRRSLTRSTSTSKTSRLAVSQSENNNPASRPARSSSVTRSSISTSHSQYSSYSSNRHSSSILNTSSASVSSYIRPSSPITRSSSSARPSTPSSRPTASRSSTPSKPRPVSTSSTAERNRPSSQGSRPSTPSSRPHIPANLHSPSASSTRSLSRPSTPTRRSSMPSLSPSPSPTIGSLTSAGRVSSNGRNSAPASRPSSPSPRVRPPPQPIVPPDFPLETPPNLRTTLPDRPVSAGRSRPGGVTMKTNSSETQASPVTMPRRHSSPIVSRGRVTEPAAKTRGYSNGHHVDAPEPRKVSHAPEVAARKSVRSSSTAPDNTGFGRTISKKSLDMAIKHMDIRNSSGNIRSLTSTTLFPQSIRTSTTKSHRVSSAPASVDMNGSMISSKNGANFDVGNGIDRNMMMKGRDADERHYSAKLSEVDIYESSRYDALLFKEDLKNTNWLHGADDKCDQGPIFDNGFEHLPEPFGLL

SEQ ID NO: 189123 - protein, 618 aa, Glycine max
  Coding DNA Sequence Number=SeqID_72345
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=95%, HitCoverage=92%, E-value=0.0, Identity=56%"; Hit description =Receptor-like protein kinase
  Pfam annotation: Domain name=LRRNT_2; Domain location=37-75; Score =47.6; E_value=4.1e-11; Accession=PF08263.3; Description=Leucine rich repeat N-terminal domain
  Pfam annotation: Domain name=LRR_1; Domain location=105-127; Score =7.7; E_value=10; Accession=PF00560.23; Description=Leucine Rich Repeat
  Pfam annotation: Domain name=LRR_1; Domain location=129-148; Score =12.6; E_value=1.2; Accession=PF00560.23; Description=Leucine Rich Repeat
  Pfam annotation: Domain name=LRR_1; Domain location=151-173; Score =19.0; E_value=0.017; Accession=PF00560.23; Description=Leucine Rich Repeat
  Pfam annotation: Domain name=LRR_1; Domain location=175-195; Score =8.1; E_value=8.6; Accession=PF00560.23; Description=Leucine Rich Repeat
  Pfam annotation: Domain name=LRR_1; Domain location=197-219; Score =16.1; E_value=0.13; Accession=PF00560.23; Description=Leucine Rich Repeat
  Pfam annotation: Domain name=Pkinase; Domain location=343-610; Score =82.9; E_value=9.9e-22; Accession=PF00069.15; Description=Protein kinase domain
  Pfam annotation: Domain name=Pkinase_Tyr; Domain location=342-610; Score=52.2; E_value=1.1e-15; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=37-75::105 -127::129-148::151-173::175-195::197-219::343-610::342-610
MGNGKETHSFHRDRHSYFTTIPIFLLLLVFPHTKANLHSEKQALLDFAAALHHGPKVNWNSSTSICTSWVGVTCSHDGSHVLSVRLPGVGLRGSLPPNTLGKLNGLISLSLRSNSLRGNLPTDLLSLPSLRFVYLQHNNFSGEIPDSLPPRLIFLDLSHNSFTGQIPASIQNLTHLIGLNLRKNSLTGPIPDVNLPSLKDLDLSFNYLNGSIPSGLHKFHASSFRGNLMLCGAPLKQCSSVSPNTTLSPLTVSERPSDLSNRKMSEGAKIAIVLGGVTLLFLPGLLVVFFCFKKKVGEQNVAPAEKGQKLKQDFGSGVQESEQNKLVFFEGCSYNFDLEDMLRASAEVLGKGSCGTTYKAILEDGTTVVVKRLREVAMGKKEFEQQMEIVQRLDHHQNVIPLRAYYYSKDEKLMVYDYSTAGSFSKLLHGTTETGRAPLDWDTRLKIMVGAARGIAHIHSANGRKLVHGNIKSSNVILSIDLQGCISDFGLTPLTNFCASSRSPGYGAPEVIESRKSTKKSDVYSFGVLLLEMLTGKTPVQYSGHDEVVDLPKWVQSVVREEWTAEVFDLELMRYPNIEDELVQMLQLAMACVAAMPDTRPSMEEVVKTIEEIRASIY

SEQ ID NO: 189124 - protein, 247 aa, Glycine max
  Coding DNA Sequence Number=SeqID_72346
  Gene Ontology: Mol. function=nucleic acid binding; Cellular component= intracellular; Biological process=DNA integration
  Homolog annotation: Hit_ID=Q1S3Z1; Match level="QueryCoverage=95%, HitCoverage=19%, E-value=4e-53, Identity=45%"; Hit description =Integrase, catalytic region; Zinc finger, CCHC-type
  Pfam annotation: Domain name=zf-CCHC; Domain location=225-242; Score =17.5; E_value=0.0013; Accession=PF00098.13; Description=Zinc knuckle
MSSAKFDIEKFTGKNDFSIWRIKMRALLVHQGLDVALDGKNLPTHVSESEKKGLLDKAHSALILSLGDKVLREISKEKSIVAVWFKLESLYMTKSLANRLLLNQMLYTFKMPLGKSLEDHMDDFNKIILDLENIEIKVDDEDQALLLLRSLPSEYDSLSDMLIYGRDSLSLDEVKAALFSKELKKKSEGGGYQDTEGLYTRGRTEKKDPKNKKGSRSKSHDERKRRCFVCGSEEHLKKDFPYTRKKK

SEQ ID NO: 189125 - protein, 139 aa, Glycine max
  Coding DNA Sequence Number=SeqID_72347
  Gene Ontology: Mol. function=prenyltransferase activity; Cellular component=integral to membrane; Biological process=biosynthetic process
  Homolog annotation: Hit_ID=Q93YP7; Match level="QueryCoverage=24%, HitCoverage=8%, E-value=6e-11, Identity=76%"; Hit description =Polyprenyltransferase like protein
  Subcellular localization annotation: CTP_CleavageSite=97; ConfidenceScore=5.81e-01
MATALTSRASHRFLKPSSSSSSSSVSLYPVIFNPLITTQQFANQNPTLNPPFKPPQLQSFNFEFRKTTGSLSSFHLVAHLSTWHSKENKNQSGDNVSSSGGGDTSWVELYLPRKVQPYARLARLDKPIGTWLLLWPCMW

SEQ ID NO: 189126 - protein, 70 aa, Glycine max
  Coding DNA Sequence Number=SeqID_72348
MKEKTRVKRQQVILSRRGTHALINHKAITEINQLTEYNFPLVCPGHPDHDRPATHNNSPPWLDVMLLQPS

SEQ ID NO: 189127 - protein, 91 aa, Glycine max
  Coding DNA Sequence Number=SeqID_72349
MVLYYLPIHLSAAGWLYYASLAVVSGHLGWQTWAVDLSSRTDCNRKYVREVHCINSPSNYPQASLKGSQILIYWLGHTVGASKFLLMLNTQ

SEQ ID NO: 189128 - protein, 111 aa, Glycine max
  Coding DNA Sequence Number=SeqID_72350
MSLNAFLNKLWVEILRDKYMPHGNIFLAKQTKGSKVWVSIISALKELEDGLAFSFWFAPWASKEPLCGKVPFVHICDSMLKLKDVWIGIFTSFILPFLNLLLMLSLNPCWC

SEQ ID NO: 189129 - protein, 71 aa, Glycine max
  Coding DNA Sequence Number=SeqID_72351
  Subcellular localization annotation: CTP_CleavageSite=50; ConfidenceScore=5.63e-01
MLTFNLNAISSSFSVVPFHANYPLSTQTQLLVPSNLSYSFATTGTRKFKSFQLKAGFWESIKSGYFQFSAH

SEQ ID NO: 189130 - protein, 539 aa, Glycine max
  Coding DNA Sequence Number=SeqID_72352
  Gene Ontology: Mol. function=signal transducer activity; Cellular component=membrane; Biological process=response to light stimulus
  Homolog annotation: Hit_ID=Q9C9Z0; Match level="QueryCoverage=99%, HitCoverage=89%, E-value=1e-158, Identity=56%"; Hit description =Putative non-phototropic hypocotyl; 42053-44089
  Pfam annotation: Domain name=BTB; Domain location=28-125; Score=7.1; E_value=0.00092; Accession=PF00651.21; Description=BTBPOZ domain
  Pfam annotation: Domain name=NPH3; Domain location=202-461; Score =356.2; E_value=5.4e-104; Accession=PF03000.5; Description=NPH3 family
  Pfam module annotation: Pfam domain module=BTB::NPH3; Domain location= 28-125::202-461
  Subcellular localization annotation: CTP_CleavageSite=28; ConfidenceScore=5.01e-01
MVSETSLSSSKRSPATPKFCNSFTTRIFADVAGDITIVVDGESFLLHKFPLVTLSGKIRKMVAEAKGSNVSNLELLNFPGGHQTFELAMKFCYGMNFEITTFNVARLLCAAEYLEMTEEYREQNLISRAEIYLNEIVFQSLQKSVEVLSTCEMLPPDIVDEIEISNGCVEAIAMNACKEQLVSGLSKLDCDGESRELKEDCVAWWVEDLSVLSIDYFQRVICAMGRMGVRSDSIIASLMHYAQSSLKGIGKCQFWNPSRTNSSPTSVEKDQKIIVETLVSLMPTDKSSSIPLTFLFGMLKMAIMLGAIIPCRLELERRIALRLEMVSLDDLLIPSLQSGDSLFDVDTVHRLLVNFLQRVEEEETEDYGYESDGFCSSGHGSLLKVGQLIDAYLAEIAPDPYLSLQKFIALIEILPDYARVIDDGFYRAVDIYLKAHPALTEQECKKLCKLIDCQKLSQEASNHAAQNDRLPLQMVVQVLYFEQLRLKNAMSGSLGDGLLSQRISSGVPSAAMSPRDNYASLRRENRELKLEISRMRVRL

SEQ ID NO: 189131 - protein, 724 aa, Glycine max
  Coding DNA Sequence Number=SeqID_72353
  Gene Ontology: Mol. function=protein serine/threonine kinase activity; Cellular component=integral to membrane; Biological process=protein amino acid phosphorylation
  Homolog annotation: Hit_ID=Q1SI44; Match level="QueryCoverage=97%, HitCoverage=97%, E-value=0.0, Identity=63%"; Hit description=Leucine Rich Repeat, putative
  Pfam annotation: Domain name=LRRNT_2; Domain location=21-62; Score =48.1; E_value=2.9e-11; Accession=PF08263.3; Description=Leucine rich repeat N-terminal domain
  Pfam annotation: Domain name=LRR_1; Domain location=119-141; Score =8.3; E_value=7.9; Accession=PF00560.23; Description=Leucine Rich Repeat
  Pfam annotation: Domain name=LRR_1; Domain location=143-165; Score =17.2; E_value=0.061; Accession=PF00560.23; Description=Leucine Rich Repeat
  Pfam annotation: Domain name=LRR_1; Domain location=167-190; Score =14.4; E_value=0.42; Accession=PF00560.23; Description=Leucine Rich Repeat
  Pfam annotation: Domain name=LRR_1; Domain location=192-214; Score =16.2; E_value=0.12; Accession=PF00560.23; Description=Leucine Rich Repeat
  Pfam annotation: Domain name=LRR_1; Domain location=217-239; Score =8.0; E_value=9.1; Accession=PF00560.23; Description=Leucine Rich Repeat
  Pfam annotation: Domain name=LRR_1; Domain location=241-262; Score =3.5; E_value=62; Accession=PF00560.23; Description=Leucine Rich Repeat
  Pfam annotation: Domain name=LRR_1; Domain location=95-117; Score =4.7; E_value=38; Accession=PF00560.23; Description=Leucine Rich Repeat
  Pfam annotation: Domain name=Pkinase; Domain location=414-696; Score =54.0; E_value=4.9e-13; Accession=PF00069.15; Description=Protein kinase domain
  Pfam annotation: Domain name=Pkinase_Tyr; Domain location=403-720; Score=19.3; E_value=1.2e-13; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::Pkinase::Pkinase_Tyr; Domain location =21-62::119-141::143-165::167-190::192-214::217-239::241-262::95 -117::414-696::403-720
MTVSLFIFLLLFFFFHPAVSLSSDGIALLTLKSAVDASGASAFSDWNDADATPCQWSGVTCADISGLPEPRVVGVALSGKGLRGYLPSELGTLLYLRRLNLHTNALRGAIPAQLFNATALHSVFLHGNNLSGNLPTSVCTLPRLENLDLSDNALSGAIPDALRKCSNLQRLILARNKFSGEIPASPWPELENLVQLDLSSNLLEGSIPDKLGELKILTGTLNLSFNHLSGKIPKSLGNLPVVVSFDLRNNDLSGEIPQTGSFSNQGPTAFLNNPNLCGFPLQKPCAGSAPSEPGLSPGSRGAHRPTKRLSPSSIILISVADAAGVALIGLVVVYVYWKRKGKSNGCSCTLKRKFGGESEELSLCCWCNGVKSDDSEVEEGEKGEGESGRGEGDLVAIDKGFNFELDELLRASAYVLGKSGLGIVYKVVLGNGVPVAVRRLGEGGEQRYKEFAAEVQAIGKVKHPNIVRLRAYYWAPDEKLLISDFISNGNLATALRGIMRFEFKTSCKLFKCLTRRNGQPSPNLSWSTRLKIIKRTARGLAYLHECSPRKFVHGDVKPSNILLSTDFQPHISDFGLNRLISITGNNPSSGGLMGGALPYLKPSQTERTNNYKAPEARVLGCIPTQKWDVYSFGVVLLELLTGKAPDSSPAASTSMDVPDLVRWVRKGFEQESPLSEIVDPSMLHEVHAKKEVLAVFHVALQCTEGDPEVRPRMKTVSENLERIG

SEQ ID NO: 189132 - protein, 106 aa, Glycine max
  Coding DNA Sequence Number=SeqID_72354
  Subcellular localization annotation: CTP_CleavageSite=37; ConfidenceScore=5.27e-01
MTWPLRPNSAQANTFKQKDFSLELVLMTWPLRPTSAQANTFKQKDFSLELVLMTWPLRPTSAQANTFKQKDFSLELVLITWPLRPTSAQAECLTLKVNPSQLGSGI

SEQ ID NO: 189133 - protein, 295 aa, Glycine max
  Coding DNA Sequence Number=SeqID_72355
MATTLKNVKSEVPGESEEMERELEEVVKNSGIGGEVNHLRKEPMDIAMNARGNYCSSPGSSDAATEHEILLKSEETRGESVETLNSCELSCSNHCLGFMHNNMLPDTNLRPNPEASIAKKHTEEVISEILGLCQGKCLKISHGQSPNEQFRRSEHFDEMKTRLKGLECKLRAHSIHYKNQAPIVGDSNHPSMQGIHLFGGGTVGPIESMSQVEALNNINTNRNSLPGFSSGHGRKLCDLSQQLHKLGGYLPEHWNSVQFPDLEVGHDYSFLNPDYDFGLYEEQKLLDICFPHVGS

SEQ ID NO: 189134 - protein, 134 aa, Glycine max
  Coding DNA Sequence Number=SeqID_72356
  Gene Ontology: Mol. function=drug transporter activity; Cellular component=membrane; Biological process=multidrug transport
  Homolog annotation: Hit_ID=Q2QYU0; Match level="QueryCoverage=68%, HitCoverage=20%, E-value=7e-22, Identity=56%"; Hit description=MATE efflux family protein, expressed
MEIVLIALPAALALAADPIASLIDTAFVGHIGAVELAAVGVSASGFNLVSKAFNVPLLNVTASFVAEEQALIRKEEESIPSDKNVSTSLALAATLGMAETVVLTLGSGILMNIMGIPAVCHTWLIIDPYIISYK

SEQ ID NO: 189135 - protein, 117 aa, Glycine max
  Coding DNA Sequence Number=SeqID_72357
  Gene Ontology: Mol. function=drug transporter activity; Cellular component=membrane; Biological process=multidrug transport
  Homolog annotation: Hit_ID=Q2QYU0; Match level="QueryCoverage=72%, HitCoverage=24%, E-value=1e-12, Identity=37%"; Hit description=MATE efflux family protein, expressed
MRGPAEQFLTLRAFGTPAIVLALAAQGTFRGFLDTKTPLYAVGKSTCLGLLDVNNEGLPWNVRTLAVFITVMLSTSVAAQQGPIPPMAELKQAMWDLATPLPSQMPVRTNKPTRTGD

SEQ ID NO: 189136 - protein, 711 aa, Glycine max
  Coding DNA Sequence Number=SeqID_72358
  Gene Ontology: Mol. function=protein serine/threonine kinase activity; Cellular component=integral to membrane; Biological process=protein amino acid phosphorylation
  Homolog annotation: Hit_ID=UPI0000196B24; Match level="QueryCoverage =99%, HitCoverage=69%, E-value=0.0, Identity=54%"; Hit description =ATP binding / kinase/ protein serine/threonine kinase
  Pfam annotation: Domain name=LRRNT_2; Domain location=28-68; Score =33.9; E_value=5.4e-07; Accession=PF08263.3; Description=Leucine rich repeat N-terminal domain
  Pfam annotation: Domain name=LRR_1; Domain location=102-124; Score =12.6; E_value=1.2; Accession=PF00560.23; Description=Leucine Rich Repeat
  Pfam annotation: Domain name=LRR_1; Domain location=126-148; Score =14.8; E_value=0.31; Accession=PF00560.23; Description=Leucine Rich Repeat
  Pfam annotation: Domain name=LRR_1; Domain location=150-172; Score =10.1; E_value=3.7; Accession=PF00560.23; Description=Leucine Rich Repeat
  Pfam annotation: Domain name=LRR_1; Domain location=174-196; Score =15.8; E_value=0.16; Accession=PF00560.23; Description=Leucine Rich Repeat
  Pfam annotation: Domain name=LRR_1; Domain location=198-220; Score =10.2; E_value=3.6; Accession=PF00560.23; Description=Leucine Rich Repeat
  Pfam annotation: Domain name=LRR_1; Domain location=222-245; Score =10.2; E_value=3.5; Accession=PF00560.23; Description=Leucine Rich Repeat
  Pfam annotation: Domain name=LRR_1; Domain location=247-268; Score =11.6; E_value=1.9; Accession=PF00560.23; Description=Leucine Rich Repeat
  Pfam annotation: Domain name=LRR_1; Domain location=270-290; Score =13.5; E_value=0.76; Accession=PF00560.23; Description=Leucine Rich Repeat
  Pfam annotation: Domain name=LRR_1; Domain location=293-312; Score =11.8; E_value=1.7; Accession=PF00560.23; Description=Leucine Rich Repeat
  Pfam annotation: Domain name=LRR_1; Domain location=315-338; Score =12.7; E_value=1.2; Accession=PF00560.23; Description=Leucine Rich Repeat
  Pfam annotation: Domain name=LRR_1; Domain location=78-100; Score =4.0; E_value=52; Accession=PF00560.23; Description=Leucine Rich Repeat
  Pfam annotation: Domain name=Pkinase_Tyr; Domain location=618-711; Score=-147.4; E_value=0.002; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::Pkinase _Tyr; Domain location=28-68::102-124::126-148::150-172::174-196::198 -220::222-245::...
  Pfam module annotation: Domain location=247-268::270-290::293 -312::315-338::78-100::618-711
MPVLRIHGYALAVSFCLIIFIAASQRTDPSEVNALIEIKKSLIDTDNNLKNWNKGDPCAANWTGVWCFDKKLDDGNFHVREIYLMTMNLSGSLSPQLGQLSHLEILDFMWNNLTGTIPKEIGNIRSLKLLLLNGNKLSGSLPDELGQLSNLNRFQVDENQLSGPIPESFANMTNVKHLHLNNNSFSGELPSTLSKLSNLMHLLVDNNNLSGHLPPEYSMLDGLAILQLDNNNFSGSEIPSAYANLTRLVKLSLRNCSLQGAIPDFSSIPKLTYLDLSWNQITGPIPSNKVADSMTTFDLSNNRLSGSIPHFLYPHLQKLSLANNLLSGSISANIWLNMSFSAKDKLTIDLQNNSFSDVLGNLNPPENVTLRLSGNPVCNNSNIQSIGQYCGPEADKAAQDSTNSTVCPVQSCPVDFFYEYAPSSPVPCFCAAPLRIGYRLKSPSFSYFAPYRTSFEDYITRSLDLDLYQLSIDSVAWEEGPRLRMYLKLFPSYNDSRSNMFNESEVRRIKGIYSSWHFPRTDFFGPCELLNFTLLGPYANLNIDSEKKNNSLGIKIAAGIAAAASALAISAIIIFLISRRNMKYQKIFRKRMSTNVSIKIDGMKTFTYKELAIATNKFNISTKVGQGGYGNVYKGILSDETFVAVKRAEKGSLQGQKEFLTEIELLSRLHHRNLVSLIGYCNEGEQMLVYEFMPNGTLRDWISGMKLLEFF

SEQ ID NO: 189137 - protein, 107 aa, Glycine max
  Coding DNA Sequence Number=SeqID_72359
MLNSKLNFGFKSSLFNEELKAGAGFGFCGGFHSGFPVEIFIVGVILWWFSFWFPVLLCGGCSGGVTTVGWLPWRCQRQQYHCGSSDDISYAYASGVREGNKYKLGKT

SEQ ID NO: 189138 - protein, 342 aa, Glycine max
  Coding DNA Sequence Number=SeqID_72360
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O80919; Match level="QueryCoverage=68%, HitCoverage=57%, E-value=6e-99, Identity=70%"; Hit description =Expressed protein
  Pfam annotation: Domain name=DUF231; Domain location=257-340; Score= -45.8; E_value=0.00068; Accession=PF03005.6; Description=Arabidopsis proteins of unknown function
MKLQKGGRDGAAGRGTMEEAKIKMAKTYQIVLAGSSWGVRNTFHSLVAILTTLVVITTIYLRQDGGHVSPKINASSSNSSSSSKCDLFSGKWVFDNESYPLYKEKECTFMSDQLACEKFGRKDLSYQNWRWQPHHCNLPRFNATALLERLRNRRLVFVGDSLNRGQWASMVCLVDSILPKTLKSMHSTANGSLNIFKAKDYNATIEHYWSPLLVESNSDDPVNHRVPERTVRVKAIEKHARYWTDADFLVFNTYLWWRRPVMNVLWGSFGDPDGVYKGVEMLRVYEMALRTWSDWLEVHVNRNKTHLFFVSMSPTHERYPQNNSIKHVCSLIHMKIGDTFEV

SEQ ID NO: 189139 - protein, 69 aa, Glycine max
  Coding DNA Sequence Number=SeqID_72361
  Gene Ontology: Mol. function=protein binding
  Homolog annotation: Hit_ID=Q1S5Q4; Match level="QueryCoverage=79%, HitCoverage=6%, E-value=1e-12, Identity=56%"; Hit description =Leucine-rich repeat
  Pfam annotation: Domain name=LRRNT_2; Domain location=13-52; Score =44.7; E_value=3.1e-10; Accession=PF08263.3; Description=Leucine rich repeat N-terminal domain
MTFHKGICSTSCNAKDQSALLIFKRGVVDRSNMLSSWSNEEDCCAWKGVQCDNMTGRVTRLDLNQENLE

SEQ ID NO: 189140 - protein, 598 aa, Glycine max
  Coding DNA Sequence Number=SeqID_72362
  Gene Ontology: Mol. function=metal ion transporter activity; Cellular component=membrane; Biological process=metal ion transport
  Homolog annotation: Hit_ID=Q72HZ0; Match level="QueryCoverage=36%, HitCoverage=86%, E-value=3e-45, Identity=48%"; Hit description =Putative divalent heavy-metal cations transporter
  Pfam annotation: Domain name=Zip; Domain location=79-356; Score=6.6; E_value=2.8e-06; Accession=PF02535.12; Description=ZIP Zinc transporter
MAPNLRLRLCVPLLFLLLSFLLNSNAELDHRVSHKVIAAPHKDVGTNVIDGTGVENAFNFENGNSVVGSRKGGSNKVSVSTVALFTLAMAAATGLGAVPFFFVELDPQWAGLCNGMAAGVMLAASFDLIQEGQEFGAGNWVVTGILAGGIFIWLCKKFLEQYGEVSMLDLKGADATKVVLVIGIMTLHSFGEGSGVGVSFAGSKGFTQGLLVTLAIAVHNIPEGLAVSMVLASRGVSPQNAMLWSIITSLPQPIVAVPSFICADAFSKFLPFCTGFAAGCMIWMVIAEVLPDAFKEASASQVASAATLSVAFMEALSTFFQNFSHDYNSEDASGFFVSLLFGLGPLLGGIILVVFALALRLQHALLMSTACGIAFVLGAWRPVQLILSSKLGFFPVLLLLGMGAAFIHVSSSGVLKVAASKKASVNDLPTLTGFPLSVHTLQSFISCGAVAFHALAEGLALGVAAPKAYGLGRHMVLPVSLHGLPRGAAVASCIFGATDSWLGSLATAAIIGFMGPISAIGAILTGIDYSGLDHIMVLACGGLIPSFGNVVKRALSLDKRKSTCGLIMGIGFATLCLTFTRLVCLHTPYCNSAPEAVR

SEQ ID NO: 189141 - protein, 158 aa, Glycine max
  Coding DNA Sequence Number=SeqID_72363
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=77%, HitCoverage=12%, E-value=9e-24, Identity=49%"; Hit description =Protein kinase; Adipokinetic hormone
MPGGYGNIYESILSDETFEAIKRTVEASLEGQDEILTKVNTARQSGTIYSIIDSRMGLYPSDCLDKFLTLALRCCQDNPEERPSMLDVVRELEDIIAMLPEPETLLSDIVSLDSSGNIAPPSFASTSASNVTREEQHMSSYVSGSDLVSDVIPTIVPR

SEQ ID NO: 189142 - protein, 711 aa, Glycine max
  Coding DNA Sequence Number=SeqID_72364
  Gene Ontology: Mol. function=binding; Cellular component =intracellular; Biological process=metabolic process
  Homolog annotation: Hit_ID=Q10MA5; Match level="QueryCoverage=99%, HitCoverage=86%, E-value=0.0, Identity=41%"; Hit description =Pentatricopeptide, putative
  Pfam annotation: Domain name=PPR; Domain location=118-152; Score =30.8; E_value=4.8e-06; Accession=PF01535.11; Description=PPR repeat
  Pfam annotation: Domain name=PPR; Domain location=180-214; Score =35.5; E_value=1.9e-07; Accession=PF01535.11; Description=PPR repeat
  Pfam annotation: Domain name=PPR; Domain location=242-276; Score =29.6; E_value=1.1e-05; Accession=PF01535.11; Description=PPR repeat
  Pfam annotation: Domain name=PPR; Domain location=304-338; Score =32.6; E_value=1.3e-06; Accession=PF01535.11; Description=PPR repeat
  Pfam annotation: Domain name=PPR; Domain location=405-439; Score =52.7; E_value=1.2e-12; Accession=PF01535.11; Description=PPR repeat
  Pfam annotation: Domain name=PPR; Domain location=440-474; Score =11.9; E_value=0.29; Accession=PF01535.11; Description=PPR repeat
  Pfam annotation: Domain name=PPR; Domain location=476-509; Score=5.6; E_value=1.6; Accession=PF01535.11; Description=PPR repeat
  Pfam annotation: Domain name=PPR; Domain location=56-90; Score=25.1; E_value=0.00024; Accession=PF01535.11; Description=PPR repeat
  Pfam module annotation: Pfam domain module=PPR::PPR::PPR::PPR::PPR::PP R::PPR::PPR; Domain location=118-152::180-214::242-276::304-338::405 -439::440-474::476-509::56-90
MGHSGRAILRRCMMLQVRLQCTTSSSYAIACYARNGQLDHARKVFDETPLPHRTVSSWNAMVAAYFEARQPREALLLFEKMPQRNTVSWNGLISGHIKNGMLSEARRVFDTMPDRNVVSWTSMVRGYVRNGDVAEAERLFWHMPHKNVVSWTVMLGGLLQEGRVDDARKLFDMMPEKDVVAVTNMIGGYCEEGRLDEARALFDEMPKRNVVTWTAMVSGYARNGKVDVARKLFEVMPERNEVSWTAMLLGYTHSGRMREASSLFDAMPVKPVVVCNEMIMGFGLNGEVDKARRVFKGMKERDNGTWSAMIKVYERKGYELEALGLFRRMQREGLALNFPSLISVLSVCVSLASLDHGKQVHAQLVRSEFDQDLYVASVLITMYVKCGNLVRAKQVFNRFPLKDVVMWNSMITGYSQHGLGEEALNVFHDMCSSGVPPDDVTFIGVLSACSYSGKVKEGLELFETMKCKYQVEPGIEHYACLVDLLGRADQVNEAMKLVEKMPMEPDAIVWGALLGACRTHMKLDLAEVAVEKLAQLEPKNAGPYVLLSNMYAYKGRWRDVEVLREKIKARSVTKLPGCSWIEVEKKVHMFTGGDSKGHPEQPIIMKMLEKLGGLLREAGYCPDGSFVLHDVDEEEKTHSLGYHSEKLAVAYGLLKVPEGMPIRVMKNLRVCGDCHSAIKLIAKVTGREIILRDANRFHHFKDGHCSCKDYW

SEQ ID NO: 189143 - protein, 850 aa, Glycine max
  Coding DNA Sequence Number=SeqID_72365
  Gene Ontology: Mol. function=protein binding; Cellular component =integral to membrane; Biological process=defense response to fungus
  Homolog annotation: Hit_ID=Q1S5Q4; Match level="QueryCoverage=96%, HitCoverage=95%, E-value=1e-165, Identity=39%"; Hit description =Leucine-rich repeat
  Pfam annotation: Domain name=LRRNT_2; Domain location=13-52; Score =44.7; E_value=3.1e-10; Accession=PF08263.3; Description=Leucine rich repeat N-terminal domain
  Pfam annotation: Domain name=LRR_1; Domain location=117-140; Score =5.1; E_value=31; Accession=PF00560.23; Description=Leucine Rich Repeat
  Pfam annotation: Domain name=LRR_1; Domain location=168-189; Score =6.1; E_value=20; Accession=PF00560.23; Description=Leucine Rich Repeat
  Pfam annotation: Domain name=LRR_1; Domain location=193-215; Score =12.8; E_value=1.1; Accession=PF00560.23; Description=Leucine Rich Repeat
  Pfam annotation: Domain name=LRR_1; Domain location=218-240; Score =13.4; E_value=0.81; Accession=PF00560.23; Description=Leucine Rich Repeat
  Pfam annotation: Domain name=LRR_1; Domain location=242-264; Score =13.8; E_value=0.65; Accession=PF00560.23; Description=Leucine Rich Repeat
  Pfam annotation: Domain name=LRR_1; Domain location=266-288; Score =12.1; E_value=1.6; Accession=PF00560.23; Description=Leucine Rich Repeat
  Pfam annotation: Domain name=LRR_1; Domain location=290-312; Score =2.4; E_value=1e+02; Accession=PF00560.23; Description=Leucine Rich Repeat
  Pfam annotation: Domain name=LRR_1; Domain location=361-383; Score =5.3; E_value=29; Accession=PF00560.23; Description=Leucine Rich Repeat
  Pfam annotation: Domain name=LRR_1; Domain location=385-407; Score =10.5; E_value=3.2; Accession=PF00560.23; Description=Leucine Rich Repeat
  Pfam annotation: Domain name=LRR_1; Domain location=452-475; Score =11.1; E_value=2.4; Accession=PF00560.23; Description=Leucine Rich Repeat
  Pfam annotation: Domain name=LRR_1; Domain location=481-502; Score =4.9; E_value=35; Accession=PF00560.23; Description=Leucine Rich Repeat
  Pfam annotation: Domain name=LRR_1; Domain location=505-527; Score =6.5; E_value=18; Accession=PF00560.23; Description=Leucine Rich Repeat
  Pfam annotation: Domain name=LRR_1; Domain location=529-551; Score =4.0; E_value=51; Accession=PF00560.23; Description=Leucine Rich Repeat
  Pfam annotation: Domain name=LRR_1; Domain location=553-572; Score =6.9; E_value=15; Accession=PF00560.23; Description=Leucine Rich Repeat
  Pfam annotation: Domain name=LRR_1; Domain location=575-597; Score =4.2; E_value=46; Accession=PF00560.23; Description=Leucine Rich Repeat
  Pfam annotation: Domain name=LRR_1; Domain location=599-620; Score =13.0; E_value=1.1; Accession=PF00560.23; Description=Leucine Rich Repeat
  Pfam annotation: Domain name=LRR_1; Domain location=653-675; Score =11.5; E_value=2; Accession=PF00560.23; Description=Leucine Rich Repeat
  Pfam annotation: Domain name=LRR_1; Domain location=677-699; Score =8.7; E_value=6.6; Accession=PF00560.23; Description=Leucine Rich Repeat
  Pfam annotation: Domain name=LRR_1; Domain location=701-723; Score =22.9; E_value=0.0011; Accession=PF00560.23; Description=Leucine Rich Repeat
  Pfam annotation: Domain name=LRR_1; Domain location=725-746; Score =8.8; E_value=6.4; Accession=PF00560.23; Description=Leucine Rich Repeat
  Pfam annotation: Domain name=LRR_1; Domain location=81-104; Score =7.2; E_value=13; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1; Domain location=...
  Pfam module annotation: Domain location=13-52::117-140::168-189::193 -215::218-240::242-264::266-288::290-312::361-383::385-407::452 -475::481-502::505-527::529-551::553-572::575-597::599-620::653 -675::677-699::701-723::725-746::81-104
MTFHKGICSTSCNAKDQSALLIFKRGVVDRSNMLSSWSNEEDCCAWKGVQCDNMTGRVTRLDLNQENLEGEINLSLLQIEFLTYLDLSLNAFTGLSLPSTLNQSLVTPSDTHANFSSLKYLDLSFNEDLHLDNLQWLSQLSSLKYLNLSLISLENETNWLQTMAMHPSLLELRLASCHLKNISPSVKFVNFTSLVTLDLSGNYFDSELPYWIFNLSNDISHIDLSFNTIQGQIPKSLLNLQNLKYLGLDNNEFTGPIPDWLGEHQHLQHLGLIENMFSGSIPSSLGNLTSLNQLTVSSDLLSGNLPNTIGQLFNLRRLYIGGSLSGVLSEKHFSKLFNLESLALNSNFAFDLDPNWIPPFQLHEISLRNTTLGPTIPEWLYTQRTLDILDISYSGISSINADRFWSFVSNIGAILLSHNAISADLTNVTLNSGYIFMSHNNFTGGIPRISTNVSIFDISSNSLSGPISPSLCPKLGREKSLLSYMDLSYNLLTGVVPDCWENWRGLLFLFLNSNKLGGEIPPSMGLLDGLIEMDLQKNNLFGKFSLDMSNFTSLVFINLGENNFSGVLPTKMPKSMQVMILRSNQFAGKIPPETCSLPSLSQLDLSQNKLSGSIPPCVYNITRMDGARAASHFQFSLDLFWKGRELRYEDTGLLKNLDFSTNNLSGEIPPELFSLTEVLFLNLSRNNLMGKIPSKIGGMKNLESLDLSNNHLSGEIPAAISNLSFLSFLNLSYNDFTGQIPLGTQLQSFEAWSYAGNPKLCGLPLTKNCSKEENYDKAKQGGANESQNTSLYLGMGVGFVVGLWGLWGSLVLNRAWRHKYFRLLDRILDWIYVFVALKINKFGELRASSR

SEQ ID NO: 189144 - protein, 688 aa, Glycine max
  Coding DNA Sequence Number=SeqID_72366
  Gene Ontology: Mol. function=protein binding; Cellular component =integral to membrane; Biological process=defense response to fungus
  Homolog annotation: Hit_ID=Q1S5Q4; Match level="QueryCoverage=96%, HitCoverage=75%, E-value=1e-112, Identity=35%"; Hit description =Leucine-rich repeat
  Pfam annotation: Domain name=LRR_1; Domain location=104-126; Score =12.1; E_value=1.6; Accession=PF00560.23; Description=Leucine Rich Repeat
  Pfam annotation: Domain name=LRR_1; Domain location=128-150; Score =2.4; E_value=1e+02; Accession=PF00560.23; Description=Leucine Rich Repeat
  Pfam annotation: Domain name=LRR_1; Domain location=199-221; Score =4.9; E_value=34; Accession=PF00560.23; Description=Leucine Rich Repeat
  Pfam annotation: Domain name=LRR_1; Domain location=223-245; Score =10.5; E_value=3.2; Accession=PF00560.23; Description=Leucine Rich Repeat
  Pfam annotation: Domain name=LRR_1; Domain location=290-313; Score =10.2; E_value=3.5; Accession=PF00560.23; Description=Leucine Rich Repeat
  Pfam annotation: Domain name=LRR_1; Domain location=31-53; Score =12.8; E_value=1.1; Accession=PF00560.23; Description=Leucine Rich Repeat
  Pfam annotation: Domain name=LRR_1; Domain location=319-340; Score =8.4; E_value=7.8; Accession=PF00560.23; Description=Leucine Rich Repeat
  Pfam annotation: Domain name=LRR_1; Domain location=343-365; Score =9.8; E_value=4.2; Accession=PF00560.23; Description=Leucine Rich Repeat
  Pfam annotation: Domain name=LRR_1; Domain location=367-389; Score =3.4; E_value=67; Accession=PF00560.23; Description=Leucine Rich Repeat
  Pfam annotation: Domain name=LRR_1; Domain location=391-410; Score =5.9; E_value=22; Accession=PF00560.23; Description=Leucine Rich Repeat
  Pfam annotation: Domain name=LRR_1; Domain location=413-435; Score =4.2; E_value=46; Accession=PF00560.23; Description=Leucine Rich Repeat
  Pfam annotation: Domain name=LRR_1; Domain location=437-458; Score =13.0; E_value=1.1; Accession=PF00560.23; Description=Leucine Rich Repeat
  Pfam annotation: Domain name=LRR_1; Domain location=491-513; Score =13.4; E_value=0.8; Accession=PF00560.23; Description=Leucine Rich Repeat
  Pfam annotation: Domain name=LRR_1; Domain location=515-537; Score =10.9; E_value=2.6; Accession=PF00560.23; Description=Leucine Rich Repeat
  Pfam annotation: Domain name=LRR_1; Domain location=539-561; Score =22.9; E_value=0.0011; Accession=PF00560.23; Description=Leucine Rich Repeat
  Pfam annotation: Domain name=LRR_1; Domain location=56-78; Score =13.4; E_value=0.81; Accession=PF00560.23; Description=Leucine Rich Repeat
  Pfam annotation: Domain name=LRR_1; Domain location=563-584; Score =9.8; E_value=4.1; Accession=PF00560.23; Description=Leucine Rich Repeat
  Pfam annotation: Domain name=LRR_1; Domain location=6-27; Score=6.1; E_value=20; Accession=PF00560.23; Description=Leucine Rich Repeat
  Pfam annotation: Domain name=LRR_1; Domain location=80-102; Score =13.8; E_value=0.65; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=104 -126::128-150::199-221::...
  Pfam module annotation: Domain location=223-245::290-313::31-53::319 -340::343-365::367-389::391-410::413-435::437-458::491-513::515 -537::539-561::56-78::563-584::6-27::80-102
MAMHPSLLELRLASCHLKNISPSVKFVNFTSLVTLDLSGNYFDSELPYWIFNLSNDISHIDLSFNTIQGQIPKSLLNLQNLKYLGLDNNEFTGPIPDWLGEHQHLQHLGLIENMFSGSIPSSLGNLTSLNQLTVSSDLLSGNLPNTIGQLFNLRRLHIGGSLSGVLSEKHFSKLFNLESLTLNSDFAFDLDPNWIPPFQLHEISLRNTILGPTIPEWLYTQRTLDILDISYSGISSINADRFWSFVSNIGTILLSHNAISADLTNVTLNSDYILMSHNNFTGGIPRISTNVSIFDVSSNSLSGPISPSLCPKLGREKSLLSYLDLSYNLLTGVVPDCWENWRGLLFLFLNSNKLSGEIPPSMGLLDGLIEMNLQKNNLFGKFSLDMSNFTSLVFINLGENNFSGVVPTKMPKSMQVMILRSNQFAGKIPPETCSLPSLSQLDLSQNKLSGSIPPCVYNITRMDGERRASHFQFSLDLFWKGRELQYKDTGLLKNLDLSTNNLSGEIPPELFSLTELLFLNLSRNNLMGKIPSKIGGMKNLESLDLSNNHLSGEIPAAISNLSFLSYLNLSYNDFTGQIPLGTQLQSFDARSYAGNPKLCGLPLTKNCSKEENYDKAKQGGANESQNKSLYLGMGVGFVVGLWGLWGSLFLNRAWRHKYFRLLDRILDWIYVFVALKINKFGELRASSR

SEQ ID NO: 189145 - protein, 417 aa, Glycine max
  Coding DNA Sequence Number=SeqID_72367
  Gene Ontology: Mol. function=oxidoreductase activity, acting on CH-OH group of donors; Cellular component=mitochondrial inner membrane; Biological process=alcohol metabolic process
  Homolog annotation: Hit_ID=Q9S746; Match level="QueryCoverage=98%, HitCoverage=71%, E-value=1e-162, Identity=66%"; Hit description =Protein HOTHEAD precursor
  Pfam annotation: Domain name=GMC_oxred_C; Domain location=268-416; Score=50.9; E_value=4.2e-12; Accession=PF05199.4; Description=GMC oxidoreductase
  Pfam annotation: Domain name=GMC_oxred_N; Domain location=1-199; Score=-34.0; E_value=1e-05; Accession=PF00732.10; Description=GMC oxidoreductase
  Pfam module annotation: Pfam domain module=GMC_oxred_C::GMC_oxred_N; Domain location=268-416::1-199
MEVVRFIRKVGWDTKLVNESYPWVEKQIVHRPKFSDWQRAVRDGLLAAGVSPFNGFTYDHKYGTKVGGTIFDRFGRRHTAAELLASANPHKLTVLIHATVQKIVFDTKGKRPKATGVIFKDENGKQHEAYLGNDRQSEVIVSSGALGTPQLLLLSGIGPKAELQKLNIPVVLDNQFVGKGMADNPMNTIFVPSKRPVQQSLIETVGITNLGVYIETSSGFGQSKDSIHCHHGILSAEIGQLSTIPPKQRSREAVKAYVKSKRDIPVEAFRGGSYCQKLRTLGQQDNPAVTFNYFSHPYDLKRCVEGIRLAIKVVQTEHVTNYTLCERENAEKMLNLSVKANINLIPKHPNDTKSVEQFCRDSVITIWHYHGGCHVGKVVNSEHKVLGVDRLRVVDGSTFSESPGTNPQATVMMMGRV

SEQ ID NO: 189146 - protein, 106 aa, Glycine max
  Coding DNA Sequence Number=SeqID_72368
MTLKNKIGLRKRQSSCYIVSKEELSGSRNQYKNEEGFELETLRITEDWINGSFAFDAGHAHKHAYIKDMERRDQWSRFEEDQEELAFEIETAILHSLIADLQDLDA

SEQ ID NO: 189147 - protein, 115 aa, Glycine max
  Coding DNA Sequence Number=SeqID_72369
  Gene Ontology: Mol. function=kinase activity; Cellular component =mitochondrion
  Homolog annotation: Hit_ID=Q10SM2; Match level="QueryCoverage=99%, HitCoverage=33%, E-value=2e-25, Identity=56%"; Hit description =Expressed protein
MGPLFANVVIEPCLLHGDLWSGNISSDINGEPIILDPACYLKQNLVCLGVLALEDHSIILTLRILVILVMPKQPGFERRDLYMLYHYLNHYNLFGSGYRSSAMPIIDDYLAFLKA

SEQ ID NO: 189148 - protein, 204 aa, Glycine max
  Coding DNA Sequence Number=SeqID_72370
  Gene Ontology: Mol. function=protein serine/threonine kinase activity; Cellular component=mitochondrion
  Homolog annotation: Hit_ID=Q10SM2; Match level="QueryCoverage=59%, HitCoverage=38%, E-value=2e-38, Identity=64%"; Hit description =Expressed protein
MQKKIMHKQPCVIGCSVTVGKGKEKRKEVDDECTRGSHVVFYMFLFTFSTSSTFFHQNQIITNSLLEFSMSMSMSKDPVREWILSEGKATEITKISPVGGVVSILLVASIPMLHIGPSMFEAEALGLGAMYETGTIRVPKPYKVGLLPTGGSFIIMEFIQFGASRGYQSDLGRKLAEMHKAGKSSKGFGFDVDNTIGRFNAPSS

SEQ ID NO: 189149 - protein, 236 aa, Glycine max
  Coding DNA Sequence Number=SeqID_72371
  Homolog annotation: Hit_ID=Q5W7C9; Match level="QueryCoverage=16%, HitCoverage=14%, E-value=6e-13, Identity=89%"; Hit description =Unknow protein
MQTSRWGPLYQKQEKPHPSLSTFTPSMSPPCDDIDGGEKSRQPCTTCVHVPEGTPLFQEDSRHVKPYSPVCLLPTRGFNSNSKGLPISGIPESTLIFNSPKHFVAYYALPHLWVPRLLPFRSPLLRESLLLSFPLATKMFQFTGLSLACPWIQHQFERLTYIGNLRIYASGVSNLIRSPSFRLSVSVSAQQSAFAVGVLSNLYAFHRSTRNSLTEKTCWACDISSTDRVAKEMRRG

SEQ ID NO: 189150 - protein, 72 aa, Glycine max
  Coding DNA Sequence Number=SeqID_72372
MVVSIVRFTISIARFDRIPAATDANRSIKDHDDIVTVTNGLESTFALPDAVAAYTDALYPYSTPALLIDSKA

SEQ ID NO: 189151 - protein, 64 aa, Glycine max
  Coding DNA Sequence Number=SeqID_72373
MVKICSSSGQSLSLRVHLDFGALDVQELKDFWKQEKIQPFCPYKKNGKSASTNSRSSWMNVKRF

SEQ ID NO: 189152 - protein, 67 aa, Glycine max
  Coding DNA Sequence Number=SeqID_72374
MTCQTAELNIFALGAMTQLVRFALTVCKSEKVLLFNSMAAAEPREARTEELNRKHKGNQPRATGGHP

SEQ ID NO: 189153 - protein, 136 aa, Glycine max
  Coding DNA Sequence Number=SeqID_72375
MVEPKYMLVVESFSSSMMNLKWCGRAVVDGAGAGAAAFKFQLIGEEDGCCDLKTGEPTFSREVYRRDSIELCVHFILGNDLEGESAILLGMLEDALEGGSAILSGTPEGDSDGGNAILEWLLILEWCRYVATEFEI

SEQ ID NO: 189154 - protein, 78 aa, Glycine max
  Coding DNA Sequence Number=SeqID_72376
MVEGYGSCAMFTSIIALPVVVVVVVVLRHPLPNVESLGVIENFFAEYGVQIALRKIFRAMKEAKELVEGSEKEQYGRV

SEQ ID NO: 189155 - protein, 400 aa, Glycine max
  Coding DNA Sequence Number=SeqID_72377
  Gene Ontology: Mol. function=beta-galactosidase activity; Cellular component=beta-galactosidase complex; Biological process =carbohydrate metabolic process
  Homolog annotation: Hit_ID=Q9SSM8; Match level="QueryCoverage=97%, HitCoverage=58%, E-value=1e-94, Identity=51%"; Hit description =Similar to acid beta-galactosidase
  Pfam annotation: Domain name=Glyco_hydro_35; Domain location=3-167; Score=-39.1; E_value=9.4e-13; Accession=PF01301.10; Description =Glycosyl hydrolases family 35
MEAPGKLLRKEPFVGIPSFQGGFSKYLGAYQLGCLLILCAAVDFGTGEDPWPIFKLQKEFNAPGKSPPLSAEFYTGWLTHWGEKNAQTDADFTAAALEKILQKNGSAVLYMAHGGTNFGFYNGANTGVDEADYKPDLTSYDYDAPIRESGDVDNSKFNAIRRVIARYSSVPLPSIPSNNEKARYGPIHLQREAFVFDMFDFTNSTNVFKSETPMSMEYVGQVENMGRVNYGSFIFDRKGILSSVYLDKEQVKGWKMFPIPLHNLNEMSTYNPITQVAYSAFSGISSFRKKLIYKNGNTSKEPAFYSGHFLIDKSSQVKDTFISFNNWGKGIVFVNDFNIGRYWPLRGPQCNLYVPAPLLKQGDNFLVILELESPDPELVVHTVDEPDFTCGSSGTSLHQL

SEQ ID NO: 189156 - protein, 108 aa, Glycine max
  Coding DNA Sequence Number=SeqID_72378
MASLTNIGLLYKHDKAPQAHQCHPHFRADKDSQHLYSITSILRDCKFLMTEHSVNLLLVVNRNANRVADYLARLAFKFVDKFWLHDFPAPVLQLADIDVMPDGNSVSE

SEQ ID NO: 189157 - protein, 135 aa, Glycine max
  Coding DNA Sequence Number=SeqID_72379
MRRKEESMKHKKLRRQVHDNIEVAHIPEINDSPIPRSKRRVVEFNVENRMKTLQVTIDNEGWSKSRIIKPSANNKVGQRCLNQKAVQDKANTQFWGLTRTHKKRLQRSKAMNKMKQSLAVIANLKARRQGENSLS

SEQ ID NO: 189158 - protein, 117 aa, Glycine max
  Coding DNA Sequence Number=SeqID_72380
  Gene Ontology: Mol. function=RNA-directed DNA polymerase activity; Biological process=RNA-dependent DNA replication
ALISDNGDLVIDQEEIVRVAQNHFRQLFLDDGEWRPWDMPNMFPVLEGTDNVVIAQEVFHAMKSKKGRQWFMAIKEDLEKVYDRLNWQFLMDTLRDVGFEEHFCKWILACGSSLGHY

SEQ ID NO: 189159 - protein, 204 aa, Glycine max
  Coding DNA Sequence Number=SeqID_72381
MDPLADLEAKAVQSANWGSILLARDLFCGVKPTSKANKIYVEPHDPQFVARQFGLTQHLHMAFLTMTSPKSRLLLSTKKKFDQAKQTLFAPPIPSTSAAPSTTIPQVEIMDYIVEVSAGISSAQVVVVAPNIAIVSYPSFVRGLLFDGMQPLVHRFEDVPPEGGCFWRKQPGSPRRAELVWASWIFNRSSSFVIRSSSFFGLQP

SEQ ID NO: 189160 - protein, 115 aa, Glycine max
  Coding DNA Sequence Number=SeqID_72382
MKGRIEGFFSTESLRWILRISLRLKRSSWCGGSAVTNDGSWWPPVVVEEAHLAKWESTFGAKRNNSHSMQFPLGLEFALSATIRIERNLSCAKRNNSRSAQFPLRLELCLVRFSC

SEQ ID NO: 189161 - protein, 571 aa, Glycine max
  Coding DNA Sequence Number=SeqID_72383
  Gene Ontology: Mol. function=hydrolase activity, hydrolyzing O -glycosyl compounds; Cellular component=apoplast; Biological process =carbohydrate metabolic process
  Homolog annotation: Hit_ID=Q2HVE4; Match level="QueryCoverage=97%, HitCoverage=97%, E-value=0.0, Identity=84%"; Hit description =Sialidase
  Pfam annotation: Domain name=Glyco_hydro_32C; Domain location=410 -525; Score=181.2; E_value=2.5e-51; Accession=PF08244.2; Description =Glycosyl hydrolases family 32 C termi
  Pfam annotation: Domain name=Glyco_hydro_32N; Domain location=50-369; Score=608.3; E_value=6.8e-180; Accession=PF00251.10; Description =Glycosyl hydrolases family 32 N termi
  Pfam module annotation: Pfam domain module=Glyco_hydro_32C::Glyco _hydro_32N; Domain location=410-525::50-369
MAISPILLLAILSLIYGNGVLPIEATHHVYRNLQTLSSDSSDQPYRTAYHFQPRKNWINGPMRYKGLYHLFYQYNPKGAVWGNIVWAHSISNDLVNWTPLDHAIYPSQPSDINGCWSGSATILPRGKPAILYTGINPNKHQVQNLAIPKNMSDPLLREWVKSPKNPLMAPTISNNINSSSFRDPTTAWLGKDGYWRVLIGSKIHTRGMAILYKSKNFVNWVQAKQPLHSAEGTGMWECPDFYPVLDNKGPSTIGLDTSVNGDNVRHVLKVSLDDTKHDHYLIGTYDIAKDIFTPDNGFEDSQTVLRYDYGKYYASKTIFEDGKNRRVLLGWVNESSSVPDDIKKGWAGIHTIPRAIWLHKSGKQLVQWPVVELESLRVNPVHWPTKVVKGGEMLQVTGVTAAQADVEISFEVNEFGKAEVLDKWVDPQILCSRKGAAVKGGLGPFGLLVFASRGLQEYTAVFFRIFRYQNKNLVLMCSDQSRSSLNKDNDMTTYGTFVDMDPLHEKLSLRTLIDRSVVESFGGEGMACITARVYPTIAINKKAQLYVFNNGTAAVKITRLSAWSMKKAKIN

SEQ ID NO: 189162 - protein, 99 aa, Glycine max
  Coding DNA Sequence Number=SeqID_72384
MGKTSDEEDVVDAIILLMQMMKQSLLSEVNLSYHYQYMNRNKHKLNDRLGMMRHVTTPDFKLRTALPSASHCSSVLTSHNLKQSPWRRWHHAPPPKLEI

SEQ ID NO: 189163 - protein, 236 aa, Glycine max
  Coding DNA Sequence Number=SeqID_72385
  Gene Ontology: Mol. function=protein binding; Cellular component =nucleus; Biological process=nucleosome assembly
  Homolog annotation: Hit_ID=Q2HVE3; Match level="QueryCoverage=72%, HitCoverage=45%, E-value=3e-67, Identity=73%"; Hit description =Nucleosome assembly protein
  Pfam annotation: Domain name=NAP; Domain location=1-171; Score=227.4; E_value=3.1e-65; Accession=PF00956.9; Description=Nucleosome assembly protein (NAP)
MKTNETLAEEVVEFITERDEGALKYLKDIKWCRIDDPKGFKLDFYFDSNPYFKNSVLTKTYHMIDDDDPILEKAIGTEIEWHPGKCLTQKVLKKKPRKGSKNAKPITKTEKCESFFNFFNPPEVPEDDDDIDEDAVEELQNLMERDYDIGSTIRDKIIPHAVSWFTGEAAQSDFEDIDEVDYDDEEGDEDEDEDEDEEEEEEEEEEKKGKSRSKSGGRVKPGKDQPTERPPECKQQ

SEQ ID NO: 189164 - protein, 83 aa, Glycine max
  Coding DNA Sequence Number=SeqID_72386
MTVIVIAVDTTVITTIIVIVTPVVAISSGYDSNNNHVGNCNGGHGSDTDDDKGYDTRGGGGGCINSHGGDTYNHDGDELIDIL

SEQ ID NO: 189165 - protein, 683 aa, Glycine max
  Coding DNA Sequence Number=SeqID_72387
  Gene Ontology: Mol. function=protein binding; Cellular component =membrane; Biological process=defense response
  Homolog annotation: Hit_ID=Q2HVD9; Match level="QueryCoverage=46%, HitCoverage=94%, E-value=1e-142, Identity=82%"; Hit description =Hydroxyacid dehydrogenase/reductase; 6-phosphogluconate dehydrogenase, C-terminal-like
  Pfam annotation: Domain name=F420_oxidored; Domain location=64-233; Score=-54.0; E_value=0.077; Accession=PF03807.7; Description=NADP oxidoreductase coenzyme F420-dependent
  Pfam annotation: Domain name=LRR_1; Domain location=338-360; Score =11.0; E_value=2.5; Accession=PF00560.23; Description=Leucine Rich Repeat
  Pfam annotation: Domain name=LRR_1; Domain location=362-383; Score =8.7; E_value=6.8; Accession=PF00560.23; Description=Leucine Rich Repeat
  Pfam annotation: Domain name=LRR_1; Domain location=385-406; Score =13.1; E_value=1; Accession=PF00560.23; Description=Leucine Rich Repeat
  Pfam annotation: Domain name=LRR_1; Domain location=593-610; Score =3.1; E_value=75; Accession=PF00560.23; Description=Leucine Rich Repeat
  Pfam annotation: Domain name=NAD_binding_2; Domain location=62-224; Score=191.9; E_value=1.5e-54; Accession=PF03446.5; Description=NAD binding domain of 6-phosphogluconate dehydrogenase
  Pfam annotation: Domain name=Shikimate_DH; Domain location=43-165; Score=-23.0; E_value=0.033; Accession=PF01488.10; Description =Shikimate  quinate 5-dehydrogenase
  Pfam module annotation: Pfam domain module=F420_oxidored::LRR_1::LRR _1::LRR_1::LRR_1::NAD_binding_2::Shikimate_DH; Domain location=64 -233::338-360::362-383::385-406::593-610::62-224::43-165
MDSMYLILVVRVEGDKSEVQSVLMRSTFCCHLNLSPVMIMKGFSAPISSYVSPRAQAVTEPPARIGFLGLGIMGSPMAHNLLKAGVDLTVWNRTKSKCDPLISLGAKYKPSPEEVAASCDVTFAMLADPQSAVDVACGKHGAANGMGPGKGYVDVSTVDGDTSKLINGHMKSTGALFLEAPVSGSKKPAEDGQLIFLTAGDKNLYEAVGSLLDIMGKSKFYLGDVGNGAAMKLVVNMIMGSMMASFSEGLLLSEKVGLDPDVLVQGAISAPMYSTKGPSMIQSLYPTAFPLKHQQKDLRLALGLAESVSQPTPIASAANELYKVAKSNGLSDQDFSASLETLKLEECRNLFEIPDNINLLSSLRELLLKGTDIESVSASIKHLSKLEKLDLSDCRRLYSLPELPQSIKELYAINCSSLETVMFTLSAVEMLHAYKLHTTFQNCVKLDQHSLSAIGVNAYVNIKKVAYDQFSTIGTNSIKFLGGPVDFIYPGSEVPEWFVYRTTQASVTVDLSSSVPCSKIMGFIFCVIVDQFTSNDNYIGCDCYMETGVGERVTRGHMDNWSSIHACEFFSDHVCLWYDEKCCLKNQECESESIEELMASYNPKISFEFFAKTGSIWEKRIDIMVNGCGVCPVYDTECDNFFKQMELELEMTLQSMATKMSSKEATLAPKQVNLPFLDMYSIG

SEQ ID NO: 189166 - protein, 47 aa, Glycine max
  Coding DNA Sequence Number=SeqID_72388
MDGSRPIFDSIEMPPKKLLTKRARKDAIGEGSNAAPQAEIEFDGHRF

SEQ ID NO: 189167 - protein, 378 aa, Glycine max
  Coding DNA Sequence Number=SeqID_72389
  Homolog annotation: Hit_ID=Q41440; Match level="QueryCoverage=37%, HitCoverage=28%, E-value=4e-49, Identity=70%"; Hit description =Mitochondrial processing peptidase
  Subcellular localization annotation: CTP_CleavageSite=20; ConfidenceScore=5.34e-01
MLAPQRFLYTFSHVLPLYSSLSTFKSRAFIFLPLVHSYYTLTPSILLSPMPHWFLFNCSSRIPASARFASSVATQQSSSGLGGLFGWLTGDRSSSLPSLDFPLLGVTLPPSLPNFVAPGKTIITTLPNGLKVASETSPVNEQLLKVKAEIGEASKNLQDLLLEAIHSAGFSGALANPLLASESALNRLNGTILEEFVTENYTAPRIVLATSGVEHEELLFAAEPLLSDLPSVPRLEEPKSVYTGGDYRCQSESGRTHFALAVELPGDWHKLKDVMVLTILGFDNVLHFLAFLHLKSPFLLLRWLKIYQSMDCMSSWFLKMLLGGGGSFSAGGPSKGMYSRLCRPSSIEMDEVDFIAPTSQGRSVHVSDELLVKKLMRF

SEQ ID NO: 189168 - protein, 245 aa, Glycine max
  Coding DNA Sequence Number=SeqID_72390
  Gene Ontology: Mol. function=nucleic acid binding; Cellular component= ribonucleoprotein complex; Biological process=mRNA processing
  Homolog annotation: Hit_ID=Q6YVH3; Match level="QueryCoverage=99%, HitCoverage=86%, E-value=1e-41, Identity=39%"; Hit description =Putative heterogeneous nuclearribonucleoprotein A2
  Pfam annotation: Domain name=RRM_1; Domain location=23-94; Score =91.4; E_value=2.8e-24; Accession=PF00076.12; Description=RNA recognition motif. (a.k.a. RRM, R
VEVKRTVPREDVDVTGVFKTKKIFVGGIAQFFTDDELREYFSPYGNVIECQIMLDHNTGRSRGFGFVTFDDEDSVEKVFSVGKIHEIGGKQVEIKRAEPKRSGVDYCNTSRKSYGGFGNEMDGHGGNSSRNRNHGKRGGQYTGSGMNGAYGHFDGSFGGSAATVYGGYCGYGYEFGYGGPMYCFGGYGLNSYGNPGGYGSGITSYGDVNAYGRAGSFNGSGGYDSSKVAEKGDGPTTGRYHPYWK

SEQ ID NO: 189169 - protein, 181 aa, Glycine max
  Coding DNA Sequence Number=SeqID_72391
  Gene Ontology: Mol. function=structural molecule activity; Cellular component=coated vesicle membrane; Biological process=intracellular protein transport
  Homolog annotation: Hit_ID=Q9MAZ9; Match level="QueryCoverage=99%, HitCoverage=100%, E-value=2e-79, Identity=82%"; Hit description =Nonclathrin coat protein zeta1-COP
  Pfam annotation: Domain name=Clat_adaptor_s; Domain location=9-153; Score=37.6; E_value=2.3e-10; Accession=PF01217.10; Description =Clathrin adaptor complex small chain
MASYGSCPSIKNILLLDSEGKRVAVKYFSDDWPTNNSKIAFEKFVFSKTVKTNARTEAEITLLDNNIIIYKFVQDLHFFVTGGDDANEIILASVLQGFFDAITLLLRNNVDKREALENLDLILLCLDEIVDGGMILETNGPLIAEKVTSHSMDGAESPLSEQTLTQAWATAREHLTRTLLK

SEQ ID NO: 189170 - protein, 508 aa, Glycine max
  Coding DNA Sequence Number=SeqID_72392
  Gene Ontology: Mol. function=nucleic acid binding; Biological process= metabolic process
  Homolog annotation: Hit_ID=Q2HVD1; Match level="QueryCoverage=91%, HitCoverage=95%, E-value=1e-153, Identity=60%"; Hit description=IQ calmodulin-binding region
MGMFTVSKEGEVTVNFKNNINLNDFYKPEQSTNLKRRKVGNLKLQTTFSFKHLLSENCGSQEEVEEDLFNKRSPTVMSQKQELMFSPTSSAQLDLAALMVQKVYKSYRIRRILADCVVVCEELRWKDSVITAFNRRSISNFDSDKSETAISKWARARMMVAKVGKGLSKDDKAQKLALRHWLEAIDPRHRYGHNLHFYYLVWFHSQSYQPFFYWLDVGGGKEVNLEECPRSQLQRQCIKYLGPEEREAYEVIVEGGRLVYRQSKDLVHTTEDSKWIFVLSTSRILYVGQKKKGHFQHSSFLAGGATIASGRLVAQNGVLHAIWPYSGHYRPTEKNFMEFTSFLEEHKVNMTNVKRDPIDEDVPPSNPVNEELPFEHMEGNVGARATANNCGKENVCQFGTNVEENKPMSSIWSTGVGPRIGCMREYPANFQVLALELLNLSPRVNDETFAGKAPIPSPRPSTKHMSLVSMGLPSPMVHVSPLQGLWTFKCIGIALVLAFKNLDNWYII

SEQ ID NO: 189171 - protein, 128 aa, Glycine max
  Coding DNA Sequence Number=SeqID_72393
  Homolog annotation: Hit_ID=Q1PEY6; Match level="QueryCoverage=43%, HitCoverage=32%, E-value=6e-08, Identity=47%"; Hit description =Allergen-like
MKATFCFFLLALLIVSWESAVVVARRPFPSTDGMCHPGPKAAPGPGPVSSPSNTVESEKGLMEEAYSYRVSKIGSSPPSCEHKCYGCTPCEAIQVPSTSSWRSHLGLQYTNYEPESWKCKCGPSLYSP

SEQ ID NO: 189172 - protein, 69 aa, Glycine max
  Coding DNA Sequence Number=SeqID_72394
MDNCDGVVSSEVVVAFCGVVLIYSNGKFIKVFFRRFGFCSVLEAELWASAKRNTHGLSARKNPEEDELY

SEQ ID NO: 189173 - protein, 296 aa, Glycine max
  Coding DNA Sequence Number=SeqID_72395
  Gene Ontology: Mol. function=nucleic acid binding; Cellular component= intracellular; Biological process=regulation of transcription
  Homolog annotation: Hit_ID=Q39262; Match level="QueryCoverage=70%, HitCoverage=85%, E-value=3e-31, Identity=41%"; Hit description=Zinc finger protein 3
  Pfam annotation: Domain name=zf-C2H2; Domain location=125-147; Score =19.7; E_value=0.01; Accession=PF00096.16; Description=Zinc finger, C2H2 type
MEGLSMKEPYFCDRPSSTRIFSSSDPPEAPPSPSTPLQHSHEKKKQLCVEEEEELEKEPKQHVSVTLLDLNIISGEDDNSCTPEGPELNLITCLDVGSSSNNANSSSETTTPLGGSSDHTEPRVFSCNYCHRKFYSSQALGGHQNAHKRERSIAKRGHRFGSQIMAFGLPLLHHNNNIRFASMASLPLYHSNRGTLGIQAHSMIQKPSSSHLHVNGFGGSYAHHHGWSRPIIDQQPGIAKLAAPDFHHRTKSALSSSQSSVATNNEIGGCVAIGGTRLKSTTNQEEMKHLDLSLKL

SEQ ID NO: 189174 - protein, 412 aa, Glycine max
  Coding DNA Sequence Number=SeqID_72396
  Homolog annotation: Hit_ID=Q2HVD0; Match level="QueryCoverage=98%, HitCoverage=99%, E-value=1e-111, Identity=58%"; Hit description=IQ calmodulin-binding region
  Pfam annotation: Domain name=IQ; Domain location=100-120; Score=18.3; E_value=0.027; Accession=PF00612.17; Description=IQ calmodulin -binding motif
  Pfam annotation: Domain name=IQ; Domain location=126-146; Score=4.0; E_value=15; Accession=PF00612.17; Description=IQ calmodulin-binding motif
  Pfam annotation: Domain name=IQ; Domain location=78-98; Score=27.8; E_ value=3.9e-05; Accession=PF00612.17; Description=IQ calmodulin -binding motif
  Pfam module annotation: Pfam domain module=IQ::IQ::IQ; Domain location=100-120::126-146::78-98
MGASGRWFKSLLPFRKTSTDQEKGGDNKSKKKRKLWRASSEGSMKNVGGGGAAAASDSSLTYAVAVMVPKDFKLIKQEWAAIRIQAVFRAFLARRALRALRAVVRLQAIFRGRLVRKQAAVTLRCMQALVRVQARVRARNVRNSPEGKAVQKLLDEHHNHADPFNLIEQGWCDIPGTMDEVKAKLRMRQEGAIKRDRAMAYSLSTQSRLCASPNPKATKALTPVKHNNPSNKSLGYSLLERWMEAKPWESPISRKSEDLVPAFQSRRNGMTTRISVKPIITSQSTSPSSAMSSEYMCDDNSPVSTSYTSGSLSLPSTNTVLVEATEERDVHQPSYMNLTESTKAKLKACRSSSQNSKRLVMEDTVSHNHSTTTGLMNGDTRSSFDSDPSVNLWKDSCATPLRASYQKRQIRI

SEQ ID NO: 189175 - protein, 65 aa, Glycine max
  Coding DNA Sequence Number=SeqID_72397
  Gene Ontology: Mol. function=catalytic activity; Biological process =metabolic process
MLISTSIVLHVPLRLHPIDAPRAWTVFLEKENHRREGRVTSSRTGFRELLGERDDECYKENTRRF

SEQ ID NO: 189176 - protein, 62 aa, Glycine max
  Coding DNA Sequence Number=SeqID_72398
MLRVRGLNNRKWMSEYTEVVNLMWGAVYHCGPVRGRGAHPVNRCTSIYADEESFSTGLVGDT

SEQ ID NO: 189177 - protein, 66 aa, Glycine max
  Coding DNA Sequence Number=SeqID_72399
MRKGWLWWRLPEEGVPEDFRKKGSSRSTERSSGRTGLPEIFWNTSFGNFLEEVVLLESFRKKGFSG

SEQ ID NO: 189178 - protein, 61 aa, Glycine max
  Coding DNA Sequence Number=SeqID_72400
MASKRKQAAGLVEKKTQEARGRGKRSSSKEEVSECSSIPTLSTWDAPCPQLSSLLLKDCLG

SEQ ID NO: 189179 - protein, 137 aa, Glycine max
  Coding DNA Sequence Number=SeqID_72401
  Homolog annotation: Hit_ID=Q1S9T4; Match level="QueryCoverage=28%, HitCoverage=3%, E-value=4e-09, Identity=69%"; Hit description =Integrase, catalytic region
MGFVGRGDMEVEVDVWRLKSLRGGGVGSDVGDGDDMIVGNDGFGGDVMDGADAVVGWSTIGIGWKEGDERIAKTSKDTKWPCVVHDATLMEVKRHGQEGELKIVAPGCPKRLCHNSVDNAAKVDGGKVVLGGLVAMG

SEQ ID NO: 189180 - protein, 981 aa, Glycine max
  Coding DNA Sequence Number=SeqID_72402
  Gene Ontology: Mol. function=DNA binding; Cellular component =chromatin; Biological process=DNA integration
  Homolog annotation: Hit_ID=Q1RSZ9; Match level="QueryCoverage=99%, HitCoverage=72%, E-value=0.0, Identity=63%"; Hit description =Polynucleotidyl transferase, Ribonuclease H fold
  Pfam annotation: Domain name=rve; Domain location=119-259; Score =10.0; E_value=0.00087; Accession=PF00665.16; Description=Integrase core domain
  Pfam module annotation: Pfam domain module=RVT_2::rve; Domain location=482-738::119-259
MDTGATSHMTANGGNLTSYFNLSNNITVGSGQNIPVIGCGHASLPNSLHPLKLPNVLHAPKLIKNLISVRKFTIDNDVSVEFDPFGFSVKNFQTGILLMRCNSSGDLYPIATRPPNTTLPPSTFAALSTELWHNRLGHPGATILSSLHRDNFLQLTSGLHQFSVQRVIVTMCCFLTITQISYGLFQFIQNLRFSCPHTSSQNGKAERKIRTINNIIRTLLAHASLPPSMWHHALHMATYLHNILPNKKFSLQSPTKILYQKDPAYTHLRVFGCLCYPLIPSSSRNKLQARSTPCVFLGYPSNHRGYKCYDLSSRKIFISRHVIFDETKLPFSNLNVPTTVGYNFLDDDTPFLPSYSYSAPPSNHQTTPVQTNIYQPSPSSFNSPLSPSHNHTSPTTASAPSITSPPNPSLPTIISSPSPTSLPTPPPSQQKPPLSPQMTTRAQHGIVKPRKLFNLHTSTSTSISPLPTNPIDALNDQNWKMAMKDEYDALIENKTWDLVPRPSNANVIRSLWIFRHKKKSDGSFERYKARLVGNGANQQTGVDCGDTFSPVVKPATIRTVLSVALSKSWCLHQLDVKNAFLHGNLHETVYMHQPPGFRNSQFPDHVCLLKKSLYGLKQAPRAWYQRFTDYVATMGFSHSISDHSLFIYHHGNDIAYILLYVDDIILAASSDTLRESIMAQLSSEFSMKDLGPLSYFLGISVTRHPEGLFLSQKKYAEYIIERAGMSSCKPSSTPVDTKAKLSGSSGNPYHDPTEYRSLAGALQYLTFTRPDISYAVQQVCLFMHDPKTQHMSALKRIIRYINGTIDFGLHLYPSSIDKLISYTDADWAGCPDTRRSTSGYCVYLGDNLISWSAKRQHTLSRSSAEAEYRGVANVVSESCWLRNLLLELCCPVTKATLVYCDNISAVYLSDNPVQHQRTKHIEMDIHFVREKVACGQVRVLHIPSRFQIADIFTKGLPLQLFDDFRDSLNIRSPPVSTTGVY

SEQ ID NO: 189181 - protein, 229 aa, Glycine max
  Coding DNA Sequence Number=SeqID_72403
  Gene Ontology: Mol. function=hydrolase activity
  Homolog annotation: Hit_ID=Q9LEV0; Match level="QueryCoverage=86%, HitCoverage=29%, E-value=2e-28, Identity=41%"; Hit description =Serine/threonine protein phosphatase-like protein
MPVIVQDGLHLIIRSHEGPDARAGRDDDFGDMLSGYSIDHDGESGRLYTLFSAPDYPQFGKRRYNNKGAYAVLKSPDFASPSFHSFKAAERPMVDPYFDFDANYMESSKLDSSQSASTSTLSAPQRFYSDGMRPEFDFGALGIYNAPGWRVELPDGSGGTQAVEVPRAPLAEGLPLPPNIQEPHKAAYEYLFELVAGLKHMIVTRETENRAPVSALRSRTRKREGKGNS

SEQ ID NO: 189182 - protein, 358 aa, Glycine max
  Coding DNA Sequence Number=SeqID_72404
  Gene Ontology: Mol. function=hydrolase activity; Cellular component =cytoplasm; Biological process=protein amino acid dephosphorylation
  Homolog annotation: Hit_ID=Q1SSN3; Match level="QueryCoverage=89%, HitCoverage=73%, E-value=1e-131, Identity=74%"; Hit description =Serine/threonine-specific protein phosphatase and bis(5-nucleosyl)- tetraphosphatase
  Pfam annotation: Domain name=Metallophos; Domain location=258-355; Score=20.6; E_value=0.0058; Accession=PF00149.18; Description =Calcineurin-like phosphoesterase
MDPRKERIKNGCLKILEGINSMSLVNLDDQQVHSLVMMREIARGVVDDRDRKVTKSDVITALRHSIEKMVCASRDIIQILSRMSFEGLDDQSMHLVMRMKEIANGVIDKQPRVAITRPDLLAEQVGFVDEGMRDSPVVESTKISNGYVPIGGAQSMTNEDEMLDVEHVLRFENGIDEVHESLLPCFQQFLLWPPDDCVTLEWVQDMMVILEQASQKMLPSEFCHIVPAILVDKLADAACSILCKEPNCVEINCQGEDSRVIVLGDIHGQFHDLMFIFKHEGVPSENQIYVFNGNCVHKGAWGIEVFLVLLAWKVLMAHRVYLLRGNHESRYCTARYGFKKEVWAKSGDQGEDVYNEFL

SEQ ID NO: 189183 - protein, 73 aa, Glycine max
  Coding DNA Sequence Number=SeqID_72405
MCKRLIIKINKLPLLKSIVVVGVELSHSGNKKLLDKSVVTLGELPRVPTKPMMNNNVVDFGIRTKAFHFVDPR

SEQ ID NO: 189184 - protein, 58 aa, Glycine max
  Coding DNA Sequence Number=SeqID_72406
MGIYANSALKAFVEMVHNGIRGSILGSTLSLKLKENNESHAICYNVLLVVEVKYGTVL

SEQ ID NO: 189185 - protein, 430 aa, Glycine max
  Coding DNA Sequence Number=SeqID_72407
  Gene Ontology: Mol. function=protein serine/threonine kinase activity; Cellular component=cytoplasm; Biological process=protein amino acid phosphorylation
  Homolog annotation: Hit_ID=Q1SRR9; Match level="QueryCoverage=99%, HitCoverage=100%, E-value=0.0, Identity=72%"; Hit description =Protein kinase
  Pfam annotation: Domain name=Pkinase; Domain location=9-231; Score =58.8; E_value=1.8e-14; Accession=PF00069.15; Description=Protein kinase domain
  Pfam annotation: Domain name=Pkinase_Tyr; Domain location=9-231; Score=-109.1; E_value=8.9e-06; Accession=PF07714.7; Description =Protein tyrosine kinase
  Pfam module annotation: Pfam domain module=Pkinase::Pkinase_Tyr; Domain location=9-231::9-231
MEPRVANKFRLGRKIGSGSFGEIYLGTNTQTNEEVAVKLENVKTKHPQLLYESKLYKILQGGTGIPNVRWFGVEGDYNVLVMDLLGPSLEDLFNFCTRKLSLKTVLMLADQMINRVEFIHSKSFLHRDIKPDNFLMGLGRRANQVYAIDFGLAKKHRDTSTHQHIPYSLPWQGLKAGTKKQKYERISEKKVSTSIESLCRSYPSEFASYFHYCRSLQFDDKPDYAYLKRLFRDLFIREGFQFDYVFDWTILKYQQSQIATPPARAIGPAAGPSSGLPPAVVNADRQTGGENSRHTGWSSSDPARRRNSGPIANDGMLSRQKAPFPSDSTRSKDVMLSSSNFRSSGSTRRGVVSSSRDATVGNETEPSHPLTVDASQGALRKISGAQRSSPIMPFEHNRTSSGRNTSNMKNYESTIRGIETLNFNDERLQY

SEQ ID NO: 189186 - protein, 939 aa, Glycine max
  Coding DNA Sequence Number=SeqID_72408
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1SSN5; Match level="QueryCoverage=95%, HitCoverage=73%, E-value=0.0, Identity=86%"; Hit description=ATPase, E1-E2 type
  Pfam annotation: Domain name=Hydrolase; Domain location=419-903; Score=15.7; E_value=0.0024; Accession=PF00702.16; Description =haloacid dehalogenase-like hydrolase
  Pfam annotation: Domain name=Hydrolase_3; Domain location=665-914; Score=-84.9; E_value=0.034; Accession=PF08282.2; Description =haloacid dehalogenase-like hydrolase
  Pfam module annotation: Pfam domain module=Hydrolase::Hydrolase_3; Domain location=419-903::665-914
MARGRIRARLRRSHLYTFGGCLRPTTTEEVPHPLQGPGYSRTVYCNQPQLLEKNSLFYCKNDVSTTKYNVITFFPKALFEQFRRVANIYFLLAACLSASPISPFSPLSMIAPLAFVVGLSMAKEALEDSRRFLQDVKVNHRKASLHKGNGDFGLRSWQKIMVGDVVKVEKDQFFPADLLLLASSYEDGICYVETMNLDGETNLKVKRSLEATLSLDNDGAFKDFSGTIRCEDPNPDLYTFVGNFEYEHQVYPLDPGQILLRDSKLRNTDHVYGVVIFTGHDSKVMQNSTKSPSKRSTIEKKMDYIIYTLFTVLILISFISSIGFVFKTKYQTPKWWYLRPGNIEYQFDPGKLGLAGMSHLITALILYGYLIPISLYVSIEFVKVLQATFINQDIQMYDDESGTPAEARTSNLNEELGQVDTILSDKTGTLTCNQMDFLKCSIAGTAYGVRSSEVELAAAKQMASDLEEQELNLSNFPMRKESNVPWENITEDEETELGTAVTSKDDGARRPAIKGFGFEDDRLMNGNWLKEPNADVLLLFFRILAVCHTAIPELNEETESCTYEAESPDEGAFLVAAREFGFEFYRRTQSSVAICERFSASGQVVQREYKILNLLDFTSKRKRMSVIVRDEEGSIILFCKGADSIIFDRLSKNGKMYLEATTRHLNEYGEAGLRTLALAYRKLDDQEYSDWNNEFQKAKTAVGSERDTMLEQVSDVMERELILVGATAVEDKLQKGVPQCIDKLAQAGLKIWVLTGDKMETAINIGFACSLLRQGMKQICITMNSDSVTNDGKEVIKGNILNQITNASQMIKLEKDPHAAFALIIDGKTLTYALEDDVKHQFLGLAVGCASVICCRVSPKQKALVTRLVKEGTGKTTLAIGDGANDVGMIQEADIGVGISGVEGMQLDSGADFLSGLFGEFIVVSADQGQSFLLLLELI

SEQ ID NO: 189187 - protein, 72 aa, Glycine max
  Coding DNA Sequence Number=SeqID_72409
  Gene Ontology: Mol. function=zinc ion binding; Cellular component =peroxisome
  Homolog annotation: Hit_ID=Q1SF38; Match level="QueryCoverage=69%, HitCoverage=15%, E-value=1e-14, Identity=70%"; Hit description=Zinc finger, RING-type; Pex2 / Pex12, N-terminal
MITFQVKRIVDSPLRKNYVGLISSSMEVQTGMEGLGLTVAQQLWYCIATIGGQYIWALLQFFFALCRWGDTE

SEQ ID NO: 189188 - protein, 103 aa, Glycine max
  Coding DNA Sequence Number=SeqID_72410
MEITPTIEPKTNITKRETMQKQRKISIKMNFTPTPLDQHIPCHEGMTIGKVQSSLCIGLSAAVALVLEPDVAPCGACRPWIFFINGVLCFLKINDSGMEKEER

SEQ ID NO: 189189 - protein, 77 aa, Glycine max
  Coding DNA Sequence Number=SeqID_72411
  Gene Ontology: Mol. function=zinc ion binding; Cellular component =peroxisome
  Homolog annotation: Hit_ID=Q1SF38; Match level="QueryCoverage=77%, HitCoverage=27%, E-value=8e-18, Identity=55%"; Hit description=Zinc finger, RING-type; Pex2 / Pex12, N-terminal
MKLFVLIKELFVLGFQQQTLPISILRVNQYEVELDAFLEFLIWRFSIWVDKPTPGIALLNLRYRDEHVVEPRDKDRK

SEQ ID NO: 189190 - protein, 52 aa, Glycine max
  Coding DNA Sequence Number=SeqID_72412
MSSDNNEDELLQSGNEMSTMVANPPPITESQWQTTSSCQRNSHLHSVGRAPY

SEQ ID NO: 189191 - protein, 417 aa, Glycine max
  Coding DNA Sequence Number=SeqID_72413
  Gene Ontology: Mol. function=RNA-directed DNA polymerase activity; Biological process=RNA-dependent DNA replication
MMSNAPGTIPYQTKINPKKEDVSVVTTKSKKAKEELWKKDEIVSSGEEVLTKQNPAVEKEKENEVLTPPKGIVEDVLAKVEKFIFLIDFVVLDTEEDGDVLIILRHPFLNTCNMIIEVRQGKLTLGLGEENVMFNLNGFVNKPDLDWEWSNDEEEILMFLQSQQDARLARNQQFEELDRGNGSKPNPSIEEPFTLELNPPSSNLKYVFLNPHASLLVVIATGDKLGLELGKMLVHGEKVHVLGHKVSSKGIEVDPAKVEVIAKLPPPNYVKAEFDLEIKDKKGLENLVVDHLSRLDPFVRQFADDGVIQKTFLDERLFIVATLIGTPWYADIVNYLACKVYGDNLVRRCVLYEEVSFILKHCHCIEAGSHLGFARTFHKVLQSGYYWPTLHRDAHAFVRSCDNCQCTGALSGRLEMP

SEQ ID NO: 189192 - protein, 126 aa, Glycine max
  Coding DNA Sequence Number=SeqID_72414
  Gene Ontology: Mol. function=DNA binding; Biological process=DNA integration
MEKIVSAFRKDWFVKLDGSLWAYRTTFKTPIGMRPYRLAFGKNFHSLVELEHRAMLQYLNEVDELRFNAYENAKLYKERTKKWHDQHIQKREFHEGQKGDLSLMICWARDVKQALPRRQPMDILSS

SEQ ID NO: 189193 - protein, 154 aa, Glycine max
  Coding DNA Sequence Number=SeqID_72415
VNAIESPLVEVTSQPQPLFEDTLTTISTSSTPCEITPLTVIGPTSVFEERLQELLHLQQANLEETMERRFLVECLETNLMIKNTLESSLKSFNDFVLFNMNLLMQQRMPPSVQPPPLPQPTIPPSTTTTYLVPTPSPSPPKSPPTIPQPPFTKG

SEQ ID NO: 189194 - protein, 91 aa, Glycine max
  Coding DNA Sequence Number=SeqID_72416
MSLSFIYLHRDRILQCHAIKMFGIIGGNKGHKIKGNLVIMRKNVLDINSITSVKGVIGTGINIIGGVVDTVTALASHISIQLISATKADET

SEQ ID NO: 189195 - protein, 425 aa, Glycine max
  Coding DNA Sequence Number=SeqID_72417
MASRKRKATTTLSQASYDSSRFVSRDAWDRYADNILGRNILSERNVKLYINEFDDFRREVERRNWHRELTIFSEGSIDVVIVKEFYANLYVPEDKEPNQVRVRGYLIKFNANSLNTFLKTPVVLEQGDSLPSYSRFCRLRPDPQELVAWLCILGREFVLNTEGLPWKLLRKDLSTLVQTWSVLSYSNLAPTSHTSDLNLDRARLVCGLVMKMDMIIGALIFRQISLIAQSNSSRLGFLALITALCKARGFTLDSLTYESLSPAINLAYIKKNSWNLDDPSITFPRTQKSRARRSEAPFPSVAPAPSTFVLPSAPVAPILPGSSAQRSEPFMSMWQSLHQGQLLIMQSLQDVVQQRPVMSVEEFLQKVAWSGVQPSPLGGATPTPPEPFIFEDDPVTVEGTQQASPVGTPALDLNEEAMDQGPPPP

SEQ ID NO: 189196 - protein, 158 aa, Glycine max
  Coding DNA Sequence Number=SeqID_72418
MSHHSSSVNGEGTSHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANIKISYFHGSFLKRNGSFLKEVSQGSFLKKASQGSYLVYK

SEQ ID NO: 189197 - protein, 182 aa, Glycine max
  Coding DNA Sequence Number=SeqID_72419
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P46317; Match level="QueryCoverage=88%, HitCoverage=35%, E-value=3e-53, Identity=58%"; Hit description =Lichenan permease IIC component
MSENLEAFQHNQPIPHIFTQQFYDLWIAPGGTGALLGLVIFMLIRARSRQMKQLGKIAAPAALFNISEPLVFGIPLVMNPYLFLPFILTPVLLVIVSWAAMSSGLVAPPAGIALPFTTPIFVSGYLATGGHISGTVLQVVNLTISLVVYYPFFRVWDRLKLREEQQNEQQAKAASSSAVVPS

SEQ ID NO: 189198 - protein, 203 aa, Glycine max
  Coding DNA Sequence Number=SeqID_72420
  Gene Ontology: Mol. function=transferase activity; Cellular component= cytoplasm; Biological process=aromatic amino acid family metabolic process
  Homolog annotation: Hit_ID=UPI0000382C38; Match level="QueryCoverage =99%, HitCoverage=97%, E-value=1e-57, Identity=55%"; Hit description =COG0625: Glutathione S-transferase
  Pfam annotation: Domain name=GST_C; Domain location=93-189; Score =43.9; E_value=5.3e-10; Accession=PF00043.15; Description=Glutathione S-transferase, C-terminal domain
  Pfam annotation: Domain name=GST_N; Domain location=1-74; Score=63.6; E_value=6.2e-16; Accession=PF02798.10; Description=Glutathione S -transferase, N-terminal domain
  Pfam module annotation: Pfam domain module=GST_C::GST_N; Domain location=93-189::1-74
MKLYNLALSGHAHRALLALSLLGIAHETVEVDLPGGEHKTPAFLAINPFGQVPVLEDEGVYIADSNAILVYLAKKFNRSDWLPEDALGAAQVQRWLSVAAGELAYGPAAARLITVFGAKFNAEEVLARAHLILSRLESHLSQREWLVGDHPTIADIALYSYLAGAPEGNVEMSGYPAVNQLLRRIEALPGFVPFPQTAAGLRA

SEQ ID NO: 189199 - protein, 104 aa, Glycine max
  Coding DNA Sequence Number=SeqID_72421
MAAELGQQTVELSTLVTRGANDKSSDSLAALGTALGPEGRLIFMEIGAACAMAGDGFNGAADVDNFLYGIPPYQTKTISGQLYDSSQQPNTQSDSNSKPKRCSK

SEQ ID NO: 189200 - protein, 505 aa, Glycine max
  Coding DNA Sequence Number=SeqID_72422
  Gene Ontology: Mol. function=phospholipase D activity; Cellular component=membrane; Biological process=phosphatidylcholine metabolic process
  Homolog annotation: Hit_ID=Q9AWB7; Match level="QueryCoverage=49%, HitCoverage=31%, E-value=5e-85, Identity=57%"; Hit description =Phospholipase PLDb1
  Pfam annotation: Domain name=ABC_tran; Domain location=290-477; Score= -25.9; E_value=3.4e-05; Accession=PF00005.17; Description=ABC transporter
  Pfam annotation: Domain name=IBB; Domain location=7-92; Score=58.5; E_ value=2.2e-14; Accession=PF01749.10; Description=Importin beta binding domain
  Pfam annotation: Domain name=PLDc; Domain location=96-131; Score =33.0; E_value=1.1e-06; Accession=PF00614.12; Description =Phospholipase D. Active site motif
  Pfam module annotation: Pfam domain module=ABC_tran::IBB::PLDc; Domain location=290-477::7-92::96-131
MKSYRPSANARTEVRRNNYKVVVDADEGRRRGEDTMVEIRKNRREESLQKKRCEGLQFQQIPSSLLSTVIEKKVGLMNTHDEDTRQFFKNSSEAGTIYTHHQKTVIVDADAGQNKRKIKAFIGGLDLCVGRYDTPNHSIFRTLQTTHKDDYHNPNFEGPVTGCPRQPWHDLHSQVDGPATYDILTNFEERWLRALKMHRYQKMRSSHDDSLLKIDRIPDIVGIDEVPCQNENNRETWHVQVFRSIDYNSVKGFPKEPQDAIRRENANSVYFIEQNLVCGKNVLIDMSIHSAMTLLLGPPCSGKTTLLLVLGAKLDPKLKFSGKVTYNGRGMDEFVPQKTAAYANQNDLHVAELTVRETLAFSARVQGVGTRYDLLAELSRREKETNIKPNQDIDVYMKVCADTIVRNAMLRGISGGQRKRVTTGEMLVGPTNALFMDEISIGLLVSLPQVGSLVFYFPQGHSEQVAASTRRTTTSQIPNYPNLPYQLLCQVQNVTLHVSVGCWLT

SEQ ID NO: 189201 - protein, 82 aa, Glycine max
  Coding DNA Sequence Number=SeqID_72423
  Homolog annotation: Hit_ID=Q7XA53; Match level="QueryCoverage=59%, HitCoverage=9%, E-value=2e-07, Identity=57%"; Hit description =Sucrose transporter
MACPHGTHPRSQNSSAFSLTTPFSHSRRSSEREDIVEAALRAWDIAQDVSDNHEEGEEGIGIFTFCGGRWRRGTIFFYTYSS

SEQ ID NO: 189202 - protein, 35 aa, Glycine max
  Coding DNA Sequence Number=SeqID_72424
  Homolog annotation: Hit_ID=Q2HSE9; Match level="QueryCoverage=94%, HitCoverage=7%, E-value=9e-07, Identity=73%"; Hit description=Pollen Ole e 1 allergen and extensin
MTRNFLLLLWLALFFVIHVLNRNSPLEAISFQVTQ

SEQ ID NO: 189203 - protein, 147 aa, Glycine max
  Coding DNA Sequence Number=SeqID_72425
MTLMRAERLRNHLFLRRCRDTEMMLMNDLETTCFYDVAGVNNDVNFKDVLPPSLKCFFHRRGGNRGGNSGGKGGKIGFVGGGGGGDGVKPGITNGGKGGNKEGGGLGGGWNGLGKRVGGLGGGWNGLGMSGGGLGGWNGFGMSGGLG

SEQ ID NO: 189204 - protein, 85 aa, Glycine max
  Coding DNA Sequence Number=SeqID_72426
MSFFNRWEYLKKKDSQKELIAQEVQHISICRQHCKSKKVARIEDYYDNSSDNEKERTPTETETMAVKMSKLYFKSTIDQAYLEPK

SEQ ID NO: 189205 - protein, 207 aa, Glycine max
  Coding DNA Sequence Number=SeqID_72427
MDEDSKHNIIVKGYVIANSSSLIRKANIQKQSSLAPKKAKITKATFSAKVQAIPSYVPKRLKTSATKENPKYPKSNGLHHLLLHLQVVTEHHQMHQSLLSAFDHPPHLIIIHFHQPSIWRSSKTNHKMKAPMAGEPRFPLAFTSANPQNICRKCEVIEEVFKEPVLRESTSTSTPEWVRYDYQHTSSEAYKALPIDVIVSLENPSWT

SEQ ID NO: 189206 - protein, 120 aa, Glycine max
  Coding DNA Sequence Number=SeqID_72428
MVCGRSNGIFSIRWNSMNLWMSEIEIFEPILCKMILFMILTQILDLSHIRCLGGNGCLHECTMWLWQWYPLTESLFSKNLGHNGIAIHECKVFDESPCFPRTLDTMVLEMKVLYEGMQSV

SEQ ID NO: 189207 - protein, 138 aa, Glycine max
  Coding DNA Sequence Number=SeqID_72429
MSLHSSSSVNGEGSTPKDPLYKILDELRSLKLWKEKQERKEKGRHRSHLRPHSHRIENERKPQEVNIKLPYFHGKDNVEANLDWEIRVEKQLKRKSTSKSYGSHSYPKKDQGQGILGVRPSKPKDDKGKTIEKQPLKA

SEQ ID NO: 189208 - protein, 94 aa, Glycine max
  Coding DNA Sequence Number=SeqID_72430
MIYTTGGCTTQIIWFKQVRCAPCQAPQTDILHVSKPGAPSTFARPTVEEPKHAVEVCHGIAERLECHLSLGVVTPGSSTHEVIEECLRMARSVT

SEQ ID NO: 189209 - protein, 106 aa, Glycine max
  Coding DNA Sequence Number=SeqID_72431
MGETHEIPHHNLADFEPWLGYATEGQAVGGIPFENTLESPQFRPQPQPLHFAVGRAPPAMAEKGKVDHLKERLRAIEGGEDYAFANLEKLFLIPKHGHSQVQGAGL

SEQ ID NO: 189210 - protein, 81 aa, Glycine max
  Coding DNA Sequence Number=SeqID_72432
MSRNFTDCLTMGVSKRSSEVAPLYIPFIGDRRKAINSWDFGLDDGGCTNNARKSIRGAPDSDLMVEDARTALGNQFVGLRT

SEQ ID NO: 189211 - protein, 44 aa, Glycine max
  Coding DNA Sequence Number=SeqID_72433
MWDNVGVEGAVSGRFQAGGKREERFQEGGGQVNIGFGKTDVNIK

SEQ ID NO: 189212 - protein, 99 aa, Glycine max
  Coding DNA Sequence Number=SeqID_72434
  Subcellular localization annotation: CTP_CleavageSite=58; ConfidenceScore=5.13e-01
MLEEKPPGAITQTRRQQEIPLWLLTSGKSTTAAAFSSIAYFATPSLSLGSRVSLLSPVVASFWASLSVLQAKWRTWKTDPNKQQEFSRIENNDGTWNIA

SEQ ID NO: 189213 - protein, 84 aa, Glycine max
  Coding DNA Sequence Number=SeqID_72435
MTTTLISPTEVSADLCHHDIGIVPVRHPMDPKKSNRVLGFPALITSLCQFYGVPIAPSKFIRPPTNRAFIKKYCAPRQAQGETP

SEQ ID NO: 189214 - protein, 152 aa, Glycine max
  Coding DNA Sequence Number=SeqID_72436
MVAITLAKVHQPPFLREYDSNATCACHGEAPGRSIEHCRALKRKVQGLIDTGWLKFEENRLLNPNINKQHHTWGNSGSCCYDSSGFSKRSELSRIGCWTNGLSYFKKGGVELRCKDYSPIELSLSLFGLTMHTGITLPLCSGILYNKRPAVS

SEQ ID NO: 189215 - protein, 73 aa, Glycine max
  Coding DNA Sequence Number=SeqID_72437
MEKLLIDFQVFAQEFLLRKHIAMKFSWNIFDDHSKISWTDVTLRSYFLKSCDSWEEKRLEKKVLEVGTLLDPG

SEQ ID NO: 189216 - protein, 70 aa, Glycine max
  Coding DNA Sequence Number=SeqID_72438
MEGTLNMASQGVIHVSNEPCHLEAFTLSSSSWKKTFQFGTLHSLNLKGKEFIFFFFQASPSVLESLIHQA

SEQ ID NO: 189217 - protein, 81 aa, Glycine max
  Coding DNA Sequence Number=SeqID_72439
ESIDEEDPRPTSSNGACINKPSKQSLRNPKAKEKFKSTAVRIRKENAELRDVNLDTTKALEQETKRARKEEHGWNMFRGAL

SEQ ID NO: 189218 - protein, 126 aa, Glycine max
  Coding DNA Sequence Number=SeqID_72440
MLRSSRGIGLRHATKRWSLSSICRVWFELPQSMIAGLFTSFPHRLSNWCMPQLGLLAFKGNGNRVARWACALHWVVYSWEVSRTVGKSSYFAPYRDCPCCLTPLRLSGGAGGGHCGRIILHHPSHT

SEQ ID NO: 189219 - protein, 186 aa, Glycine max
  Coding DNA Sequence Number=SeqID_72441
DRELRGSSNGIIGGYHMWLRVRTQGLDWLPNLKTVRDDEVKASEESDEVQALKAELERAWVVEEKFKAAIVSSSSEEVKGIITGQRHDLEGQAKGNMWAIIDKCKEKLNLAATHEQRLEDEYAKISAKREARERVIDSLHQEATMWTDRFALTLNRSQELPPLLAKAKAVADTYSAPEEIHGLLSY

SEQ ID NO: 189220 - protein, 99 aa, Glycine max
  Coding DNA Sequence Number=SeqID_72442
MLHSMLQSIHRGQSIIMQSLQGLGLPFIMSIEEFDAQVAWPGDQPSSFGGGGASAAQERDIEEPPAAVAAEREDKFTPPEPFYFEADVHMAQEEGTSTD

SEQ ID NO: 189221 - protein, 175 aa, Glycine max
  Coding DNA Sequence Number=SeqID_72443
  Gene Ontology: Mol. function=RNA-directed DNA polymerase activity; Cellular component=mitochondrion; Biological process=RNA-dependent DNA replication
MYYIPKESNIRVDLLSKLTNTKKVGNFKTIIQETLQTPTIGDVKEIMLLQELPNPGGTPPNKDEARHLKRKVSYYVILDGELFKRGLTTPLLKCLNSQRLDYVMREFHEANCGLHIRGCSLATKAIRARYYWPTLKVDALDFTRRCRRCQEFVDVSHTPPNNLHSMSYPWPFTMY

SEQ ID NO: 189222 - protein, 71 aa, Glycine max
  Coding DNA Sequence Number=SeqID_72444
MEGQRGLFRVFSGPQLAQASLWFAWVPKWLRVEVTSSPGRAKLLQSEASACLGELQVHQVPFFAINRREGG

SEQ ID NO: 189223 - protein, 139 aa, Glycine max
  Coding DNA Sequence Number=SeqID_72445
  Gene Ontology: Mol. function=RNA-directed DNA polymerase activity; Biological process=RNA-dependent DNA replication
MVEGTQVMIVDESSQIQAMTIYQTNLGSEFDIDPQDKTSDRGPKLIEELVQLQPRPKLRQCTWLNRDLTNHEHWRIPDAKPLSHKKRKMGEERCKAIKEDVDKLFKANFIREANGHAPKRSSWSKRSTTNGECAPTTLI

SEQ ID NO: 189224 - protein, 110 aa, Glycine max
  Coding DNA Sequence Number=SeqID_72446
  Subcellular localization annotation: CTP_CleavageSite=21; ConfidenceScore=5.25e-01
MASSWMGGYDATFRLSAYHFRASYWSSLTVTIFPVSVGNFIFKWGVETMAPSSLSVFLLIKENGIALVDKNPGHHEVFNDVGDDYEVVLVDGVDAFEVPIHESDRRETSR

SEQ ID NO: 189225 - protein, 66 aa, Glycine max
  Coding DNA Sequence Number=SeqID_72447
MTQALLPESSSGSQDELPHQVGFEKSELAGRMVAWSIELSEFNIQYEPSMCDFLDVDFELCGVLLT

SEQ ID NO: 189226 - protein, 93 aa, Glycine max
  Coding DNA Sequence Number=SeqID_72448
  Homolog annotation: Hit_ID=Q9SZE8; Match level="QueryCoverage=54%, HitCoverage=21%, E-value=2e-18, Identity=82%"; Hit description=LOB domain-containing protein 39
MKDIRSLRPKNLARKRVACRCDSGDSIHCRHDLRGHVSLHPFRSTRQPLQLILISWVVKGIYIYHPSQFSVLRRTAPCFCTALSDSTHASLGF

SEQ ID NO: 189227 - protein, 256 aa, Glycine max
  Coding DNA Sequence Number=SeqID_72449
MAQSNSSRLGFPALITALCKSRGVASDSLVFKRLSLVINLAYIRKNCWNPDDLIVTIKGARRARTRPTKVPSTSTAPPPARTPAAPSASASADFWHLEAMLQSIHQGKIILLHSLQMVAPPDSIPLIEQFNEWVAWPGTQSSLHREDEGPTAQVPLQMEDEPSETTTPEPLVRRKKADETQEAVATSEKPLEATSEPSELVVDTTSPQQATDPSTPEDLTTPVLSLNTSPTATPVLHLTNEEDVQTQETQDQSQNF

SEQ ID NO: 189228 - protein, 96 aa, Glycine max
  Coding DNA Sequence Number=SeqID_72450
MSSDSPSLDDKGADDDISLYVSTGSLASDSPSLNDKGADDDVSHCMLPDPRVTIAEGGVVDKSGAFAPTYPQFVMKNSDLRSSCFCETKIVLVFFH

SEQ ID NO: 189229 - protein, 214 aa, Glycine max
  Coding DNA Sequence Number=SeqID_72451
  Homolog annotation: Hit_ID=UPI0000612705; Match level="QueryCoverage =50%, HitCoverage=92%, E-value=1e-12, Identity=31%"; Hit description =UPI0000612705 related cluster
MSRKEFLKNCKGCKSLKVSQKLFKKIFECKSRSCFYRLFMSGQENHWKSYNLEKIMSRVTSLDLLFKTCHCLLLHNPLKARVCSPMKARTCSPLKARACSPLKARASNPLKVRTCSPVKVRMCSPLKAKACSPLKTRACNSLKARTCSPLKVRACSPQKARACSSLKARACSPRKAIGTSTQGSLMRKQEINSSRWPLILNSKDWTLDVGNLCS

SEQ ID NO: 189230 - protein, 105 aa, Glycine max
  Coding DNA Sequence Number=SeqID_72452
MTETERVKHKEGLRVFLPSSRGRELRVAHDGSMGEAVRGHHHDGLGQRVKLCRTRVRASWHETDSSGSFDSHTGKKAPPPRFRVHERQSERGHKERDRVRLSKRA

SEQ ID NO: 189231 - protein, 331 aa, Glycine max
  Coding DNA Sequence Number=SeqID_72453
  Gene Ontology: Mol. function=RNA-directed DNA polymerase activity; Biological process=RNA-dependent DNA replication
MVSDFGKNIWCPPWGRDKTYPAASPQLSFIHTWLALDLTADSHPHPVAMTNTNTLQQLQNCIAEMEQHHEKELTKLKVDHDQLEAHVRHPQGDEQCAHTLPKCTQGESHPRCIGNTADDLSLSHMHRPTGQTIRRHPFVNHIMKVNLYTNNNVILYRVFPTSLKGATLTWNGGLPPRSIDNFDSLVERFNAQYATNRSHRITLISLASQRQADNKSLKKFIERFGRTAVQIQNLNPNVALHSMLLALRPSKFANNLCKNHPVTWTSCASEPKATSRWKKCLDSRMKSVNPNRSMTSVKEIPRLTCISQIRDTSQASASLSPKGTSTSDTHP

SEQ ID NO: 189232 - protein, 94 aa, Glycine max
  Coding DNA Sequence Number=SeqID_72454
MWLNWSLLPSTVCRDRPRKTLSGPEEVQQGPGVLALIMGLCWFNGVTTTPISPSRSVSWDRARKTPSKVIRPPTNRAFIKKYYAPRQAQGETPQ

SEQ ID NO: 189233 - protein, 88 aa, Glycine max
  Coding DNA Sequence Number=SeqID_72455
MSEIEEVQEQMKIDMEAMKEQMTTMMEEMMSMRKKMEDNIATVVATSTATEMDPIHLASLNQVNRPVSDIVGQGGEATKNACGPYHVQ

SEQ ID NO: 189234 - protein, 88 aa, Glycine max
  Coding DNA Sequence Number=SeqID_72456
MKHYANSNHREVTFNQGDWVMVRLWPYRQSTIPGHSSANVKLAKSPQTPGDIKHVMVIYRYPKLQFLVQWEGLLPDDTSWEDWELLKR

SEQ ID NO: 189235 - protein, 92 aa, Glycine max
  Coding DNA Sequence Number=SeqID_72457
  Homolog annotation: Hit_ID=Q1SAV4; Match level="QueryCoverage=69%, HitCoverage=16%, E-value=7e-07, Identity=53%"; Hit description =Integrase, catalytic region
MEFFDDVHEESCHDKSSMIREEHAQLYALQKSINNHQNCIVAMIQGNPTRKSNERSSHGRSGTARHKNLEENLPCKHALSALLLAKRVICHF

SEQ ID NO: 189236 - protein, 174 aa, Glycine max
  Coding DNA Sequence Number=SeqID_72458
  Gene Ontology: Mol. function=glutamine-tRNA ligase activity; Cellular component=cytoplasm; Biological process=tRNA aminoacylation for protein translation
  Homolog annotation: Hit_ID=Q1GZI8; Match level="QueryCoverage=98%, HitCoverage=28%, E-value=2e-66, Identity=70%"; Hit description =Glutaminyl-tRNA synthetase
  Pfam annotation: Domain name=tRNA-synt_1c; Domain location=52-174; Score=-81.9; E_value=8.1e-09; Accession=PF00749.11; Description=tRNA synthetases class I (E and Q), catalytic domain
MSTEKEPTPAASNFIRAIIDKDLAEHKYATKKWAGSPGDAAHQATGQVDFAKIRTRFPPEPNGYLHIGHAKSIFLNFGLARDYDGVCHLRFDDTNPEKESQEYVDSISDMVQWLGFGWDNTTPTGNKENNLYFASDYFDVMYQAAEALIQHGHAYVDEQTAEEVRINRGTLTEP

SEQ ID NO: 189237 - protein, 229 aa, Glycine max
  Coding DNA Sequence Number=SeqID_72459
MHGFSHVDGFVEISNCLAEMIKYAANEPSAGLFFIQHHTQNAVPNVIKLKNNIIDKSHETTLQTEDLEDSVAMVRSMKECGFPIADEMIGDIKKSLEGISEMRGNYFSSVFSFSKQKTKTKSLNKWPQLDSMGSVNSNTEKQLMYHSMSLPDASANSTASSQADKPVSSQVEGESRPEPSDIGDKLLSLSENFDDFKASKQAKLEDWLEGTSNHGENCLPGDEKMALRK

SEQ ID NO: 189238 - protein, 122 aa, Glycine max
  Coding DNA Sequence Number=SeqID_72460
  Gene Ontology: Mol. function=pepsin A activity; Cellular component =anchored to membrane; Biological process=proteolysis
  Homolog annotation: Hit_ID=UPI000034F181; Match level="QueryCoverage =73%, HitCoverage=17%, E-value=3e-11, Identity=44%"; Hit description =aspartic-type endopeptidase/ pepsin A
MCLKHIMRILIEAHYLEYVKKNRKVQSEGADAEGGVAIGEGEAGVDLGELAAAMEVVAVGELGVVLDGALLRRGGDSNGGGVGPLPDGLRVAVVQRKSVDVAVSLATLPEGEERHNDENGSE

SEQ ID NO: 189239 - protein, 148 aa, Glycine max
  Coding DNA Sequence Number=SeqID_72461
  Subcellular localization annotation: CTP_CleavageSite=43; ConfidenceScore=5.36e-01
MHGATTTGASAKELPRGEGRANSSSGFAFCLRGVGRATSTGALCMESRNASQTGVLALQVTGHNAAAKVTGHSAAAAGSRETPLEPAACVCRFNAPSRGALSSFYMQFLCCIVLPVCSAFSKLASFGWFLASFASLASAACNFLIRFS

SEQ ID NO: 189240 - protein, 186 aa, Glycine max
  Coding DNA Sequence Number=SeqID_72462
  Gene Ontology: Mol. function=RNA-directed DNA polymerase activity; Biological process=RNA-dependent DNA replication
PQEVNISLTYFHGKDNVEAYLDWEMKVEQLFACHHISEERKVPLATLSFQGALRKRHISSYYEKELMDKLQRLRQGSMSVEEYRQQMELLLLRVGLREEERTSIARFLSGLNMEVRNKVELHPYRDLDELVQLCIRVEQKHKRKPSSKSYGFLSGLKTKPRMGPITRAMARRLQEDWARDAVECPR

SEQ ID NO: 189241 - protein, 188 aa, Glycine max
  Coding DNA Sequence Number=SeqID_72463
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=98%, E-value=1e-10, Identity=28%"; Hit description =UPI00006A17C9 related cluster
  Pfam annotation: Domain name=DUF865; Domain location=118-151; Score =6.1; E_value=0.86; Accession=PF05906.2; Description=Herpesvirus-7 repeat of unknown function (DUF865)
  Pfam annotation: Domain name=DUF865; Domain location=39-72; Score =6.0; E_value=0.91; Accession=PF05906.2; Description=Herpesvirus-7 repeat of unknown function (DUF865)
  Pfam module annotation: Pfam domain module=DUF865::DUF865; Domain location=118-151::39-72
LPSPLRGLHVLTIRGLHALTSRGLHVLALRGLHVLTLGTSYPHRQRATRPHLERTTRPRQQRGLHALTSRGLHVLALRGLHALTLGLHVLTIRGLHALTSRGLHVLALRGLHVLTLGTSYPHRQRATRPHIERTTRPRQQRGLHALTSRGLHLLALRGLHALTFRGLRVLIFSVLDIHTLKEFKVLCP

SEQ ID NO: 189242 - protein, 307 aa, Glycine max
  Coding DNA Sequence Number=SeqID_72464
  Gene Ontology: Mol. function=electron carrier activity; Biological process=electron transport
  Homolog annotation: Hit_ID=Q0AN65; Match level="QueryCoverage=77%, HitCoverage=68%, E-value=2e-38, Identity=35%"; Hit description =Hypothetical protein precursor
MKKIYFLFLLSFLIVYSCKDERIEGIGVESPRVNFDINAVPYAKLSTYSFFTGELKNLVPAPKVIPYEPASSLFTDYALKKRFIWMPEGTKATFDGDTKTLDFPVGTVLIKSFYYNTIQPGNTTKILETRLMIRKSSGWIFAEYLWNDDQTEANLVSGNDFTSGSSKNITFKKENNEILSIDYRIPSESECYACHKLDNKPVPIGVKPQNLNTTYNYPGGIKNQLQKLVDEGYLVSYPANIVSTVNYKDTSKPVDIRLRSYLDINCAHCHQQNARCDYRAIRLSFNQTTNLTNMGVCVLADEPIDAS

SEQ ID NO: 189243 - protein, 73 aa, Glycine max
  Coding DNA Sequence Number=SeqID_72465
MKNVEEQLKIFANSPTETLRKRLGLDFSSRKQFFSLISRNRGEACHPTRPDELGCFLQKQPPSGGIFWKLKWA

SEQ ID NO: 189244 - protein, 93 aa, Glycine max
  Coding DNA Sequence Number=SeqID_72466
MKRKLSCGNLDEILRDCEEASLLWRAKSSVGSSYGFFLFTNYSAIELYDQQSQDPDRTWMVNGQRLKLYHGGEFEKANTILHLISPIEVYASS

SEQ ID NO: 189245 - protein, 513 aa, Glycine max
  Coding DNA Sequence Number=SeqID_72467
  Gene Ontology: Mol. function=monophenol monooxygenase activity; Cellular component=chloroplast; Biological process=metabolic process
  Homolog annotation: Hit_ID=Q66NX3; Match level="QueryCoverage=87%, HitCoverage=78%, E-value=1e-125, Identity=49%"; Hit description =Polyphenol oxidase
  Pfam annotation: Domain name=Tyrosinase; Domain location=33-355; Score=434.9; E_value=1.1e-127; Accession=PF00264.10; Description =Common central domain of tyrosinase
MATSPQTPMEETNHVFGGKPSLASKILTSHLRIFLEQYPLIPPPSKIIDFKDFASPNATLRVRKPAHMVDEEYIAKLEKGIALMKALPDDDPRNFIQQAKVHCAYCNGAYHLPHPFQNTKLNIHRSWFFFPFHRWYIYFFERILGSLLGDPNFALPFWNWDAVEGMQMPPYFANPNSSLYHKLRNPKHLPPQVVDLNYDPFDFNDDTPSHQQVSYNLAFMYKQMVLASTKELFMGSPFRLGDNPTPGIGSIEAAPHNTVHKWVGAADKPHQEDMGTFYTAARDPVFYPHHTNSDRLWGIWKKLGEGRKDYSDDPDWLDSDFYFYDENANFVRVKVRDCFDTKRLGYVYEDVDLPWLRTPPTSRKSKLLREAKKGSLLSSKPWKFPLVLDSITSIVVKRPKKWRSKEEKEQEEEVLVIEGIEFGSDKYVKFDVHIDDDEDNLSGPDETEFVGSFVNVQHGHGHNVKTSFKVGISKVLESVEAEEDDEVLVSLVPKVGKGDAIIGGIKIEFIPKY

SEQ ID NO: 189246 - protein, 75 aa, Glycine max
  Coding DNA Sequence Number=SeqID_72468
MGYGKFVAICQMGVSRAVSGLGTVIYVDTTIGVKLVTPLAMTGTTMPPLTTAGQGLTRRDKEAHTVIRTSGTRLT

SEQ ID NO: 189247 - protein, 56 aa, Glycine max
  Coding DNA Sequence Number=SeqID_72469
MVLMVKIEKSLLSKETKGISKTMSTKNKDKSLEGVLIAALAYSVYYIWDAHAFNIF

SEQ ID NO: 189248 - protein, 172 aa, Glycine max
  Coding DNA Sequence Number=SeqID_72470
MARRDKLWSFCAFYHPEAACPMTCGDKLWSFRTPFRHPEAIVSDGTQRQIMVILRLSIQARSCPMARKDKLWSFGALLSSRGGGLDGIWRQIMVIMHTFSPSRGDRVRWRAETNYVHSAPFHPGSIVSDGAQRQTMVILRPLSFKGSKSSDKRAETIYGHFAPFVIQGQHIK

SEQ ID NO: 189249 - protein, 264 aa, Glycine max
  Coding DNA Sequence Number=SeqID_72471
  Gene Ontology: Biological process=cell adhesion
  Homolog annotation: Hit_ID=Q9ZQ23; Match level="QueryCoverage=45%, HitCoverage=42%, E-value=1e-20, Identity=45%"; Hit description =Fasciclin-like arabinogalactan protein 3 precursor
RNTITVLAVEDSAMHSIAAKSPEAIKAIIGTHVILDFFDEKKLMEAQASSQQLTTLFQASGLAVNQQGFLKVALVGEGEIAFGSAASDAPADATELVRTVTSEPYNISILQVTKPILAPGVDSPTPASSSGAQPSQGAKAPIAAQSAKAPVTAQEAKTPMPSSQGVNAKAPVQAQVAKSPVPAQSAKAPTPLENAASPSPASESVAESPEVAAEAPATSPVGAEAPGPLADDVAPADVTASSASTTKMGLVGAVMAFASLFIVL

SEQ ID NO: 189250 - protein, 88 aa, Glycine max
  Coding DNA Sequence Number=SeqID_72472
MKLTYNNRGVGARKVEERKKFSNTNGGGRDIREFNGFIFYMELEDIPIVQRMYTWFKPNSHVKSKLGRVFVSKEWVTHLARELSSCLE

SEQ ID NO: 189251 - protein, 102 aa, Glycine max
  Coding DNA Sequence Number=SeqID_72473
MVYQEGAELRLIQIALSGTFDAAGDVEEAVAALRDEGVGVEGEPAEAEGDGERDVDREQPGERREKEAEEGGELGERGGDGEAFGLWSEERDAGRASRGIGG

SEQ ID NO: 189252 - protein, 48 aa, Glycine max
  Coding DNA Sequence Number=SeqID_72474
MEGLGGAGESLEVSWRRWLAVVVVEILIGMVCRELKMMKFALCLKGFG

SEQ ID NO: 189253 - protein, 203 aa, Glycine max
  Coding DNA Sequence Number=SeqID_72475
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=1e-31, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHILAFRGPHVFAFRELHVLAFKGLHVLTFRGLHVLTFRGLHTLAFRGLHVLAFRGLHALTFRELHALTFRGLHVLAFRGLHVLAFRGLHALAFKGLHALAFIGLHTLTFRGLHALAFRGLHILTFRVLHVLAFKGLHILAFGGLHALAFKGLHALALRGLHALAFRGLHAIAFRGRMAPHLRLQRTQGPPPLILNRGLHSQ

SEQ ID NO: 189254 - protein, 215 aa, Glycine max
  Coding DNA Sequence Number=SeqID_72476
MARNIIQAKWNHSKEDEDDEQEEEEEALSLCDLPINLEDPPRNQEHSRPNEASQEEFNFRSWGAPFSKEHEMCVADEVFFKGQILPLRVSFSSEAGLLATVSQSQQHYGKQFVRSESLDRNSSDFRSSNNSSRSSSLRSQNSSTSSVTAATATTTTTIPKSKPRIRNQFHTHPSPKPQLRASAPTHNQGRKSTSAWGIFRLGVVAAPEIGLHDLK

SEQ ID NO: 189255 - protein, 61 aa, Glycine max
  Coding DNA Sequence Number=SeqID_72477
MVKFFNKWAVAPLFVQSEVLAEASVVKSGRNVTMVALEFKLKKTGNLMYIAHTTFYNIPVA

SEQ ID NO: 189256 - protein, 135 aa, Glycine max
  Coding DNA Sequence Number=SeqID_72478
  Subcellular localization annotation: CTP_CleavageSite=19; ConfidenceScore=5.08e-01
MASKASSSASQTQTLSSISDQKEFPQHVSMTRTWLNKLGIDKPIPQSCETRGFYSHFFGSFIKLNDIKRGRISCTIAVKPQIIITVGNEGLKLMIFSVYQDSVWIKDFKISSFVAYSALTRLNKIGLYQTSHFDI

SEQ ID NO: 189257 - protein, 75 aa, Glycine max
  Coding DNA Sequence Number=SeqID_72479
  Homolog annotation: Hit_ID=Q9SJK3; Match level="QueryCoverage=98%, HitCoverage=8%, E-value=6e-08, Identity=44%"; Hit description =Argonaute-like protein At2g27880
MEFYPDPLLPITSQIESALVNVHKQWVTNLANMDVQGRLQLLIRILPDVKGSYGIVSQYCLPRQVGKTIMQYLES

SEQ ID NO: 189258 - protein, 54 aa, Glycine max
  Coding DNA Sequence Number=SeqID_72480
  Homolog annotation: Hit_ID=Q6H7E3; Match level="QueryCoverage=69%, HitCoverage=26%, E-value=1e-07, Identity=71%"; Hit description =Putative elicitor-responsive gene-3
MYLKKEINLEPVFAVGSIPETSYNVVKDQKYCGEIKVALTFNPERGSGLGYGDE

SEQ ID NO: 189259 - protein, 332 aa, Glycine max
  Coding DNA Sequence Number=SeqID_72481
  Gene Ontology: Mol. function=DNA binding; Cellular component=nucleus; Biological process=regulation of transcription, DNA-dependent
  Homolog annotation: Hit_ID=Q71KV1; Match level="QueryCoverage=99%, HitCoverage=99%, E-value=2e-69, Identity=45%"; Hit description =Transcription factor Myb
  Pfam annotation: Domain name=Myb_DNA-binding; Domain location=13-65; Score=51.8; E_value=2.3e-12; Accession=PF00249.21; Description=Myb -like DNA-binding domain
  Pfam annotation: Domain name=Myb_DNA-binding; Domain location=71-116; Score=46.8; E_value=7.1e-11; Accession=PF00249.21; Description=Myb -like DNA-binding domain
  Pfam module annotation: Pfam domain module=Myb_DNA-binding::Myb_DNA -binding; Domain location=13-65::71-116
MGHRCCSKQKIKRGLWSPEEDEKLLRYINTHGHKSWSSVPKFAGIHLSRLQRCGKSCRLRWINYLRPDLKRGSFTAEEEQIIIDIHRILGNRWAQIAKHLPGRTDNEVKNFWNSCIKKKLISQGLDPQTHTLLSSHRRSSACTISNNIHQNSNSIFIMSSHIPNAPFETTCQTFSTLPKPPPNIVQTPSSIVSSEFQTLSTILSDDGEPLQHLPYELLMENATNICSPTYMNPSAVELCNDDNNVNWVSRLNVHDFSAQTLEEGAQVLQVQQEKGKTFDDKGSDVREANKGNLETSVSFESSNFDLGFLESVLTSEFISHDLNCMDELAWNF

SEQ ID NO: 189260 - protein, 92 aa, Glycine max
  Coding DNA Sequence Number=SeqID_72482
MSSSGAEAKPVCGVSVQDDAAVGGRVAVAVAVVDSVEHLLQNPWRRHMIHHQRGQQGRDRQCRYGSRRPPYCLCRIEWYRQRGHLRRKLQHT

SEQ ID NO: 189261 - protein, 168 aa, Glycine max
  Coding DNA Sequence Number=SeqID_72483
  Subcellular localization annotation: CTP_CleavageSite=32; ConfidenceScore=5.56e-01
MPPPQIPPPPPSLSPPLKATQSPMLTAPTTSSSSMNNHHVDDEVPSNITKELVPLGMLELSSEVPPLSIQLDAAQAIWWSPRPVSALTVSSLLPPLVMNHVATPRVLQKVFHTVHYRHSYCNTAPYGSVILHRDATDRFCLRATTRHSLISTPILIWDPGSFLLQPTP

SEQ ID NO: 189262 - protein, 137 aa, Glycine max
  Coding DNA Sequence Number=SeqID_72484
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=1e-10, Identity=33%"; Hit description= UPI00006A17C9 related cluster
MLSHKGRPLGTSTLSFRGLHVLTFRGLHVLTFRGLHALATLGGLHVLAFRGLHALAFRGLHVLAFRGLHVLTFRGLHVLTFRGLHVLTFRGLHTLIFRGLYILPLRGLHVLTFRELRVLAFRGLHIYTLREFKVLCP

SEQ ID NO: 189263 - protein, 50 aa, Glycine max
  Coding DNA Sequence Number=SeqID_72485
MGLLANRHCQWGRFRRRLGGAATMQAAAGAEGLEIASHGGDLVVKKFSGL

SEQ ID NO: 189264 - protein, 163 aa, Glycine max
  Coding DNA Sequence Number=SeqID_72486
  Gene Ontology: Mol. function=structural molecule activity; Cellular component=cytoskeleton; Biological process=actin filament organization
  Homolog annotation: Hit_ID=Q76K86; Match level="QueryCoverage=48%, HitCoverage=42%, E-value=3e-29, Identity=68%"; Hit description=Actin
MKILIERGYMFTIAAQWEIVHDMKEKLAYVALDYEQVITIGAERFRCPEVLFQPSMIGMEAVGIHETTYNSIMKCDVDISLAKPICWLSEASVECTPPSAEREERSGRRMSCACSLSEGSSSEVHRFSPSVEREKHTLSQNPLMSAKRSRVALSVQARTKPPI

SEQ ID NO: 189265 - protein, 131 aa, Glycine max
  Coding DNA Sequence Number=SeqID_72487
MPRHKKCNPCKIRVEPNQSIFHACPDKLCWFTYIDNSSYNNISGGNFDFNGDSNSDNDDSSDNNIGDKDHNVSIGCGGDDVGDSSVGSNDNDNDDGANRNGGGGCVHPPHHIIPPGHGIHSTLSLASNLGP

SEQ ID NO: 189266 - protein, 479 aa, Glycine max
  Coding DNA Sequence Number=SeqID_72488
MSVGSSSSTPAVAGYEWDKDNVLKYKSCLSLIASVTALQRQVKLANPEDSCIMGDFSWRPLVKQVRPEGGTMPLFAATLSVGERGQLASEIDLIAIAVEVTPNVHSSIFAKRKRDDIVGSFGCKKSRTPMSLHALRFIGLTTGHLTTRQDMPPAPLEVKALVVVAAAAATPATPVHSPSPTTIIQEVTLADVEDVVLATLVESVVVSSSTVASLLLSVSVVTTGAPTVLSPSLVALPVAILEAMALPSSSSHPCVSLDHLYTFSDVELLWGATYKSEQKTLIGFVSTFEKNLIRSVGVQNATDSVKMFLQRSLTILEENILQHQEAVQKISSLEAEVSKWRAIAQTLWRVELPKVANAIVAFTEVVRENHQLSSKVGGALTKLLHTRLDGDDLFRCCKNLQTEKMDMCGRVESMVAEKDRLAKRIAKLEAWLRESESRLKESELRAAKEIEASKELEEELILYKKVVEQHEKGFQKAVK

SEQ ID NO: 189267 - protein, 71 aa, Glycine max
  Coding DNA Sequence Number=SeqID_72489
MTLTTSDIHARTYYHHDSSMCHPRRVTYMHEHITTSSVLSPTTSDMYARTQCSKPRMNYSLVNPLKGSQNS

SEQ ID NO: 189268 - protein, 63 aa, Glycine max
  Coding DNA Sequence Number=SeqID_72490
VSDSGSGGVASGDEGLSETVTRWLAAVVDRLAAMMGWLATVAGVGGGDCGVAGDGDEVVTCLE

SEQ ID NO: 189269 - protein, 85 aa, Glycine max
  Coding DNA Sequence Number=SeqID_72491
  Gene Ontology: Mol. function=catalytic activity
  Homolog annotation: Hit_ID=Q8W3K8; Match level="QueryCoverage=89%, HitCoverage=22%, E-value=3e-19, Identity=63%"; Hit description =Spermine synthase
MGEAPEVFYINGFSKFEHEIETQQNHHVNDQNHDSSWYEEIIDEDLKWSFKLNSVLHKAISEYQDIALLDTKRFGKVCNLCFFFS

SEQ ID NO: 189270 - protein, 213 aa, Glycine max
  Coding DNA Sequence Number=SeqID_72492
  Gene Ontology: Mol. function=protein kinase activity; Cellular component=membrane; Biological process=protein amino acid phosphorylation
  Homolog annotation: Hit_ID=Q2QZ78; Match level="QueryCoverage=78%, HitCoverage=30%, E-value=2e-48, Identity=54%"; Hit description=AT hook motif-containing protein, putative
MPYPEDANCPAYLDNSLILVELNYNNEELRLEFEHLFSHMADEQASIYNQIVEAINKDESGMFFLYGYGGTGKTYIWKTLASSLRADNKIVIMVASSGIVSLLLPGGRTAHSKFKIPVLVFEDSTCNIHQGTQLAELLNQTRLIIWDEAPMAHKFCFEALDHSLRHIIKHNSKDNTIFGGKVMVFGGDFRQIPPVIPRGSRNNSKLLSYLYTF

SEQ ID NO: 189271 - protein, 49 aa, Glycine max
  Coding DNA Sequence Number=SeqID_72493
MEVPHDAQELTPVRLLRIGEIDHIEMMPEEEEVYHELLRDVESSSEEED

SEQ ID NO: 189272 - protein, 78 aa, Glycine max
  Coding DNA Sequence Number=SeqID_72494
MGLFLKYFREGALLDVKCMHATPKPPVGLAGSLLWEPPVKLTSFRYRFRRPVALAFSGGRLPFSVDRPKDKLQLSLTS

SEQ ID NO: 189273 - protein, 45 aa, Glycine max
  Coding DNA Sequence Number=SeqID_72495
IAGIVSGRGSAQSEVRVYDLMWVIKCGIVTMDHDFEEVIFHFNLV

SEQ ID NO: 189274 - protein, 184 aa, Glycine max
  Coding DNA Sequence Number=SeqID_72496
  Gene Ontology: Mol. function=metal ion binding; Cellular component =integral to membrane; Biological process=ubiquitin cycle
  Homolog annotation: Hit_ID=Q6EPF2; Match level="QueryCoverage=96%, HitCoverage=45%, E-value=3e-71, Identity=66%"; Hit description=Ring zinc finger protein-like
  Pfam annotation: Domain name=zf-C3HC4; Domain location=130-170; Score= 41.1; E_value=3.9e-09; Accession=PF00097.15; Description=Zinc finger, C3HC4 type (RING finger)
MLSFIWWIVGFYWVTAGGQSLTRDSPQLYWLCITFLAFDVVIVLICVSVACLIGIAVCCCLPCILAILYVVADPEGATKEEIDQLPKYKFRIIKEFKKEGDIEESSRGIMTETESETAAEHVIALEDAECCICLSAYDNDAELRELPCNHHFHCTCIDKWLLINATCPLCKFNILRTGNHYQEV

SEQ ID NO: 189275 - protein, 815 aa, Glycine max
  Coding DNA Sequence Number=SeqID_72497
  Gene Ontology: Mol. function=protein binding; Cellular component =membrane; Biological process=defense response
  Homolog annotation: Hit_ID=Q1S2W5; Match level="QueryCoverage=48%, HitCoverage=43%, E-value=3e-42, Identity=35%"; Hit description=NB -ARC domain, putative
  Pfam annotation: Domain name=LRR_1; Domain location=472-493; Score =1.1; E_value=1.8e+02; Accession=PF00560.23; Description=Leucine Rich Repeat
  Pfam annotation: Domain name=LRR_1; Domain location=496-519; Score =0.4; E_value=2.4e+02; Accession=PF00560.23; Description=Leucine Rich Repeat
  Pfam annotation: Domain name=LRR_1; Domain location=520-547; Score =0.8; E_value=2e+02; Accession=PF00560.23; Description=Leucine Rich Repeat
  Pfam annotation: Domain name=LRR_1; Domain location=549-570; Score =6.1; E_value=20; Accession=PF00560.23; Description=Leucine Rich Repeat
  Pfam annotation: Domain name=LRR_1; Domain location=627-648; Score =5.8; E_value=24; Accession=PF00560.23; Description=Leucine Rich Repeat
  Pfam annotation: Domain name=LRR_1; Domain location=650-672; Score =5.3; E_value=30; Accession=PF00560.23; Description=Leucine Rich Repeat
  Pfam annotation: Domain name=LRR_1; Domain location=674-696; Score =5.8; E_value=24; Accession=PF00560.23; Description=Leucine Rich Repeat
  Pfam annotation: Domain name=LRR_1; Domain location=698-721; Score =9.8; E_value=4.2; Accession=PF00560.23; Description=Leucine Rich Repeat
  Pfam annotation: Domain name=LRR_1; Domain location=723-746; Score =5.9; E_value=23; Accession=PF00560.23; Description=Leucine Rich Repeat
  Pfam annotation: Domain name=NB-ARC; Domain location=8-284; Score= -94.6; E_value=0.0003; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::NB-ARC; Domain location=472 -493::496-519::520-547::549-570::627-648::650-672::674-696::698 -721::723-746::8-284
MVIVAPMKNVKMLPNLDAQEEEEATVVRGYAKKGIIKCILETGEGVNVRAVVIRGITGMEKGRAAKYVCEDEKVKSGFDVVVWINGLQLQRHYAESVVNHVKHELQEKKKENDSGEGKGFFVVLDDFHNENHKEWLESVKKLKEVAETRASSGGGVFLVITRSKAVIEFVDQSFDFVHKYRFDRSSHSESRFLFEQIAGTSVSVIKSETEDSLLEMCGGILGAIETMERLEMLLKYYNEFNLSSWCLRQCFAYSFFIFSSQDSVKGEKLVRLWMVEGYLAHSSSSSSPVLEDLGHECIEEFLHRSIFRVNEDGEIYSIFKEGELAELCVHQVARVDSEKFRHEGVAGFNWGLEEFEIPRFVSQQLQQTSYLHRHLEVDECTNLMHMPSALRKLTWLRSLPHFVTSKRNSLGELIDLNEQHLEGLTLRWNHDDNDDQDEIMLKQLEPHQNLKRLSIIGYQGNQFPGWLSSLNNLVEISLYKCSKCQSLSTLNHVLVNLEKLTLMSLDSLEFIKDNGSEDLRLKQVQISDCPKLTSWWKNPETHNTTVFTAISELVVEYCPKLVSLPLFPMLDYRLVLESFNMKLLLNTLRHNSTGPDPSLSKLNHLTMINADEKQYQREEKMLKNLTSLSSLDIKNCKALKFIKGWKHLNSLEILHITNCTDIDLPNDEWEGLKNLSNLIIEDMSDLKSLPEGIKHLTNLDNLEIRSCPNLEVVPKEVGEGLNDFTFIVIDDCPKIASLPESLINNFIGLKIGNCPLLEPWNKSRPKLPLQASDIQEEQNLTSPDSNKTSNEIQNVIPPTNSRPQCNYCGTFASLY

SEQ ID NO: 189276 - protein, 172 aa, Glycine max
  Coding DNA Sequence Number=SeqID_72498
  Homolog annotation: Hit_ID=Q941L2; Match level="QueryCoverage=95%, HitCoverage=88%, E-value=1e-09, Identity=31%"; Hit description=BON1 -associated protein 1
  Pfam annotation: Domain name=C2; Domain location=1-89; Score=16.2; E _value=0.0088; Accession=PF00168.20; Description=C2 domain
MEITIISAENLCMNGKPLKDHPYVVVHTQSCTKFFTTRMPTQEEGGSKSTNNNPSWNDKFRVDDGDSDCITLEVQCKTWFGVRSVGAARIAVADFAAEKSLQLLSYRLWDGKGRRNGVINFSVRVVEKPAESESLCSMHEAEAQRTIGGNDDSRGIVTGIPVFWNYPLNIPR

SEQ ID NO: 189277 - protein, 226 aa, Glycine max
  Coding DNA Sequence Number=SeqID_72499
  Gene Ontology: Mol. function=catalytic activity; Cellular component =intracellular; Biological process=metabolic process
  Homolog annotation: Hit_ID=Q1S1R8; Match level="QueryCoverage=76%, HitCoverage=40%, E-value=5e-72, Identity=74%"; Hit description =Tetratricopeptide-like helical
MSSHGPPLSQVMHKRTPMKNPGRFFCDMRIAGNGKGGDSLRFYDAKLEEAKEILNQMDVKHDATVWKALLAACRVHGNLQFGERTTTNLFELEPMNAMPYVMLSNKHSEARKWDDAAKIRRLVKSKVITKGPGCSWIEMNCRVRTFISEDRGHPREAEIYSKIDEIVRRTKEVGYVPDMNFFLHDMDREGKEVGLAYHSEKLGLLASQTSAPIRMFKNEFVEIVLL

SEQ ID NO: 189278 - protein, 45 aa, Glycine max
  Coding DNA Sequence Number=SeqID_72500
MTVVIVTSINHDRGDRKDDNDSNQDNRGDFITPTSIHLPAPDASR

SEQ ID NO: 189279 - protein, 584 aa, Glycine max
  Coding DNA Sequence Number=SeqID_72501
  Gene Ontology: Mol. function=oxidoreductase activity; Cellular component=chloroplast; Biological process=metabolic process
  Homolog annotation: Hit_ID=Q9FRX6; Match level="QueryCoverage=76%, HitCoverage=80%, E-value=1e-126, Identity=51%"; Hit description =Aureusidin synthase
  Pfam annotation: Domain name=Tyrosinase; Domain location=103-427; Score=454.1; E_value=1.9e-133; Accession=PF00264.10; Description =Common central domain of tyrosinase
  Subcellular localization annotation: CTP_CleavageSite=55; ConfidenceScore=5.33e-01
MGNPSKLFPFFFAFIVFLMPLVSLSHNDFSTFAIKTVSYLVSFSENPNHNGHITTSSNERDKSRLWRKAFIGLKNTHEPSSNISRAISLNARECFPVELPSDAITSTRCCPPRPSPSNIIDFKDFASPNATLRVRKPAHMVDEEYIAKLEKGIALMKALPDDDPRNFIQQAKVHCAYCNGAYHLRHPFQDTKLNIHRSWFFFPFHRWYLYFFERTLGKLIGDPNFALPFWNWDSVEGMQIPSYFNNPNSSLYHQLRNQNHLPPHVVDLNYNKLDPNDDTPSHQQVSYNLAFMYKQMVLASTKELFMGSPFRLGDNPTPGMGSIEAAPHNTVHTWVGAADKPHHEDMGAFYTAARDPIFYAHHPNSDRLWGLWKTLEGGRKDYSDDPDWLDSEFYFYDENANFVRVKVRDCLDTKKLGYVYEDVDLPWLRTPPTSPKSKLLREANKSPLLSSKPSKFPLVLDSITSTVVKRPKKLRSKEEKEQEEEVLVIEGIEFGSDKYVKFDVHIDDDEDNLSEPDQTEFVGTFVNLFHGQGHNINTSFKVGISKVLECLEAEEDDVVLVTLVPKVGKGDVIIGGIKIEFIPK

SEQ ID NO: 189280 - protein, 115 aa, Glycine max
  Coding DNA Sequence Number=SeqID_72502
DRARKTPSGPRDVQQGLGFPALVTGLYKSYRAPVPPSSLCHRDLGIVPAKHSVDPEKSNRVLGLPALITGLCRFYGVPVAPSKVIRPPINQAFIKKYCAPRQAQGETPQQHWDGR

SEQ ID NO: 189281 - protein, 77 aa, Glycine max
  Coding DNA Sequence Number=SeqID_72503
  Subcellular localization annotation: CTP_CleavageSite=59; ConfidenceScore=5.42e-01
MPIALQTQVQVLKSLVKPALPCTFGRANKSCDMQSFVASHSGDMPRDSSLSKAPSALAPCMAEMERIDIVLRSENPY

SEQ ID NO: 189282 - protein, 65 aa, Glycine max
  Coding DNA Sequence Number=SeqID_72504
  Gene Ontology: Mol. function=protein serine/threonine kinase activity; Biological process=protein amino acid phosphorylation
  Homolog annotation: Hit_ID=Q66MH7; Match level="QueryCoverage=78%, HitCoverage=14%, E-value=2e-18, Identity=88%"; Hit description=MAPKK
MKTKMPLKQLKLAVPAQETPITSFLTASGTFHDGDLLLNQKGLRLISEEKESRNLLFALSHTFNQ

SEQ ID NO: 189283 - protein, 86 aa, Glycine max
  Coding DNA Sequence Number=SeqID_72505
MVALGEVESAWDIRNGFGRKKEEEMVFLLSYTKAKAENAQVRNGLGHRNVAHTPDIFSTIPTLRTKFHEDPTVNKGWAVFIPRQLM

SEQ ID NO: 189284 - protein, 368 aa, Glycine max
  Coding DNA Sequence Number=SeqID_72506
  Gene Ontology: Mol. function=protein serine/threonine kinase activity; Cellular component=intracellular; Biological process =protein amino acid phosphorylation
  Homolog annotation: Hit_ID=Q66MH7; Match level="QueryCoverage=73%, HitCoverage=81%, E-value=1e-118, Identity=75%"; Hit description=MAPKK
  Pfam annotation: Domain name=Pkinase; Domain location=88-332; Score =222.1; E_value=1.2e-63; Accession=PF00069.15; Description=Protein kinase domain
  Pfam annotation: Domain name=Pkinase_Tyr; Domain location=88-332; Score=16.2; E_value=1.8e-13; Accession=PF07714.7; Description =Protein tyrosine kinase
  Pfam module annotation: Pfam domain module=Pkinase::Pkinase_Tyr; Domain location=88-332::88-332
MIGSNLFVLSPPVLDTHLAQSILSHWAHSTHSNSVLYHHSACIIYRFIFCPFSLFSFLGFEHLRLTIYLFEQPSDGKELEFDFSLDDLETIKVIGKGSGGVVIQMNIQEDIRKQIVQELKINQASQCPHVVVCYHSFYHNGVISLVLEYMDRGSLADVIKQVKTILEPYLAVVSKQVLQGLVYLHNERHVIHRDIKPSNLLVNHKGEVKITDFGVSAMLASSMGQRDTFVGTYNYMSPERISGSTYDYSSDIWSLGMVVLECAIGRFPYIQSEDQQSWPSFYELLAAIVESPPPSAPPDQFSPEFCSFVSSCIQKDPRDRLTSLKLLDHPFIKKFEDKDLDLGILAGLTRVLSLFLCILKCDEELKPK

SEQ ID NO: 189285 - protein, 531 aa, Glycine max
  Coding DNA Sequence Number=SeqID_72507
  Gene Ontology: Mol. function=DNA binding; Cellular component =intracellular; Biological process=DNA integration
  Homolog annotation: Hit_ID=Q1SH28; Match level="QueryCoverage=67%, HitCoverage=41%, E-value=2e-60, Identity=46%"; Hit description =Integrase, catalytic region
MAIIEIRVVTLLMYGVRRMDSQLKMNLQNISIEADHGVNQIHVARERGDDHTTNSGTEGISYALSFSSSKIHASWQLPSKLLSNCCPYQLLYGSLPDIDNIKVFGSLCYLSTLTSHRSKFDAWARKCAFLGHKAGVKGFLAYDVHNSPPDDTPPLPLVYSSPGPSPSEPPQHTHEPSNHIQPDTLTSSPRRKAKKQIPEKNAKEEKKKRKSGVEALQSCDRRSLPSSFLLDAMQAELDAFNSNHTWTIIDLPPNITPFVNKWVYKIKRKADGSIECYKARLVAKGYTQTEGVDYFDTFSPVAKLHTIRLLLALASTKNWYVHQLDANNVFLHGELLEDVYMTIPQGVVSPGPNKACKLLKSLYGLKQSNRKCISLAWKQLILNKESLCQRQYCLDLLSDFGVLRSKPASNPMDPGTQLAEADSPPFPDVASYKRLVGRLLYLTTTHPDISHAVQQLLGSLTSSVSVLEMQLIYLGGVRKSHIACLSSWAVTYISVGQLHLAALQSLHCLKGSPGKGFAAFFLSLPNLQAWD

SEQ ID NO: 189286 - protein, 123 aa, Glycine max
  Coding DNA Sequence Number=SeqID_72508
  Gene Ontology: Mol. function=cytokinin dehydrogenase activity; Cellular component=vacuole; Biological process=electron transport
  Homolog annotation: Hit_ID=Q9FUJ1; Match level="QueryCoverage=84%, HitCoverage=20%, E-value=1e-31, Identity=58%"; Hit description =Cytokinin dehydrogenase 7
  Pfam annotation: Domain name=Cytokin-bind; Domain location=1-113; Score=-57.8; E_value=6.3e-10; Accession=PF09265.1; Description =Cytokinin dehydrogenase 1, FAD and cyto
MDKDVYSPTGLQRHRWDSRHSVVVPDSNIFYIIALLRFIPPPPKGPPTELLVEQNHEIIQLCYNRGFDFKLYLPHYQSKENWMRHYGDKWSRFVERKANFDPLAILAPGQKIFSRIPQPLSIT

SEQ ID NO: 189287 - protein, 99 aa, Glycine max
  Coding DNA Sequence Number=SeqID_72509
  Homolog annotation: Hit_ID=Q9FML0; Match level="QueryCoverage=53%, HitCoverage=27%, E-value=2e-09, Identity=54%"; Hit description =Arabidopsis thaliana genomic DNA, chromosome 5, P1 clone:MDC12
  Subcellular localization annotation: CTP_CleavageSite=39; ConfidenceScore=5.42e-01
MYGIKLVAVIIAVRSTVQKPRASIKLRVARSFCRRQSVVATNAVVCCVQQRIGGGNGTVDNKDFGVAANVTKFAVSGARENLAVVATKELDSLTVLTTQ

SEQ ID NO: 189288 - protein, 142 aa, Glycine max
  Coding DNA Sequence Number=SeqID_72510
  Subcellular localization annotation: CTP_CleavageSite=9; ConfidenceScore=5.15e-01
MLTMPTKVLSFLRRSLIRGRPLLQPQSYTAVSFLRRPLLQPQSLGNKTPHHTVSPNATKKRKSHKESHIKGTDAFRFGTVTSRNPIFFSRLQAEVTQRLTSAKESSSKPALQSHEDLAKKLQNPEPNADLLSESAYRIKALI

SEQ ID NO: 189289 - protein, 188 aa, Glycine max
  Coding DNA Sequence Number=SeqID_72511
  Gene Ontology: Mol. function=signal transducer activity; Cellular component=membrane; Biological process=regulation of transcription, DNA-dependent
  Homolog annotation: Hit_ID=Q7WJC4; Match level="QueryCoverage=99%, HitCoverage=35%, E-value=4e-70, Identity=77%"; Hit description =Methyl-accepting chemotaxis protein
  Pfam annotation: Domain name=MCPsignal; Domain location=2-185; Score =210.3; E_value=4.3e-60; Accession=PF00015.11; Description=Methyl -accepting chemotaxis protein (MCP) signaling domain
MDVAWRGGVPVGQVVNTMHGISDSSRKIVDIVSIIEGIAFQTNILALNAAVEAARAGESGKGFAVVAGEVRSLAQKSAQAAKEIKGLIEDSVERVSEGSAQAEQAGATMQEIVDAVHRVTDIIGEISQASQEQSSGIEQVDSAVSQMDVMTVQNTALVQELGGAVLQLGNQSGALRETIRVFRLTGQQ

SEQ ID NO: 189290 - protein, 88 aa, Glycine max
  Coding DNA Sequence Number=SeqID_72512
MSEIEEVQEQMKVVMEAMKEQMATMMEAMLSMKKIMEERVRSIEGGGDYAFADMVELCLVPDVVIPSKFKPSPGILIWNLPKSILGKT

SEQ ID NO: 189291 - protein, 124 aa, Glycine max
  Coding DNA Sequence Number=SeqID_72513
METCPTVEELLQQMMDHGQLEVVNLSPSSIRTARQSHGGMLLQGQVRGRMIPPVLTLFWQNGRQRRRGERRRHPLGNKPWKKELHHQDEPWIRSSEGCFNGGKERGRERERGEHEIEGRKRERS

SEQ ID NO: 189292 - protein, 198 aa, Glycine max
  Coding DNA Sequence Number=SeqID_72514
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=5e-30, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTIRGLHALAIRGLHALALRGLHVLAFGGQHVLAFRGLHVLAFRGLHALSFRGLHSFSFRGLHVLAFRGLHVLALGGMHALAFRGLHVLTFEGLYVLAFRRLHALTFRGLHFLAFRGLHVLTFRGLHVLLFRGLHALTFRGLHFLAFRGLHALAFRGLHVLAFKGLNTLTFVGLHALAFIGLYICVFRELKLLYP

SEQ ID NO: 189293 - protein, 79 aa, Glycine max
  Coding DNA Sequence Number=SeqID_72515
YGKVIHKKDSCSQIVMLGHEKLTKFSLKVAAATVQVFGSVHEGDRVDVTPSQSGAKEMCLAKNALIEEGGNYGEWMIAK

SEQ ID NO: 189294 - protein, 234 aa, Glycine max
  Coding DNA Sequence Number=SeqID_72516
  Gene Ontology: Mol. function=oxidoreductase activity; Biological process=D-gluconate metabolic process
  Homolog annotation: Hit_ID=Q5PJC8; Match level="QueryCoverage=99%, HitCoverage=68%, E-value=8e-72, Identity=55%"; Hit description=L -idonate 5-dehydrogenase
  Pfam annotation: Domain name=ADH_zinc_N; Domain location=60-196; Score=135.4; E_value=1.5e-37; Accession=PF00107.16; Description=Zinc- binding dehydrogenase
MRFFGSAMYFPHVDGAFTQYKVVDSAQCIPYGADRDDRVMVFAEPLAVAIHAAKQPGDVTGKKIFVSGVGPIGCLLVAALKALGAAEIVCADLSPRCLAIARQMGADRCLHAADDDVSGYQQDKGYFDVAFEVAGHPQSLQRCLEITRAKGTVVQVGMGASFPDFPLMLLIAKELNLLGSFRFVAEFALAVAWLADDVVDPLPLLSAEFASGQLAQALEFAGDKRQAAKVQLVF

SEQ ID NO: 189295 - protein, 121 aa, Glycine max
  Coding DNA Sequence Number=SeqID_72517
  Gene Ontology: Mol. function=protein binding
  Homolog annotation: Hit_ID=Q5PN67; Match level="QueryCoverage=77%, HitCoverage=92%, E-value=3e-21, Identity=51%"; Hit description =Hypothetical protein elaB
MGDLFAGQQQPQHQPYGGADAYAVPGFIPHVVVGAVYRFFGARIVGFAGVRPARLNLTQRLLGVRLDVDVGLIRAIAGVLQHFLQRLGQHSQIVIQRSLLSIRMSCHSEISVVEKLSVPTL

SEQ ID NO: 189296 - protein, 266 aa, Glycine max
  Coding DNA Sequence Number=SeqID_72518
  Gene Ontology: Mol. function=o-succinylbenzoate-CoA ligase activity; Cellular component=membrane; Biological process=menaquinone biosynthetic process
  Homolog annotation: Hit_ID=Q8D0S3; Match level="QueryCoverage=97%, HitCoverage=53%, E-value=2e-96, Identity=68%"; Hit description=O -succinylbenzoate-CoA ligase
  Pfam annotation: Domain name=AMP-binding; Domain location=1-192; Score=-134.4; E_value=0.065; Accession=PF00501.18; Description=AMP -binding enzyme
MVWRWLAAGARLAVREMHPLAEALAGCTHASLVPTQLWRLLAQPLTGMTLKEVLLGGAMIPVELTERAEAAGIHCWCGYGLTELASTVCAKRADARPGVGLPLSGREVKLVDEEVWIRADSLALGYWCHGQLQPLADAQGWFATRDRGAMAEGELRILGRLDNLFFSGGEGVQPEDIERVLAAHPQISQAFVVPAADVEFGQRPVAVIDGDPSLSLAALLAWSQDKLANFQRPAALLPLPDELKNGGIKISRRQLQQWVAQRLSQA

SEQ ID NO: 189297 - protein, 147 aa, Glycine max
  Coding DNA Sequence Number=SeqID_72519
  Gene Ontology: Mol. function=oxidoreductase activity; Cellular component=periplasmic space; Biological process=response to oxidative stress
  Homolog annotation: Hit_ID=Q66D03; Match level="QueryCoverage=98%, HitCoverage=30%, E-value=3e-75, Identity=91%"; Hit description =Catalase
  Pfam annotation: Domain name=Catalase-rel; Domain location=98-147; Score=-6.7; E_value=0.011; Accession=PF06628.3; Description=Catalase- related
GRLFSYGDAHRYRLGVNHHQIPVNGAKCPFHNYHRDGAMRVDGNSGNGATYEPNSFGLFQEQPDFSEPPLSIEGAADHWNHREDDDYYSQPRALFNLLSAEEHQRMFTRIAGELSQVPEQIQRRQIELFTKVHPDYGAGVAKALGLK

SEQ ID NO: 189298 - protein, 98 aa, Glycine max
  Coding DNA Sequence Number=SeqID_72520
MEVGNGRRSRGSESKNQNIRSPREKNNLENIFSGKKNSPFAKRKPCAKRISVHTLSRESHTLSAQPLHLRLIHFAKLAMAKLSLIEFNLNSAKLQPDS

SEQ ID NO: 189299 - protein, 56 aa, Glycine max
  Coding DNA Sequence Number=SeqID_72521
MAGHGRDQNRDVEPAEYRGLMAFRKNHPPKFSGDYDLEGARSHSLILGYGEFVPNS

SEQ ID NO: 189300 - protein, 33 aa, Glycine max
  Coding DNA Sequence Number=SeqID_72522
MVMSGGEGGLGLQNSFGRNFARLGKLAQLRLAW

SEQ ID NO: 189301 - protein, 125 aa, Glycine max
  Coding DNA Sequence Number=SeqID_72523
MHIGARFHPYHHREMSTDHAHHHNSDLPLPKCQLVCVVMTYGSHPQDTQWTLRSPTGPWDFQLWLRASVSPIGYRVSVPPSKGSYPQDIQWTRRSPTGPWGFQLWLQASVNPIGCPSPPARSSDL

SEQ ID NO: 189302 - protein, 123 aa, Glycine max
  Coding DNA Sequence Number=SeqID_72524
  Gene Ontology: Mol. function=RNA-directed DNA polymerase activity; Biological process=RNA-dependent DNA replication
MAPDRTQLQNMVKKESETFNEYAQRCRDLATQVALPMVERKMITMMVDTLPVFYYEKLVGYMPSSFADLVFAGERIEVGLKRGMFDYVSSASGNARRIGTTGAKRKEGDTHAVTLAPAWVKPP

SEQ ID NO: 189303 - protein, 167 aa, Glycine max
  Coding DNA Sequence Number=SeqID_72525
  Homolog annotation: Hit_ID=Q571R6; Match level="QueryCoverage=58%, HitCoverage=7%, E-value=9e-23, Identity=55%"; Hit description =Osmosensor histidine-aspartate kinase
MGLISGNQFGPLGDNGNPNRENEGPIRKKVIWLRKVIKPIVRGHCQIPLRVDQALYGSRALYASVNGHANNLATQADQVEVELTMYDAMRVVTWALFACKKALNSITVKYKNGFVQAFDRDLKDNNTFYIYSDLANYSMVASGYNEINSRSSCEAWNDKDIHGIGAK

SEQ ID NO: 189304 - protein, 98 aa, Glycine max
  Coding DNA Sequence Number=SeqID_72526
  Gene Ontology: Mol. function=microtubule motor activity; Cellular component=microtubule associated complex; Biological process =anterior/posterior pattern formation
  Homolog annotation: Hit_ID=Q2HTE3; Match level="QueryCoverage=97%, HitCoverage=9%, E-value=3e-36, Identity=76%"; Hit description =Kinesin, motor region
  Pfam annotation: Domain name=Kinesin; Domain location=3-98; Score= -190.0; E_value=0.02; Accession=PF00225.13; Description=Kinesin motor domain
MYSKEKGTNVQSIVGKHINRVFTFDKVFGPSTQQMDLYEQVVTPIVNEVLEGFNYTIFAYGQTGTGKIYTMEGKCKKAKSGPNGKLPLGAGVIPRVVK

SEQ ID NO: 189305 - protein, 222 aa, Glycine max
  Coding DNA Sequence Number=SeqID_72527
  Homolog annotation: Hit_ID=Q9AUH6; Match level="QueryCoverage=40%, HitCoverage=22%, E-value=3e-16, Identity=47%"; Hit description=F-box containing protein TIR1
  Subcellular localization annotation: CTP_CleavageSite=62; ConfidenceScore=5.63e-01
MVSYLSLSSSLSMRKKGVRCMFYVSHQTSSKLLRWTSLRVGKRASQPSSHLFNPSLAGNLKRQSLKNAISNPIPHRRPPPRIPLVQALSSISKYWISHIDHGGAKAFTAREKEVLEGGEGVGEEVEVMVSEGHVFEVEVGEAWLAINGHRPNAGELGAGAMRGHDVAVFDEELGAAHFPRHSLGLGPIEGKGFDHRQFGSSLASEIEKMRVSEEGGARVAFA

SEQ ID NO: 189306 - protein, 66 aa, Glycine max
  Coding DNA Sequence Number=SeqID_72528
  Gene Ontology: Mol. function=nucleic acid binding
  Homolog annotation: Hit_ID=Q1T4Y5; Match level="QueryCoverage=97%, HitCoverage=22%, E-value=2e-20, Identity=69%"; Hit description=Zinc finger, CCHC-type
MFQIFVKGKELWGHVDGTDYAPDKTMHKEAHAKWEVKDAQVMTWIISSVEPNIVLNLRPFTTAAKM

SEQ ID NO: 189307 - protein, 79 aa, Glycine max
  Coding DNA Sequence Number=SeqID_72529
MVVKDLIDNDKGGWNLDLLNNILHHEDVEEVLRVSVLTNGDEDALWMMGRDTLGYSGRIGSMNLEELASGDYPTFSALI

SEQ ID NO: 189308 - protein, 323 aa, Glycine max
  Coding DNA Sequence Number=SeqID_72530
  Gene Ontology: Mol. function=RNA-directed DNA polymerase activity; Cellular component=extracellular region; Biological process=RNA -dependent DNA replication
  Homolog annotation: Hit_ID=Q2HS45; Match level="QueryCoverage=91%, HitCoverage=60%, E-value=6e-70, Identity=38%"; Hit description=RNA -directed DNA polymerase
MWLKGIFYLFNDIPVDFDHVLNVIDNKISEEDNITLLAPFEDEEFCCVMFQVHPDKALGHDRMNPRFYRHFWNVCGNHIIDTCKSWLASSSIPHALNETNISIIPKCDKPRSMKDLRPISLCNAAYKVLSKVLANCLKPFFPSTISEERRAFVENRAIIDNILLANEIVHYLNCETRGHWISMFLESVVFSIIVNNEEVGPTHPSQGSRQGNPLSLYLFLLCVEGLLTLIKLTKAWEECIELKNIMEIHGNALGVKEGLGRGKYPGMHSLIGRSKKSMSNFAKDKIWCKIQSWSGRFLSRVGKEVMIKVVLQAIQTYCTEASL

SEQ ID NO: 189309 - protein, 46 aa, Glycine max
  Coding DNA Sequence Number=SeqID_72531
MAPDAFKMCMEACLFLYHVAVAIATDPFEHPLLILHDLLLKLVVAK

SEQ ID NO: 189310 - protein, 120 aa, Glycine max
  Coding DNA Sequence Number=SeqID_72532
  Subcellular localization annotation: CTP_CleavageSite=30; ConfidenceScore=5.48e-01
MPHITTHSSVPLSVISLTSLSTTLTLDLHNCTTRRDLCNNSSGTMSTRGLLDLPSVRTRPLKFMRMWEIFSDDKDLTSSEIAYYWDVISEEILEGEMLSFDKEHDSSGDESDISKYMTSP

SEQ ID NO: 189311 - protein, 134 aa, Glycine max
  Coding DNA Sequence Number=SeqID_72533
MRPSPGAVPLCICKGKAAYNIPPPYLRITKSLRAMGYEVFYCLYIISNTHLYLCTIVCEFHISIETPVEDSTRISHACWNLTSESKASKTLEGTGSGQSSSETMLSRIFLISVALNIGHNTMLTTSNLKKNSIS

SEQ ID NO: 189312 - protein, 165 aa, Glycine max
  Coding DNA Sequence Number=SeqID_72534
  Gene Ontology: Biological process=protein modification process
  Homolog annotation: Hit_ID=Q8L8S0; Match level="QueryCoverage=44%, HitCoverage=77%, E-value=2e-24, Identity=74%"; Hit description =Ubiquitin-like protein
  Pfam annotation: Domain name=ubiquitin; Domain location=53-124; Score= 44.1; E_value=4.7e-10; Accession=PF00240.13; Description=Ubiquitin family
MMGCQCHNVNADVTHSIDGDLLANYFWMSVMHCGKFGVILIQTVAYWQDMYIRVKRSKTTYFIRCKPSDKILDIKQKLQELVDQPANNQRLILPVTGEVLEDSKTLADQKVENDAVVALTLRKGNGYTVILFLAANLVSFLPSLVVCRVLLPVVYVVHQRCIRDA

SEQ ID NO: 189313 - protein, 82 aa, Glycine max
  Coding DNA Sequence Number=SeqID_72535
MDQTSSGCGVRQFKSYLLHKQEKDLNSDTNAMMRSQAVFSEGSFIGCHDLENRVHHDMNVTIKDLLKRMTLEEKICSRKKHA

SEQ ID NO: 189314 - protein, 131 aa, Glycine max
  Coding DNA Sequence Number=SeqID_72536
MAVVTLRRIYQSPFPQWYNPNATCAYHGGTPGHSTEQFDRLNAIEECGLQRPKQLKDVITSRRFILMALREVGINGSPCNVGVWVQTQKGFRSEQRRRGELGRVQREPWKQGPQVKGTPLCHINKSFVSTG

SEQ ID NO: 189315 - protein, 109 aa, Glycine max
  Coding DNA Sequence Number=SeqID_72537
MASTSGDATLSSPKITRLEAEMIKLGDQMRRMSYDNEERMERMRKENDESLGRIYRSSEALSVRIENIERKRVMMDMKRMREDGGMKGIGREEIIQDMEVDKERKGLRE

SEQ ID NO: 189316 - protein, 40 aa, Glycine max
  Coding DNA Sequence Number=SeqID_72538
MEPNCHDIQMPDRSSLNKENDLTTYGTFVDVDPLHNIENL

SEQ ID NO: 189317 - protein, 152 aa, Glycine max
  Coding DNA Sequence Number=SeqID_72539
  Subcellular localization annotation: CTP_CleavageSite=74; ConfidenceScore=5.18e-01
MLPAEEGSAGSSTTIKCSLRNLLPLDPAEEPSSPSSAGTRGRTFSPFFRRSPWKNSFFRYNIQLPLPHARKKVLLAEESSSSTSGTTHHYTSLMSSILRPFTRFKQTRAVEEKKGTKFEIEKQMKGAKEERKKTKEEDEPFWKEKNESAKEE

SEQ ID NO: 189318 - protein, 83 aa, Glycine max
  Coding DNA Sequence Number=SeqID_72540
MAFGGPGARLGKLELHPEQLGGPGEPEAGLGEPGSRKLPEMTLLPLPFSIFRILDQTSNDHLFRTVTGVQHHKSTSKDQKINK

SEQ ID NO: 189319 - protein, 535 aa, Glycine max
  Coding DNA Sequence Number=SeqID_72541
MTLAKRANKAIMEQLLASLDARTFFSSFAHLKARVDPPRSFEADEDEVVKVMPNVPSPSVSFSYGVEESGYRVDVRFESPFSRSSRSSFLHAYYVDPLAVLATTPPFSTIVLLLSVGVATTSVLVDLPLCSSAMPVSALTVSLLAMLALSSCTSENGQRNQEALNKVASLEPEVAKCRATAWTVWRGRVVWANHQLLSRVDDVLAMLLRIRLDGDEVFERCKDLLKERNDLASRVEHTVEEKEEHTATMVKYAKVIADLQAQLKEAQSKINESKLEATKEKETNKKLEKELLVFKKEVMEQHEKGFYKAIRQVKFFSKGPDLSLFDPFKDVKNNELHNEEDIDVGEEDVGEEKDDGANGSPRTDLGFGRAMEIRQGSPRTNLGCDEPWRFIKARQGRTLGMTSLEDSLRLTKGGRWVLVSLGDPSRLTKGRPWIRQGSPRADLVFDEPWRFVEAHQDWTLGSPRVNLGFDELWRSVEAHQGRTLGLTSLEDSSRLTKAFVPVGLSLLHLRLATLCRQVERLEAGYWYYILLMLEA

SEQ ID NO: 189320 - protein, 114 aa, Glycine max
  Coding DNA Sequence Number=SeqID_72542
MRLVALTLKTILKLAKHVWVKLEHLLGHAIKRHPTYLPCQLHLEEVKEHGHAGSNVEKWTQDLKSPHHCLTVMMKLGRCHVYMLQQGTLKGVQRKGQVQNLEQAAIYIEEGWTT

SEQ ID NO: 189321 - protein, 120 aa, Glycine max
  Coding DNA Sequence Number=SeqID_72543
MTAGKGKPIFEVVLTLGLPFKVAPDWRKSCASHGAAMGYIVSLKYGALVNDLFFLAKACLPFYVKKPGGPFGPANKSYPEPHELLVIHASSTIESGAPRIDCLAQFVYPPPSNLIQSPMN

SEQ ID NO: 189322 - protein, 132 aa, Glycine max
  Coding DNA Sequence Number=SeqID_72544
MEHKRVLIGEAIMLHSLVELPRMCNKCFAYLGVIYITHLIVEAKLHDELRMIQRCFDDNKGDDKKLKGQSKNEFKMFKIESRKNEFKMFKIESRTLQDSRIKLPRIKIKIQDSRIKRRLNQDKYEKVFSKTE

SEQ ID NO: 189323 - protein, 85 aa, Glycine max
  Coding DNA Sequence Number=SeqID_72545
MYNTTITHIRLHYSGHWQMVIILLKENLVVWFSSLNNRPNNYFKGIINSALKGLDDTPQPKSKAGARRIVVKYFNDVRPLESERL

SEQ ID NO: 189324 - protein, 101 aa, Glycine max
  Coding DNA Sequence Number=SeqID_72546
RVYEGSIVVHNIPLLHGQVKVGVEQVKDAEAPVPVPTDEAAVSPAKSHDRPDHEENKVDDHGDDKEGGTGAVGASDGPWHRWPAAAMVVEEPFCFFIDSAI

SEQ ID NO: 189325 - protein, 171 aa, Glycine max
  Coding DNA Sequence Number=SeqID_72547
  Gene Ontology: Mol. function=sequence-specific DNA binding; Cellular component=nucleus; Biological process=regulation of transcription
  Homolog annotation: Hit_ID=O64747-2; Match level="QueryCoverage=30%, HitCoverage=14%, E-value=8e-17, Identity=78%"; Hit description =Isoform 2 of O64747
  Pfam annotation: Domain name=WRKY; Domain location=41-101; Score =26.5; E_value=4e-07; Accession=PF03106.6; Description=WRKY DNA -binding domain
MEINGCERVLTTDTPPLKTVCFGLALASLINKGCVLTLCLEWQKPNPLLRSQNSNKHYFKRGNRIHCSSSKGCSARKQLERSKNDPNMLVITYTSEHNHSWPTQRNALPVMAGNSSNSMKEDNMEDKERHHIEMDEGEFSDGLPYKPSLINHSANNQESEDFFVGYLMSWA

SEQ ID NO: 189326 - protein, 114 aa, Glycine max
  Coding DNA Sequence Number=SeqID_72548
MGIPYIKILLGGRSIRGGQATCPVNDHLGVLPPQFAQQLVSELIVQPGCSPSKLVVLHCAEDHDSSPFGCSSAPYLGTFCVPVRLTASVAAIVTVGFKVHLTASVAAIVAVGFE

SEQ ID NO: 189327 - protein, 80 aa, Glycine max
  Coding DNA Sequence Number=SeqID_72549
MKKSHLLYDSKRDSEHWLPASLAPFPEMSASFDRHYEKVSFSILKTQWMMQAVTNVVTYTLSGDVSIFRPILGKILICYP

SEQ ID NO: 189328 - protein, 117 aa, Glycine max
  Coding DNA Sequence Number=SeqID_72550
  Gene Ontology: Mol. function=DNA binding; Biological process=DNA integration
  Homolog annotation: Hit_ID=Q1S3H4; Match level="QueryCoverage=61%, HitCoverage=12%, E-value=1e-13, Identity=53%"; Hit description =Integrase, catalytic region
MPLRGRIASENYVADHLSRLTTDEVTPQGPGIQEEFFDEKLFNISIRPWFTEMANFKAIGALPDDLTCHQKKQSPTKVKKRLSFELQKAVVGLSSAVGLSAYPPLSAASARLAQRRI

SEQ ID NO: 189329 - protein, 87 aa, Glycine max
  Coding DNA Sequence Number=SeqID_72551
MQGKRKRIDQKPEILEKRRRRMRRGKVELRHCRVVTVDDFLRHFPYFFRGTEFRALLFLSLHSSSSTFKLLSMASYGSELLLDSSST

SEQ ID NO: 189330 - protein, 470 aa, Glycine max
  Coding DNA Sequence Number=SeqID_72552
  Gene Ontology: Mol. function=catalytic activity; Biological process =metabolic process
  Homolog annotation: Hit_ID=Q6X0N8; Match level="QueryCoverage=43%, HitCoverage=27%, E-value=1e-09, Identity=24%"; Hit description =Putative spermine/spermidine synthase
  Subcellular localization annotation: CTP_CleavageSite=49; ConfidenceScore=5.07e-01
MALDASTFETITPSRFIAFTVPHPTCSDSTLRVAVLDSPLQPTDSPRVGAMLVPEGRETDWIFSTESGHLQLLFSSPGISRLILIGTLFKEGTLTLLQSRAYHRSLECSLQHQGFEVWSKPLLLALSPKSLFKRGIPEIPLLSYEDSLVSSVVVHECVGCHVGEMLVEDVEIENESDHGREFRRRLRFKRMPNLIQTEICIIPERDCDGVCIGGDVGFVPDLKVLVHPYLGPMVAGLVLNSEYVEGRIRMGFRPKALCLGVGGGALMTFLRNQLGFEVMGVDSDREVLRVARKYFGLEECEFVRVVVGDAFESMNKLVCGGKLNGRRSSFDDCEVNGFGGHLVVEDEVNCKFDVVMVDLDSSDVRNGVRSPPLEFIRKDVLLAAKLVLCEFGILAINVIPPSRSFYDNLVSHFQEVFHELYKIDVGNGENFVLIATASPLVFSVEDCGNSFLMRLKSVIPEAFINSITKI

SEQ ID NO: 189331 - protein, 64 aa, Glycine max
  Coding DNA Sequence Number=SeqID_72553
MLLQQASIASRFIQDQLLLQNTLFPTYHVSGNWKRGLESSLEEFESRSKGPTTLRAIGLRSTLN

SEQ ID NO: 189332 - protein, 64 aa, Glycine max
  Coding DNA Sequence Number=SeqID_72554
  Gene Ontology: Mol. function=transferase activity
  Homolog annotation: Hit_ID=Q1VT59; Match level="QueryCoverage=100%, HitCoverage=34%, E-value=8e-21, Identity=71%"; Hit description=WblF protein
MSLVGPRPDIPGYYDKLEGENRFVLLLKPGLTSEAGIKYRNEEQILAQQKNPLQYNDEILFPDK

SEQ ID NO: 189333 - protein, 122 aa, Glycine max
  Coding DNA Sequence Number=SeqID_72555
  Subcellular localization annotation: CTP_CleavageSite=70; ConfidenceScore=5.07e-01
MTLHSIFLLVKTIHRSESFVAFGSLSFRCDLFGCYMVVVIMTMTVTITIMMVTMLVVIVMVGTMMVVVVVAEVAVSYDGGGGVVVVMIDVILVVMTVTMMVMMVAMVTTKRIIVKCRKLMFF

SEQ ID NO: 189334 - protein, 69 aa, Glycine max
  Coding DNA Sequence Number=SeqID_72556
MDTSKPYTGAMRGTMHKPQVNLGADQKFSPNRFPAIRTFYIGSKTDVESDDVECMNVNIGFGEPMLTYI

SEQ ID NO: 189335 - protein, 51 aa, Glycine max
  Coding DNA Sequence Number=SeqID_72557
MANVVTCTLPEDQAVTNVVTCTLPEMSASSDRHYEKVSSGIRKNQSTDSKQ

SEQ ID NO: 189336 - protein, 43 aa, Glycine max
  Coding DNA Sequence Number=SeqID_72558
MPCKYQFESRSFKSILEVGLLKEEATGQQAPPRFVEKWFSGLP

SEQ ID NO: 189337 - protein, 71 aa, Glycine max
  Coding DNA Sequence Number=SeqID_72559
MKGPKKVGSEAHWKTNSRFQEGSASEEFRPFWWTWFDRRYSAIILEDTILTDFGIVCLGEIQFALLAGDNP

SEQ ID NO: 189338 - protein, 83 aa, Glycine max
  Coding DNA Sequence Number=SeqID_72560
MVKMVPNSHWEAMRNQCLDEVVNSATTMTSVLSPTVPHDKLLEHGDMTLFERGVESYGFAMVASKCQLAIFALWMAAKPSELR

SEQ ID NO: 189339 - protein, 267 aa, Glycine max
  Coding DNA Sequence Number=SeqID_72561
  Gene Ontology: Mol. function=DNA binding; Cellular component=nucleus; Biological process=regulation of transcription
  Homolog annotation: Hit_ID=Q2L3A9; Match level="QueryCoverage=67%, HitCoverage=39%, E-value=3e-29, Identity=36%"; Hit description =Jumonji family protein
  Pfam annotation: Domain name=JmjN; Domain location=75-119; Score =39.1; E_value=1.5e-08; Accession=PF02375.7; Description=jmjN domain
MMIHQDVLMMPKLSCFKIKESSIQDSTQRFKNQMKKSRSIKPSQSSEHKGGYILCGSLQIECTSTWLFKENKGGYILCGSLLEFEDTLGYIAKIFSQAEPYGICRIFPPPCWVPPRPLQEKDLWENAKFPTRIQQIYMLQNRKPTRKKIRGRKQKRRKQSKMGMGTRTPKSDCYFGLNDANEYEKLVIVVTNRDGNPMWRKLKVYYGADLETGSLGSGFPKTSSLTKNESDRYALSSWNLNNFSRLPGSTLCFEGSHISGVVARKKV

SEQ ID NO: 189340 - protein, 158 aa, Glycine max
  Coding DNA Sequence Number=SeqID_72562
  Gene Ontology: Mol. function=protein serine/threonine kinase activity; Cellular component=integral to membrane; Biological process=protein amino acid phosphorylation
  Homolog annotation: Hit_ID=Q9FG24; Match level="QueryCoverage=92%, HitCoverage=15%, E-value=6e-23, Identity=42%"; Hit description =Receptor-like protein kinase
MNDDPLCLVKHSSRPREEQYLAKWASSRLHDGDSLEQMVDPAIKRTFSSKALSRYADIISLCIQVCRIAHHSFLSYMFVRSIFFSGGVAMKLNMSLVQPVKEFRPPMSEIVDSLVSFSQKLVSKSGAADGTELDPLERSFRTTTSRFIGSPALSYVSA

SEQ ID NO: 189341 - protein, 72 aa, Glycine max
  Coding DNA Sequence Number=SeqID_72563
MEDYGVCPSVDEYDKLIQSLWLEALDWEMAEKLQEEMKESGLRLKSITRGLIRAVKETDKEVVEAESITVVA

SEQ ID NO: 189342 - protein, 58 aa, Glycine max
  Coding DNA Sequence Number=SeqID_72564
  Homolog annotation: Hit_ID=Q9FG24; Match level="QueryCoverage=86%, HitCoverage=6%, E-value=2e-11, Identity=64%"; Hit description =Receptor-like protein kinase
MCSSSLISKQTHASEIEIRDTGYSSPDHGQPAIGSTKSDTFSFGVLLLELLTGRKPFD

SEQ ID NO: 189343 - protein, 301 aa, Glycine max
  Coding DNA Sequence Number=SeqID_72565
  Gene Ontology: Mol. function=nucleic acid binding; Cellular component= intracellular
  Homolog annotation: Hit_ID=UPI00006607D7; Match level="QueryCoverage =37%, HitCoverage=45%, E-value=7e-11, Identity=30%"; Hit description =UPI00006607D7 related cluster
  Pfam annotation: Domain name=G-patch; Domain location=130-174; Score =66.3; E_value=9.7e-17; Accession=PF01585.13; Description=G-patch domain
MDESPANREGKNRAQGNEEQEDDDYMGDLSQFLPSDALFPPKLFSSKKVTSSFPVLPLKDFYSLKESTIHSDDNSLYTVQISSKKDPSVNSSKNRLKTHSWQERRKLERERKQQEEDEQTLAKVEAPIAQSNIGFKLLKQMGYTPGSALGKQGSGRAEPVGIEIRRSRAGVGLEDPHKEKRKNEGIMMDRKRRKEEDLMKEFGSRQKSQWQSRRVIINYNKAKAALDQLENREIVEPQKNDDDAEGEEEEEEEITEEDLHDVLMKLRDEFNYCLFCGCQIGGCLIFIHAELPRDMAACPLS

SEQ ID NO: 189344 - protein, 502 aa, Glycine max
  Coding DNA Sequence Number=SeqID_72566
  Gene Ontology: Mol. function=protein serine/threonine kinase activity; Cellular component=integral to membrane; Biological process=protein amino acid phosphorylation
  Homolog annotation: Hit_ID=Q9FG24; Match level="QueryCoverage=94%, HitCoverage=74%, E-value=1e-101, Identity=47%"; Hit description =Receptor-like protein kinase
  Pfam annotation: Domain name=LRRNT_2; Domain location=29-68; Score =43.8; E_value=6e-10; Accession=PF08263.3; Description=Leucine rich repeat N-terminal domain
  Pfam annotation: Domain name=LRR_1; Domain location=117-138; Score =4.2; E_value=47; Accession=PF00560.23; Description=Leucine Rich Repeat
  Pfam annotation: Domain name=LRR_1; Domain location=139-161; Score =3.7; E_value=59; Accession=PF00560.23; Description=Leucine Rich Repeat
  Pfam annotation: Domain name=LRR_1; Domain location=71-93; Score=5.0; E_value=32; Accession=PF00560.23; Description=Leucine Rich Repeat
  Pfam annotation: Domain name=LRR_1; Domain location=95-114; Score =10.8; E_value=2.7; Accession=PF00560.23; Description=Leucine Rich Repeat
  Pfam annotation: Domain name=Pkinase; Domain location=341-502; Score=- 71.5; E_value=0.00027; Accession=PF00069.15; Description=Protein kinase domain
  Pfam annotation: Domain name=Pkinase_Tyr; Domain location=341-502; Score=-118.2; E_value=3.2e-05; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=29-68::117-138::139 -161::71-93::95-114::341-502::341-502
MVRNYVFVNLVLVLVFSATLVSRCFAFTDPPDVTALQDLYRALNSPPVLNGWNGNDPCEESWTGVACSGSSIIHLKIRGLNLTGYLGGLLNNLQNLKQLDVSSNNIMGEIPLALPPNATHMFLQNNRFTGSVTYLAELPLIDLNIQDNLFSGILPQPFQSIPNLWIGGNKFHALDDSPAWAFPLDNVPIEQNTSRPPITQTNAVENYDPPKVRKQKKKRMGPGGIAFIVGAGTLLVTGFALFIAIRLNKLHRQRMEDYESNHSSLPTKRHIDDVSTTAVDESLQIPPYNAASLLGPRRLTSQIHKRAAGETSRKSFSGRDRFTGRTKVYTIAEVQLVTNSFHEDNLLGEGSLGPLYRAEFPDNKVLAVKNINMAGMSFSEEEKFLDVVCTASRLKHPNIVSLKGYCLEHGQHLLVYDYVRNLTLDDALHCAAYKPLSWSTRLKIALGVGQALDYLHSTFSPPVSHGNLKATNVLLDENLMPRLTDCGLAILRPLTNDKVKNR

SEQ ID NO: 189345 - protein, 71 aa, Glycine max
  Coding DNA Sequence Number=SeqID_72567
  Subcellular localization annotation: CTP_CleavageSite=50; ConfidenceScore=5.46e-01
MATTPPVLLKNGIPGLPGHPWVASGSNPARLSELRSPGRAGRGASVTLPRCFRKQIREGFRPFFIRSSFFN

SEQ ID NO: 189346 - protein, 365 aa, Glycine max
  Coding DNA Sequence Number=SeqID_72568
  Gene Ontology: Mol. function=receptor activity
  Homolog annotation: Hit_ID=Q10MM4; Match level="QueryCoverage=74%, HitCoverage=77%, E-value=5e-26, Identity=36%"; Hit description =Expressed protein
  Pfam annotation: Domain name=DUF1645; Domain location=25-267; Score =19.1; E_value=4e-06; Accession=PF07816.2; Description=Protein of unknown function (DUF1645)
MGFEFEFSARFGCSGSAGSGSMSSADELFLNGQIRPMKLSSHLERPQVLAPLLDLEGNEDEEDEEVVEEGVNVNVSVVRGRDLRLRDKSVRRRTRSMSPLRSNTPLEWAENEEDHDQNVTKPNKTNMISSSEAEKVEDGFGLETTPSASSSRSSSAGRSSKRWVFLKDFLRSKSEGRSNNKFWSTISFSPTKDKKNQNPPNTNKNVASSETTQKPKGSSSSQTWARRISGKPTNGVGKRRVPASPHELHYKANRAQAEELRKKTFLPYRQGLLGCLGFSSKGYGAINGFARALNPVSSSLVLALRIKITPCSRGSFYEGSGSGSCSSLSILLVEDAELIKVLLCTIYQVMYSYSQHFAIYTVAVQ

SEQ ID NO: 189347 - protein, 317 aa, Glycine max
  Coding DNA Sequence Number=SeqID_72569
  Gene Ontology: Mol. function=chitin binding; Cellular component =extracellular region; Biological process=chitin metabolic process
  Homolog annotation: Hit_ID=UPI000044A8F0; Match level="QueryCoverage =71%, HitCoverage=99%, E-value=7e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHVLALRGLQARTFKGQHVLAFRGLHALAFRGLHVLTFKGLHALAFRGLHVLTFRGLYALTFRGLHVLAFRRLHALTFRGMHVLTFRGLCTLTFRGLHVHAFTGLHALAFRGLQVLAFRGLHVLAFRGLHVLAFRGLHVLTFRGLHVLTFRRLHAFTFRGVHVLAFKGCTPSPSEDYTSSPSAGYTPSPSEDYTSSPSQGYTPSPSEDYTSSPSEDYTSSPSEGCTPSHVLAFRGLHILAFRGLHICAFRGLKVSMHVAQLISDAIHYCRDHAHKTPNGPGGAQQGPGVSSSGYGPLSVLQGARPPQQGHAIVT

SEQ ID NO: 189348 - protein, 48 aa, Glycine max
  Coding DNA Sequence Number=SeqID_72570
MELASYIMRDPKRRWVTRSIHSLFLEKDKRLDANNEDWMEKLRRALRS

SEQ ID NO: 189349 - protein, 510 aa, Glycine max
  Coding DNA Sequence Number=SeqID_72571
  Gene Ontology: Mol. function=tRNA (cytosine-5-)-methyltransferase activity; Cellular component=nucleus; Biological process=ribosome biogenesis and assembly
  Homolog annotation: Hit_ID=Q6K4D4; Match level="QueryCoverage=83%, HitCoverage=52%, E-value=1e-101, Identity=44%"; Hit description =Proliferating-cell nucleolar protein-like
MRMFCGGVEGLSNLLMFLVSFHNLFVSQVSRDGSEFFLIKFLLFDMLDVRQVIPTFMSMIYDKGTWLVSYKDVPKYRRSVILSSMFPSGRGHHDLVDSSCSVDPEGITNGINGNAGDGVQAAENPVMSESAAEVCDFPLEHCMRILPHDQNTGAFFIAVLQKVSPLPAITEQTKKKIDEQYVEQSNQSLNDAQVPQITSPESTHEEVLNAVSEENVDDNEPITEDLEVGPVTCEEQNSKETREPDNVQNTTKRVPGKRKLQIQGKWRGVDPVVFFKDETIINSIKDFYGIDERFPFNGHLVTRNSDTNHVKRIYYISKSVKDVLELNFKVGQQLKITSIGMKMFERQTAREGSSAPCAFRISSEGLPLILPYITKQILHASPSDFKHLLQNKEVKFEDFTDAEFGEKAANLLPGCCVVIMCIGKTVVAESLQVDESTIAIGCWKGRARLSVMVTAMDCQELLERLLIRFDTEKGSSGHLDNSSNDVEEVQPVQELNRKNDDDDVKATELK

SEQ ID NO: 189350 - protein, 233 aa, Glycine max
  Coding DNA Sequence Number=SeqID_72572
  Gene Ontology: Mol. function=nucleic acid binding; Cellular component= cytoplasm; Biological process=mRNA polyadenylation
  Homolog annotation: Hit_ID=Q9LX90; Match level="QueryCoverage=51%, HitCoverage=55%, E-value=2e-48, Identity=75%"; Hit description=RNA binding protein-like
  Pfam annotation: Domain name=RRM_1; Domain location=112-176; Score =53.3; E_value=8.3e-13; Accession=PF00076.12; Description=RNA recognition motif. (a.k.a. RRM, R
MLRRLSSISWMAQTGTAGVECVKDASTALPEETACGSFGRTFLKKIACGGNCPHNAVSASATACRPEKVDAIVNCYEEDETKEQKARVLSRGGCIAWLGFVFGIPSWLELEVDYACTPEEVQQHFQSCGTVNRVTILTDKFGQPKGFAYVEFVEAEAVQEALLLNESELHGRQLKVLPKRTNVPGMKQYRPRRFNPYMAYGFRRPYTPPYFYSPYGYGKVPRFRRPNRYMPYH

SEQ ID NO: 189351 - protein, 316 aa, Glycine max
  Coding DNA Sequence Number=SeqID_72573
  Homolog annotation: Hit_ID=Q9FJP0; Match level="QueryCoverage=46%, HitCoverage=48%, E-value=3e-43, Identity=64%"; Hit description =Genomic DNA, chromosome 5, P1 clone:MQN23
  Subcellular localization annotation: CTP_CleavageSite=70; ConfidenceScore=5.80e-01
MLLTCYHHPFPHSFSSTSTHSLCTTNRNCNLSLSFSIVTSRPLHLTTQNLNLTAQRFNSLTVRADSFCLRSEHVAVAGVSNFDSLLSLLEFSCLLSSAVASAAAAVVAGSKNELLVGIGTRAAPFGGALLVVGVLVGAWIRRRQWRRACVETGKGGLEVNLLERIEKLEEDMRSSATVVRVLSRQLEKLGVRFRVTRKALKDPIAETAALAQKNSEAARALAVQSDILEKELGEIQQVLLAMQEQQRKQLDLILAIGKASKLWESKHETSERHDTLEMSNSAEDEYLKFAVDTGEKRLHDSQDKLMWGHLLNSVQL

SEQ ID NO: 189352 - protein, 57 aa, Glycine max
  Coding DNA Sequence Number=SeqID_72574
MTHISDIKRIRTDTTFDLSQKAEKVLRTVFVWSTSNHPSLTNTTDNGCHHPQLMKLG

SEQ ID NO: 189353 - protein, 255 aa, Glycine max
  Coding DNA Sequence Number=SeqID_72575
MESESKQVKQKLGVLDILKEAVTFYASNINFIIFTFLTSLPFFFVMVYFETLFQQTMVETPEIISLLPFKEQNYLYYHFAYHPHIYGVVDTPGKSFSEDYLPVLIQLGFIYLVPLHVLGLCSAVVTMDSASKLRSEENNISLKDINLLCSTCKAIDVVDGIYAIGALRVSYYLSTGNQKRGLLLMLVFFALGLCLRLSCVSLECYKGGYGIFVQIGLLTVLNTLKWVSCMIYFSDCKERKMEKKVDEESGKDLAK

SEQ ID NO: 189354 - protein, 340 aa, Glycine max
  Coding DNA Sequence Number=SeqID_72576
  Gene Ontology: Mol. function=hydrolase activity; Cellular component =membrane; Biological process=metabolic process
  Homolog annotation: Hit_ID=Q680K2; Match level="QueryCoverage=71%, HitCoverage=76%, E-value=1e-114, Identity=81%"; Hit description=MRNA, complete cds, clone: RAFL22-48-I16
  Pfam annotation: Domain name=Hydrolase; Domain location=56-274; Score= 81.2; E_value=3.2e-21; Accession=PF00702.16; Description=haloacid dehalogenase-like hydrolase
  Subcellular localization annotation: CTP_CleavageSite=45; ConfidenceScore=5.64e-01
MASSTLAPTLSLSTKSHCYLPNTKHRFSCPRIKLFYSKHRSFSVSASASASTSNSLQALIFDCDGVILESEHLHRQAYNDAFVHFNVRCPSSSSPGPLNWDVQFYDELQNLIGGGKPKMRWYFKEHGWPKSTLFETPPTNDEDRAKLIDTLQDWKTERYKEIIKSGTVKPRPGVLRLMDEARDAGKKLAVCSAATKSSVILCLENLIGIERFQGLDCFLAGDDVKEKKPSPSIYVTASKKLGISEKDCLVVEDSVIGLQAATQAGMSCVVTYTPSTAEQDFKEAIAIYPDLSNVRYKALLTTEAALQWFLSGKWIEIFDVYHKIFPLTIHYVQCKKIAIF

SEQ ID NO: 189355 - protein, 179 aa, Glycine max
  Coding DNA Sequence Number=SeqID_72577
  Gene Ontology: Mol. function=two-component response regulator activity; Cellular component=nucleus; Biological process=two -component signal transduction system (phosphorelay)
  Homolog annotation: Hit_ID=Q1RU46; Match level="QueryCoverage=98%, HitCoverage=99%, E-value=6e-76, Identity=82%"; Hit description =Response regulator receiver
  Pfam annotation: Domain name=Response_reg; Domain location=9-141; Score=66.3; E_value=9.6e-17; Accession=PF00072.14; Description =Response regulator receiver domain
MAMTVEAQFHVLAVDDSIIDRMLIERLLKTSSFHVTTLDSATKALKFLGLVEDELRTFDTTVASEIHQDVDVNLIITDYCMPGLTGYDLLRKIKESKSLKNIPVVIMSSENVPSRINRCLEEGAEEFFLKPVQQADVNKLKPHLMKSRAKEEQDQPFNNKRKDMKEIHSPNKTRIKCSS

SEQ ID NO: 189356 - protein, 76 aa, Glycine max
  Coding DNA Sequence Number=SeqID_72578
MSSSTSRSPSPVMTAEQLASLFVTGGEKQLKITCKQGRVNEAIQDNNRIAHSHFVCDLATSHAVLTTTNEANEMFV

SEQ ID NO: 189357 - protein, 484 aa, Glycine max
  Coding DNA Sequence Number=SeqID_72579
  Gene Ontology: Mol. function=transporter activity; Cellular component= integral to membrane; Biological process=oligopeptide transport
  Homolog annotation: Hit_ID=Q9M1I2; Match level="QueryCoverage=91%, HitCoverage=76%, E-value=1e-129, Identity=51%"; Hit description =Oligopeptide transporter-like protein
  Pfam annotation: Domain name=DUF975; Domain location=255-467; Score= -103.8; E_value=0.067; Accession=PF06161.2; Description=Protein of unknown function (DUF975)
  Pfam annotation: Domain name=PTR2; Domain location=1-396; Score =343.3; E_value=4e-100; Accession=PF00854.12; Description=POT family
  Pfam module annotation: Pfam domain module=DUF975::PTR2; Domain location=255-467::1-396
MVFLTLSVTAFKHKLLFFLALYVLAIGDGGHKPCVQTFAADQFDEDTPEEKDAKSSFFNWWYLGIVAGSTASVFVVIYLQDNVGWGVGLGVLAGVLALALALFLLGIKRYRKEGPAGSPFTRLAQVFVAAWRKWRVQATHGHYNFFHDEDEEHHEPHHHLHVQPKIHTLLHTHQYSGGNDVGVVVGRAKFLDKAAIIDEIDAESKTRDPWRLCSLTQVEEVKLVLRLIPIWLSCLMFTVVQSQVHTFFIKQGATMERSIGPHFQVPPASLQGLVGVTILFAVPFYDRVFVPLARKITGKPTGITVLQRIGVGLFLSILNMVVSALVEDKRVGVAKEFGLIDDPKAVLPISIWWLLPQYMITGISDAFTIVGLQELFYDQMPESLRSLGAAAYISIVGVGSFVGNIVIIVVEAVTSRAGDGEKWLGNNLNRAHLDYFYWVLAGLSAVNLCVYVWLAIAYVYKKVDEGHRTSSDQQGSGHKKYKPG

SEQ ID NO: 189358 - protein, 89 aa, Glycine max
  Coding DNA Sequence Number=SeqID_72580
MVEVHMDDDAIEFVHRQKQKEGSLVEIADLLEALGRLLDISILFSKTKTVVKILIILHGEVLMIFRKGYQKLSLLMMQGSRVQLSLGRK

SEQ ID NO: 189359 - protein, 77 aa, Glycine max
  Coding DNA Sequence Number=SeqID_72581
MWQWVVFGNVDGTIRHGKKIRIYGYPSESVSTLTSNIRVDRVWIRVRVFPDNQKSGMSTSMRLLHPPRPRNWIRPAT

SEQ ID NO: 189360 - protein, 145 aa, Glycine max
  Coding DNA Sequence Number=SeqID_72582
MILRCDNILEKNIRSGTTDAVNLKETNIPAAIDSISVAEGLPSPGFHDKCNNEKSSDVNLNEQIGRIREALPNEDLKIAEQPVLELNTSISDTSMEDKRETDALELDEMKMEYDSTAAKHLLPDVIMKDKRLSEVSTASGAPLID

SEQ ID NO: 189361 - protein, 613 aa, Glycine max
  Coding DNA Sequence Number=SeqID_72583
  Gene Ontology: Mol. function=transferase activity; Cellular component= mitochondrion; Biological process=metabolic process
  Homolog annotation: Hit_ID=Q8S5U6; Match level="QueryCoverage=72%, HitCoverage=78%, E-value=5e-55, Identity=28%"; Hit description =Putative indole-3-acetate beta-glucosyltransferase
  Pfam annotation: Domain name=PPR; Domain location=151-185; Score =35.1; E_value=2.5e-07; Accession=PF01535.11; Description=PPR repeat
  Pfam annotation: Domain name=PPR; Domain location=186-220; Score =32.4; E_value=1.6e-06; Accession=PF01535.11; Description=PPR repeat
  Pfam annotation: Domain name=PPR; Domain location=221-255; Score =19.5; E_value=0.012; Accession=PF01535.11; Description=PPR repeat
  Pfam annotation: Domain name=PPR; Domain location=259-293; Score =17.1; E_value=0.062; Accession=PF01535.11; Description=PPR repeat
  Pfam annotation: Domain name=PPR; Domain location=294-328; Score =34.4; E_value=4.1e-07; Accession=PF01535.11; Description=PPR repeat
  Pfam annotation: Domain name=PPR; Domain location=329-363; Score =33.8; E_value=6.2e-07; Accession=PF01535.11; Description=PPR repeat
  Pfam annotation: Domain name=PPR; Domain location=364-398; Score =15.9; E_value=0.098; Accession=PF01535.11; Description=PPR repeat
  Pfam annotation: Domain name=PPR; Domain location=399-433; Score =25.2; E_value=0.00022; Accession=PF01535.11; Description=PPR repeat
  Pfam annotation: Domain name=PPR; Domain location=434-468; Score =30.6; E_value=5.5e-06; Accession=PF01535.11; Description=PPR repeat
  Pfam annotation: Domain name=PPR; Domain location=469-503; Score =38.7; E_value=2e-08; Accession=PF01535.11; Description=PPR repeat
  Pfam annotation: Domain name=PPR; Domain location=504-537; Score =21.5; E_value=0.0031; Accession=PF01535.11; Description=PPR repeat
  Pfam module annotation: Pfam domain module=PPR::PPR::PPR::PPR::PPR::PP R::PPR::PPR::PPR::PPR::PPR; Domain location=151-185::186-220::221 -255::259-293::294-328::329-363::364-398::399-433::434-468::469 -503::504-537
MEIQLKDIHVSSANSNSAASLSISQYSSLVNNTDLKCLKVQSEIFREVDDSATEKKCELNAGDCLSNDGGNGRHAVFNALDTMLKDSLERLKMMRENLCLVKTGLTIGYACESKYAEDTATIRRLCLDGKLGAAVWLWGKMAQKGVVSDVFTHNHIVNGLCKIGLLDKADLVVREMLEFGPRPNCATYNTLIKGYCAVNGVDRALYLFSTMTYAGILPNRVTCRILVHALCEKGLLMEAKRMLEEVLKDDDEKDIPDLVISTVFMDSYFKDGAIIQALNLWNQMLQNCTKVDVVAYNVLINGFCKSQQMNLAYGYACEMFKKGLLPDAFTYNIIIGALCKEGKISEACYTVGVMSNMGIMPDQITYQIVIRGLCFAGEIVRAKHLLWCMLNNLMVPKPLIWNLIIDLYGRYNDLSNAFFTRDQMLSFGVCPNVFTYNALILAQVKSGNFHGACSLKEEMISKCLFPDVVTYNLLIGAACNIGRLDFALLLHDQMVQRGYEPDLITYTELVRGFCIRGKMKEAEELYAKILKSEDADRVQEAVQVDSVLKKILDKIRADPNSQPGYTRAGLVVSQWEIGIKKPHETKPIGVRENEEKGGNNKGGKGREKITEWA

SEQ ID NO: 189362 - protein, 136 aa, Glycine max
  Coding DNA Sequence Number=SeqID_72584
  Gene Ontology: Mol. function=asparaginase activity; Cellular component=cellular_component; Biological process=amino acid metabolic process
  Homolog annotation: Hit_ID=Q66AP3; Match level="QueryCoverage=96%, HitCoverage=39%, E-value=1e-63, Identity=88%"; Hit description=L -asparaginase I
  Pfam annotation: Domain name=Asparaginase; Domain location=1-136; Score=-18.3; E_value=3.5e-11; Accession=PF00710.10; Description =Asparaginase
MPDFTIHEYHPLIDSSDMTPQDWQSIADDIQLNYDRYDGFVILHGTDTMAFTASALSFMLENLAKPVIVTGSQIPLAELRSDGQQNLLNSLYVAANYPINEVALFFNNTLFRGNRTTKAHADGFNAFASPNLFSAA

SEQ ID NO: 189363 - protein, 51 aa, Glycine max
  Coding DNA Sequence Number=SeqID_72585
MASKKRKAPSTPTQARYDRSSCINIAIMKEFYANLYDPEDKSPKQVCTPEA

SEQ ID NO: 189364 - protein, 123 aa, Glycine max
  Coding DNA Sequence Number=SeqID_72586
MKKILGLQAPMELTSKEASWNGFKRLSFSDQGLCEAEVTIKEEIETICKRFEELNVCGKVTFESKLREIAYPDQNSMCPPLSKVNTKGALKKPMNRSQRSQSAIRLIGSMLMLFILFRTATLQ

SEQ ID NO: 189365 - protein, 293 aa, Glycine max
  Coding DNA Sequence Number=SeqID_72587
  Gene Ontology: Mol. function=signal transducer activity; Cellular component=membrane; Biological process=signal transduction
  Homolog annotation: Hit_ID=Q4J3W5; Match level="QueryCoverage=100%, HitCoverage=55%, E-value=2e-76, Identity=48%"; Hit description=GGDEF
GDGQSGDRGGDRGPGRRQAGDQFARRGHAGRLRAGACQRLGRGGAAAHRGDAGADPRPAVGAAGIRRAAGGGVPAGHLVVRPADIPAAVATGHQCRASRRGRGDAAREIRQGLVFRGRTPQARGDLELHQPAGEDRQAEPGQHHRSTDRPAQPARHAGRGGPPAGGRHALCRGGAGHRSLQARQRHVWPHGGRQGDPGRGATDARLLASQRHPLSQRRRGIPHSAAGRGADRGGDRGRAAAPTHRRTRNRPGRRHHGVSRGGPMADQWTGGAAGFPRRRCRAVCRQTAGPQPG

SEQ ID NO: 189366 - protein, 177 aa, Glycine max
  Coding DNA Sequence Number=SeqID_72588
  Subcellular localization annotation: CTP_CleavageSite=90; ConfidenceScore=5.54e-01
MHQPVFSSDSDTHLPSKIQSKSIHGGVSSGYNTYTVLANNKSNNSNLAMKSNTSNFIFSSQLHAPPEKLPATASTSPTAYILSFDDSTVVAATRQNYGEKQPYHQEVVLGSGGACLPSKGVSEGHDFEPKAKPTTKRSRSSAETLVHIMTERKRRRELTERFIALSATIPGLKKVSS

SEQ ID NO: 189367 - protein, 285 aa, Glycine max
  Coding DNA Sequence Number=SeqID_72589
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=6e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHVLAIRGLQALTFRGLHVLALRGLHVLAFSGLHALAFRGLHVLAIRGLRVHAFRGLHILTFRGLHTFAFVGLHTFAFVGLHTLTFRGLHNLTLRGLHALAFKGLHTLTFRGLPILTFRGLHVLAVRGLHVLAVRGLHVLAIRGLLILAIRGLHALAFRGLHVLTFRGLHVLAIRRLHALTFRGLHALTFRGLHVLTFRGLHVLTFRRLHVLAFRGPHTLAFRGPYVLTFRGLHVLAFRGLHALAFKGLHVLAFRGLHALSFRGLKERSTNRLNSF

SEQ ID NO: 189368 - protein, 305 aa, Glycine max
  Coding DNA Sequence Number=SeqID_72590
  Pfam annotation: Domain name=Transposase_23; Domain location=175-245; Score=-11.3; E_value=0.02; Accession=PF03017.5; Description=TNP1ENSPM transposase
TKKKLEEAAQSGSVDDIIDPPSPIRRHVKWKMARTKKTGEMTTEAAKEIADKIDSFEEQASQGSFVPHGRQDVLTAAIGCPEHPGRVCAAGAGVTIRQYFRSAPWTSRSSSLLPPEELQQLTQQIRDQLEESITEKSQMQSQELALPLKPLVGPSGPRVSTKESCVDSSINDHETGGSDRCGLYIEANPAHLVALRRLYEGSTIVHNTPLLPSQVKMGVEEVKDPDAPVPVPTDEVSLVGQSIHTFLAWPTHLVKPLSQQATVSLAKPPQKPNPEIDDLLYLMALTISELFLRPYQVTWDATVFG

SEQ ID NO: 189369 - protein, 266 aa, Glycine max
  Coding DNA Sequence Number=SeqID_72591
NVKIYHTEFDEFKAKLKRRNLHKRLANLQEGSIDVAVDKELYANLYSPENQSPKQVRVRGHLIRIGANSLNSFLETPVVLEKGETLPTYSSNLTPTSHTSDLNMDRARLVYGLVTRMDMNIGGKISGQITIMAQSNSSLLGFRTLITALCRSRGVGSDALTSYKSLRPVINLAYIKRKCWDVNDQAVNFPRARKTRSRAAGVASSSAPAVDIPSYSTPAPPPTSTTPSAQSSQTSDAKLQSLFEGQILIMQSLQELAHQRPIMSVE

SEQ ID NO: 189370 - protein, 95 aa, Glycine max
  Coding DNA Sequence Number=SeqID_72592
MEIKGREENGEGIRHRVKVEEEGAERERMGIREEKKNELGIPTPCLCCGLPIAPAMACLLYDVAPCRACRPWIFFINGVIRFLKINGSRMEKVER

SEQ ID NO: 189371 - protein, 112 aa, Glycine max
  Coding DNA Sequence Number=SeqID_72593
MVIVVPGKFLEDSSEATNSMATCLGRAYASRASLGGVWIWWGGASGPDMELRSMSSDHGRHCAKTWRRDEEMHDMKGRGTPVSDQRLELRDSVTGGAEFGGVAMVAHWRVNH

SEQ ID NO: 189372 - protein, 212 aa, Glycine max
  Coding DNA Sequence Number=SeqID_72594
  Gene Ontology: Mol. function=transcription regulator activity; Cellular component=nucleus; Biological process=regulation of transcription
  Homolog annotation: Hit_ID=Q7XHI6; Match level="QueryCoverage=96%, HitCoverage=78%, E-value=2e-33, Identity=40%"; Hit description =Putative bHLH131 transcription factor
  Pfam annotation: Domain name=HLH; Domain location=52-101; Score=34.3; E_value=4.4e-07; Accession=PF00010.16; Description=Helix-loop-helix DNA-binding domain
MVMLRQGMQHVRNYYNSEAQMMRSSFSQPFISRTYKTSFLKPKSKAEIKVLAAKKHSEAEKRRRMRINGQYETLRNILPNIIKKDKASVLAETIKQVKELKKKVSKLEQDSSTNPSKDVVKFPSGAEKLRLERCNIEEGLVKATLSCEDRPELMQLISKAVGSANTKLVKAEIVSVGGRTRSVLWVQGLGNDGMGMLKSHLRTALHKPRSFQ

SEQ ID NO: 189373 - protein, 83 aa, Glycine max
  Coding DNA Sequence Number=SeqID_72595
  Subcellular localization annotation: CTP_CleavageSite=55; ConfidenceScore=5.64e-01
MGVQIAIFKFLNLGPSRTFWKLGCLRRKQPSSPGRVGRQPPPPFPINRRMGVVPMSASLGYVFHPFWVKNMFFMKKIQAEVLP

SEQ ID NO: 189374 - protein, 179 aa, Glycine max
  Coding DNA Sequence Number=SeqID_72596
NDARREGRANGKSQRTRQTTKRSLCHIFAIGQSELNRNSKTTTRFQSPHRGIIINSFISDAHTHGQQDYDAVDPVFGAGPGCGIRNVEAKREEEGMMMMMRMVADADVTETEVAETAEVTVASEVEYSSPVPVDGSRWFQCAGPWDFVWGVESNSHLSACLVARYSAIDLHEAIVSNLT

SEQ ID NO: 189375 - protein, 589 aa, Glycine max
  Coding DNA Sequence Number=SeqID_72597
  Gene Ontology: Mol. function=ubiquitin thiolesterase activity; Cellular component=nucleus; Biological process=ubiquitin-dependent protein catabolic process
  Homolog annotation: Hit_ID=Q9FKP5; Match level="QueryCoverage=83%, HitCoverage=48%, E-value=6e-51, Identity=50%"; Hit description =Similarity to ubiquitin carboxyl-terminal hydrolase
  Pfam annotation: Domain name=UCH; Domain location=3-367; Score=74.4; E_value=3.5e-19; Accession=PF00443.19; Description=Ubiquitin carboxyl-terminal hydrolase
MFSLGQKKGWCFTCEFEYLIQKAKEGISPLSPIGILSKIHKIGSHLGRGREEDAHEFLRCVVDTMQSICLKEVGVSSPLAEETTLVSYTFGGYLRSKVLSQSNSLFFVKVHIFNFYRVIKCLRCLGKSERYERMMDLTVEIDGDIGTLEEALGQFTAPEILDKDNKYNCSRFESRYSEKTGAERSQMPEKRKQAEKVLPFRNITKREQKLRVSTLYSQRATQDGGGCGAVTVGTSREKFEGCRLQMKCKTYVKARKKLTVLEAPNILTIVLKRFQSGNFEKLNKSVQFPEVLNMAPYMSGTKDKSPLYSLYAVVVHLDLDIMNAAFSGHYVCYVKNIQGEWFRTDDSRVEPVELSRVLSERAYMLLYARHSPKPLGLVSSNVISSAGKFKRRNLEAIPATSKTRSNSMATSGYSPSPQQKHGKYPNWNDADDSLSNDFAYPEEWRFQYGVRNTMVDSSSESSLFSSSDASSCSTASIKDSASSADFSDYIFGEVGPNWYSHYGLSSNMGASSSYDNLDTDFLVDSNGGASRRLQQDSEDKAVLYANKSKNHSGSRGIDLKRYITANHYDKKSGVHVRRTSGDASAQTFY

SEQ ID NO: 189376 - protein, 60 aa, Glycine max
  Coding DNA Sequence Number=SeqID_72598
MELVASDESSRNFPGTTITIEEKQNWEYVWILILWILFVSRLLVLRWVTLVLSFMGCGWT

SEQ ID NO: 189377 - protein, 220 aa, Glycine max
  Coding DNA Sequence Number=SeqID_72599
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=96%, HitCoverage=18%, E-value=3e-71, Identity=58%"; Hit description =Similarity to kinesin heavy chain
  Pfam annotation: Domain name=Kinesin; Domain location=39-218; Score= -115.7; E_value=5.2e-07; Accession=PF00225.13; Description=Kinesin motor domain
MPDQVALETEARMSSVIKEKKKLFNDLLTSKGNIRVFCRTRPLFEDEGSSVVEFPDDYTIRVNTGDESLSNSKKEFEFDRVYGPHVGQAELFSDVQPMEGSSYDRGLYARCFEELFDLSNSDTTATSQYTFCITVFELYNEQIRDLLLESGKSLPKLCFGSPEYFIELMQEKVDNPLDFSRVLKAAFQGRGNNPLKINISIDIILSAMELVMSMHRSAFV

SEQ ID NO: 189378 - protein, 95 aa, Glycine max
  Coding DNA Sequence Number=SeqID_72600
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=95%, HitCoverage=8%, E-value=6e-27, Identity=73%"; Hit description =Similarity to kinesin heavy chain
MWDRKHRWEFKNSDDCKSRNSVLSLGNRDTIKKWRDAANDARKELYEKEKEIQYLKQDDLRLKQALKVANDQCVLLFNEVQKAWKVSSALQTDLK

SEQ ID NO: 189379 - protein, 733 aa, Glycine max
  Coding DNA Sequence Number=SeqID_72601
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=98%, HitCoverage=54%, E-value=0.0, Identity=69%"; Hit description =Similarity to kinesin heavy chain
MACHHGLLDNAKIGSLEIQLNKALGSINTGSNVGPETVSAALSNSRTTGEGMDSSAVTKKLEEELKRRDALIERLHVENEKLFDKLTEKASLAGSPQQSSPLSRGSVNVQPQNIGSLWILALFSLYSNRNDTSTTARARSVDVLPSSLMIDKNDGTVALVKSGSEKVKTTPAGEYLTAALNDFNPDQYEGLAAISDGADKLLMLVLAAVIKAGASREHEILAEIRDAVFSFIRKMEPRRVMDTMLVSRVRILYIRSLLARSPELQSIKVLPVECFLEKANTGPSRSSSRASSPGRSSMQYVDEQIQGFKVNLKPEKKSKFSSVVLKIRGIDEETWRQQVTGGKLREISEEAKNFAIGNKALAALFVHTPAGELQRQIRFWLAEKFDFLSVMGNDAPGGTTGQLELISTAIMDGWMAGLGSALPPQTDALGQLLFEYSKRVYTSQVQHLKDISGTLATEEAEDAAQVAKLRSALESVDHKRRKILQQMRSDVALLTLENGGLPIQNPSTAAEDARLASLISLDRILKQVKDISRLSTVNTIEKSKKRTVLGSLDKLTEQMSSLLEIDHPCARRYIADARRMVESIPEEDDRIQNLSHSRKPSTDTDSGSGTDVAQWNVLQFNTGNTSPFIIKCGANSNSELIIKAEARVKEPKGGEIVRVAPRPSILENMSLEEMKQVFAELPEALSLLALARTADGTRARYSRLYRTLAMKVTSLKDMVSELEKGGALKDVRT

SEQ ID NO: 189380 - protein, 135 aa, Glycine max
  Coding DNA Sequence Number=SeqID_72602
MTSTPVHTSQEKKMIWSIFPTLVATTNQQDCHLNKPVLKLKATSIQEPEAIWRKRRVAVIRSAIVIAGWSSEILRATNGVLAVTGEKWFDGEETENGEKWFDGEETENEDGKTDELDLNQGKQANRKLPFQPNTF

SEQ ID NO: 189381 - protein, 108 aa, Glycine max
  Coding DNA Sequence Number=SeqID_72603
MSTLLLNGGAMVDFFAKRHRPQWLGDVLSSLTSKKDVIPYENSMLTKLFADSLVPSAIFDYNNTNLVPTGHINLKKEEACKCIPVELKSTCSEELRVSAGAPRMTEHL

SEQ ID NO: 189382 - protein, 75 aa, Glycine max
  Coding DNA Sequence Number=SeqID_72604
  Homolog annotation: Hit_ID=Q9FKP4; Match level="QueryCoverage=80%, HitCoverage=5%, E-value=7e-07, Identity=46%"; Hit description =Similarity to kinesin heavy chain
MAEQGNRWSWDVAGFEPWKSPSPEQNDQKPTAPLARRNSTTSSVPPHSVASKVEGLREKVKRISVTVSGEDLTVN

SEQ ID NO: 189383 - protein, 89 aa, Glycine max
  Coding DNA Sequence Number=SeqID_72605
MSEKRYCLLDYWSCYCHYNNVRFESGNHEIVSLCQDVVDKDWINIPKFIRIRISEVNNGLGCFYRVKGVRGAILDLTPGLLLPSTHNSF

SEQ ID NO: 189384 - protein, 171 aa, Glycine max
  Coding DNA Sequence Number=SeqID_72606
MAKFDPDIVLEFYANAWPTEEGVRDMRSWVRGQWIPFDVDALSQFLGDPLVLEEGQECEFSQRRNRADEFDEEAIAVMYTGSGFFPDCCREAGADHAHQHDYPNPDMDDVATQQCMPPTRHPLDPDKSNRALGFPALITGLYQSFGVPVTPSKVIRPPITRALIEKYCTPR

SEQ ID NO: 189385 - protein, 199 aa, Glycine max
  Coding DNA Sequence Number=SeqID_72607
  Homolog annotation: Hit_ID=Q47522; Match level="QueryCoverage=26%, HitCoverage=64%, E-value=7e-24, Identity=100%"; Hit description=LacZ protein
MDQHVVARAGHDRTEELLGRHVVEGDVEALFQGRTRLRQLARERACRRQQGIRHGVLAAGRLAVDGAGVGDLAPDRIVGLVRRRALSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 189386 - protein, 74 aa, Glycine max
  Coding DNA Sequence Number=SeqID_72608
  Homolog annotation: Hit_ID=Q3SKQ8; Match level="QueryCoverage=70%, HitCoverage=9%, E-value=7e-09, Identity=50%"; Hit description =General secretion pathway protein D precursor
  Subcellular localization annotation: CTP_CleavageSite=47; ConfidenceScore=5.34e-01
MYGYDYRIDGTKITIRPLTMQTRMFHVNYLVGSRRGSSNLRVTSTSVANAGSSLSIPSTSRGGPVPAFVPFSEG

SEQ ID NO: 189387 - protein, 72 aa, Glycine max
  Coding DNA Sequence Number=SeqID_72609
  Homolog annotation: Hit_ID=Q676Y4; Match level="QueryCoverage=52%, HitCoverage=15%, E-value=4e-07, Identity=68%"; Hit description =Protein tyrosine phosphatase
MITRLSTRSPVEDILSYRRDIVGCSARETPQDSPSQQQPRTYLWQGCCYWRPHQPFAHRGKKKERKSINKQI
